United States Patent 9,328,346 (POLYCOMB-ASSOCIATED NON-CODING RNAS) - sequence listing, part 28

SEQ ID NO: 4737 - RNA, 11246 nt, Mus musculus
ccacucccgcggccauuuugccucucccacuguggguggggcgucgaggcguagcgugacguuccgugaggccccgcccgcugaacuggauggacaucccgucgcgccccgcgccuucccacaguacuccgcgaucgccgcuauggaggccggcaggacugcgguguugcgcgugaagcggaagcgcaacgcggagcccgccgaggcgcucgugcuggccuguaaacgcccccggagcagcgaggucgagucggcggcucgggagacgccagagggccaggaggcggcggcggcggagagaaaugucuuccaguugguugccaccgugcgaucccagguaugagaagggugaauggacucuuugugggagcgaucuuugaacgcugcccgugucgcagucaucucuuuucccgacgccccucaggaggagccaauccagcagcuugugcgggcugccuugcgcccgucccggagcagccagcugcguauccgccgcgaucuucgugccucggugcgcgagguccguaaagagggccgcuacaggguggucuccagccaccgauccucgggaaccucgaacaguuuggagccucagugugggucagaagcugucggggaugcgggcuuccaguuguuggaccugguccacgaggaggaaaacccagaggcugcugccaccgacugccgcaaagugaguacuguauaugucugcucugcucccaaaggcaguaaugaagagcauacacacuguaagcuuaagaauggaugauccaucucuaagaguugaccucauuuuaccugauuucuguuguuguuuuuguucuguugagauaguuuugcuguguagcucugguugacauaguacgggcuauggagcccaagcagaccucugacacacagcaguucugccuccgucgcuccagugcugggauuauaaguaagcaugugcaacccacgccccuuaggauugguuuucuuucuuucucuuuugcuugugucguaauacacaccuucccucccagcauuugggaggcaguaccauguggaucucugaguuccagcccaaaaaggacuacauagugagaccuugucuccaaaaaaaaaaaaaacaaaaagcaaaaaacaaaaacuuugugugugauugaucaggccuuuaauacucaagaggcauggaucaauagaucucuucuuucaaggccaggcagagcuacacagugagaacguguaucaaaauaaauaaacagaauugauguaggccuuuugaaaguggauuuggcuauuuaaaagauauacaguauuuagagaugauguuaaacugucauugcuacgaaaaaugagguaaauauggaaggaguuuuagcucacaauuuuggagguuuuggugcaguguauggucagacuacuaacaauuugccuccaaccucccugaagacggggcucuagcauuuauauauacccucugagaaguucccagaauuccaaaugucacagaaacuaucuacagcugacaaaaaccacuucugcuagggcaugaggcaaaucauagucagcugcuuuagacagcucaaagcagccccacauccccacaccugggauuaaaacaaaaaaaaaaauaaacuguuucuguguucuuuaaagaaaccaaaauuccagacuugucacuacaaagggaacuugcggcaaguguucuuccucugagcuagauuccuaaugugguauuuuccuuuucuuaaucuucacaaauacuaugaauuagauacuuuuaucgccauuuuguuuuuuuuuucagaaaguuuuuauuagcaagcauuggcuauucaaaguaauaguuuuuauuagauuuuguaugucuauacucacuccuguugaaccuuuaaaaaaaaaagccuuauuuauuuuauguauguaaguacacuguagcuguacagauggagcucacucuguagaccaggcuggccucaaagucagaaauccgccugccucugccuccugagugcugggauuaaaggcggcugucucuaccuuuucuaaugggaaaaccagagccuucaugugguuguugggaauugaauuuuaggacuucugaucacucaacccugcucacuccauucagcccacuugcuucggucagcccagcuccggcccaaagauuuauuuauuauuauacauaaguacacuguagcugucuucagaugggccagaagagggcaucagaucucauuacagguaauugugagccaccaugugguugcugggauuugaacuuaggaccuucaagaagagcagucagugcucuuacccacugagccauuucgcuugccccccuguugaaacuuucuuaaugaacccugauucuuuuucuuuuauugcuaugcucuuugaguguguguguucccauuaauuuacuugagguugcuuauagaaguaugggugaggaggcuuuagcuguguuaccuggcauuuauuucuaugccuguauuugguuuuuuuuuuuuguuguuguuaugccugauuuuuuuuuuuucuugagacuauguagaccaggcuggcguugaacucaacagagaucugccugcugccuaaaguacugagauuaaaagcuugcaccaggggggcuggugagauggcucagcagguaagagcacccgauuguucuuccaaagguccugaguucaaaucccagcaaccacaugguggcucacaaccauccguaaugagaucugacucccucuucuggugugucugaagacagcuacaguguacuuacauauaauaaauaaauaaaucuuaaaaaaaaaaaaaaaaaaaaaaagcuugcaccaggccgggcggugguggcgcacgccuuuaaucccagcacuugggaggcagaggcaggcagauuucugaguucgaggccagccuggucuacagagugaguuccaggacagccagggcuacacagagaaacccugucucgaaaaaaacaaacaaacaaaauaaaacccaaagaguaauagcucugaaccuuccuaaugcugugacccuuaaacacaguuccucuuauggugaugcucagccaugaauuauuuugcuacuucauaacuggaauuuugcuacuguuaugaauaauaauguaaauaucugauaugcaggauaaugauaugcaacaccccuccccccaaagggguuacaaccaaugggguugagaacagcuaguguagagauaaaacagcugugaaagaaagaaggcaagguaaagcugugggcucugcauuccauagguuacaggcaacuaagcuuuacauuauuguguggaaacagaucuaggauggcggguaccaagcaugaauuuuguuuuucuaggaaagauaauuugaaccuguagucaguggacuacagcaaaguucuucccuucccuuggucgauugacgugcagcccucagaugguguuaaguguuggugcuuuucagaguugucuacauuuuaacuggaaugacggugguaaaguuggguuaagggcuuguuuucuccaagguuaucaccauuuucaaaugcagagaugaaauauuguggauaccgcuaaugauuaguucaagaacuaggaaugcauggggcucuagacacggcucagcaguuuacuuaaagcaguuucaucaugaagauuucccagcacccacauaaggcaccuuaaaacugcuuguuacuccacuccaaauggaguuaucaacaccuuugauaacacugaagauuaacaauggaagguggucuauauaacugaaaauauuaaaaauuuuucugagggcuggcaggauuauucagcagguacagguaaagccugaauucaguucccaggacucccaugugcaccaugccaugcaaaucauguagaacuauuauucuaguuuccuuucccauuagaaaagguagagacagcugccuuuaaucccagcacucaggaggcagaggcaggcggauuucugacuucgaggccagccuggucuacagagugaguuccaggauagccagggcuacacagagaaacccugucucgaaaaaccaaaaaaaaaaaaaaagaaagaaaagaaaaguuagaaacucgaagcagagauuauggaaacugcuuccuuuguuguaguguuuugagauagggucucucuauguggcucuggcuguccuggaauucacuuauguagaccaggcuggccuuaaacucccaagagaucugacugccucugcuacuugagugcugggauuaaaggcccuacugaaaaaugccuccaagcuuauguuuagugacuuuugcagccuuagagcacuugcucaggaaaugguacagaccugucuacucaaucccuauugauucucuucacuggugacucuaggcuaugucaaguugacaguuacagcuaacuaggacacaaacaauuauaacuuguuuuucuacaaaguauagugacucaaugccuauaaucucagcacuaaggaaacugagguaagauguccaugaguuugaggcaagucuggccuacauacauaguccaagcuaguaacaaaaguuauaagaacaaugucuguucgugaaaaaacccaguaagggcuggugagauggcucaguggguuagagcacccgacugcucuuccgaagauccagaguucaaaucccagcaaccacaugguggcucacaaccauccguaacaagaucugacccccucuucugagugucuggggacagcuacaguguacuuacauauaauaaauaaauaaauaaauaaaucuuuaaaaaaaaaagaaaaaagaaaaaacccaguaaaaguagacuaggaguuuaaggaucagugauaaagcuuuuuguguaguuugcguaagcccucaguucaaaucuuagaacuggagacagagagagaaaaaaaaaaucacuccauuuaccuacaauccaaaaguagacugaagcugguuaauuuacuaugaauauaaaauugauuggaacuuuguuaguauuaaaaacuuaauggcuauuuuauuuacuagacuagagaguuugcuuacagauuaaaagcaccaaguucuuuuugcagacgaccugaguucaauucccagcacucacuuagcagcucacaaccacauacaacucaggucccagggaaccuagcacuuucuucugaccuccaagggcaacaaauacacaugauguguauccauacauauaggcaaaacacuccuauacauuaagcaaaaggaaaugccccuugauuuguaugugacaguaucgaucucgcucugugugccuuagucauggaacauuccuacuuugugugguuguugguugcagcuauguagcuuucugugaugaaccugagagcggccaucuguagcauuucucugcagugccauacucaccugugcuaccagagugccuacagaagcuggagaacaucuaaccugcaccaguucuuuucuggaaccuuuguuuucaagcucuucuuucuagcagagagauuauagaugagucuuuuuauuauuauuauuauuauuauuauguggaauauuggucagucauguugagccagaugacacauucuaacagguuuuaccaggaaaccuauaugggcauacggaucccauaggaagaacaucacaguaaagagaagaccuguagaagcagguagaaggaaacgagugugugaggauaagaaucuugaauacugucugcaauccuaguauuuagguagaagcagaggaaaaucugggaguucaaaaccugccuggucagccgggggugguggcgcacgccuuuaaucccagcacucggguggcagaggcaggcagauuucugacuucgaggccagccuggucuacagagugaguuccaggacagccaggacuauacagagaaacccugucuuuaaaaaaaagaaaaagaaaaaaccugccuggucaauacaacaaguuccuggccagccaggacuacauagaguaaaacugucucagaacaaaaaaauaaacugucuugaauagggcauaaaaaaaauuacaggcuggcgagauggcucagugguuaauaguacugacugcucuuccgaagaucauaagugcaaaucccagcaaccacgugguggcucacaaccauccguaaugaggucugacacucccucuucuggugugucuggugacagcuacaguguacuuacauauaauaauaaauaaaucuuuaaaaaaaacaaaaaacagggcuagugagauggcucagcugguugguaggagcauugacugcucuucugaagguccugaguucaaaucccagcaaccacaugguggcucacagccacccauaaugagauuugaugcccucuucuggcgcgucugaagauagcuauaguguacuuauauauaauaauaaauuaaaaaaaaaaagaauuccauaaggugaugggaauuuaaagacaaaaacaggccuucauuuacccaauccuuagaauccuuauaaagaguccucauuugaguuuuaaucucuuaucaucugguuucuuuguagacaucugauccagaugugauccucugcaauucuguagaguugauccgugagaggcugacuguauccgaggauggaucccaaguaaaccaccaggaggacccaaagcacaaugacgacuauguauaugacauuuacuauauggagauggccccuccaggguggauugagaacaucauguccgugcagcccuacagccaggaaugggagcugguaaggagguccaagaggagaagggugaauaggguacuucugacuuccuggacuccacuccuuuuguuuuuaaauuuuaaaaucaauuuuauuuaguguguaugcauggugcauguguggaagccaggacaauuuguuuguaccacguggacuccugggauacaauuuaggucaucagguuugguggcaagcaccuucauccacuaaaucaucuuacuaugccuuuuuuuuuuuuuuuccuuuggcaggggugggggaaguggggagggagaggcagggaaugggaucucauacaguccauuuagugucuuccuugauguagggucucucacugaaacuagagcuugccaaucccaacuaaucuaacgacagcuuaccccagggauuccugucucuaccucccauuugcugggaucucaggcaggcuacccaguccacccagcuuuuacauggguucuggauauccaaaaaguggugcuuaagcuuguucagccccuuucuaaauuuuuuuaaagauuuguucauuuauauuuauguauaugaguacacuguagcuguacagaugguugugagccuucaugugguugcugggaguucaacuccgggccucugcucauuccggcccuaaauugauugauguagcaggacgaggaugaggacgaggaugcugucaccaucuuuagacauaccagaagagggcgucagaucucauuucaggugguuauaaaccaccaugugguugcuggaauuugaacucaggaccuucggaaaagcagucagugcucuuaccugcugagccaucucuccagacucccuuuuuauuuuuaugaaaggauuucacaauguaguccaggcaggccuuguacuuagcauguugcccaagcuuuuaauuuguggcaaucugaauugccucagcuuccccaguagugggauuacaagcaucccaccuggauguuuaucuucucuugauaaacauuguucuaguucuugguuuuccuuggaaggaaaauucuguuuuaaauucuuuguagaaacccugguuuaauacagcaauauguuggacuacuuacacugaaaguuuuguuuacaaccuugagacaauaaaaccagacaugaguaagagcaaaaagcuguauggauguuugccuacaugaauaucugcacgucauaugcaugcugguaccaaaagaggccagaagaguguuaguuacaucuucuggcaguguaguuuacagauuauaauuguaagacaauacauguuaggaauugaccucuuaaaacauuaggugcucuaaccacugagcaccuaaggacgaacacauucuaaauuuuaagaagagcuggcauacacuuuuaauucuagcacuuaagaagcagagguaggugggucucugugagaccauccugaucuacacauagcaagcucccugccaaccaggacuacauaguaagucccuaugggggggggggggaggcaucuugauuccauuuucuaaaaacguugagcuuccuuuuuccaguuuauguguauguaugugugagacuguaucugucugccugagugggugugcauguggcuaccuucagaguccacuauuacuagugcggauaggcaccaucuuagaccacuauguggugucuacuccuuuccucuaccacuuacccugaaguuuuugguccuaaccuuuagcauuacucaaguuguaaaaucccucucccaccuggccauccaugaaugcugcucuacagucauuccccucugcuggcacugggaugugguaucuguagcuagacuccugguuggaccugggccuaagauuaccuagucucuaguaaagcagucagacaaacucuuccuugucuaccuuuucacguggugccuuuaguugaaucuccccgagaugguauugccaauagcaucccauaaggagcaugacucaggucuggacuuaaacucauguuuauguugagauguucagguaaaugaugaugagcagucagaagauauuuaugaagaugaagaugaugaaaacagugaaaauaacuggcggaaugaguacccggaugaagaaagcagugauagagaugaagauuccagagguggguagcaacccagauggagugggauugauaggagucaagauugagguugaagguauaauuaauugaugugguaugcuugcauauggcuggcuuucccucucuuucuaggggaacugcuggggaaaguauuaacuggguugaggagaugguucaguggcaagagcacuggcuguucuuacaaaagauguggguucuauuucuagaacugacauggcaacacccccauccuuaauuccauucaauuugagggaaccugacucccucuucagaccucuauggguaccagguaugcacauacauacauucaggaaaaacacuaacacguuuaaaaaauaaaauugagaggcagagggagauagauggguaucucagcucaaggacagccuggucuaagaggagaguuccagaacacccagggauacacaaagaaacccuuucucaaaaaccaaacaaacaaaagguauuaauguaccacagcaagucuugcaacaugaguugcuauaauccucuguaaaaggaaaaccaauuccuauaaguugucaucuuaccauuauacauaacacacacacacaaauaaauuuaauuuuaaaaaaagauaaaguauuuacauggcucaaguaggacaucccugucaucccagcacucccauggcugaaguggcagagcagugagcucuagacagaucuugaaacaauacgggaaggagaggauuuuuaaaaaaaagaaaaaagguggggcucagcaguuaggaacacugacugcuuuuccagagguccugaguucaauuccuagcaaccacaugguggcucacaaccaucuguaaugggauccaaugcccuccucuggugugucugaagacagugacaguguauaguguacuuaccuaaaagaaauuuaaaaaaaaaaaaaaaaaaaaaagccucuaaccccugaucauuuggcugcuaagccugauaacccaaguuugauucuccuaauacccacauaacgggagaacugacucuaaguucuuuaucguaaauuuucuuuaugagcaaguauuuuauaauggaaaauacaaucuuuuaucucccugaaggcucugaugaauacaacagccucagcgaggaggaaagaagcugcgagcgacugauguggagcaaauacccuuuggauguacaaaaggaguuugacuaugacagcccccauggucuggauucagauugaugguuugcugguauuugugagauucuuccaugggccuuuaaggcucugacuacagagucaucaucuuaggauuccuaacugaacauguggaaagaaaagccuuuaccccagcacagugaggacuuccuuguaagugauaagugacgccaaacacgcugggucaugucuguaauuccagcauuggagaguuugggagccaagaagagcacugagaauacaaggccagccuuuagacuaaacagccugggcauucuauuuuuaaaaagugaucuuacacucuggaaaauaaaaugauguaaaaccuccaucccuggugguuuuucugucauuuuacuuauaugcucagggcuaaagaagcuggugggaggagggagagcccgcucccagugauggagaugaucucugcaaggacaacagugacucccccgccucagggcggucaugucuuucccccccccccccccccgcccccuuuagacucugauaaugguuauaaagacugcuaucaccuuuggcagugguaccaaggaacaguauguaugaaugugaugaucuuuaauaaaaacuuaacuuuuuacacagaagcaagcaguucuuuuuuagaucugauuauuuuagguguuuuccucauagaaaaaggagagguuggugaacuacauguuucaaaauuaacuuuaaacauuaugggccaugucaacuguuuauagcacucacccaaggcauuacauacaucacccuuguuauaugguucuagggcugccaaaaaccaccauguguccaagucccuuacauaagaugacacgguaugucuacaaagucuaugccucuucagauuauaaaaaucuaauguaaacacuaaauuauuauaccacaacucuuuggagaaugagaguaaaucuuuccauauuuagaauaggcacauugccccaaaauguagauuaguaaaugcagggcccguacauggaaggccaacugucaucaauaggacacugucaccagaacucagcaucucagcugccuuagcccuagauguaguauuguccaauaaaacuucccacagcauguucuguguauccacgguacaccuguguggcuucugagcacuugaaauaugauuagggcaacugagaaacuucaacgguuuuuguuuggggaggggaugauacagucucuguguagaugaggcugccucagaagggauccaccuaccuc

SEQ ID NO: 4738 - RNA, 460 nt, Mus musculus
cgcccugcagagguccugccuccuaguggggggcugcaguaagagcacaagaaggcgggcagguuagguucaaaguuuuucuuugguauguguguuuucuggagcugcuggaaagguucaaaguuuuugucguguguguguguguguguguguguguguguguguguguguguguguguguguuggagcuucuagaaauucucaccgcuccuucuuuucuuuucuccuucuccuccaccucccaucccguucccuuucccuccccccucccucuuucucccucuguguagcucaggauguccagaaacucacucuguagacucaauucucaauucucuuagcacacaaguggcuaaggaucgggaguucaagguuauccuaaacugugguucaagaccagccugggcuacaagagaccuggucuuacaagccaaaauaaauaaacaaugcaugcacgaau

SEQ ID NO: 4739 - RNA, 11274 nt, Mus musculus
cgcagucgcacucguggcucugcgcccgccgcuguggccauuguccgacccuguuguugcagagcaguacugccgggaacaagaaacugcagcgggcgcuagaggggcggaccugaggucgcggauuccgaagccccggaggcagauuccgagugcaguggguaggaggcuguccuccgggccucgccgaccauccugcggacggacugggcguggccggaggaacugucccgaagcuguggggccuuucauuuggccuugggaagagcagcaggagaaggcggggcuccuccccacguuucggccgaaguggcugcagagcugaagggguggggccucgggguagcccggugaguggauccuguccucucuccucagcccuggaccauagccagcacacacugaggcaggaauggccccgagaccuccgacggccaagccccaggugagccgagccuucccccaccgcccggagcaucccacccugagaggcccccggagucuguauggaacaguuauugguauagguauagagagucuuaguuuggaucgcuuugagucuccuccucuggagaaaaccccucccaaagugcccagcccugggcagagcaggauuucugaaaggauggaguuaaagaggagacuagggaagugcgaucuugugagaggaaguguucugggggugucagcacugagacuuuauugcagugugcacuucuuagaacucuucagugaggaauggaggauagagggacaaaauagaaaagcccccugcuucccauccaaaggccauaaagagauaguaggggggcagaagagaccuauuagaauaagaggccggugaagguugggcgcugagucggagaccaccauuacagccaaaccuggucagacaagcuccagcuuuucuugcccccccccccgccccacucguuuuauuuuccuuucuuucuuuccccauuaacaaauguauaauagugcgcacccuccauagccccggcuucagguuaauuaguaagagacagauuuaucaacccacuuuuuaguuguagcaaaaggggcauuuucuggacauaagcucugaggcuguccguuuuacuuugaugagaacauaaucugaacucucuuuggaguugaagguaagaacuaggacuauagcucagugguagaucacuugccuaguaugugugagguccuagguucaauucccagcaccuccuggaaaaugauaaggaugggcuggagagauggcgcuccaguuaagagcacacacuguaagcuuuuacacgcugcucuugcagaauuaguuucguuccuaguacucacggcaggaaguacacauccaccuuguaauacagguuaaaggggaccugauggcucuggcuucuuggauaccugcucucacaggaacaaaauuguuagaaacgggggaaaaaaaucucagcucaaggcauugaggaagaaaggaucgcacagaguugaaagaagccuagcagggcucugaacucuuguaaaaaugguccaacugaaccaaaacugagcuaaaaaccacaguuugccagggugacuuccgucuuuucucccucacagagguggugacugaaacucaucccguuaauugaagcuugauccuauaaucugacacgauuggcuaauuguugcaaaggggaaggcuuggggaauauaauaugggccuuuauaaggcuauuuucgugaggggaaaaaggguuugcacaauacccacagagagacccauaauauaacaaaauacuuuuaacaguaagcuacaaguuguaguugcuacagguaucauauaaucaaguucaaucuagauaaaaauacuaacaguaucuuuuaaggucaguuuauagaguccaaaaauguagcacagucaguugcuauguauaucauauaaucaaguucaaucuaguuaaaaauacuaacagugucuuuuaaggucaguuuauaggguccaaaaauguagggcagucaguagagucgcugccuagagugcagggaacccuggguuuacaucccuucaugaacugcacacagccuggggagaacuagagaagucacccuugggaaagaacauugaucgaggucuagaacaguggcuaggaguauuuucuguagagcugagggaaggccaugcacuguggugaggaugugcaaagcaaaaggaugcaaaagagagacaaguuaauaaggcaaggaguccaugugacaggaaccgaacugccgccuucugccuuuuguggaucagcaaguugcugccugguuguguuguuugcaaagacccacacaggugaugaugauggugaugguggugaugaugaugaugaugauguucuagauuauuuuagaccucuaccuccugcuauucuuuccaggcaacugaaucaccuucucuuuaaacuuugcuuccuauccuaugcccugugcuucugucuaaugggaaaaaaaaaaucaaauuguagagcuagagauggccucagcugauacaaugcuuaccuagcaugagccaagcccuggcuucccucccagugccacagacaccagauguuguggugcgcgccuguaauccugcuguugggaaguagaaccagaaagaucggagguucaaccucgaccacauagugugcuggagaucagccugggauacacgagaaccugucuuaauaauuauaaauggggcuagagagauggcucagcaguuaagagcacugacugcucuucugaaggaccuaaguucaaaucccagcuaccaugugguggcucacaaccauccguaauaaaaucugaugcccucuucuggggugucugaagacacuacaguguauuuacauauaagaaagaaaggaaggaaggaaggaaagggaaagggaaaagagggaaaaagggaaaagggaaaggaaaaggaaagagaaaagguugagaguacugacugcucuugcagaagacccagguccauuuuccaaaacccacagaguggcucacaacugccuguaacacagcuccaggggaucugauguguucuccugacccucauggguucccgcaugaacacaacgcacacacauacccucagauacacacacauaaaugaaugagcagauauuuuuaaacauuagugaauacauaaaaagcaauuuguagaucaauguguguaaugguucauaaagcaugcguguagaacguguguaaaacauggacagggagcuccuagguauguacaccaacgguugggaaugauuauugggagaauauauggggauaggaaggcuuggugauggugguguucgccuuuagucucagcacucgggaggcagagguagcuggaguucugugaguuuggagccagccugguucaagagcgaguucuaggauggcuaaggcuguaacggugaaagagaacgggagcugugaucugugcaggacaguguaggccuguggucccagcccacaaaggcaaagcacuagggauccacagucaccuucaaccaccuauugaauccgaggccagcccaggcuacauucgacagaaucguacacgcagggcugugggauagacuuccccuuugacuuuuccgucaggcaaacucggugcuugaaauuagcauacaaaaccaaaccuugccccuuggagcggcuaacacaugguccccaagucuguuguucccagcacuucaagaggagcguuugugcuguugauuccgacuugagcagggcugugaucccacaggagucggugacauucaaagauguggcugugaacuucacccaggaagaauggcaccacgugggcccugcccagaggagcuuauacagggaugucaugcuggagaacuacaaccaccuggugucgcucgguaaggagggccaccccugcucagugucucacauaguccugaauuuuccuuccucgguggcacacagccuagauagaaagauggaagcccaaagcuugguuggggccuguuuuggggagccagcuuuccugggcuuugagccugaaagauccuuauuuuacagagcuaggaaagggggcuuugcuagugugucuccuuaaguugcgccuuuucuuuucuucagaguuccugaggaucaaggacuaguacugacuuauaggaggguccuuugucugcuugcucaaacacccaaaucuuguguguuuacccaugagcaggguaucaagucuccaagccagaggugaucuucaaauuggagcaaggagaagagccauggauaucagagaaagaaauccaaagaccuuucuguccagguaaugaguucagaauucugcuccuagaaaucaguguagacagggcuacagcuuauggagagagacuucuucuaacuagaggcgugggagcugucugaccugaaaaggaagccgaagccauuccuggggcugucucucuucuccagucagguguuccugcuggaaauaagucuuauggggaaaacauagacaagugcugaauuacaggcauguaauaccgcacccagcuuuauacugucaucagagauugguuaacccuuuaaugccagcauucagaaggcagaggcagguggcucucugugagcucgaggccagccuccgcuacaauagugagaccuggcuggucucuaaagaaagugaagacaaaacacagggcgaggcugguguaaggugaaccuuaguccgagccucacaacaccgugucccaagcacacaguccccaggagucaacacugccgucacuauugaaaaagaagcauguuagaauuuugacaaagccaacuuuucagagacuguguuuucauuuuuaacucacagagcgagcuuaguuugugaugaggcuucugaccagccugagugcauuguguuugguaaacguacacuccacaguaaaucuaugcaguacacacuucggggagaggucuguuuuaggccuuuagcaauggaaaaagaaacaaaacuaacccuuuauuaaagcuccacugagaggaagucugagaagaaaauguggcauucucugcccuuaggaguuuugcuucuuguuuuaguuguuagaaagcguguggcuguguggcccagccuggcuucaaacuaccccccucucugccccauccccccccacacacacacucucaagugcugagauuacaagugagugcuauuguguauggcugacacuaugaguuuaggauugauucuuguugcaaacuuagaagguugaguauuggacuucuuuaaguguugcuuccucucccaacauuuuguuauaagaaucucaaauauauggaagacaucggaaaguuguacaguaguuaucauagagcugccaccuaggugaucacagacuuuggcugugauacuugcuuugccucaugccucuucaucuacccacauaagaaccaccuuuuuaaugcguucuuaagggaguugaaaacauaggcaugagucucguuaguuagaguucuuuguuuuguuuuccuuugaaauacugaaaagaaaauccugggcuuuucccaaguucuuaaaaaaaaagaaguucuguaucaacaaacuauauccugaguccaggguucagcuuuuuaauuaauuaaccuaugaauuauuccuuaaaucucagggcauguauauauaagcaagaguaggaaguauauguuccuguguucccgagccaccaaaggcagagagggcauuggauccucuggaguuagugucacagucaguuguuagcucccuagugugggugcugggaacugaacuuggguccuucacaagagcagugcgugcucuuaaccacugagccaccucucaagcucugcucacuuguucucauggauauggguguuuugucugcacguagguguguaccacauaugugcagcccucagagggacuggaguuaacgguugggagccuccaagucagugcugagaaucaaaccucgguccucuggaagagcagccaguguucuuaacugcugagccacaucucaccucuuuagccucccaauuuauuuuuauaguuuuggguuuuuuugguuuuuugguucuuuuguuugguugguugguugguuguguuugguugguugguugguugguugguuuugguuuuuggagggacaugcuugauuuuuguuguuugaguuugugagaucuauuuuauuuguguggggugugugugugugugugugugugugugugugugugugugugugugugaaggauagaagaaaaagcccauugcagcccuuggagcuuaaauuacaguuauuguguggggcucucaauaagugagagugagugacaagauccaauucauguacucuccguugaauagcaaguaaucuugaccccugggccaccuucccagccuuagguuuuucuucccugauuugaacuucugauccuucugccuccuccaccugaguuuugggaaugugggggaugccccgucacacccuguuuauuugguagcagugaucaaagccaggacccugggagugcuagacagacuuucaacuagcuuguucuauuggcagcccuauaggguuuauuuuuuaaguaaauguuguauacacuaaaauguucaacccuguugguuuugacaagugcauuagcccuuccaacccacacuccccaguauuuucauuuuugagagagcaucucccuacauguauccagauuggccucaaacucgugaucucuucugccucaguuucccagguacuaggguaauagguauaagcaaaggugccugguguuucccuuaguuuguuaagauaaacauucuuuuuuuuagaucuauuuauuuuacguguguguguguguguguguguguguguguguguguauaagaaugucuugccugcauguauauauguguacugugugcauaccugguacccacagagcucggaagagggcauuggauuuccugggacuaaagucacagaugguuaugagauuccauguggaugcugggaaucaaauaugguauucuacaaaagcaacaagugccucuaaacacugagucuauacucuuaaguccuaaaaauuacuauucuuagaaccuaaauauuaauguuaucuaguauuauuauucuaugguaaaaaacagaccuaggggauauaucuauugaccaaaauaaauucuuuguaaagugaggugauggggaagggggacuagagagauggcucagcaauuagagauuugcucuugcagaagacucagauucaauucccagcaucaacauggugucucacaacucuguaaguccagcuguaggagauccaguguccucuucugaccucaauggguaccaggcacacauggugcauauauaagccugcagacaaaacacucauaaaauaaaaugaaacuuuuaaaaagguauuuuaagagcacuuuaaaaagaaagagaaaaagguuuggggacugggaagacagcuaaguuagaaaagugccugcuuucaaacaugagaaucuugguuuagauccccaacacccaugaacacuagagaucuguaaccccggcacugguaggacgcaggaagggagagacagauggauuccuggaacucauuggcuggccgguguggcugaaucggugagcucucagguucagugagagcccuguuccaaauacuaaauaggccagugagauggcucagcagguaagacgcuuguugccaaaucugacggccuggguuuggucccugagugucacaugguagaaggagauaagugucacaugguagaaggagaugagugucacaugguagaaggagaugagugucacaugauaggagagaauuuacuccuucaacuuuugucagaccucugcacaugugcucugaugcuuggaugcgaguguguguguguguguguguguguguguguguguguguguguguacagaauauaaaugaguuuuauuggaacuuucuauguggaccaggccgaccucaaacucugcucucgucccagauguugagcuuaaaggcuugcuaggcaauaaauguuauuuuaaaauuacagaugauagaagagagauggucgcuauagaaucagagcucacacaaacugaaacuucuccuaguuuuaagaccaaaaauaacuugcuuuccgaaucauuacuuuuucucaguuuuuagcaugguguguggccuccccauaugucagagaaucuuuucagaagguccuuagcuggagauuuuuuuucugcaguauuuagaagccugcuaucuaauagguuacuguaaaggaauuauaaaauggauguauuagccaggcagguuuuuguuauguaaaaucaguacucgcacacuuaggcuccucugugcuucuguuuccuaucacacucgcccacuuacaugggcuuuccucacucucuggaugugacaggcacucuggauuuguaauauucgcugguacuucacucuuucuuuucugcaggcaucuuucucuaagggacugauuuaaaaauacagccaugcaugauuucuaucucauuuucuuaucccuacucuagcauuuuguuugagcugcaagaaaugugggaacuuuugcacuuuauauuucuuuuagacuggaagaccaggccugaguccucacggaguccucagcagggcguaucugaaguauuccucagaacaaauguuuuaucacacaccacaauaggugauaucuggaaugucgcuauccaggggcaucaggaaagugggagaagacaucuggggccagaggcaucuucccagaagaaaauaaccacucuagagaaaaaaauugagcaaaacaaaguuggugaagacucuaguuugagcacagacuugguuccacaacuggacauuucuucaaguauaaggcccagugacuguaaaacauuuggaaauaauuuggaacacaauucagaacuaguuacucagaguaauauccuugcuaaaaagaagccuuauaagugugauaaauguaggaaaucauuuauucauagaucaucacuuaauaaacacgagaagauucauaaaggcgauccuuacuccaaugguacagaccaaggagcucagucuggaaggaaacaccaugagugugcggacugugggaaaaccuuccucuggagaacacagcucacggagcaccagagaauucacacuggggaaaaacccuuugaguguaauguguguggaaaggccuucaggcacagcucgucccuuggucagcaugaaaacgcacauacaggagagaagcccuaucaguguagccucugugggaaagccuuccagcgcaguucaucucuuguucaacaccagagaauccacacgggagagaagcccuaucgcugcaaucucugugggaggucauucaggcacagcacgucccucacgcaacaugaggugacccacaguggggagaaacccuuccaguguaaggaaugugggaaggccuuuagcagguguucuucccuuguccagcaugagaggacccauacaggagagaagccuuucgagugcagcauuugugggagggcauuuggucagagcccaucccuuuauaaacauaugaggauucauaaaagaagcaaaccuuaccaaaguaacaacuucagccuggcuuuugugccuaacacuccucuuccucaaggugaaggccugcuuacugaaguaaagucguaccauuguaaugacugugggaaagacuucggucacauuacagacuucucugagcaccagaggcuccacgcuggggagaauuccuacggcucugaacagacccuucuuggucagcagucccugucucauccccgagagaaacccuaucagugcaacguaugugggaaagcuuuuaaaaggaguacaaguuuuauagagcaucaucgaauucacacuggagagaaacccuaugaauguaaugaguguggggaagccuucagucgacucucgucacucacgcaacacgagaggacccacacuggcgagaaacccuaugagugcauugacugcgggaaagccuucagucaaagcucaucccugauucagcacgaaaggacgcauaccggagagaaacccuaugaguguaaugagugugggcgggccuuuagaaagaagaccaauuugcacgaccaucagagaacucacacuggagagaaacccuaugcuugcaaggagugugggagaaacuucagccggagcuccgcccuuacuaaacaccaccgaguucacgcccggaauaaacugcaggaaagcuaaacaaugggauggggaggaggcacggccgaacaucugcuuccaacccagugucagaggauucugaaagucugagaauguaauuauguguuuggacacuguguauagagaaaacugccacuagaagaaaaaaauuuuaaauuaaagccauucuuucauaccuuauuacaggcuucuuguagaacuacguacggcauauguagucguuuggaaaugaugugaccuuacuaaagcuuuugaauauaugugugcagagucaccaaguuuuaacagcuugauauguaaauccuguuguucacaaccuugaaagaaagaaagaaaacucauaguauggccaaggcucauuucaaacaucauugacaguuucacuugacugaaacuguagaaaucaguuuguuucccagaagucaacauucagagaauuagagcagcuagaccaaccaccuaaauguacagaugguugcacggcaggcucuaacccacaaagcugaacguugaaagcuuguuuucggguucuuuggccucauaccauggcuauagaaaggguauuuuggaguucagaggccuuuaaaguuuuaauauagauucccagacauguugugacauuuugaagagccugaagacauacaggcaaccauauggaaaucugucaaaaauguaaggccacuuaguggaagcuuuacaaaagaaaagauuggcagaaacugacauugauggaaugggacaggaacacaugcaugcgugugcacacacacacacacacccuucccagcuguaauuauaccuucaaccgauguaucauuccauuggcauuucauggcacugcaugaggagaauuugcaguuugcuugaaacccugcccuccucucuggugcuucugagcccccccccccccgccccaagucaauuuuacuauagagaaguauacaccuaacuacccacagccauaaacuuucucucugacuccauuuacggaaacagcaugguuugccucuuuuugugugcaaagagaauacacugcuguuucaaccccca

SEQ ID NO: 4740 - RNA, 9154 nt, Mus musculus
ggagaauuguggauuggaauggagcuccuucuguugcuaaaucccuugucuguugucuacaaggcccuggcuuccaucuucagccaaacagaaaagucgccaagauugagguauuauuucucauguacaaagcauguucuccaaguccauucuagaaaaugcuuuucaagagcagguuggcaauaaaucugggaguccagagcuggguacagcacagguucacgucuuccuugcuguuuggccuuggacaggggacagaaccuuuuacuuguaagacauaaaaccaggacaagcagggcuauacagagaaacccugauaaggagagagagagagagagagagagggagagagagaaagagagagagagagagggagagagagaaagagagagagagagagggaggaaucuuaugaacuaccuccuagaacugcauggauuagaagaauuaagcucgcacaggaaagcacauggccgcaagucugguaugcagugauuaauacggaauugugguuauuugucuucuuaugacgcgugugauuuguauggcacuuugcagaaagacucuucccucacaugagugcacuggagcgcugcugugugaggucggucagggaaacaacauugauuuugcuucuccugugcauuuagcacccugccagaugcuaacagauaguguuuuguugguuucacuuauucaauaaauauuugaguauuugaugccaggcuguuuuaggcacuggggaaucuagcagugaacgaaauagauuaauaaaaaaaaaaagaucccugacuggggcuggagagauggcucaggaggugaagccacugagaaucugagcuuggauucccccaacaccuaccugaaagucauguguggcaacacucgucuguaaccuuaacagacagaaagacagacaccccaccacuaccaccucacccccagagcuuuugggcaagccaacagugcucuaucagugaucucuggguucaaucuucucauaaagaaugaaguggaaagccaagugaagaaggcaccugccauggaccucuucaguccuaugcaaggcgagaguggagcaggcucuagaccuuugcauuaaaugacuccaugauggaagcaccacucagcacauagacagcaccaccugccaaacaaaaacaaggcccuaauccaccaaagucuagaguucaggaaaagucucuaaguggacuggccuggcuuguuagcuccuggagcuccccuucuggcuaacugucuuuguuaacugaaguaugucaagccacaacgugguuuuuccacguaaaagcucaccccaagaaauguuuagugucacccuggggucucaaauacgcaggguggucaccagcuggcucguaaagacuuucuuguaaaugcaguucuuuggggggggggguucuauaccccuuuugcucccaaauaacugcagggcguuucuacacucugcuccagcccauuuuagcuccuggauauuggacacagagagcuggcauuuguauuaacaagcuguaaaccuaagcaggacagguucugaacuauucuagcccaacuaggauauuaauacuuagauaaaugucccauuacuugccaucuggucuugcccuggcucucuugucaugagcucauugugaaucccuugguggccugcucaucacuacuccuccuagaccugccucauagcuaccucuucucuuuccuccucacccuacuucuuucugucugggaccauagucugggaccaaaaguuuuccucugccccagucaaaggcugagucaacccuuuguugaccaacuguaaggugguggagaagaauauuuacaaaacaccuagacaguaaaugcuucauaaaaauaacaauaccaccagguguugugguggccuuuaagcccagcacuugggaggcaaaggcaggcagauuucugauuucuggucuacagagugaguuccaggacagccagggcuauacagagaaacccugucucaaaaaacaaacaaacaaacaaacaaacaaacaaacaaagucaguggcacucaacucuuuguggguauggaaaucagcauuugaauaauacaaagacaaccuuuacacacugcacaaagagacuaucccuacacuuucccuuagcuugcagcugucugagcagucuucucugguggauaccucgcaacaagagcacacccacacaagaacauacacauauguacacucauccauacaccacacacacacacacacacacacacacacacacacacacacacaaauaaaaaccaguaauuaaaagauguucauuagggguuggaaagauuugguugagagcacuggguguucuuccagggcacccacaugucagcucacugucaucugucacuccagucaucugucacuccagucaucugucacuccagucaucugucacucuagucgucugucacuccagucaucugucacuucagucaucugucauuccaguugucugucacuccagucaucugucauuccaguucuuaauagcguucucacgcccggccaggaaagacgcaacaaaccaaaaucuucugcggcaaaacuuuauugcuuacaucuuugggagccaggagggcaagcgcccagcgcccagccccaaaaacgaaagccccuucaauaaugaaaccgaaaccccuucccuauuuaggagaguuauauuucgccuaggacgcaucacucccugauuggcugcagcccauggccgagcugacguucacgggaaaggcagaguacaaguagucguaaaauacccuuggcacaugcgcagauuauuuguuuaccacuuagaacacaggaugucagcgccaucuugugacggcgaaugugggggcggcucccaacauccagucaucugucacuccagucaucugucgucacuccaguaaucugucacuccagucgucuguuacucuagucgucugucacuccagucaucugucacuucagucaucugucauuccaguugucugucacuccaggccucugucacuccaguuucaaggaucuggagcuuucucugaccuccaugggcaccagacacucacacaugcaugcaggcaaaacacucacagacauaaaauaauugaaguguuuaaaaaagauauucuuuaguaccucuucugauuacucaacugcaaguugauuaaaccaguuuuuuguuuguuuguuuguuuuuaaaaaauccuuucucacauagggaguucuccaccuggagaaagacaguaagcagcagauacugaucuuuuagguuugaugucacacgguaccuuacaaacaugcauugugcagaugacuuuugagacacauggucacuuacucagagucuuguggcuaaguugagcuaaauucaagauuuaaagccagauagcacgauucugaguucugaauccugaucacuauggucugguaccuuccccaacaaaaccaacaucaaaacaaaacaaacacuuuaucauuuuuguuuguuuguuuugguguuugugacagggucuucuuauagcucuggcuguccuggaacucacuacauagacuuagaccaaggaacacgccuuuaaucccagcacucagaaggcagaaacaggcucaagaucagucuggucuacagaaauucuaggccauagaggacugcauaguaagacucugucucaaaguaguaguaguagaaguaauaguaauaagaauaagaauaauuggagaauaggguguguguguucuccaugcagagucaucagggagcagcucuuugaggacucaccucuagagacccuccaggcaugggaaaggcuccaagggauaucuuggaacaucaguccuggcagagggaagagucugugcaaaggccggaaacggaccgcucccaacguuccagggagucacauggacaccaguacagaagaugccgugagccaaggcucacagauggcucacccaagcugcgggcaggaugcagcuguuucuugcugcggaggauuaugggagcagguuugcauggcaaggugaggaguugguuuuugguaacauccaagugggaaugaccagcuccagaggauguaaaggguuaguagauaacccaggcaggcagucaucuuccacagcuugauucaaacccaaguaaaugaguguggugguacccaccucuaaucccugcacugaggcagaaggaucaggaguucagggccagccugacuuacauaaucaagguugagaucagccaaagguugaggacaguaaaaacaaggacugaagauagaacaugcccagggcuuucauccuuaauaucacauaagcugggaauaguggaauccuagcaucuggggagacagaaggucugcaaguucuaggacacccucuacuauuagugaguucugagccagccugggcuacauaaaauacuaucuaaaaaaauaagggauggaguggugggaauaugguucaucggcaaaagugcuuuuaauacaagcaaaagaaccagcguccagaucgugugaacuccuauaaaugcguggugaguaugguggcucaccugucauucugucuuggaagguggaaacauggggucccccaaaagaaccuggcuggugaaaguagcuauauugauaagcucuggguuugaugagaaacccugccucaaagaauaagguagaagagucauagaagauuucugaaugaaaaacugccucgaaccuccaucugcauacauuuguguguuugcaccugccugcuacaugcacugggggcgcgcgcgcgcgcgcgcgcacacacacacacacacacacacacacacacacgggcgugcgagcaugggggaguggagggagacagagagugagagagagagagagagagagagagagagagagagagagagaggcaggcucagucuugggucugugggcuuuacauuuuaaagccacauacacuuccccguguggguguggguaagucuggagcuguucaauuccgacaggcuuagccucuguccccaaggaggguuuaaggugggaggaaagggggagaaagauagcagagagucuagcaacugagacacugagcggaaagcagaggcaccagagauuuuuuacagcacaguaaaaggcaaacauuuaaauacaaaaugcagucaaggaacgcugagaaggggcuguuuucuggaaaggaaaaaggaagaguuccagccccguggaccuggaggauguccaacagacugugcgcuguuggaaaugguauuacaguuuggaucuuugucucccaaaguggucuggggaaauaguucaguggugcagugccuggcacacacaaagccccggguuuuauccccagacuucccuguaccccaaagucuccaaagauuggucuucaagguccacuaaugggaaaugaugaguauuuaagagcugggggcuggggauagguacaguggcgcacuccuugagagagacaggcagaucucugugcauuugagguuaccugauguagaguuccagaacaacauaggcuuagugaaaucaucuuuccaaaaaacucacacauaaacacacacacaaaaaaaauguaggacccggugaucauugggaacacauucuuauauuuuguuauuuaguauuugaccuguuaaugcuacaaauuuuaauuuuuuuaaaauuccuuuuaugcaucugaguauuuugucugcauauacauuuugugcaugucuggagaagccagaagugggccucagauucccuggaacuggaguuaagaaugccuguaagcagccaugugggugccuggaacaaacccaguuaacauuuuuucuguaagaacagugagugcuccucacccugagucaucucucuagcccaaaaucaguuuguuugauuguuuuuaccuuuuaaaacuuuauuuucuguguauguuuguccacauguguauaugagcuccacuuauguuccuggugccugaggaggccaagaaagggcauccaauucuagaaaugaaguuacagaggggguuaugagccaccaugugggugcucagaaccuggguccccuacaagagcuacagugcucugaacugcugaacuaucucaccagccccuggacuuuuguuuccuaaaguuaacuuuuagggcaaucuuaugcauuguauuuugauuacauugacacacacacacacacacacacacacacacacacacacacacacacaccugcauuauuucuugacccccucucaaucacaccccaucuucugcaccacugaagaaaagugucuccccaugccauggggacauguucugaagcuugaugccucuucuucuuccauucuuuguuuccaagguuaccaggagguagguggguuuugcgcaauaaaccucugccaccauaugcugcuaucacaggcccaauacuuuggggucucucagcuguggacuggaaccuccaaaacuccaaacaaaccuuucucuuucucacuugcaugucucuggcauuuucuuauuguuacagaaaacugacuaauagagaugugaaggcuccaggaacccaggguccaaccucggcaagccugccuuccacuguaaggugccagacuccgcguguugccuuugugacagagcacaucccccagccacauuggucuucugcgguggcacauacaacaacuacagccuccucaucacaccauggcaggcuucugacacauccccaaacagaagaagcucuugguccgucuucaguuccaagcuuguucuggauucauguccccagcaagacacaucaagaagugcucccaggaagaacuguuaacuaaacgggagaccgcaggcugaagggcagcggcggugugaguacagaccuagucccaaagagagcaucagccagauguacaggggaacucuggugcaauuacaacuuagcguuugucuguuuggaaaggaaggaugcuggggcugucaccuacaccagguaaucacuggcuguggguggaggaagcaaauucugggcaucuguuuuguuuuuccaagacaagagcuuggagauacacacacacacacauacacacacacacacacacacacacacacacacacacacaucccacgcugaccuugaacucaugaucaggcuauccgggaaauuuaacugaaacucaagacugagauucauuuaguuaaaugaaugaauugaugaaugaccagcuggagaagcugcgcagaaggcagcgucgugguccaggcucgcccgaagagcugaguaucguuuucuccgcucugcucgcggccccccgccggaaugcagagugcccuggaaggaggcggaaaugagcgcgcuccacagcucuccagccgaguguuuacuuaauuagggccuguauccugaggcucguuuguguuuaacugucugccuaaugguuucgucuggcuccgggccggcgcugggggaacuuugggggugaggauaggucgagccacccuguccccucuagguuagagcauugagcagcuccagcgggcagcuaggauuuggcaagcguccccagcaggagagcuggaccacuaagcugccuugggcuuuuucugcaaguugccaccuccucccacagugcuaggacugcgcggaucacugaagacuccagagauggcagaugccggcugcccgcagcggcgaaauugaaggauucugacacugcucauucucuuaguuguggaacugggagcgcuagccaguucccuagcuggcgaggcagagaaaacuaaaugagccgcauccuagaguccuaauaccgacaccacugggcucuugcucagugccagcuacugaguucagcguuuuuaacacguucaucuguuuaauccucaaguacacaucuucguuuaauucuaauacagccgagcuccucuuccuacccccccccucuguguguguguguguguguguaagagagagggagagggagagauguguguucaugaguaugaguaggggccacgugcauuggccagaggacagucucugagacaauacuaucuuucaccuuguuugagauugggucucuuuguuugacacuguaugaaccaggcuggcuggccugcuggcuuccuucugcccuccccccaucucuucauaggagauccuuacagaugggcuacugccauccacauuccguggaaucuggggacuugaacuugggacuuaccaaagcacauuauccacugagccuucuccuuuagucuaguccuuuuuuuuugaaacaaagacucacuauguaguguaggcugucuuugaacuugcaguaaucaucuugccuccacaccccgagcagggauuaaaggcacaccccucuccuggcucuaguacaguacuuucagaggguagguaucaaaauaaucccagugacagcugaauagccucaguaagaggugggacccgagucuaaaucccacacaguaaaucgaguagagccaaugcuugccugauuacaucauaaguucuacugcucagccagagacuuggguagaaaggacagguagguacagguuaauacuugaaggcaaacaaaacaaaacaaacauaaacuucuaaagcugagcuagcuggagaaaaagcaucauccugggauucucuggagagcaaugcaagaugaggcgcacucggagaauggggguggggggauacguugguucagaaggcuugucucauccagggcugaggcugcagcucagcaguggagcacuuacuugccuggcaggugugcaaggucaugcguucaaucuccagcauugcagagaggaggggcaggggaugggggagagaugccuuuacagggaaagggcacggggaauggggccguuggaaccugugcaugggguggcaagucuuaguacuagguacaaggucuuaguacuaggaagguagaggcaggagaaucggaaguucaaggccaucccaggugcauaguuucaggccagccugagacacauuacacuuuuuuuaaaaagucaucauuguuaagcuggucauugugggucauugucuuuuauuccagcaguuaggagccagagacagaagguuugaaugaauucaaggccagccugagacuacaaugugagagucugccucaaaaca

SEQ ID NO: 4741 - RNA, 556 nt, Mus musculus
cgccuggcuuguucuuuguuuuuuuuuuuuuuuuguuuuuuuuguuuuuuuuuuacagguucagcucuuuauuggccaacuuaacaaaagcaguuuagucaaaaagaccgaagcccaugucaucuucagacuccucggacucuuccuucuuugccuccacuuucuucuccucagcuggggcagcggcaguggacagagcagcaccaccagcaggcgcagcuccagcugcuggagcgggcccaccagccccuacauugcagaugaggcucccaauguugacauuggccagagccuuggcaaacaagccaggccagaaagguucgacgcugacaccagcugcuuuaaugagggcauugaucuuauccuccgugaccgucaccucgucgccgugcaggaugagggcggaguagaugcaagcgagcucggagacagaagccaugcuguagacugccggcacggugcuagucgccggaugaagugagggccucaccccaacgcggccuuagcuuccucggaaggaccgagcaccuuggcggcagcugaggaaaagguucuu

SEQ ID NO: 4742 - RNA, 66900 nt, Mus musculus
cgcagccucugcgcugcucacuggugugggagccgcggcgcacuacugaguucccaagaacuucugcuagacuccugcccggccuaacccggcccugcccgaccgcacccgagcucaguguuugcucggcgucugccggguccgccaugggagcccggugccgcagcuuuuccgcgcuccugcuccugcugcagguauguggaggguccugacucgugccccaugauccgcuucgcuguguuuuucugccggcuguggucccgcuucccuucuuccaagaaaguugggauccggagggccagaucgcccugggcgcugcgcggugcggggcugagugcgguggagugggagggagguccaggcgggcgcggaguggucgccucuggcgcagguucccaggugggggcgcgccacgcugccggcucccggguccccggguugagcagggucccuguuugagacagaggaggcguggagcaggaugggggccugccuguagaagguggggugcugaaguagcgcggacgauccgagauaagggaagggauuuuaguauuauaaaagcaccuguccuguuagggagggaccguagauugggguacccgagaggagucugcgggugugcguugagaccguucgcggucgaaggaaagugguguccggaagagucaaggcgucuccagugagaugcaaauggagcuaggagaggaagguggacuagguugccaggugguggccccagauguccccucccccaaaggcuuuuggagcuuggcggcugguuucgggaugagcggauagcgucccugugugcccugagggggguccuccccacuaaucccggcgcccgaggcgagggaaggguuacccuugguuucggugugggcugcugggaacccccucaagucaccaguuugcuuacuuuaccuccaucccaggucuccucauggcuuugccaggagcuggagccugaguccugcagucccggcuucaguuccgaggucuacaccuucccggugccggagaggcaccuggagagaggccauguccugggcagagguaagggaaacugaugguguuacucggccgaguggggucggguagugaaggcgccaagaaaucgugcuaccaugcugguaggguggaauggacaaaacucuuccuuggaauuuacggcagauuugggagucuuauuuaucgauugugguugaucaagguagauaugucuggcucugcuauuuauacggggcagaaaugggccaaggguauuuagaggucaucgguauuccuccaacugauuacuggagccggucuaucauuucagaccgccaaaccugcuggguagagccaguuggacuguaguuccauuuaaugaugagcaauuggaggcucauagagugacuucacagggucagcagggcaggcauuugaaccgggauuugacucccacuauuuagguauagucacugaggaaccgguucauaaugacuugugguuuuuguucauaaggauaaaaauacucgauacaggugcugcuuucccaaggaauagguuuuuuuuguuuuguuuuuuuguuuuuuuguuuuuuguuuucuuuaagaaaaaaaaagaaaagguagcucugacucauacauucaaacacucaauauauauugaggucuuauugugauaaucuagaauuuucuuuguauaacuguagggaauggcugggagcaaggcaagaggaccagguuuuuguuaauguuguuucuuuuuuaacuauuuucccuaguuucuaggugcuucuuuugcaccaaaaugaccuccccccucaugauuuuaguugauccccaaaguaugauaaacaaaaagcaauaauuuuaaaaggagaagucacacacaaucccuuucugggaauagauucaccgagguucuucuuccagucguaagccaccugaaaaaucuacagcacucaugauggugucuaaaaguuugcugugagcuuuggaaguuggguccagguuugguggugcaccuuacagagaaauagcggcccgacugguuggucuuaacuugcuuuucugagaucugacugguuuuguggagcuuucuuuggguccagaaaggcugcagcccugugguccugagguuggaauggucagggauccuucagccagucuccacgugacucuugcccaaggacgaaucugagccucugguagguugcugagagcagggagcauccggccugccuucaguggcacguugggaugggcuagcgaggcaugaguguucuaggauguuuccaaggaccgcagugagugucugagaauaaauaaguagacgucgugucacucaggguugagcuuggugggcuuggagacaggaaugcuuauauauuagggaucagugcaaguccugguggcuugcugaugcguaugugugccugaguuacgacagucuuugguagcagugcuaaggaugaaaccuucagccuguuguuacauguuagccaggcaccuaaccaccaguguguugguugggucgauuuguuuguuuaugagacaggaugucccugugugacaugggcuggucagaaauucacaguuugauuuuccugcuucagacuccagugcugggauuccagggucaccuugacgcugacccagcuuuaauuuacaccucuacgugcuagugucuggucacucacaccacugcauaucagugacaagaucacuuaaaaacugauaguaccaccugcucacucacgccccuuaaggcgagugagucauuuaccuaagguaaaaaugagaacuucuggaggguggacaccauuccaguccucaaggaaaucaggagccugaagcaucuacgacugguccuccucuuuuugguuuucuuuucucucaaaaagagaggggaugaaaacaaaacaaaagagagggaagugagugagcugccccagcgguggucacaccugugaccugcacucccggaagugaagugugugagcugcagcuguggugguucccauucgugaucagcccuugggaggccaaggcaagaggauugcuaaaaguuguagguuugaggucagccuggucuaaguaguggguuacagacuaaccugggcuacagagugaaaugagaccuuuaaaaaaaaaaacaaggaaaaaggaaggaaggaggaaggaaagaaagagagaaggguggaaaggaaggaagggagggagggagggagggauaugugugugcuuuuggggaaaacaguccauugugaaauagacuguggacagaggucuuaacguagggggagcugagaguggcugguguugauggagauagaacaugcuccgcgggagguagagagcccccgcugagagcauugcccccgcccccaaaggcagggagccacuucaccccgcugagagcacacccagugggagguagagagccccgcccccgccggugguuuaggugggagaagcacccuccacacagcaucccacaagcuuccaugcuucccgcggcugguuccaguucccuuuaagucugagacuccaccacugcucacccggggucuaauugcaccaguggagugugggauugcgcuagaucagagguaucuuuccagaaaucacacacugcaccccagaaaauugaaaaugaauugccuucauuuaggaagguggggacacucuuucgaccuucuggggaaaccgaggauugugaccuuggcuccagguuccacuaugcaggcuucugagaaucugacacagguggcuuaaaggucacaaacaggcuuugaugagcucuguuagcaucgucccgaugcccuguaagcuugccuguagaaucucuggcuucuaaaaugcagaaucuuaaaaacugaaaacccaaaccccuccacuacccaagcauauccuuuaguuagguugauuuguuuauuuuuucuguuuuggguuuuuguuguuuguuuuugagauaggaucucacuauuagccuuagcugggcuggacuucacuguuguagaccaggcugcccuugauuucacagagaucuuucugcuucugcuuccugagugcugggcagacacaccagcuguggcucuucgguuucuauuucuuguuuuuguuuuuuugagacagggucccagguaguucaggcuggccugcaacccucuauguaguagaggaugauugaauuugugaucuuucugcucccacuuuccuggggcuaggauacaaguguauaccacuaugcugguucuugcuuguuuuaaagcugauucacuguuuuuguuuguuuguuuguuuuuacuuuuauuuaauauguauguuugugugucauucuuuucagggacuaaucucugucccguucuaauuuuaguuuauguguggcagagugaagcacucugugguuugagacagggucuaacccaggcuaguguggaacucaacaguguagcgcagauuagccuugaauucauggugauccuccugccucagcuuccugagugcugggauucccaacaacaaucaccaaguccaguuuaaguuguuucuuuagaguuguugauuauuauuauuuuuuuaagcacaaucuuuucagggaucuggccuuugccuuucagagcuacaggauuaauacacaaaguuacauccauguagggugcugguaaauccuuuaauugauggcuuccacagcuuuuuuuuuuuuuuuuuuuuuuuuuuuuuuuuuuugguuuuuuuuuuuuuuuuucgagacaggguuucucuguauagcccuggcuguccuggaacucacucuguagaccaggcuggccucgaacucagaaauccgccugccucugccuccccgaguacugggauuaaaggcgugcgccaccacgcccggcuuccacagcuuuauaaugucuguaggacaaacgggccugggcuuugguuauuugauggauugaccuaguucucaggcagccaccuguguggacuaaauacacccauuucuucuccauucugaaggaugugcugaaagccgccuuggacagugagaaaagcaaacauggaagccugcuguaggaucaccuuacaccaucagauacccacuucccacccccggcuuccugaacuuucuguaauuacucaugccagugacuagggcucaugugggccaucccaggaaggagacuaguggcugccauucuguccuggucuuugugucucccgaggaggaguguagguggugaggucacaggcuaagccaggccauuuaaggaaagcugccucagcuccagcccagcccucucugccagguggauauggaaaucccgguuuacucucuggggccuuuuauuggcugaaaugcucaccuugguaucuguuacacauucccuuccaagagcagagcuagauaagccagguguggagacaaucagcucuugaaaucucccagaagcugccaaaccccuaaaaucagcaagagacaccccucauaguccagacucagcuguuuuauucugccucucccugaucucuuuucagggcauaaaguuuuccaaggagaagaaugaaaucaguauagcaggucauugagaaaguauagaaaggcucagguugaacuucagugucugcuaccaaugugucauaaauaagucauuuuacuacugugagacucaguuuacccauuuguugaguaugaaaaaaaaucauauauauuuguuaugcuauauguaucaaugcauauuugauucauaaacaccucaugcuaacuggaguaugugcaucuggcuguccauauugaguuacuguuuuaagccagcccuaggcuagacucuggggcuaaagcaaugaguaaaacguauuuggcugaacauaaauaugggagggggguggaaugcaugaauguaaagaaugcuggcauaaguaggaccagugaguuggguguggcagugcaccuuggagacagagccaggcggaccucugaguucaaggacagucaucagggcuccacagagaaauccuguccaaaaaaaaaaaaaaaaaucaguggggaaaggcaccugccaucgaggcugaagaccugaauuugguccacaggauccacgugguaggaaagaaagaacuuccaaggguuauucucuaaccuccauacuuauaugugaguguacacuuaaguaauguuuguuuguuuguuuuguuccuguuauguuuuguuuguuuuuaaagccaagucuggugguucaggcauuuaaucauagcacccagaaggcagaguucaagggcagccuggucuacauaggaaauuguaggccuauacagugaaacccuguuucaaaggaagauuaaaggaaaaaagucuugcacucuuccacacccugaccaaaguccuauagugaaacucugguccccucccucaucacugcuauugccaaacucagucucccucuaugacccacaucaugauagccagggcuagaccguuuguaaagauaaaucagccuugucuggauaaauaacuccaggaaggagaaacugccggcuguaaagaaccuuagcagucguauuccccaaaaccaccuauauaagccucaagugccccuccaccuuucacagacaccccuccccuacgggagaguaucuguccugcacuguuugaaauaaacaguccugucuguugaggucagucuucagucuuuuuuucugcuuccagucucuuaaguugcuucagaaauuuaccaagaaucacuaaauaaagccagcugugaugguccacaucuguauuccagugcuucgaaggcugaggcagagggucucaagugugaggcuagccugggcugccuguggaacccugccuuuuuuuggggagcaggcuuuuaaaaaauauuuaucacggugaaauauaaggcaggaggauuguuagaaguucaauaaggacaaucugauucuguagugggguucaggcuagcuagggcuacauacuaaacaaggucucaaccuuguuuuaguaagaggaggaggaggaaacagaaggaaaaaaaaguaauuucuuaggcacccaguaggccugcaagucuuguuuugaacaaaugaauggaugcaugaaucaaucuuugcuaccuuucaggcucuauucuguguccccagagcacccccggcccaggaaagugagcagggcacgguaggucugcuggaaucucugauuguacuugugagggcucugccuagcagucucccuggaagcugagccuggccuuagccucuuccuucucucucagagcuucugaagccacagaagggacgcaucaaacucggaccuagaaaugaacgauuagucuuuuuuagugauuuuuuuucuuccgucuuuauuuuuugacacucacuggguagccuuggcuggcccagagcucccuagguuggucagagaucugccugccuccugccuggguguugauauacagggauucaccacucuaugcucuuacgagcuggcuucgaacucaucaggcuuagaaugucgggucgucucacuuauaccuccuaaguguuggaauaaccagugugcaccacccaagagccccuagcugggacucuugccaggccugucuucucuaagccuuaguauccccaucuccaaaauggguauaaccauaugcauacguauccuaagggcauauaccaaaaguucagugaauacaguagaguauguaggacccccugcgggcuagcaguagaagccuuucccuuuccauuauacccuugguucuaaaguugguugaaaguuccccuaagcucucucccgcccagcaaaccagucaaaccaguuuccucauuccccgggcuucuguacuaagcaaacacugcuuugcaaacgguugaccaggagcuugccuuuguuagagaaggaaguccaaugguguuuucuuccuugcaaugccgggaguggguuugcugugccuuagaaaggguucaaacugggcuggaaguagggccccagaguagcuggggguuggggauucaggauggccucaaguuuguuguuccccaaacccucacuuuuucuagaacuauuucauaauacacaugcuuaaggauacccauuuguugacccauugcaaaaugcucucugacccagcuucugagacugguucaccccccauggauaagaauugagucaucuggugccauucacaaauacagauuaaccucccucccccaauuuacugaaccucaaccaaaaaaagauccgccugccucugccucccaagugcuaggauuuuaaagggccacgguaccacacggauggacacaacauucauuuuccugacagaccaggagucaggucacagguguuugacuaguaaacacccggugccaaccagggugugggcauuuggcuaucuacccugaggcccaagauccaagagcacccgugguccauggugcuaggggacccggaaauguagccagugcaucagagauccagccucuguccucagggaaguucagaaacaucucugcuuacugagacuucugcaggguauuugggaagaggggccagcacagcaggcaugaucaguuuuacaugcugggccuuuguaaguaagaggauguguccaggcacaguaaaggaaagucucccccaggaccuugggccuuuuuauccacuggugaggcuuuuuuucucuuucuguuccccccuccccaccucccgggcuuuccagacagaguuucccuguguauucauuccuggcuguccuggaacuugcuagguagaccgggcuggccucgaacucaguaugaacaaauguuuacuuauggcuggcacugagacuuccucuucacccugacuccucacccagagcuuccccugaacagaauucucuugguuagccuucucaagaucuucuguggaaaaggcagagauagucaugggguguggcucuguggucaggcuaaaccuaaugagugugaggcccugacuuugauuccuagcauugaggaaaagcagaaacaggaaucuuacccaauuuuccucugccuguuaccagacucaaggcugucccguggagcccauugcccuuccugagaaacccacuuccuuuccugaggcuaggaaagacaucccucaucucugugccucaaucucauugauuuuugugguguuaaaauucaguuauuugucuuugagagggcuccccuccccccuuugccuuucacauccuuucccuucuuuauugcuaugcagaggacccuaacuccuaggcaggcccucuacccuugagauacagcuccauccucuugcuuuuuaaaaacuuaauuaauucgagacagggucucacugcuacccaggcugguuuugagcuuacucugcagccuccugcaucagcccaccgccuuguacgugagauggugggccugagacucagccucuugaccuucacauacaucugauacgugcuaucugaacaggccugucuuacucaguuuucuggguccuguuggggggugagguggggaggggagaucuucguucaggcauggagaggugggaaggaaaccaguccacaccucuaacaagugaguuccaacuaggacuugcuuagggcacauaaggcagacagacgugggagaugugagcggcggggaagcgaugaugcuuagaugcuaccacgaggaccugauguggugugccugaagaugaaccuguuccccaugagccagcucauaaauggggaccagcaccggccccugugggauaauuggccucguccuagauaauaauuacuuagcuuuguaauuaggagagcuuguaagaagccgaaaguguuucggauuuauuuuaccuggacaaguucaagacuaaacuaacaccuguuccugugguuuggcaugcagagccaucuguuuccaaaggagguccugcagcagcuuuuuuugggguucuccucccuguuccuucccuucucuccccacaucgccuuuucuccguccaguggucaguguguguguguguguguguguguguguguguguuaaugagacagggucucauuauguagccuugggccuggaacucacuauguagauguggcuggcuucaaacucagagaggcauaucuauccacuugccuuugccucugccucucaagugcugagacuaaagggaugugcuacuacuccuggccagagugauaaguacucauccuguuuaaaguugccugggauucccuguuugacacugaauaaaaauccugcccaugacuuccaaggcucugggucccuccuucccccgcagcccauggcuugggccuucauuuuaaccccacuccccacaugugcuucguucagaugcuuugcuuccugauuguacucagaauaccauggcagcucgggcugaggcugguuuugaacucuuaauacuccuguccgggaguaguagcaucucagguguguccaaucacacucuauguauuccuuguuugugaugucuguaucacucacccgugcccuucaaagcuuugcuaagauguugccugggcaaugaggaccuucucuuuuugcuuuauuuuucuguagccccccaccuccccguuuuuugggugguuuugguagggaugagacauuaagauguugccugggcaaugaggaccuucucuuuuugcuuuauuuuucuguagccccccaccuccccguuuuuugggugguuuugguagggaugagacaacagggccuuaugcagguuaugcaaguacccuauugcugauccacaucccagccuuucugguauuuuccaccauugaaccugucaugugguuuguguauuuccucaguucauagucuucuuccauaaaaacauaaauguggccggacgugguggcgcaugccuuuaaucccagcacucgggaggcagaggcagguggauuucugaguucgaggccagccuggucuacaaagugaguuccaggacagccagggcuauagagaaacccugucucaaaaccaaaaaaaaaaaaaaaaaaaaaaaaaaaccaaaaccauaaaugugaggaggucaggguguucuguguuuguugguucuugagcuguacuucaggccguaacaaguucuuagaccucaucuguugaaugagugaacggaggagugagagguccagaagguaaauauggcgcuguacaguucuuuuuagaagcugugcuguggguuuuguuuuuucuaagauaaaaugggguccagugacauggcucagaguaaauguaaauguuguaccuuuuggcauccuggguuuuauuuuuccagaacccauuuauccugugacuuccagaugcgcaccauacccccuguaaacccccccccccccaacacacacacacaccaaacuagcaaacagauacagggcugucagcgugugagcacaugaggaagggaugcuauguucucaggcccuguguuucuucuuggcacccccugguuucucugagcccugcacagcuacaguguaaccuuaccuaauugucuuguuacaaagaaguuugcugcccagagucuaaaggucagaugagucacuugggccucacacuucuggguguauggaagcaccagauggaagucucaagguacacccgacaccggcugccuuuccgucgucaggcagcacauuccugaagcaggcucucucagcugugcccucucaaccuucauccugcagcccauuaauuguucaaggccuucuaguucuuggcaggucugagcaucuuggaaggagcuagaagagagauguagaaagcucaaagacaaaaaugcaaagcuacccccaucagauaccagcucuugggucuauugaccagccaauauccauugauaguggaguucuacauccauauggaagauacaccauucucuuucauggacaggagugccaaaucagaauacaggacauuacaucuuuuugagacaaggucuuaccauguagccuuuguagaccagcuauguagaccaugcugcccuggaacccacagagauuugcuagcuucugccucccaagugcuaagauuagugacacacaccuccacuuacacaguacacacccaggaaaaaaguaaaacauaaauaaaaagcaaaaaauuguugugaaauagcucaguauuagaguccuugucuaagauauaugggcuccaggcuugcccauccaucuauuuucugagacuggauuuuucuguguagcccuggcuguccugggucuuacuuuguagaccaggcugaccuugaacucagagauccaccugccucugccucuggagcucugggguuaaagguagaccccaccagccaugggcuuaagcccaguauggguuuaaaaacauggaaccgauuggacuuugcauaaaguuagauuggauccugugggugcugaccucccaugcuuucaagcacuuauugguagcauucacugaacaagccugagggcgggaacagcccuggcaucuuucaaaggguauccgguucaaaccagaaucgaaugcucuuuuccuagccaccccaccucuuggcuuguugccuaaggaaaauggcucuagccugguucuccaguguucucauggcagucuggagagauuguccauuuguaucacaaccuuuugggcgcugcccuuggugacccgcugcugauguggacaccagcaagacuugagacugcagaccuccucccccacagauuucucacaaugcccgugugggaguguuugaaaagggaacaagcugaccaaccuguuugugggaaagucguggcuuuccuaucagaaaacgucacacucugagucaggagugggacauaccuggguacuuuaacagguggggcaggguccugagucauagagaggucucaccugggaagguuucucuuucaaagagugaaucaaccaugacaucacccaucuggaucuacacccuuucaagccgucucucuccuuagcaaacaggaaucuaaaagaggaauaauaaggugaaagcaaacuggaaauaggacagaacagacaagggaaaaaguuaaagagaaagcuuaagagacgcagacacagacguuuacaugcaaacaggggguccauaaaaacaaaaccggaagccguaauauauguacauggccuguaagauuagaaacaaauguccuggcacaacauuaugggacaacuucccaagcugcuguugaguuuguuuuguguuggccggcaugggcccuuaaacugagugguguguuucucucuuagagaauuuuucaugaacuaguuuuucauuugcaagugguuaguaguuugagauagcuucuagguuagggguggggccguguguccacuuuacucagcucuaaugucccccguuuggugcagaccccugcagacccuaugcguccugccacagucucugaguucaugccugcauuguucaaauuguguuuccuugauguccuccaaucuccucuuugcugggcucccuggggcccccaaggugagggauuuggcagagguauucauuccauuuaggguugauuguuccaaggucccucacuguacguguuauuugucccuucucccuggcuuccugcucaggaguucugcagacauggcugguguuuaguagcuucuuggugaaguucagguagccaguuucaugaccacccagcucucaggccugacuaagcccguggagaaagcccauaaaauaaagggggugaacuucuaaucuacaucugaaaggagaaccccugucuacaucuaccuguuacccuagccaucggggagacugaggcagaaggaucuagccuggaaauuuagggugagucugggcagcauuaggagacuauuucacagugaagaaggaaggaacucacucacacccuuggugcaccucacaggucucugggcucagauuggagucuuugguuuugaaauuuccucaucaucggccgccucagcugguuuuucuucuggagucuguuacgccuucuccccuuuccccccuucucuugcuaauccuuucgcuugaacaauaggaguccuuaaaaccugggagggaaguaaauaccuuucagaugagacccugucuuaagagggggaaaaaaaaaacaaaaaaacccuagggaccgggucaccaagugucagguuaaucagcagaugucaagaugacuccugagugcuugcucuuucuucagcuggugaaauuacagcggcaacauagaaugacagucagcagggagggaggagagggccuggguggccuggacagcggccccuccuugccauuggaccucaguaaauugcuuaaccucaguccgucugucccuuuaccugugaaaggagauagggagccagugagcuaacauucauucacuucugcuuucagugccuggugcuuaagcauauggagggguuuguuuuugguuuuuguuguuguguuguugcuguuuuugagagagggucucuauagcucaggcaggccuuagaaugaugauguaauccagauuggccuccaacuugagaugauccucguguccccaacagcacuggcuuuacaggggccgucugcuuugucuguagauauggugauaggagucugauuuagaaacuuccuuguucuccucuucccgaauccuuccuccugaacaauaggaauaccuaagugcacaagugcaggugcccaggaggcccugagacaacccccccuccccagcugcgagccuucuccgguggugcugggaaucgaacuggaguccucugcaagaacaguaugugcucuuaaccacugcaccaucucuucagcccccucuaguucuuuaguuuguacauaaauuagcaaguucagggaaugcagaagaacuggccaggggucagagccagacuggaaacauuuuucaccaaacaauagcuacaguguucauggcgugccuccauugaauacuaaacuagcuguugaugugugacuuugauuuuuaaucuuugcaccaacuuuaguuacuauauagauaauuccauuuccaaaugauauauaguggaagcuuguaaaagcugcuuacuaucccaggguccccagccgagaucuacaugauaaagcuacucucaacccagccuacauucccccucccugugcucagcccuaccugggguuguucacuuucaagcucccaggaaggaaccugagcgcucccugcccccaugcaguccauuucuaucucugguccuuuggguacuuggagccucaagcuccugacugcuaaugaagccuguaacagaagggcauuacuuacugcccgccuugugcucccuugaaaucuggucaccuggagguggaagugggcagugcuuccgugcuuccgugcuuccgcuuucucccagcuccuuuuaaucacuauuuuuuuuuuuucuuuuccaaauuacuaccuaggaguuuucuaguaaucacuuuggugggagugggagggggaguggaggcaguuaacucugugagugccaaggacaguuguuggacggugguagugauggaggggaggguguucacggugagggaacucuguggaguuacguagcuggcaacaauggggagagacggagccgcaccaccacagacgcuuugcaugagcaacuauuuuguuuucuguagauguuuuccaaaccuuaaacucuguuaagucugaaacugggaggggaaccucuccaccaaaaucuaaauauggaucagagauaaggaaacuuccauagucuccagcucccucccugacucaguggccucugugaccaacuccacgugacucuaguggacaccuuccuggugguuuggcuuuuuuuuuuuuuccccauuucaucuuuuaaauggaguuuuccaugaauaagaauauaaaacugcgggggcuggugagauggaucagcagguaagagcacagagguccugaguucaaaucccagcaaccacuugguggcucaccaucgguaacgagaucugacucccucuucuagagugucugaagauagcuacaguguacuuacauauaauaaauaaacaaaucuuaaaaaaaagaauauaaaacugcuuccuucccaacaggccuuggauaguuuugucugugggaacagcuucccauaggaaaggugcuuuugcuacuuccgaccgucacacacuccuccucugcaccccgugagggccucccaggaguuuuguguuggucacaagccuccccaugucccaagggggucuggagagggaucugaggugguggaaagugcuggggugccaaguuaucagacaaugggcacauugagaaugcagguggggccaggccugugugggcuggagcagcugucggagccucagggggugcagcucaugcgcagagggaagaggcagucucucugcuggcugagaggggagggccacaguaagcaaaggaggggggugaucccccccucacaagauuccagagcaaagggauguuugaacgaugacucacaugacaggggcggggucugugagcaaacuuccuguuggaagcuuguucuugguuccugacuguccuucccaggucauagagacugucugcaauagggcuggggccuguuaggaugccaucgaggugggaaauccuggagagcuuggaguagccagcaggcccucuucccucuccugccccaggcuagcuggaaacccgcgaggaggaaggguguguuguucccuaucccauggagaggcuugcauggucagaccaggccuggugugaccucuggggcugcucugugacugcccuguucugugacugcccuucucccucccagcccuccccuuccauuugcuucuagauucgucuaggagcccaucucagcaaauggcagcauccucgcuuaccagacaucuuguuuguuuguuuguuuguucauucauucugggccugaagauggagagcugugguaggggagagcucagaggcugggggcagccuuaagggcacagccaggacggagccucugagcaaagggcaguguguguagagucagguagguggugggcagcaggagacaggaggagcacagagguagguggcacuguacagaggcccuggcaccauuuugugacaaggacucucagaccccucuagccuauucccccacccccacccccauuacaagcaguagggucuuaauagcuaauggcuuggacaccagccucuggcugcucugguucccagcuggucagagcccuuguucuccuuuggguucugauccagguggcacagggugggggcccugauucacauucuugauagugccgcuagguucccugcuaccagcuggcacauucugucuuccuuuccagcagguacuuggcugggcuuccugcccagcugcuagaccuacuguuaggucagcucauuggaugcuuccuccaggaagccuucucuaaucuccauucccuuggcuucuuuucaagagcagaaguucacuggcuucuccuguuuccccagaguagcaccuggugucucaaguacucgcuaagcaguuaggagaggugugaacugggccucagggaccccagagacaggaggggaggucauuacaggaaagucggauucuuuuccuggcuuuguucuuauaaccaucguguguguguguguguguguguguguguguguguguguguguguguguguguacguguguguacguguguguguguguacaugcgugcgcgcacacgugcacgcggcugaugcccucuuucuggccacccuuuauuuauuuguaauauuuauuuauuuauuuauuuauuuauuuuugguuuuuuugagacaggguuucucguauagcccuggcuauccugaaacccacuuuauagaccaggcuggccuugaacucagaaaucugccugccucugccucccgagugcugggauuaaaggugugcgccaccacugcccggcuucuguucacucuuaagcguacccaacagcccauccugcaccagcccagagagucugcagaguccccugugaaaaugugggcaaccuguuccuccuggcaucagguggggaggagaggcagauuaugcagaaucaaucaauagcaaucaauagguccaaugcggaggagacaaaggauugagaugagacagggggcgucccacguccaauuccuuuauugcugcaguccuuucugccccucuuuacaaacaggagacugagguuuagaaaggcaggcuaggguaguggguggaagggugaggugaaccuacaggggagacuaaggagccagaugaauggggaaagggaggcagccucuuaauccuuuugucuguagcuccaucuuuggaaaugcugaguaauuaaucaauuguuaaagggcuuucugccgaauucuggggaaagccuuuacuuuuaaugagcugcuagucugucucuucagugcugggaaugagucuagagccaccugucuccuaggcaaacacuuuacugcuaaacuacuaagcucugcucccccacacuccggguuagccuuuacaucuguaucugucugccucuguugggauuucaggugugugccacccccugugcuccucaguguauuucuacaggguggugguaccuaaggaaaaauccauuccuagggacucugacguaaauauuugggaugaggucugucaaggacugggcauuuuaacuucacuuauuuuuauagcccugaggguggacaugggaccucuuguaggcuagguagguuuccuuccuuuuuucuccccuuuuguuucuuuuucuuuugacagggucuuuacuagccuugggcggucuggaacucacuguguagacuaggauagccucaaacuccuaacggucugccugccucuaccucuuggccuagggcuguggacugucuuuuugguccuacuauaaggaucaucuggaccagaacgcacguucucaagccuacgcuggggagugccucaccuagaaagcuuaaaagcguagacucucgcuggaugugguggcucaggccuuugaucccaguacucaggaggcagaagcagguagaucucugugaguuccaggacauccagggcuacauagagagacauuguuugcccccaaagcacagacccugacaggccuguccaucuuaaggaacggaggccagagaccuguugguaguugaugguuugaugguuuauuuagaaacucucccugaugguucuugacuuggggagugaggagaagccacuucaaguuguagacaaggugugugugugugugugugugugugugcaagugugccaauguguaagugugucuguaugccuugcacacacacaguuguuucaagugugcuauguagccaaggauaacacugaacucugaauuccccuuuaucuguuuaugggcacacauuuccccccugagggauauaaauucuccuugaaguguugauucaccccugaaguagaaucaggucuaaaguggggaugaaucucaggguccuuccagguagaaauguagggcaacaaugacaguacacuguacccuccuccucccuguccuucuccccgcuucuuuuuucuuuuugagcucugagugacuggaagucauguagauuggcuggucccgaucuugugccuuugcuucccgggugcugagagucguguguucugaagaacagauuuaagcaggcaagcaggcuauguaagaugugugacagaauuccagaguugaagaggcuggauggccaagggaccuggcucuguccauccagccuucagucugccuuuucuucucgcugggagaguggcuugguuaauccacaccagugggugacuuuacaaauuaacucccgugaccuuggacuguuccauccauaaacacggcucccuaguuuaugaguugcccagcccaguguuaaaaaucuacggugaacuaagcccugggagaagccagugugaaacucaaacugagcagagaccagaucaaacauggagauaagacagcuacaguuucacuuuugggcagggccaagaauuucaggacuuucuuuacuacagauggggcguuauuuugcuuuccuaugggugugugugugugugugcugauuuaguuuaugauucauugauuuugggguuugauagcaggucuagggaacacauaaugcguuacagauauuugauuuuaaauguauuccugguacuuuuuggggggggguuguuuauuguuuugagguuucucuuuucccccggcuguccuagaacucaugcuauagacuagacuguccucaaacucaagauuugccugcuucuguuuccugaguauuggaauuaaaggcacgcaccaccacugccaaguuguuugccugguauuuuagaaagggcaauuagucaugagccugaggguuuuucacauuuauuuguuuugcuuguaacaaguuaaccagugacagguuuacuuuaguucucucugucucugucuuugugucucugucucuuaucuuuccuugacaggggggucucauguagcuucgguugaccccaaacucacuauuuuagccaccagggccuuuagcaccuagucuucugacuguaaguccucugagugcuggggucacaggucuaaccuucucauugaggaaacuuuggccucuaucucuggucaucaauacugaucuggagaucucugagauacuauuacuguggaaggccauuugauucucuuaugauggagccugaugagccagaccagagaauggcuccuauuaggcucauaaacuggaaugcuuacucacuggggaguggcaucauuugaaaggauuagaaggauuagggguguggccuuguugggggaaguaugucacuggaggugggcuuugagguuucaaaagcccaugucaagaccaguguguguguguguguguguguaugugucugucugucugucugucugccucuuuggaucagguuguagcucucagcuacugcuccagcaccauucaagccaccaugaugauuaaugggccaaacuuuugaaacuguuagacaaguccccaguuaaacgcuuuuuuggauaugaguuccuuaagucacaugccucuucagcaauagaacagugauauuggacaaccaggagcgugcuggaaaagugagaaauuuagaauuuuucccagcagugggaauuuccuguguccugaugccgaugcccucuuuucaagacuaaacugagaacuuugcuccuuugcugcuucccuccuuccauccuuaccugcuccagugaagaauuuguugacauccguaucucaggcacaagggggaaaacaaagggaaaauaaagauaagaggaggagggcugaguggcaaagugagugccauacagcuuagaacucugcagaaagcagaccacaaauuugccucuguuccugccaggcaaaauaaagagggaaaucugaucagcccuccugcuggacuucagugugcuggccauuaguggggugccuggcuccuccagagaguucuugcuucauuguagcucccaccacucuaaugugcuagacuucccauuugcaauugucuuuacuagauaaccaacuaaugcuuggguggacaacauugcacaauagagggcagagauuucagucaugugugucaccaccuacacagcuccaugaggagcauuuuugcaucuuugcacucccccacuccccggguaagaucugucuuguauaaugcauagcauaacuauguaaugguggggauuuuacuaaugcuauucacuacccagcacucugccgccucagggucacguguuuacuauucccucugcugggcaccuuugccuuggcauauagcuuauaacuccaggcucuguuaaagcuucccccauaguggagucuaccacauaauaaaauguacaguuccuuuuucauagccuuuauuauaauccagcuuaauacuguaugcuauuugauugcuucuccaacauccccccccuccaaauguaggcuccuugaaggugcaaccugcuuuauuucauugguugcugauagaaaauuuucaagugauccuccccaccccgccccccucacacucgcugcaugagaucaggugcugggaauugaacccagcaccuuaccugcuacacaugcuaggcaagugcucuaccaucgaggcuccaggaauauggaucucucuccuuuucucuccccacuccuccaguuacaguucuuuugccuugacuucacuugaacuagcucuguagaccagguuggccucaaagacucaggcguccacuugccucccaaagugcugggauuaaaggugugccauuucaggcaucagccagagauuuaaaaagaaaaaaaaaaauccagauauaaaaagaauacuguuuaucuccacuuuuagaaaauuggggagggauauagugcagagauagaguaccuagcaugugggugguccuggauugaagagaguagucugcaagagaaaaagcaaaagagauucucuaauagaggaaggacuccaugagaagaguagaaagaagguucuagaacaaccaaggcagggagucuccagacagaaugagcacagugugccgagaaggaaaaggccaaggcccgugacugagauccuugagggucuguaggugcugcacaguuauggaaaugauauccaggguccagccucucaguucugaagacuggguaacugccucuguauccaucagcuucugccaagauggagugaugagucuguguucaaaccgauucuuccuucuggccaagcauacgguggguguggugcacuggugugugcacgugaguaguaagugagugcguuccuuguuccuucagcccaggagcuucuggguccuuuggaaacaauugcaggagaccagaauaacacagcucauucaucacuggguauggcucagcccagcaucuugugucagaaacgauccgaggggcauguuugauggggauuagcgcugcucucaauauccugccuuuuggucccagcugacucugacauuccuugcuggugaguuccugcucauuucaguucuagcccuggagcagcagucaguauuaaagcaaacacuuauucugugugucacagugccaaggggaacuaucacuauucugauaguauguuaacuuacuuguggguuuuguuuauuacuguuuguuuccgagacagaaaucugccuuccaagugcugggugcaaucuuaccagagccuuaccccauagcuucuagguaugcacuauauaguucauugucuugaaaccugauguagcuuccucaaaagucacuauggaaauggacugacacaagccaccggccagugggagaaugggguuugaagcuuagcgacuguaaguucaucauguaauguaggagggggaagugugguguuaguaauaccuauagucuuaguucuuguggaguugaggcaggaaaaucccuugagccuaagugaagaugagguaacauagcaggacccugugucugugugugugugugugugugugugugugugugugugugugugugugugugacugacugagauagucucaauauauguagccuugucugcccuggaacucuucucauggccuugaacuccuagagaucuuuuugccucuguuucugcuucugccuuccaugugcugggacuaaaggcauaugccaccaugccaggucccaggucccugucucuuuuaaaaaauaaagcagaaagaaacaccauacuuggggcuggagagauggcucagcgguuaagagcacugacuguucuuaugaagguccugaguucaaaucccaacaaccacaugauggcuuacaaccaucuguaacgaaaucugaugcucucuucuggagugucugaagacacacuacaguguacuuacauauaauaaauaaauaaauaaauaaauaaauaaauaaauauuaaaaaaaaagaaacaccacacuuaaacugaugccuuacaagaacuucguacguguuuuguaccuguuacugugcagcuguggucgggacaaggguuaucagagagagaucuaucugguagaguuugagcucuagaugucaguggauguggcaugucacgggcuucggcuuugugccuuccuacuuugcagcuggguguaauuuucugcauucaccugguguuucuugcagcagaaaucaucacacccauaagagaaguagccucugaguuaaucuuaagugagguagaccucugggcuaugcuuaaguuguccgcuaauucaucacuugugcuggaaggaaugugcacucuccaaacagaugcuguagaggacuguuaucuccaccuugcagugaagugaacugagguucugagauuuaaggacaaagguuccugucgggggaaggacagggagagguguguguggggggugggacugggagagaaagggacaggcagguuugagacagggcuucucaguguagccuaggcuuaccuggaauucacagagauccaccugucucugagucaugggugcuggacauuuguuuauuuuaaagauuuauuuauuuauuuuauaugaguacaguguagcugucuucagacacacuagaagagggcaucagauaccauuacaguugguugugagucaccaugugguugcugggaauugaacucgggaccuccgguagagcagucagugcucuuaacugcugagccaccucuccagcccaggauauuuguuuuaagagugauagaacuaggaagcuggaggaauagggcagucgauaaagugcuuaccuuaaguucaaagacaugcuuuucugcugcugcuuguccuccuccuccccuucccucuuucucuucuuccuccuccuccucuuuucuuucaagauagggucucucucuacauagcucuugcuguccuagaacccuaucuguaaaccaggcuagccucaaacucuuaccugcucccgacuccugaggagacagguucucaaacagacccuuuugagacgggcuggacuugaacucuugaccuuccugccuuacuuauucugcuagugcuggcaccacaggcagcugccugguuuuguguuagaccuuuuuagugguggucagaggugccuugggcagcagcugcagagccacgugggcauagggaaaaugcccaggggcagggcagaggccaucagggcagcggagugagcagcucucauggcacgucagccuccaucguguccucggugugcacaugguuggaugcucgcuuugaguucuucuguaggaucuucccuuauccccaaauguuuuaguuauaaaaaaaaaaaaaaaaaaaaaaaaacaacuucccagaggugcaaggagccaccuccuucugcaguucauucugugaauggagcuuguugcuuugugucaggcauuugcaagugcgggucacucagagguugagaaguccucacccuggugcuuccuggaggcuggggggaggagggcagcgggauggggggaaagguuggccucccaagugcugcaaugaaagucaggcaccacuacaccuggcuaauuuuauuuuuaaaaacuucuguauauguguggccaugcacacauuuagaggccagaaggugucggauccccagagguggaguuacagauggucaugagccaccuaacaugggugcugggaaccgaauguggguccucugcaagaacagugcacaccuuugacugcugagccaucuuuccagccccagcuuguucaauuccaaacaauaagucaguauuuaggaaaacaaagcauuccaugagucaggauaagaugccugaugccccuucugaaccaugcugcccguucucauggguaggagauuuacaguaucauuugcugucuaguccauauucaaacacccccaacuaucccaagaauguuuuauuuaguguaggaacuuaaacgcaaggcaucucagacaugaccuccaauucuguacagucaagaauguaaagaaggggagguaguccugccuuugaucagccugccuaucccucuuucuucucccucuuggggguugagccaggaagcaucuuauuggauuauaggagucaagauucugguuuuguguuuuuaagcacauggauuucauauaagcuacaucuaugcgcacaaauagccacacacagagcucaaguuuguaauuuaaaaagacauauaaugucucccccuguaauaaaggcaagcuggcguuucuggaucugaagugucugguagugucugcauguuacuuccacaaggaacaaagggcuuugaugcagaugcugcugcaguuagucaugaaggucaagcccccaggucugucuguccuuuacagacuucuuuccucaaagcgggcaaucuaggagagaaagcugauucuguuugucccuggaggcaggccuggagcucaacuguauagaccaggcuggccucagacguguggcaguucugccugggccucacgugugguggauuguuuuccauccagguuuggagucacaggcuuguaaucauaaaaguuggaagugcaguuaguacacugcagaaugguuuagcagcacagcauacuuacugcucagcagaggcaagaggaacguuggaaguuugaagcuagccuaguccacacagugaguucugguuuauccagagcucaagcugugcuugucugcuguguaugaaacccuggacuuguucugcagugcugcauaaacuggucauggugguccauuccagcacaaggacauuuuugcuaagucguaagccuaggcuacaugaggcacugucucaaaaaaaaauuuuuuuuuuaagguagagaauaauagagaagggaauccagcaucuacuucugcccaaacauauauaucuucuucacucccaggaacacacacgccacaccugaaaacagcuauuagcaguacuaggcagggaacuauaugcauaccucuuagauggcugaguuuaaggccaaccugggccacgcaggcaauucaaagccagccaaggcuaugcauauauagugaggcuaucugggaaagauggaaaacaaaugaaacaucagacugaggcagagcgggacacuugaccucucacgucacaagcuucuggacuuacaguggguaacauccugcuaaguuggaagugcaguuggaacacugcaaaaugguuuagcaauacagcauagugcccaguggccgagugcugcaggcugcagacugcuagccugggacccagaugcaaucuuuauagucuccaucaaacauguauuacuugauuuugaacugccguacaaauagaaaaaaagaaaaugcuagaccaggcaccagaugugcacagaauacccagagcaggaaggaugaguggccacaggggaucggaggagaccagcuacugggcacagaguugccuaggggaguggccagggcguucuggagguagaaacugguuauugcuacacaagauggagacuauauccaaaccacugaauuuuguguuauuaacaguaguuuugauuuuaaaaauugauugccaaggacaaauacuaauuacuuuuaaauauuaccuaccaguuuccuuuugcuuugcuuuuauguuuuaaaaauuauuuauuuuauguauaugaguacaauauagaugucuucagaagagggcaucagagaucucauuacagauggcugugagccaccacgugguugcugggaauugaacucaggaccucuggaagagcagccagugcuuuuagcugcugagccaucucuccagucccuuguuuuuguuauuauuauauuuuaucuacuuuuggguuugugucugugcacacauaccacguugugcacauggagguuugaaaacaugagcgucuucuccugccgucauuuuacuuggcugcaugccuuugcccgcugagccaucuugccagccuuuuuauuuuuguuuccuuuuguccuuguugagauagguucucacuauggagcccagacuagcuuugaacucccuacuccaaccuguccuaucucucaggcaaugaccuaaaccaaccagugagucuuccugggcccaccuccugugaggaacuuugcuuugcagccuuuaaaacaaacaaaccaaccaggauucugagaagccccagcuaccugccuagauacaaucgauauguuguauauucagaaggaggccagggcuaguggcuuuccaggagagccugcacugauagcuugagaggguguuuaagagagaaagcuugagagugacuggccugaaguacccagucagcaaaaaagaggcccauuaagaaugaagguauuuaaagcuggcaucaauggggagaguuggguuaaugcacgguauuugcaggacugacuagagaaagggcuuugcccugugggccaccccccagccccagccccacccccaacccaacccuggcauccugugagaagccagggcuuucucugggagcuacacccaaaggcuuugcuuuuuauuuaagcaaaugaaggccuuugugggauauucagauggccuuuuaaaguucugccagagccaacaaagccaagguguggagccaacaucggcacagcucuuagaagcaguuccugcauuguccaaguacccagaggcuccuucuaaguggguccugugccagcgccaucugucccaucagcacuuugguccucuaccugcccugugggauguguugagcugcuccagugguuugucccaggacgugcugcccucccuccacagugcugcccccauccgcaaucuacagcaaugcaggucggccuggagggauuccucugcaggugcuuagaggguuuggguuaaagggcugguauugggaauagccagucauuguggccacaggggggggucuccagaauuuucuuauuucacuuccaucuucaacacuaaaaccugggccacauuuuuaaaaaggguuuuucuuuuguguauaugugcaucuguguacaaagguguacuagguccucuggagcuggucuuauaauugguugugaaccacacccaacgugaaagcugggagcccaacuccaggcaggaagagcaggacaugcucagagugauggccgucucuccagcccccuccccuauuuuaauccucucugcauaucucuaaggcagggauccuuucugagagucugaggugcucuggagaauuaccaguccaacacuguggagccuccaucugaauauccauguuccauauccauguucuuagcauuucagggacucaacuuucucugaugcccauucuccaaccuaaguaaacccuggcuccgcccacuccugagucuuuacggaugggucaggaaagcagaauagcuacccagggagcuuccuuuuauguccacagauucguuuccaaguggucugggaagggaguggcuggcacgaacagacacuguucccugugguaccgaagcuuugaugaggaggggcggggacggaucagcuuccccagaguggagcugugcaggcaccccccacagguaggggcagccacgccugcaggcaggggugaccaaggcuuagggugugcacugaggccagggagcccugcugguugcucagccaccugggcgccaccuacccugaggcagcugcagaaaauucuaguucugccaauugggccacugcaguguaaucacagcagcaauacuuaguagcucacuucauaggcucucccuucagauuuuuuuuuuuuuuauagagucuguaagaggcagugacuuuuuuuuuuuuuuuguuauuuugaaucaguguuauucuguagcucaggcuggccaagaauucacccuacaauucagguuugugacaaauuuccugcuucagccuucagaguguaggguuacagguaugacuuaucauccacggccauuacgucuguuuuuguuuuauguaucccaggucacccuuaaacccuguguagcccagguuggucucaaacuggaauagauuuucuugccuuugccuccccaaugcuacuguauccaacuuucuguuuuagaaagagggcgaguggguuuucccgaugccccacagcuaguucagauuuauccaaauuccaaccagcccuggcaguagcguggggcaccugugcuaaaagagcaaagggcuuugguuaggggcggggcggagugggcugguccaaucagaggucaacaaaggggccuucaggaagggguagguccaaucagaggagucucaguacaggaacagcucuguuccuuugcuaucuuuguuuccagucucugcuggccuuucucguuauccucaggugcccgugugacuggcccuuccuggugaagucagccaugaacucuuagcgcucaggauucuucuccguuucugucucucccuuugcagagggccacuuacuaucauuaccccugugccccgggacuagcuccaggggucaaagucccucuuaaagccugacuuuuggaaagagcaaaacaucaucuaucauuuaugucguuagauugcagcccugaagauguucuuaucaaaccgcaaagaaucugacggaacccacaggcucccugaguccuuaaugucuucgcccgauaaugcaacugagacccacacucaggguuuuggaagccaugucacccaguuguuugcuguugaccacagguuccucauucaguugggcucucaguuaaagacaaggaaaacguuuguuacguaaagagaggagagcaaccucuuuacuuacuuagauugagugugcauguauuguaauggcacaugcaugugagaguguaagugcauguacccauccaugcuuacacacauggaggcuacccacaggaucaggugccuuugcuguauuccuucuuagccuuauugucuuaagaaagguccucucggccuggucugcaaagccaguuccaggacagacagggccacaacagagaaacccuguccuggaaaaaaagaaaaaggaaaaaacaaaguuucccucacuaaauguaaagcuggcugggcagccagagagcucuggaucugccugucucuguccaccccagugcugaggucacaggcaugcaguuauguccagcuuccuaugugggugauggggacuccaacacaggcccucaggcuugaagagcaagugcuuuggaccacucaggcauucccucaccccugccccccaaauccaauuuaaaugauacaggaaaagucccacccccuuuugcagugguggggcuugaacccaggaccuccuucaugcuagggaagugcuuugcugagucgcaccccaccccuuuuagccuuuuuuuuguuagaagacauggucuuucuucuguguagcccaggcuggccucaaauucccaauucuucuuucucagucaucagaguggugggucccgggugugccgccuuguccuuagcuuuucuaagacaaauucuucucauacaguuccaugccauacagugagacccuguguagccuuaacuguccuggaacucucuguagaccaggcuggccuugacucgcagagauccaccugucuuugccuccaggugcugggauuuguuuguuuguuuguuuuuauuuuguuuuaaaacagggucuuuguauauagcuuuggcuguccuggaacucacuaugaagaccaggcauuugccaccauaaacagccuagcugcauccuuucgaauuucugcauccuuuccuguugagugugugagaucagcccuaugccuugcuguuuauguggcacugagaacaagccugcccugacguccuuguucagcuccucuagggcaggugccggagucuuguggauugaaguaggaaaagaggauucacaaguauaagaucuguaagcauagccagaauagccuccaaccauuagacugagccagaugugguagugcauuuuuauauuucuagaacuugagagaccagagcaagaggcaggacuauuggagaguucagccuggcuacauagugauauguugcccauccaugcuaauaugugcuugcuccagcauccugugcccuugagcccacaucugugcugguucagugcagccucugugccuuacagaugaacgcuaggaaggguguaggaggagccaggcaucagacguggcuucuguuauguuucucuuuagacagcccacagcggccugcgguucccccuccucuuuggcucaugugugggucagccucccaacugccucaccacccugcagauguccuuccccacaaggacuccucaguccugugaggcacagauucuagggacguucucaguccccaggggguggccagguaggaccuugugugacuugcucccaaguccugagcauuugcaaaaaauguuuauuauucugcuguuuguuuauugagaugggguuccauucuaaaacucaaggcugguccggagcugaccuggagcucgcgacaauccucuuccugccucaacuuucccauugcugaccuuacaggcgugagccauugugcccagcacugacauaauguauuaguguuugcucaacgccccggugugaagagcuuuauuuaucuuacagcugcauaauaguuugccccaagaaaaugccaucauuuauuuaguuaauccugcacugguggcuccuuggguugucccccaggcuugugcuuugcaaacaaugccuuagugagaaaccuugaaugggaauuugcaugugugcaaguuuccaauucuugauuccaucggaaacugggaacagacuagguaaagggauaauggagucuuuugaaagagucgcaggcauggagguaaaagauuugagaagcucaucuggggcagaugucacagcacucagacugugguaucuugaguaugugaccuacggcuguacgcuauuguacacuaaagccugcaucugauaucugcagccuggucuuuuuuuuuuuuuuuuuuuaauucgcuguuaauuguuacugucagaguauuacuguggugcccaggcuggauucaaacucacuccagccucugauucaugauccugccucugccguccagugcuggaaucacuacucguggugaacagggcuaaugaugagaaagggacccaccaaggucagaaaucaaccaaaagcaaccuagcugcuucuacccaguuaggguugaaguugggcucggagucagcaacugccccccagaaagcagcaacagucuccuuuugaagcauaaaaucacaagcagaucaauauucaggagacaaugaagaaggaauucauaaauugagguuuaguccugcgaugugacucuuuauacuauaggcccaaggccacucugaggcaggggucuuaucucaacuuuuaugggguuaaugcaggucagguuuuacuguaacugaaaggaauguagggcuugagggcuuguaguaaaaagggggguggcagaacaauaauacacggcguuacucugggcucuucagugguacuccccccaccuuuucggugcuacugagagguuugaacccagaaccucuggcaagcugcuaagcacuguaccacugagcuaucgccacagcucuuccguuuccuuuuuucacguuuucugaccuugaauucuuagaauguacgucccaaauggagauaccuuccccuccuccccucugagggacacggcauuguuguggggcuuauuuucugaguaaauuaccuuuccaggcaggcuguguaggguuagcaaacacucuuggaagcagcugccuuucccaucaaugcuugcuuguuuuggauaaugaaaaaugaugcuagcauccauuaaagaaaaagccgccucuuagaagcgcugguggacaagugggugcuugucacagagucaucugcugaugcaugugaccuggagaacgagaaacggccucucucugugacuuggacuccucgacauucuuugggucuguuuaggaguuuuguuuaaaggucggaggcggagggucuccgcuccuccggcacagcccacauuuggcaagagcucaggccucguguucuuccucuguagaagagguuuucacaucucauucuugagcuacugaaugaaccgaauauucuggauuuccaaucucagcaacuccagagccugaggcagaagaaccucuugagcccaggaguuaaaggccagccugggcaacacaggcugucugaaacaaaaguucuuacuuccauggcaacuuccccuguucucacaugggcuguggcauuucuguauucuuuugugcuugggaagugcggcccuggauugaugaguguuucugguuggcugguucuguugacucugagcugcccccagcaagaaggugaucagaagcccaaccucagcugggcacaauggugcauuccuuuaaccgcagcacuugggaggcagagaagcaaguggaucuucgugaguucaaggccagccugaguuccaaagagacuauuucaaaaccccaaaagaaaaucagcuuaaaaccaaaaagagaggccggagagauggcucagccguuaagagcaccaucugcucuuccggagguccugaguucaaaucccagcaaccacauaguggcucacaaccaucuguaaugagaucagaugcccucuuccggugugucugaagacagcuacaguauacucacauauaauaaauaaauaaaucuuuaaaaaacaaacaaacaaacaaacaaacaggagccuggcauggugguguauccuuuuaguuccagcacucaggaggcaggggcaggggcaggggcagggggaucucugaauucaaagccagccuggucuucagagugaguuccaggacagccagagcuauacagagaaacccugucuugaaaaauagaagguaaacaaacaacaacuauacaacccccagaaaacccagauggcucccaguguugccugugugugcaaguaugagugugugcgugcacauguguguguacacacgccauguacacacacgccacagugggaucuggaggucauaaaacaauucacuucaugcuucucugggguugaacuuggguuuucagguuuggcagcagguguccuugccagccaagccaccugucugaccugccuauuuuguuuuauugagacuguagccuagacaagcuuuaaaaugucugcagaugacaaugaucuuggucuucuugucuccaccuccacagaguuuggauuacaggcaugugccaccacaccuggcuccucguuacuccuguaauuacuguuaauuaaggacuguuuaugaccuugucauucuccacuucuucacagccucaguauuauuggguguguagacuuuggcucaugggguaccccucacacgaaacccuaauaacuauauuucuucgaguucguugaguuguaauuugcacaccuuacaauuugcccaguggaaaugcguguuaauuuuuauaggugcacucaguggcucacccgucacccggauccaguuuuagauuugcauuacucaggagcccccuuugggucaauuggcaaucuaauaccugccuugccucagccccaggccuccgugggccugcuuucugucugcaauguguccuggcugaccugaacucauucauggauguaaacuaggcuggcucagaguucugcaagccucugccuccugagugcugggaucaaagguugcaugugccaccacaccccgcagucucuucauuuucuaguagcugcguaaauaagacaaguacauuuuugggugagcacuuaaugcuuaguguaguugaggcuuuacauaccugugcuuuugggagggcuaggaauguagcccaaaggcagagcgcuggccuaacaugcccaagggccugcaugcuacccuaaacacugcaaaaggaaaauguggcguuucuauuuguuggggaguugugaguugccauagcuuaauuuauccauccuggcaacaauagauucauuguaagacuuuuagagguuuguuuuguuuuaaaguauaggugucugcaugugugccuggguguuugcaugugucugcaugugugccugaguguaugcacgugucugcaugugugccugaguguaugcauguauaccacaugagugcaugagcccucaggugucagaacagggcauuagguccuucagaguuggaguuacagggugguugugagcugccccaggguucugugaaccaaacucagguccucuguaagagcagugagcacucuuaacucuccaguuaacccuccagccaagccaucucuccaucucucagccaccuuuuuauuuguuuuuguuuuauaggcagauuugaaaagagaagggggagggaagagaagagaaaaguauuaauucacuuaucacauaucauucccauuucgcaugugaaucaaaugccuuugguauaugaacagaauuugcaaccaucccccaucaacuugggagcguuuucauggguacuagagagauggcucaacagguaagagcguuugcuguucucacagaggaaccggguucuguucccagcgcccacauggugguucaccaccaucuauaaccccaguucuaagggaucugaugaugccuuucugugaccucuguggcauuaagcauccaugugguguacagacagacagacauggagcuaaaacacucacacauugaggaaaaugaaaaaaauauaacauauauuuaguuauuaaaaaggaaugugccccuugccacccgccaucucccaaguccuaucuguagaucuuuuugaucugggacguucgagugugacaaaggaauggcacggggucuguguggucuuuugugucauucagcaucugcuaucuccacucuggcauguuagcuaacgcugcaguuucaccuuguaacacucccucccacgcacauacagaaggcauugcuguugauauucaaaacuaagccaaaucccagucggagugcaaaauagacguccugacggagugccgucacuuuagaacccagccaucaggguuaguaaguggaaggacuauguucucacuuuccauucccggacaagggagugaaggaaauuccccaaacccagcaggucaggcuggagaaagacugugugggagucgucuauauucaaccaguguuugagcccuacucuugccauuuaugcugugugaccuuggaagaggcauuuaacaucucugagccuuugcugagucauguuucccucuuuaugccugaugcaaugacuuacuuacuuacuuuauuuauuuauuuauuuauuuauuuauuuauuggugauucuuugcucacauuggauucuauaggagcuuggagaaaauuuaagaucugccaauuccugggcucuuccaucucuggauaucuguauugaguuaguuggaguuaggacccaggacuggguaguuuucaaagcacaccaggacaguaugugcacuguacaccagauccgagagggugauuauaggcauuuuggucaacaugcuuuaguccccgagugggacuggaggccugagagcucauaaggcuacauuaaggacuagagagggcuaggagggccuggcucagcggcacucaggccugccugccugccuuuugucgggggguggcagggguugagggugggggacucagcuguauggaauuuagaacaggauucucucugggcuugggaaaauccacagaagggaaaaguagagaagcagccuccuuccuaaucaauaagcaaacaagucguggagucgcccaaacagccacaggaaugcuccgugggcuguagccaguggcagugccagagagcaccccuguauuuaggcaguagggugcggugguauugucugcuugcagcuaaaagccaggacaccacagcccugacuuggcaugaaagccaaagguuuuuuuuuuuuuucuuucuuucuuuuuuuuuaaaccuguaugugucucccuuugucugcuggugucagcugggccagaagagaggauaucagauccccugaaacuagaauuacaggcagaugugagguaccuggggagggugcugggauuugaaccacaucuucagaagagaaguuaagugcucuuaaaaacugagccagcucuucaggcccauuucuggccccacccuaucccuauuacagcagguagggacaaauuccccaucuucuugcaccggauuucaguuucucuuaaaagaauugccuccucaccggacagugccuccaggaacauugaaaccuggguuguggacacuggacugucuaagaggggccuggagaggaaaaugacuucaagcugcuguuucuuuuccuuggucuugacaugaaggacaaguagauggaggcgaucuuggcucuuuagauggaggagaucuuagcucuucugaacugaaggaacaggggccauugcugguugcaagccuauguagacuucaauaccuaccagcuaccguaacuucaauuccaguacuguggucacaucugcuguguucucaccuggcucuucugugcagcacccaggcugugacaggcacaaggagcuugggugggucuucugcacuacccugugccuuguggcuugagcaugucucuggaaguccagccuucccugcuauccuugauuaaaucagucccacccaccuuggucccuguuaccuucucugucugauauguguuuguuaccccagcugccuugggucacaacucuugggaggaaagaaacccacauauuuuuugagaaagaauccuuacauucuugagggggugagugggggaagugccccuuggcagaggugagcugugguguaaaagagaggcaagacuggggccugaacccuugaauguguuuaaccacauucaccaagcugcaagacuauuaacacgucucaugucugaggcugauggcagguuuuacccuguugauuguaguuggcucacuggaguuaccauggagcuuggaacacauggcgagguagaaccugggcagauaaucacugccccaaugucuacagucagcaugaaugaccuuacaucugggggugggggggcaguccugggugaugauggaguguccuuuguccuguuuacucucagaagucaggguuaaaugagccugagugaauucucucccuucugugccuuugcugggcucuccuugcugcacuccucuggguguuaucccuggccuccuuugagauguuuuuguugauguuguuuuuugagacagagucucacuaggaguccacucuaggcuccaacuugcucuguagccucuugauccuccugccuccgaguguuggaauuaaagggguaugccaccacaccuggccuccuggucugaauuagugaaguuagugacuuuguuuuggaccaggacauuuaagagaaguugggagaaaaucugguaacuuuaaugcaaauaaguuuccuguccuuggaaucccccccccaccccagagucuccuuucaacacaggcgcacauaucuauggcauuaggaacacaggcuggggguuugcuuguguaguaugaccuuucgagcuccugguccuugcaggaguggggaugggugaccuauuaggggaaauacagcuuauuucaguuuaugacaaguggugacauaauguggagguuuuguuuguuuuuuucuuucuuucuuuuuccuuuugguucuucaagacaaggugucucuguguagaacucuggaacucuguauaagaucaagcuggucuugaacccagaaauuugccugccucugccucccaagugaugggacuaaaggcaugcuuuguaggagggagguucuugagucuggcuuuagacuucuuccuuuguucaaaccucuucuguuaguauccuugugguucugaggcccuugucuacggaaugaucuuuugcugguagcuguagcuacuuccuguuaaucuucacuuaauagccagguaaccuaggcgacucgccacaguguagacagagaccacagccucuugucuguuccuagccauguggcugggccacauccuuuaccuaucuguguuucugcuauuucauuugugaacaagaguugcuaaaugccuccuacuguauacgccugacuagguguauccaacccagggcuucuguaccuaauaaacagaacauuauaguucuugucuucagcuuucaagagauggacacaaauagcgaccuaucugagugaacccauguguccuuggcaacaaaggguagcuuguccaugcccuguuucuuucuuucuuuuuuuuuuuuuccauuuuuuauuagguauuuagcucauuuacauuuccaaugcuauaccaaaagucccccauacccacccacccccaccaugcccuguuucuaaagcuauggugacaucuccugcgggagugguuguuucacaagcuuguaguccuuucuaguuuuguggacaccuaucaaagguaucaucaaccucauacaugagacauguuaauauuuuacaucaaaggagggaguuccggcauugcauugcccaaugucaucuaagaaaaugaccuggggggagguuuucuggguggugacaucugugaagacuuuagaaaggaauacugaaccacaaaacaagagacugucuacuccuguccccucauccuucaggugaaacuuuuuuuuuuuuaagauuuauuuauuuauuauauggaaguacacuguagcuaucuucagacacaccagaagaggguauugggucccauuacagaugguugugagccaccaugugguugcugggauuugaacucaggacccccggaagagcaaucacugcucuuaaccgcuaagccaucucuccagcccaggguaaaacuuuuugucuucuggucuucagaguuugagucagaaaauacagagguauuuuugggauacacaguagcaguguagcucuguaacccuggagcucagaaggaaaacucugaucauaccuuuguuaccuugagccaaccaccuguguauaaauaaaugguccuuuaaguauagcugaacggaggucucagaguugucuguggaaccucucucgucaaggauacucagagaagagguuugaacaaaggaggcagucuaaaaaaagaaacaaaacaaaacaaaaacaccuguucuucauguccugccuugugcaugguaugagcaggguucuauuuucaaacaguuucccagagacuggaucaccuauuaguugcuaaagcgaucaaccaugguuagcugcccuuggugacaggacccuguccucgagccccagcauuuucugugauguucagaggcuucugagauuccuugucucuacccacucacauuccagagauggccacccuaguggaagaagaaaugggauccuucaagugaggcuggccuuggcucgauggcaauuacuggaaaagaauguagcgaaggcucgcgcuugcccgcccgcccgcccacccacgugaccagaggcuuucaccaacccugccuuuuauuuguauugaauuauguccccaggguuuucugcuguuagcuacuacuucugccaagccugcuaaaagauggggugcuuacaaugaauauaaaacuuaggcauacuaaaaagacauucuugguuuuuugucauuuaaagaauuuauuuuaauuguaaucaacaaagaaacaauaaugucacacacacacacacccuucuuggguggguaguuugaggcagucugauguuucuugggcuggccucuaucuaaucugcuauguagcccaggaugaccuugaauuucugguccucuuuccacuuucaagugcuaggauugagaccagcccuccccugcccccuauugguaauuuaacucaaaacuuuacacguguuauaggcaaaugcuuuacuacagagcuguauuuagggggaaaaaagcccaccucaaccccucuucuaucaguuuucuccaguuaucauucaugcccaugauagagguacuagcacgggcuagucuguguaugcaaaguuuucgauugcauugccaacaauugggguggggcagggacagucuugaauagcagugaagagcccucauuuaggggugaaccaauuaagcucugaacucagcaguguauaauuucaggaaaagaaagcccaugcugaaggggccucagcaaggcugggaugggggcagggagaaguugcaccaccccuccccaguagcucaguggcauaucaguccaugggauauauguaacagcaggagcauaaagcuaaccccaugagguuguccucugacccccauauauccccugccacauacaccccugugcacauauauaguaaggggcuagaggaugaaaagaauuaaguggguaaaaaugcuugccgcccagccuggcagccugaguuugaucccagggaccuacauggaaggagagacuugaugccugcaaguugucaucaucugaccuacacacacacacacacacacacacacacacagagagagagagagagagagagagagacagacccauacauacaaaaauaaaagccuaaggaaauacaaggcaaagaccaccaccagagcaaggacccucuauagagaggcaaggaaugcaaucaaggagcaagagaucucagauugccuucgucuaaaucccagccuugccgauuuccgcaucuguaaaaagaggaugugccagaggcgugguggcgcacgccuuuaaucccagcacucagaaggcagaggcaggcagaucucugugaguucgagacuagccuggucuacagagugaguuccaggacagccagggcuacguacagagaagagacccagucugaaaaagcaagauauagaaagcaaagcauauaucaacuguauaaaguucuggguuugaacgguuuaauguuuguaaagugcuuaaaauggagccuggaacgauaguguucugcaaauauuuaaaauguggccaaaguaguugacaagaguaauugaaaguauuaguucagacuuuccaaucaugggauugcaggugugcacuaccacacccaguuugagguuguggaguuuccugguaauaauggugaugguggugacuacugugguagguuuuccaauuaagagacagaugcucaggggucuuaauucccauggggaccagugcauagcacagcugguuaaggaaaggugucccacugggugagguugacuuagucccuuggcagcuuucuuuauucaguaccuuccccuggggaaacaucaaugcacacccagcuccuugggcugaucuugguguucucagaguucugcauagcugagcccgguggaagacaacuucuagaaccuuccuggagccagcaagccccuccaacuuucccuuauuucucagcccagaggaucugguuuuacagaaagauaaugagccuuaaccagcaccuggaaauucaggucgggccucucuugucauacuuacaaggugucacuucuccaagggugaggccgagucgccauuaagaggugccuugagcagguuaauugccucgcaccagguuauuuaccaagccucucagcucucuuuugcuaccacccuuggcagguccagucauguuccuguugguuuuucacuggcuagauuugugcgggcuggagaaaggaaucaaggccagcuccuguucccugcuuaugugacaggcccccaaagaugacucagaugccccucccccucaccccaguaccugugcugcagguugagaggguuucuuuaagagcaccuuuaaauguuccuaaucuggacuuuaaaagugcuaacugggaacuaggggagacggcugagccuguaaggugcuugcuaugcccugaagaaagucugccacucucaguguaggacuuguaaucucaguaugcacgggcagauaccagauggaguccuggugcuugcuggcuagccagccugucuuacuuguugaguuccaggccaaugagagacucuagucuuacaaaacaagguggauagcaucgacugcacagacagacagacagacucagucucucucucuuuuccuacauauccauucuucccauaagaaaggauaguugcuucaaguuuagacagauccuccugugacuguuaucucucauuugccuuuugcuccaaaguguguauuuuugccagucagacugguggugccugcacccucccucuucuugcucacugaaacaacauucauaucuauuuucucugucaaguacaggggcuuuuggcuucugagauguuuacaagggugaccccugguggaagaaaugagcacuguagcacaggcaucuccuccuggggcagaaaguguuccguccaccugaauguaagaggcaggggaguagggauuuucauaagagaaugcuuaggcaaaguagaaguuccguuguggggagugaugggcaauuguuugaaaguuuggaaaguaagcuaacuucugagauuuguugugaauucauucaaaugugcccucugagauuuuuuucuauuacacuucucuuuguguauacacacacacauacauacacacacacacacacacacacacacacaccccuuaugcccaugagcacagaacgucccauaugguaugccugaggaagucugaggauagcucacaagucaguucucuuagcuggguagugcuaguacacaccuuuaauccuagcacuugaggcagaggcagaggcaggaggaucucugaguucaaggccagucuggucuauagagugaguuccaggauggucagggcuacacagagcccagucuugaaaccccacuucccaaccccccuauacacaguuaguucucuuaucauuugagugaguucuuucacugugggguuccaggaguggaacucaggauuggcuguaagcaugcuugccugcugagccaucuaggugccuuggguuuauaaggcaggguuuccuacagccucagauuugcuuaccucuggaaauguaaccaguguuccuugcccccauaccuguuuuguuugugugugguguaugugugugggugggucugauguuugcauaagugcagguacagaugugccauggagggguauaaaggucagaggccaacuuugggacucuucuguuccgucuugcuuugaggcagggucucuugucucugcagacuuggcugcauacacugagcuagcuggcccaugagcuucugggugaaucucccaucuugcugcaggagcgccaggcuuauagaggcacauuaccacaucuugcucuaccugaguucagggguccgaacuuuggucaccaugccgcgcugcaagcacucugacccgaugagacauuucccggucugguuucauauuaaguaucucuuuugcuuucacucugaaaaugaaagauuugcuuuauagacaagauacucauugacgacuaagugaagaaaaccagccaaccaaucaaacaaacaaaaaaccacccagacuccaaaugucaguugcccuguauuugggaagaauuuaacgaugaggccaaggcucuccggguaggguuguucauugccaguuuguugaguuaguguauauuuuguaugaugugcuagaugaaucagguucccuuucuggagaagaaauguccugucugugaucuguccacuuuccuaaucucugugaucuccauccuguagugagauuugaaggaugcacuggccggccaaggacagccuucuuuucggaagacucccgauucaaaguggcgacagacggcaccaucacagugaagcggcaucuaaagcuccacaagcuggagaccaguuuccucguccgcgcccgggacuccagucauagggagcugucuaccaaagugacgcugaaguccauggggcaccaccaucaccggcaccaccaccgcguacguacuuggggguauuucuuagauauguguauauuuuucagggagcugucuaaucuggggggccucuagucuuagcacuggggacuuguugggcgagauaauuuuaugggaagacucuaggaugcuacguggcaucccugaugccuggaauaccugcagaagaaccuccauaaacucaugacucuuagggugggaguggcaaaaauaccccccauugaggacagucuuucguucugacugaauccauuccuauugggcuugggguuugcuguuggguucuguggcucugguaguauggggugaugaggaagauacuggcccugccuggauuguuagcccacaguugcuuucucucugacaacaaccccagugacaccagaggggucguuuccccugugcagacugagugaauuuacacacaggagacaccgagaucauguacauacacuugguauccacaaggaccaucuucuuccuuuaugaauaugaaaaccuaaaugcucaauaggggugaggauauuugccuauagccagcauguccugcugcgaaugcaccucuacauaagauaaugcucaacucaugacucuaugcgacagucacuguugcacccuuauuaguaagucugcauauguucugcgcggacagaguuguucucauaguuauuuugguuugagcccagguuggcuucaaacucauagacucuugaucugggacuguggguguguacuaauagguuucauacaggguugguucuuccucguuuuucucuuuuuuggacaggauuucuuauagccacgauggugcccagcucacuguacugcagaagauaacuucuaauuuuucauuuccggagugauaggguuguaagcuugugccaucacaccuggguuuguggggcucuagggauuaaauacauggguucaugcaugcuagacuuaguacucugccaacugagcuacacccccuacucuagauaccuuaaaaaaaaucuuguagaauccuuucugucccccuuuuuguuuuauuuaaaggaugguuuuguguagccaagauuguccccaaacuugaucuauagcccaggaugaccuugaacucccaauccuccaaaguuugggauuacaggcauguacuaccauauuuggcuuugaaaagaaaucauuucuaucugcucuugguugacuaccuaugugaaccuaagcuauggagggagggcugaguggaagguuagagucuuaucaaauacucucuguuggccuugccuuccuggagagagaaugagugucuuauuuagcaaggagggggaaggaagaccaguaagucuuugucccuuuuuagagcugaagagacagcuguagguuuggcuccccaaaccuccauuagguaccauagaacagccaggacucagcuguaggagacacaggcucccuuucgggccucugcagugcuuacacaugaauggugccuucaauucaugcaaacauacacagagaugauaaacagauugcuuguuuguuuuaagucuucuuugcacugucguuauguaagauccuucuccugauguuugcagugcugcucuuagguccugcgcagucccgaaaacccguacagugaagaggcagauacacagcuuguguguggucuagacucugcuugggaaugucccuggaggaugucaccaaaagccacauaaaugcuucuguccauuuugagaauggucucugggcacuuccuauggugucucucuaggggacauucuagacacgcuuugauuucugcucccgggguguggauugugccaaagccuuuaaaguugauuucuguucuguucucugaagacacuugagacuccugagauuuaauaaucccggauguaguuuuccucuccggaauuagagaagugaagaacuuaguucuguuauguuagucauggcuuccugagacccaagccccagcuugcuggcagucaagcaugcaugcauguucagcacaguaaguccccaccaggcaguugacugugggagcuuucuaagaccaacaacaguuuggagguugucuuugcccugguccccucacccucauccuccccuccgcugacuucauucuccauuucugccauaucaugauuugauucaagucugcauuuuggaaacccccaagccaggugugguggugcacaccucuucuguuuguuucguugguuuuuguuuuucaagacaggauuucucauauguagcccuggcuggccuggaacucacaguuuagaccaggcugucacugaacucagaaaucugcuugucucugccucccgagugcugguuuacauaguaaguuucaggccagccaggauuaugcugugaagcccuaucucaacaaaacaaaacaaauccccacuuuagauauugggacaguucucacagaagguaugugauccucuggagaccgagggggagcuauucugguagccagguagccagucccagagccagccuuuagcccaugcuggcuuuuuucuguggguaacagaugcagggaugguaagacugugugugugugacagguaugugagacugaguucuagaauacuuggucacauuuuaugucugucggucuuuccuguuuugauucuugggggcaggggggaccaauccagaagggcugaaaauguagcucaguugaugaguucugauuuagaguacaugaggcccugguuucuauacccuacuaucacauaaaugcacccaucauccauccuuuguugaguggaggcaggaggaccugaaguucaagaucaccgauggcccgcauaauuugaagccagacugggcuucaugagauuguuucuaaaaauguuccaaccaaacaacagacagacaggaaagagggccuggcuagaacuuggcaggcuguggucucuguugauguagugucuuccuguggaggguaaggaugagaucuuguagaaacuuuguuaccaggaaucauucuaaaccaauccaggaggugucgccuuucaucuuaggcuuuccuguuucccugagugugcaggaaguuaucuuuauugcacaugagaacuguucaaugcaagucuccagguaauuuuuguuuccuagcccagcugcuucuguuagaacaaaugcaacccuuacagauauaacacaauaagauuaacauguuuguaucgaucucagaaauaguucuuuuuuuuuuuuuuuuuuuuuuagauuuauuuauuauuauaucuaaguacacuguagcugucuucagaugcaccagaagagggcgucagaucucauuacggaugguugugagccaccaugugguugcugggauuugaacucaggaccuuuggaagagcaguuggugcucuuaaccacugagccaucucuccagccccucagaaauaguucuuaauagcaauuccccaaacucguugauugauagcuccacuuuggugagcuguaucccuagggaaacaaaagaagagaagccuagaacucccaaauagcuaguuacugaauuacuucugacauuaucaguguauggcuuaaagggcauguaccauauaaguuugaaauaacuuuuaaauacaauugucaaaugucuggacccacaaauuuuguaugcacagugauuauuugaaugcuaaacauuaaggauuuaaugagaacaaccugguggugauggcacaugccuucaauuccagcacuuggaaggcagaugcagguggauuucucuugaguucaaggccggccuggucugcaaaacaaguuccaggacagcaaagggcuacacagagaaauccuaucucaaaccaaccaaccaaccaaccaacaaacaacaacaaaaaaacauacuaacacggguggugguggugggguuugcuuggguuuuuaacucuggagguucaagcccauaugauacuuuauucuguccucuaauugggcuagcguacuggagaguaaaccacuugucauaugauccagaaagcaaagaugagacucgggucugaauaucuucugugaucugaaggccucucauuagccacuaaguuagggaaccaagcuuuuaggcauaggaacugugggaagucagcguccagacaacaguauguuuauuucuuuggcuuaaacuuuaacuguucaucuugaaugguacagguaauuugucauugagaaugagucacuaaauucaagaugguggacguccaugggauggaugaacuguuagacccguaugucuucugcauuaccucauuuuguuaaucuucuuuucucuuaggacccugccucugaauccaacccagagcugcucauguuucccagcguguacccaggucucagaagacagaaacgagacugggucaucccucccaucagcugccccgaaaaugaaaagggcgaauuuccaaagaaccugguucagguaggagaggaaguugguggcaggcucugcccucuugagagaagagaaaaugaaaagaccccauguugagaucuucccuggccaguucugauccucuucuguuuuguguucagaucaaauccaacagggacaaagaaacaaagguuuucuacagcaucaccggccaaggagcugacaaaccccccguuggcguuuucaucauugagagggagacaggcuggcugaaagugacacagccucuggauagagaagccauugccaaguacaucgugaguaauuuuguagacacuuguuggccacuggguaacgguugucaaauuuugggagcagcugguguuuuauccccaguuuggaugcccuggacauauaaguagcuuaacuuaucuuaaaguugggauggugaguuguugauguuguagggauuccucacaucauacaugagcuuagauggaagcuguaggagugggccuggaggaauggcucaguggauaagaacauuuguugcccuugaagagaaucuugaguugaguucccagcauucacauggguagcucacaaccaccugaaacugcagcucuggguguucugacaccguaugaccucccuugauaacugcacaaaaguguaugcgaacacacacagaggcagagacaggcagagacagggauagagauagagacagagacauacauacauauacaugcuggggacuagccugcucuaacagguauggaggugggggagccuuggauaaagcuaaaggcuggugauagcuucagaacucuuccuugcuguuuugggggucagaagcugucuggcaauuuaacucucucacuauucuguggcuaaaagcugaugauuucuggcaauuaacuccugcugauagcagcaggggauuaagaaaagaaguuaguugcuuaggcugucuccuuuuugacucugaggcugagaguucuguuaacucuuugugggccagagagaaaggaaaagacucuacucacucuggaugaagcagagaaaagaaucuccaacaaaucuuuauuucuguucucaguauacacacauucucugaaaauuaccucauacagcuaucagguagaauugauuacaugauuuuuuuuuuucuuuuuuucuuuuuucuuuuuugguuuuucaagacaggguuucucuguguagcccuggcuguccuggaacucacucuguagaucaggcugaccucgaacucagagauccaccugccucugccucccaaguguuaggauuaaaggcgugugccacugcugcuaggcuuacaugauuuucuaaacacuuuuccauucuguaaguucauaguaaaagcagcaguucaugucauaagguuuaaggaguuagagcagaaauguuuaaucucuucccauuaagauaguaucugacuaaacaucugcuaucuaucuuuagcucuauaaguucaauauaaguaaauaauuuuuuaucacaaauuagcacgguuuuguggagauaaaucaccuaccuuuugucuuauuaauuuuaaaguuuuauauagauaaacuagucaauauuuuauuuguugucuuugcaccuacaauaaauuauccauucccaguuuaugaccuuucguuaccagauagugaccuuguuccuaaccagaaggaauguuuuccuuggucauaaauuuguuccaagccugcuuucuuuuccuagugcaauuagccugugacacaugaagcauuacagggcucuguuugcagcuuuuucuucuacaggggacuugagauuacuuguaucaauuuaggaauucuaaauucaucauuaucaguauuuauguaaucauuaauucuucuacacagcauuacuguaugaaagcacaucuucauauugauucggcaggaaaugugcccaauugggugggcugaugcccagggaucauuaggcuauguaauagugacaggaaaggcauaucagcaacaagauacaauccugggaugaagccucuaaggacccuguguucucagagcucacccauuguacuuauucagaagggugggccaucuccagaaagcuuacuuguaugccuuagccuuuccuagaugacuucugacuuauacacauacauacacauaaagugaaagauguugucuuggcucgggagauggcuuaguuguuaagagcacugguuguucuuguaaaggaccugagugugguuuuccauacugacaagguagcuuauaaucauuuguaacucagguuccaaggaacucaguguccuccauggguaccagcucacauaugguacacauaccuaccuggagccaaaacacuuauauacauaaaaaagggagaaagguugggcacuagagagauggcuuagcaguuaagagcacuagcuacuccuucaaaggacccugguuuaauuuguagcccacauggcagcucagaacugucuguaacuccaguuccuaaggauucaacacucuuacucagacaugauguagacaaaacagcagugcacauaaaaaaaauaaaaaauaaauaaauauaucuuuuuaaauuggcauccugccugcauguaugacucuacaccaguagagaucaucagaggucauggugguuaugagucaccauguggaugcuaggaauagaacaaaggaccuguagaagagcaggcaaugguaguaaccucugagccaccucuccagccauauauauauauauauauauauauauauauauauauauauauauauauaauuuuuuuuaaaugucaacuuguucuuggggagaaauuucuuaccuagaugauacuuguucugauaauaacuauagggagcaaagcucacuucugagacuugguugcaaugugaacuuagggaggagggagauaaucuguaggugccaaauauagaaaaaucucaggaaaauauuagacugaaauagccagagggaaaaugaccccaacugaaauuuguguauuaugugauaaaugggcuggcuggcuggugguugucucuagcuuugagacuucaucaugaguucauuaagcagcaacacacaauguggaaaauucucacaugaaggugucauaguagaaagaguggaggcuagauggagccauucuagccagacucgccacccuggaucuucuuccaaguaacccucacuugacucucuugcagcucuauucucaugccgugucaucaaauggggaagcgguggaggaucccauggagauagugaucacagugacagaucagaaugacaacaggccagaguuuacccagccggucuuugagggauucguugcagaaggcgcuguuccagguaaauuagucucaaggaacugaguacccagaaagacauuuggguucuuuagaccuugaaggaugggauuagagaucgugucacugaaguuccgaccugcucuuugaaagccacccugagggaugagguggaggcaugagggagcaaauauaaaauucuaccuguagaaacauauaugagcuugguggugcauguauauaacuccagcucuaagggaugugaugcccucuucuggccuuuaagggcaucuacuacuacuacuacuacuacuacuacuaucuacaaguguacauacuacuacuacuacuacuacuacuacuacuaagggaugugaugcccucuucuggccuuuaagggcaucuacuacuacuacuacuacuacuacuacuaucuacaaguguacauacuacuacuacuacuacuaauaauaauaauaauaauaauaauagaaggaggaggaggaggaaaauaauaagaagaaauaugaaaagaaauaaaauaagaacgggaaggacuugguagcgauauuuauuuauugccaacaccaucuuccuuuccuccucacaucugaauuguaggcauuaaaaguugaguucccugaccauggcucguuuggugugaugcccccuugacugguagcuugcugagaauuuuagaaauaaaaacugugacaaagugugcuuaucuucuggaacaggauuguucugaauaguugugagcaaaucccaggguagccauugcaacccauuuaaggccccucuccuuugacaggaaccuccgugaugaaggucucagccaccgaugcagacgaugacgucaacaccuacaacgcugccaucgccuacaccaucgucagccaggauccugagcugccucacaaaaacauguucacugucaauagggacaccggggucaucagugugcucaccucugggcuggaccgagaggucaggcagaacucgggggauggcagaggggcuugaagggcaaauauacauuaaaucccauggacaguguaacccucugcuaagccuaguggucaguuaguguaaguggcuuggcuuuauaucuaaauaccugugcagaagcucugugccuggggacaggcagccugggcaguuaagcacguggucaaauacuuuucuauacgcaguaagcugcacuggguuuggggugacugauggggaguggguucugauuccauguguuuuggugucuacagaguuacccuacauacacucuggugguucaggcugcugaccuucaaggugaaggcuugagcacaacagccaaggcugugaucacugucaaggauauuaaugacaacgcuccugucuucaacccaagcacgguaacucuccaccuucuuuguuccaugaagggcccuucauugcucacgagcuaaguuuugccccugugcccuggugaacccuuuaaaaacucuucccuagguuagugaaugugagcuucagacuuagaaaccaacauccuagagcagcuacaaucuuugaaaugcuucuucuaucuuuugccuggggccauuggcacgugaucguguauugccgaaagcuccugaguccuugcuguccuuaccucagcauaucuauaguaucugugggucucacuuacuccuaacauuuccuaaguuuauauuccacccuguguuaccggagaccugccagcucaaagcagacaaguuuucuagucuguggaacuuacaauuuauaggaaauauauaauuuuaggaggauggaugauuugagccagaucuuacuguguaacccauccuggccuccagcucaacaacgcaccuccuaaaugcuggguuacagcuguaagaugccauguccagcuuuguuaagaaucacuaaaugccaaauaucaaaugaaugaaugaaugaaugaaugucaaaaacauucaaggaaaagguuuuaagagccagauaaaggaacuucgucugcagacucgaguacgcuugcacacacauacaugcacacagaacuuaaucaaauuaaaauuuuauagcccacguuggcaggcagguuuauaaugccauggccaucuuuuuagccuuagaagagaagaccauauguuacugagugaguuagaaguugauauggugguugcuuaguuagcagaggcccaaauaguguagauucaaaaggcaggguugauuuuuuuuuuuuuuuuuuuuuuuuucucuuucccuuuuguuacaauaggccccagggacaacugauuuaucuuauuuagugucuacuaauagagacuagagagaagaugggugugggagcaaauaguacaccugucuuaagaucaaaguaagcagacaaugggacuaacagaggguccuuguacccagggccucagaaagcuacuucagcguguauagaggagggugcucggagcugcuaguugaucuacugaugggaacugauggccuguucccagggcucuuaccuccauccuuagagacucaugcgaguuucuugaccucacucaucccaccuaugucuccagaauuggccucaguaugguucccauuccuuuagcccaagcccugggucuaugcuuacugucaucuugucacuaaugacccaauuuuuccuuuccucuucaguaucagggucaagugccugagaaugaggucaaugcccggaucgccacacucaaagugaccgaugaugaugcccccaacacuccggcguggaaagcuguguacaccguagucaacgauccugaccagcaguucguuguugucacagaccccacgaccaaugauggcauuuugaaaacagccaagguuuguacggugcuuagugaaugaugugccacuggcugagggucucucgucccacgaugucuucucgugggugguucaacacuggcagggggagagguuggaagucugagggugguacugacgugcuggggcuugcagaaacucucauggcuguuuugcugggucauuagaagugagauugguauggcuccuucgaaaaauauucuaaagccugaggcuaggcagcagagccugugggucaugaccccuuuugggguaggggggguugcuaagaccaccugaaaacauauuuacauuauuauucauaacaguagccaaauuacaguuaugaaguagcaaugaaaauaauuuuaugguuggggucaucacaacaugaggaacuauauuaaaagcucgcagcauuaggaaaguugagaaccacugggcuggaaagaugauggcuccgugguuaagagcacuuguugcucuguagaggauuuacauggcaggucacaacugcugguaaaucuuuggaauauguccaaauuaaaaguggggaagacuuacugguaaauuuagcaaacguuaguuaguagaugccuagagugucuauagagcuuuagugcccucuucagcaagugagaagccauguuugagaacuacugucuaccaaaaaaugguaucugagccagcuggugguggugcuggcuuuaaucucaguacuugggaggcagaggcaugugggucucugugaguucaagaccagccuagucuacagugugaguuccggguugcuagggcuccagagaaacccugucucgggaggaaaaauacaacaaaaaacccuaaagauuauagcugaaacuaaaccccucaaaaaaaauuuuuuuggacuaaccaguuuuuaaagcuuauauauuuguucaguggcaguggugguggaacacaggaccuuaagcaugcugggcgggugcucuaccaccgagccacacaucugauccugugguauuuuaguuuugacuuugucuuucuccuguucucuagggcuuggauuuugaggccaagcagcaauacauccuucaugugagaguggagaacgaggaacccuuugaggggucucuugucccuuccacagccacugucacuguggacgugguagacgugaaugaagcccccaucuuuaugccugcggagaggagagucgaagugcccgaagacuuuggugugggucaggaaaucacaucuuauaccgcucgagagccggacacguucauggaucagaagaucacgugaguaggaucccuuucaguggcgacucuugaauggguguugguuuguagucacacuucuuuuuugagacagggucucaccguaguccucacuguccuggaacuugcuuuguagaccagauuggccucaaacucauagagcuccuucuaccucccuaguucugggacuaaaguaaaggcaugugucaccauggcugaccacuuuggcuuuuuaauacauaauuuauauauucauuuauguaacuauaaauauagccauuuggggcuggcgagauggcucagcaguuaagagcgccgacugcucucccaaagauccugaguucaaaucccagcaaccccauaguggcucacaaccauccguaaugaaaucugaugcccucuucuggugugucugaagacagcuacaguguacuuacauauaauaaauaaauaagucuuaaauuaaagaaaaauauauagccauuugucauguaaugauaagacauucugauuuauguguccauggcaagggggcugggguuucacugaagaauugccauuugguggaggucccaggguaucacacgccccaccuuuuuuacuaaaggacugggguccgcaucaacauggaagcucauaagcauauguaacucuaguuccuggggaucugauaccucuucuaaccucuugcacuaugugggacacauauauacacucaggcacacgcacauagguaaaauuaguguuuauaauauauaugcguauauguauuuaaaaggggcaacuguguaacaagugaagaggaccugugaccuucuucaguuccuuugcuguuccuauucucacccagagcuugugcccucagguaucggauuuggagggacacugccaacuggcuggagauuaacccagagacuggugccauuuucacgcgcgcugagauggacagagaagacgcugagcaugugaagaacagcacauauguagcucucaucaucgccacagaugaugguauggacaccguguggucccauccccauuguggccugggcuccauccuucuccagcuugcuugcccccucugccucugccuuacuaggaggaggagacuucauucuuucuuuuaucuguaacaaacaaacaaucaaucauaacauaaaacuuuugguaacugaauuccaaacuuuagaucaaguagacuuucuuucccucuucucccuuucugcacuugaaucucacuccuuccugcaggaacuugguucaugguuaugaacuuacuauuacuuaaaucuuauaauucuucaauuuauaaucuuauaaucuucaacuuuucucucuuuuauuuugaauuuuauguguuucuuaggguuucauuucugugaagagacaccauaaccaaggcaacucuuuuuuuuuuuuuuuuuaaagauuuauuuauuauuuauuuuauauauauaacuauacuguagcugucuucagaugcaccagaaaaggccaucagaucccauuacagaugguugugagccaccaugugguugcugggaauugaacucaggaccucuagaagaguugucagugcucuuaaccacuaagccaucucuccagcccccaaggcaacucuuacaaaggaaaacauuuggggcuggcuaaaaguuucagagguuuaguccauuaucgucacggcaggaagccgagaggcaugugggcaguggugcuagagaaggagcugagaguuguacaucuugauccaagggcagcuaggaagaggcucugauugagccuaggcugguggagccuaggcacgggagaccucaaagcuuacccccacaguuacacacauccucccacaagaccacaccaacuugauuaaggccacaccuccuaauagugccccuuuuuguagggcaagcauucaaacacacgagccugugggggccaaacauacuaccacaauguguauggguauuauagccugccuguguuccugguauccacagaggauggucaccuggaacuggaguuacagacagucaggagcuacuaugaaagugcuaaaaaccgaacccuaagcauucuuagucacugagcugucucuucggccccuuuuccuuucuguauggaaaugggaacugaccacagugcuaaacauagacguguguucucuacuacuuauauauauauauauaccacguggauaccccaagauuuuuuaguauaguuuaguuuguuuguuuuguuuguuuuuguuuuagacauuguuuccuauauaacccaggcuaguuuugaacucacgauguagcccaaaagaccucaaaauugaugugccccccccccccauccuguguguuucuaagauuccaacaaauucuacugcauucugcuuuuccuaaccuccuaauaagaucugccggagccaggcuucuguaggagguuggggugggauaaggcuuugucucaacaaacaaaugacaacaacaaaaaaaauaaacucccgaauuggacuguauuaguaauguacuagaaagagaagaagaagaaagcugccuuugaaaugagaaauaaucuaagacauuguauacagagcaugcuugucagaaagccgagacaaggacagagcgccugugguuaguguggaaccugcugaggggucguggacaaacuaagaauuugaccuccuggaaggugacacgauccuuaaucugugacaccuuuuauguuuucucauagguucacccauugccacuggcacgggcacucuucuccugguccuguuagacgucaaugacaacgcucccaucccagaaccucgaaacaugcaguucugccagaggaacccacagccucauaucaucaccaucuuggauccagaccuuccccccaacacgucccccuuuacugcugagcuaacccauggggccagcgucaacuggaccauugaguauaaugacgcaggugugaaggcucgcugucuuuagagaggcucugccugucccgcuucacccuucccuuugauaucugcccccgguuccuucugcauucaugcacgcuccuuuuccucguauugcgcgguauuccuccagcacucgaugucucugguucccuaaacccuuugauucacugagcuuuuugcucugcccccucucccggucucaucguuccuguuuuccuuucccuagcucaagaaucucucauuuugcaaccaagaaaggacuuagagauuggcgaauacaaaauccaucucaagcucgcggauaaccagaacaaagaccaggugaccacguuggacguccaugugugugacugugaagggacggucaacaacugcaugaaggcgggaaucguggcagcaggauugcaaguuccugccauccucggaauccuuggagggauccucgcccugcugaguaaguucagguggcaggugcuucagcccgugaccucuaaaaccaggaagggccaucuccuaggaggagcuuuuauuugggguacagggggcgcaggauccuucuguucugucugucucugcucgccuagauugagugcauguccuucaguaaguggggcuucagacccaggaucccugaugaggcuccucagaugcuucauuuuaaaccaguccccaaggaaugcugugcuggcagagccagguuuacguauagcucgcuguacucguuagcacaggcaaggcuggcagcuaccaucaccuccgcauuccaucuuggagggcagaugagaggggaaguagaggcugccuaccugcagguuguagaugucagcagcacucacaucucauuggcccaaguguagccaugacaaaugacaaggcauccuggaagcuccugcucuuagcugggugaugaugagcccauuuucauugcaugcuugggagacagugguauuggauggagggcugagugagcagcggauggugcccauggcugaaaagaugaaggagaguggagaugcuuggagggaaucugucauuuuuguccguggucuuuguucugauuuuaccuguccugggcuugguaaaaugccaugaggauuucaaugaucaaagauacgggguuuugcuuauugaggauauaccuugacuuuuuuugucgggggcaguagauaaagcuggggaaauucucuuauuagacauuggaagcagaagugguaucaggagccagaugucaaacuuguuuaucauuuuuguuauauuguuuuuugagaaaugaucucauuuggcuggacaugagauaguccucguucagguggcuacccaccugccugguggggugaggcuguggcauuccaggacaguggcuuccccuggucuuuccugcguguggcucaucacucuucccugccuuccuuccuugucuccaguucugauccugcugcuccuacuguuucuacggaggagaacgguggucaaagagccccugcugccaccagaugaugauacccgggacaauguguauuacuaugaugaagaaggagguggagaagaagaccagguggguuuuaaagauggagagcuuuaagucugauuaagggguguuggguaggcuaugucagucaucacccugcuguacugcuauggaggacagaacucuguggucacaagaauucaaguuucuucccccagacacucuuguguucucuacacugcugguugauuacauugagacucacaacaucuguaaaucagugagggccuuucccaaccaggcagcguugugaugaaagacucuaagcugcagccuacgcucgggucugcugcacgggagccucaugugaguugcaguaggcaugcauugcugucuuauugccugaagccccucacaugccagagcccguuuuuaacagacaagacacuacuuguaucagcugugacggggaggacuaaggauuugccaggugauuaccugauaaucaugucccgagaaacgaguaagacucaauagcuugaguucaugcaguccccaagggcuccuuuuucuuucaguuugcaucaggagacuuguaguuuggaaaaugccauuucauaugcauuugggcacuugggggucguuugcuuuguccaucagcauagucugugaugccaugaagcaagccccgcccugugcgagcagcugcuucuuucucacaggcucucaugcucugcucuucucucuaggacuuugauuugagccagcugcacaggggccuggaugcccgaccggaagugacucgaaaugauguggcucccacccucaugagcgugccccaguaucguccccguccugccaauccugaugaaauuggaaacuucaucgaugaaguaaguagacaaggcugugaggcaaaucacaguacaucucuuaacuccgaaccaagaagaaaagcguucuaaaugaggagaaccuuccagugguugcuguacugugccuauguccccgagacaaaagcaaaaucuacuugcagagauuuaggagaccuaggaguuacagagcaaaucugcuuugcaugaguuuccugcauucauuacaccuguuugggggagugucacagggagccaaaggccgcuuggcagguagauaaaacagcaucucagcuacaugaggaccguaguuggugccucagauacacuguaguuggcauccgaggcaccaacguaaaugccgagcaggcaugguggccuguuuauucuaguguucagauuagagcauccugaaucagcaagcucuagguucuguugucugagaccuugucucaguaaaugagguaaagaaaaguugaggaagaccccugauauugucaaccuuggguuuucauaugcacaugugcacacaaaaacacgcuauacauagcacacacaguguuuuccagauuaccuaaggccccuaaaaauagcaucccucauguaacauacucacguaacguacuuauauguguuagaaauaguuucagcucugaucaaaacacuuaaacagauaauaggagaugcuggguucagcauucuauucuguugaaaacauaugcacauauauaacauauuaacucuucuaccauccugcuccauuauuuugcugucuuagguguguuucuuucuccucuuuucucuucucuucucuucucuucucuucucuucucuucucuucucuucuccucuuuucucuucucuucuccccuccccuccccuccccuccccuccccuccccuccccuccccuccccuccccuccccuccccuccccuccccuccccuccucuccucuccucucuucucuucucuucucuucucuucucuucuuuucuuuucuuuucuuuucuuuucuuuucuuuucuuuucuuuucuuuucuuuucuuuucuuuucuuuuccaagacaggguuucuccauguagccacagcuguccuggaacucucuucauagaccaggcuggcuucaaucucagagccccaccuaccgcugcauucccaagugcugggauuaaaggugugggcugccacugcccgguauugguuacuuuuuuuuuuuucuuuuuugcugugccaagauaccaugccuaaggcaguuuacagaaggaagagucuaauuugggguucuagaagguuagaguccaugacaaucauggcagggagccuggcagcggguagacaugcacagcuggagcaggagcugggggcucaggccagccuggucugcaaagugaguuccagacagccagggcuauacagagaaacccugucucaaaagacaaaaacaaaaaccaaaaaaaacccaaaaaccaaccaaccaaacagaaaaaugucaagccuuggccaugccuuuaguccuugcacuugggcgauaguagguagcagguguaucucugaguuugaagccaaccugaucuacaggagggaguuccaggauguccaggaaaaaccuggauucaaagaaaagcagaaaaagacugaagccuguucucaguagcacaccuucuccaacaaggccacaccuccuaauccuuccaaauuguuccagcuggggaccaagaguucaaacacuggcuggcuuuguauguacucgcuauguagaucaggcuggucuugaaguauguagcagaggaggacuuuaaauuccugauucccccaacuucagaauuaacauuuaacaauagcaguuugucaucuguccuucgaggauuuucugggcugaacuguaaccuacguguuuuaguaugacgacucucguugcucuuacccucuguccagccuggccuugggacuuugccuucugugcugguguguguguguguguguguguguguguguguaccuugaagggguuaacuacuccuugguuaguuuuucauguuugggguguugcuugccucugaugcauacugauaaguacggugcucuuccuuuuagaaccugaaggcagccgacagcgaccccacggcacccccuuacgacucucuguugguguucgauuacgagggcagugguucugaagccgcuagccugagcucacugaacuccucugagucggaucaggaccaggacuacgauuaucugaacgaguggggcaaccgauucaagaagcuggcggacauguacggcgguggugaggacgacuaggggacuagcaagucucccccguguggcaccaugggagaugcagaauaauuauaucaguggucuuucagcuccuucccugaguguguagaagagagacugaucugagaagugugcagauugcauaguggucucacucucccuacuggacugucuguguuaggaugguuuucacugauuguugaaaucuuuuuuuauuuuuuauuuuuacagugcugagauauaaacugugccuuuuuuuguuuguuuguuucuguuuuuguucuuuugagcuaugaucugccccagacacaacagccccaagccccucacaccucacuaauuuuuuacauuguguacuugcccucaauuaccauguuugcuguauucuaauagucacucauguuccugaauucuguugcccugcccaggugauauucuaggaugcagaaaugccugggcccuuuuauggugagagacagguaucuuggugugggugcaacugcgcuggauaguguguguguucccaagaucuuucgugguauucccucuccaccuccagagaacucauuuacaguggcauuccuuguucggcuaugugucuggggcagaacaaaaaaaagggaccacuaugcaugcugcacacgucucagauucuuagguacacaccugauucuuaggugcaugccauagugggauauguugcuuugaucagaaccugcagggagguuuucgggcaccacuuaaguuucuuggcguuucuuucaaaccaaaacuaaagaaugguuguucucugagagagacuggagugccaccaccaaagacagaggagagaaaaggagagaaaccaaacuuggggacagcaacaucagcgaacccggcuaguuggcacaccgauggugaggguacacaggcggugagaccuaucccacaagauuucuggaagacuaggcuuaucucaaccaauguuuucuggcuggaaucuuuguccauguauuccugaagcccaggaaaugcaccccuccaaugccugcucuugaugguagcuacagaaaaugcuggccgauuuaaacccaaguugcccaguucugaguagaaaacugagacuaugcuguguguggcggcgcgcaccuuuaagcccagcacucaggaggcagaggcagucagaucucccugaguucgaggccaaccugguauauauaguauaguaagcgaauucuaggacagccagggcuacacagagaaacccugucucugcaaaccaaaagagaaaacugagaauauuacaaauugugcauuuucucaggaagcaggaagagaacauucuaacgggaaaaaggagacaagaccuuugagaguuuucauucaaaaugcaaaucucagcuuuuugauaaccacuggaaagaauuuuauugaaaguucuguacuuaccuaacuuuggaagaaaaugaugaccacaaucaacugugagaacuguugauuucucuguaguuuaaucauguaauguugcuagagugaccuuuguauguaguuugaguguaugugugugggugcugauaauuuuguauuuugugggggguggaaaagguaagccauugaaaccguucucuaagaugcauuuuuaugaauuuuauuaaagaguuuuguuaaacuguug

SEQ ID NO: 4743 - RNA, 66900 nt, Mus musculus
caacaguuuaacaaaacucuuuaauaaaauucauaaaaaugcaucuuagagaacgguuucaauggcuuaccuuuuccaccccccacaaaauacaaaauuaucagcacccacacacauacacucaaacuacauacaaaggucacucuagcaacauuacaugauuaaacuacagagaaaucaacaguucucacaguugauuguggucaucauuuucuuccaaaguuagguaaguacagaacuuucaauaaaauucuuuccagugguuaucaaaaagcugagauuugcauuuugaaugaaaacucucaaaggucuugucuccuuuuucccguuagaauguucucuuccugcuuccugagaaaaugcacaauuuguaauauucucaguuuucucuuuugguuugcagagacaggguuucucuguguagcccuggcuguccuagaauucgcuuacuauacuauauauaccagguuggccucgaacucagggagaucugacugccucugccuccugagugcugggcuuaaaggugcgcgccgccacacacagcauagucucaguuuucuacucagaacugggcaacuuggguuuaaaucggccagcauuuucuguagcuaccaucaagagcaggcauuggaggggugcauuuccugggcuucaggaauacauggacaaagauuccagccagaaaacauugguugagauaagccuagucuuccagaaaucuugugggauaggucucaccgccuguguacccucaccaucggugugccaacuagccggguucgcugauguugcuguccccaaguuugguuucucuccuuuucucuccucugucuuuggugguggcacuccagucucucucagagaacaaccauucuuuaguuuugguuugaaagaaacgccaagaaacuuaaguggugcccgaaaaccucccugcagguucugaucaaagcaacauaucccacuauggcaugcaccuaagaaucagguguguaccuaagaaucugagacgugugcagcaugcauaguggucccuuuuuuuuguucugccccagacacauagccgaacaaggaaugccacuguaaaugaguucucuggagguggagagggaauaccacgaaagaucuugggaacacacacacuauccagcgcaguugcacccacaccaagauaccugucucucaccauaaaagggcccaggcauuucugcauccuagaauaucaccugggcagggcaacagaauucaggaacaugagugacuauuagaauacagcaaacaugguaauugagggcaaguacacaauguaaaaaauuagugaggugugaggggcuuggggcuguugugucuggggcagaucauagcucaaaagaacaaaaacagaaacaaacaaacaaaaaaaggcacaguuuauaucucagcacuguaaaaauaaaaaauaaaaaaagauuucaacaaucagugaaaaccauccuaacacagacaguccaguagggagagugagaccacuaugcaaucugcacacuucucagaucagucucucuucuacacacucagggaaggagcugaaagaccacugauauaauuauucugcaucucccauggugccacacgggggagacuugcuaguccccuagucguccucaccaccgccguacauguccgccagcuucuugaaucgguugccccacucguucagauaaucguaguccugguccugauccgacucagaggaguucagugagcucaggcuagcggcuucagaaccacugcccucguaaucgaacaccaacagagagucguaagggggugccguggggucgcugucggcugccuucagguucuaaaaggaagagcaccguacuuaucaguaugcaucagaggcaagcaacaccccaaacaugaaaaacuaaccaaggaguaguuaaccccuucaagguacacacacacacacacacacacacacacacaccagcacagaaggcaaagucccaaggccaggcuggacagaggguaagagcaacgagagucgucauacuaaaacacguagguuacaguucagcccagaaaauccucgaaggacagaugacaaacugcuauuguuaaauguuaauucugaaguugggggaaucaggaauuuaaaguccuccucugcuacauacuucaagaccagccugaucuacauagcgaguacauacaaagccagccaguguuugaacucuugguccccagcuggaacaauuuggaaggauuaggagguguggccuuguuggagaaggugugcuacugagaacaggcuucagucuuuuucugcuuuucuuugaauccagguuuuuccuggacauccuggaacucccuccuguagaucagguuggcuucaaacucagagauacaccugcuaccuacuaucgcccaagugcaaggacuaaaggcauggccaaggcuugacauuuuucuguuugguugguugguuuuuggguuuuuuuugguuuuuguuuuugucuuuugagacaggguuucucuguauagcccuggcugucuggaacucacuuugcagaccaggcuggccugagcccccagcuccugcuccagcugugcaugucuacccgcugccaggcucccugccaugauugucauggacucuaaccuucuagaaccccaaauuagacucuuccuucuguaaacugccuuaggcaugguaucuuggcacagcaaaaaagaaaaaaaaaaaaguaaccaauaccgggcaguggcagcccacaccuuuaaucccagcacuugggaaugcagcgguagguggggcucugagauugaagccagccuggucuaugaagagaguuccaggacagcuguggcuacauggagaaacccugucuuggaaaagaaaagaaaagaaaagaaaagaaaagaaaagaaaagaaaagaaaagaaaagaaaagaaaagaaaagaagagaagagaagagaagagaagagaagagaggagaggagaggaggggaggggaggggaggggaggggaggggaggggaggggaggggaggggaggggaggggaggggaggggaggggaggggagaagagaagagaaaagaggagaagagaagagaagagaagagaagagaagagaagagaagagaagagaaaagaggagaaagaaacacaccuaagacagcaaaauaauggagcaggaugguagaagaguuaauauguuauauaugugcauauguuuucaacagaauagaaugcugaacccagcaucuccuauuaucuguuuaaguguuuugaucagagcugaaacuauuucuaacacauauaaguacguuacgugaguauguuacaugagggaugcuauuuuuaggggccuuagguaaucuggaaaacacugugugugcuauguauagcguguuuuugugugcacaugugcauaugaaaacccaagguugacaauaucaggggucuuccucaacuuuucuuuaccucauuuacugagacaaggucucagacaacagaaccuagagcuugcugauucaggaugcucuaaucugaacacuagaauaaacaggccaccaugccugcucggcauuuacguuggugccucggaugccaacuacaguguaucugaggcaccaacuacgguccucauguagcugagaugcuguuuuaucuaccugccaagcggccuuuggcucccugugacacucccccaaacagguguaaugaaugcaggaaacucaugcaaagcagauuugcucuguaacuccuaggucuccuaaaucucugcaaguagauuuugcuuuugucucggggacauaggcacaguacagcaaccacuggaagguucuccucauuuagaacgcuuuucuucuugguucggaguuaagagauguacugugauuugccucacagccuugucuacuuacuucaucgaugaaguuuccaauuucaucaggauuggcaggacggggacgauacuggggcacgcucaugagggugggagccacaucauuucgagucacuuccggucgggcauccaggccccugugcagcuggcucaaaucaaaguccuagagagaagagcagagcaugagagccugugagaaagaagcagcugcucgcacagggcggggcuugcuucauggcaucacagacuaugcugauggacaaagcaaacgacccccaagugcccaaaugcauaugaaauggcauuuuccaaacuacaagucuccugaugcaaacugaaagaaaaaggagcccuuggggacugcaugaacucaagcuauugagucuuacucguuucucgggacaugauuaucagguaaucaccuggcaaauccuuaguccuccccgucacagcugauacaaguagugucuugucuguuaaaaacgggcucuggcaugugaggggcuucaggcaauaagacagcaaugcaugccuacugcaacucacaugaggcucccgugcagcagacccgagcguaggcugcagcuuagagucuuucaucacaacgcugccugguugggaaaggcccucacugauuuacagauguugugagucucaauguaaucaaccagcaguguagagaacacaagagugucugggggaagaaacuugaauucuugugaccacagaguucuguccuccauagcaguacagcagggugaugacugacauagccuacccaacaccccuuaaucagacuuaaagcucuccaucuuuaaaacccaccuggucuucuucuccaccuccuucuucaucauaguaauacacauugucccggguaucaucaucugguggcagcaggggcucuuugaccaccguucuccuccguagaaacaguaggagcagcaggaucagaacuggagacaaggaaggaaggcagggaagagugaugagccacacgcaggaaagaccaggggaagccacuguccuggaaugccacagccucaccccaccaggcagguggguagccaccugaacgaggacuaucucauguccagccaaaugagaucauuucucaaaaaacaauauaacaaaaaugauaaacaaguuugacaucuggcuccugauaccacuucugcuuccaaugucuaauaagagaauuuccccagcuuuaucuacugcccccgacaaaaaaagucaagguauauccucaauaagcaaaaccccguaucuuugaucauugaaauccucauggcauuuuaccaagcccaggacagguaaaaucagaacaaagaccacggacaaaaaugacagauucccuccaagcaucuccacucuccuucaucuuuucagccaugggcaccauccgcugcucacucagcccuccauccaauaccacugucucccaagcaugcaaugaaaaugggcucaucaucacccagcuaagagcaggagcuuccaggaugccuugucauuugucauggcuacacuugggccaaugagaugugagugcugcugacaucuacaaccugcagguaggcagccucuacuuccccucucaucugcccuccaagauggaaugcggaggugaugguagcugccagccuugccugugcuaacgaguacagcgagcuauacguaaaccuggcucugccagcacagcauuccuuggggacugguuuaaaaugaagcaucugaggagccucaucagggauccugggucugaagccccacuuacugaaggacaugcacucaaucuaggcgagcagagacagacagaacagaaggauccugcgcccccuguaccccaaauaaaagcuccuccuaggagauggcccuuccugguuuuagaggucacgggcugaagcaccugccaccugaacuuacucagcagggcgaggaucccuccaaggauuccgaggauggcaggaacuugcaauccugcugccacgauucccgccuucaugcaguuguugaccgucccuucacagucacacacauggacguccaacguggucaccuggucuuuguucugguuauccgcgagcuugagauggauuuuguauucgccaaucucuaaguccuuucuugguugcaaaaugagagauucuugagcuagggaaaggaaaacaggaacgaugagaccgggagagggggcagagcaaaaagcucagugaaucaaaggguuuagggaaccagagacaucgagugcuggaggaauaccgcgcaauacgaggaaaaggagcgugcaugaaugcagaaggaaccgggggcagauaucaaagggaagggugaagcgggacaggcagagccucucuaaagacagcgagccuucacaccugcgucauuauacucaaugguccaguugacgcuggccccauggguuagcucagcaguaaagggggacguguuggggggaaggucuggauccaagauggugaugauaugaggcuguggguuccucuggcagaacugcauguuucgagguucugggaugggagcguugucauugacgucuaacaggaccaggagaagagugcccgugccaguggcaaugggugaaccuaugagaaaacauaaaaggugucacagauuaaggaucgugucaccuuccaggaggucaaauucuuaguuuguccacgaccccucagcagguuccacacuaaccacaggcgcucuguccuugucucggcuuucugacaagcaugcucuguauacaaugucuuagauuauuucucauuucaaaggcagcuuucuucuucuucucuuucuaguacauuacuaauacaguccaauucgggaguuuauuuuuuuuguuguugucauuuguuuguugagacaaagccuuaucccaccccaaccuccuacagaagccuggcuccggcagaucuuauuaggagguuaggaaaagcagaaugcaguagaauuuguuggaaucuuagaaacacacaggauggggggggggggcacaucaauuuugaggucuuuugggcuacaucgugaguucaaaacuagccuggguuauauaggaaacaaugucuaaaacaaaaacaaacaaaacaaacaaacuaaacuauacuaaaaaaucuugggguauccacgugguauauauauauauauaaguaguagagaacacacgucuauguuuagcacuguggucaguucccauuuccauacagaaaggaaaaggggccgaagagacagcucagugacuaagaaugcuuaggguucgguuuuuagcacuuucauaguagcuccugacugucuguaacuccaguuccaggugaccauccucuguggauaccaggaacacaggcaggcuauaauacccauacacauugugguaguauguuuggcccccacaggcucguguguuugaaugcuugcccuacaaaaaggggcacuauuaggagguguggccuuaaucaaguugguguggucuugugggaggauguguguaacuguggggguaagcuuugaggucucccgugccuaggcuccaccagccuaggcucaaucagagccucuuccuagcugcccuuggaucaagauguacaacucucagcuccuucucuagcaccacugcccacaugccucucggcuuccugccgugacgauaauggacuaaaccucugaaacuuuuagccagccccaaauguuuuccuuuguaagaguugccuugggggcuggagagauggcuuagugguuaagagcacugacaacucuucuagagguccugaguucaauucccagcaaccacaugguggcucacaaccaucuguaaugggaucugauggccuuuucuggugcaucugaagacagcuacaguauaguuauauauauaaaauaaauaauaaauaaaucuuuaaaaaaaaaaaaaaaaagaguugccuugguuauggugucucuucacagaaaugaaacccuaagaaacacauaaaauucaaaauaaaagagagaaaaguugaagauuauaagauuauaaauugaagaauuauaagauuuaaguaauaguaaguucauaaccaugaaccaaguuccugcaggaaggagugagauucaagugcagaaagggagaagagggaaagaaagucuacuugaucuaaaguuuggaauucaguuaccaaaaguuuuauguuaugauugauuguuuguuuguuacagauaaaagaaagaaugaagucuccuccuccuaguaaggcagaggcagagggggcaagcaagcuggagaaggauggagcccaggccacaauggggaugggaccacacgguguccauaccaucaucuguggcgaugaugagagcuacauaugugcuguucuucacaugcucagcgucuucucuguccaucucagcgcgcgugaaaauggcaccagucucuggguuaaucuccagccaguuggcagugucccuccaaauccgauaccugagggcacaagcucugggugagaauaggaacagcaaaggaacugaagaaggucacagguccucuucacuuguuacacaguugccccuuuuaaauacauauacgcauauauauuauaaacacuaauuuuaccuaugugcgugugccugaguguauauaugugucccacauagugcaagagguuagaagagguaucagauccccaggaacuagaguuacauaugcuuaugagcuuccauguugaugcggaccccaguccuuuaguaaaaaagguggggcgugugauacccugggaccuccaccaaauggcaauucuucagugaaaccccagcccccuugccauggacacauaaaucagaaugucuuaucauuacaugacaaauggcuauauauuuuucuuuaauuuaagacuuauuuauuuauuauauguaaguacacuguagcugucuucagacacaccagaagagggcaucagauuucauuacggaugguugugagccacuaugggguugcugggauuugaacucaggaucuuugggagagcagucggcgcucuuaacugcugagccaucucgccagccccaaauggcuauauuuauaguuacauaaaugaauauauaaauuauguauuaaaaagccaaaguggucagccauggugacacaugccuuuacuuuagucccagaacuagggagguagaaggagcucuaugaguuugaggccaaucuggucuacaaagcaaguuccaggacagugaggacuacggugagacccugucucaaaaaagaagugugacuacaaaccaacacccauucaagagucgccacugaaagggauccuacucacgugaucuucugauccaugaacguguccggcucucgagcgguauaagaugugauuuccugacccacaccaaagucuucgggcacuucgacucuccucuccgcaggcauaaagaugggggcuucauucacgucuaccacguccacagugacaguggcuguggaagggacaagagaccccucaaaggguuccucguucuccacucucacaugaaggauguauugcugcuuggccucaaaauccaagcccuagagaacaggagaaagacaaagucaaaacuaaaauaccacaggaucagauguguggcucggugguagagcacccgcccagcaugcuuaagguccuguguuccaccaccacugccacugaacaaauauauaagcuuuaaaaacugguuaguccaaaaaaauuuuuuuugagggguuuaguuucagcuauaaucuuuaggguuuuuuguuguauuuuuccucccgagacaggguuucucuggagcccuagcaacccggaacucacacuguagacuaggcuggucuugaacucacagagacccacaugccucugccucccaaguacugagauuaaagccagcaccaccaccagcuggcucagauaccauuuuuugguagacaguaguucucaaacauggcuucucacuugcugaagagggcacuaaagcucuauagacacucuaggcaucuacuaacuaacguuugcuaaauuuaccaguaagucuuccccacuuuuaauuuggacauauuccaaagauuuaccagcaguugugaccugccauguaaauccucuacagagcaacaagugcucuuaaccacggagccaucaucuuuccagcccagugguucucaacuuuccuaaugcugcgagcuuuuaauauaguuccucauguugugaugaccccaaccauaaaauuauuuucauugcuacuucauaacuguaauuuggcuacuguuaugaauaauaauguaaauauguuuucagguggucuuagcaacccccccuaccccaaaaggggucaugacccacaggcucugcugccuagccucaggcuuuagaauauuuuucgaaggagccauaccaaucucacuucuaaugacccagcaaaacagccaugagaguuucugcaagccccagcacgucaguaccacccucagacuuccaaccucucccccugccaguguugaaccacccacgagaagacaucgugggacgagagacccucagccaguggcacaucauucacuaagcaccguacaaaccuuggcuguuuucaaaaugccaucauuggucguggggucugugacaacaacgaacugcuggucaggaucguugacuacgguguacacagcuuuccacgccggaguguugggggcaucaucaucggucacuuugaguguggcgauccgggcauugaccucauucucaggcacuugacccugauacugaagaggaaaggaaaaauugggucauuagugacaagaugacaguaagcauagacccagggcuugggcuaaaggaaugggaaccauacugaggccaauucuggagacauaggugggaugagugaggucaagaaacucgcaugagucucuaaggauggagguaagagcccugggaacaggccaucaguucccaucaguagaucaacuagcagcuccgagcacccuccucuauacacgcugaaguagcuuucugaggcccuggguacaaggacccucuguuagucccauugucugcuuacuuugaucuuaagacagguguacuauuugcucccacacccaucuucucucuagucucuauuaguagacacuaaauaagauaaaucaguugucccuggggccuauuguaacaaaagggaaagagaaaaaaaaaaaaaaaaaaaaaaaaaucaacccugccuuuugaaucuacacuauuugggccucugcuaacuaagcaaccaccauaucaacuucuaacucacucaguaacauauggucuucucuucuaaggcuaaaaagauggccauggcauuauaaaccugccugccaacgugggcuauaaaauuuuaauuugauuaaguucugugugcauguaugugugugcaagcguacucgagucugcagacgaaguuccuuuaucuggcucuuaaaaccuuuuccuugaauguuuuugacauucauucauucauucauucauuugauauuuggcauuuagugauucuuaacaaagcuggacauggcaucuuacagcuguaacccagcauuuaggaggugcguuguugagcuggaggccaggauggguuacacaguaagaucuggcucaaaucauccauccuccuaaaauuauauauuuccuauaaauuguaaguuccacagacuagaaaacuugucugcuuugagcuggcaggucuccgguaacacaggguggaauauaaacuuaggaaauguuaggaguaagugagacccacagauacuauagauaugcugagguaaggacagcaaggacucaggagcuuucggcaauacacgaucacgugccaauggccccaggcaaaagauagaagaagcauuucaaagauuguagcugcucuaggauguugguuucuaagucugaagcucacauucacuaaccuagggaagaguuuuuaaaggguucaccagggcacaggggcaaaacuuagcucgugagcaaugaagggcccuucauggaacaaagaagguggagaguuaccgugcuuggguugaagacaggagcguugucauuaauauccuugacagugaucacagccuuggcuguugugcucaagccuucaccuugaaggucagcagccugaaccaccagaguguauguaggguaacucuguagacaccaaaacacauggaaucagaacccacuccccaucagucaccccaaacccagugcagcuuacugcguauagaaaaguauuugaccacgugcuuaacugcccaggcugccuguccccaggcacagagcuucugcacagguauuuagauauaaagccaagccacuuacacuaacugaccacuaggcuuagcagaggguuacacuguccaugggauuuaauguauauuugcccuucaagccccucugccaucccccgaguucugccugaccucucgguccagcccagaggugagcacacugaugaccccggugucccuauugacagugaacauguuuuugugaggcagcucaggauccuggcugacgaugguguaggcgauggcagcguuguagguguugacgucaucgucugcaucgguggcugagaccuucaucacggagguuccugucaaaggagaggggccuuaaauggguugcaauggcuacccugggauuugcucacaacuauucagaacaauccuguuccagaagauaagcacacuuugucacaguuuuuauuucuaaaauucucagcaagcuaccagucaagggggcaucacaccaaacgagccauggucagggaacucaacuuuuaaugccuacaauucagaugugaggaggaaaggaagaugguguuggcaauaaauaaauaucgcuaccaaguccuucccguucuuauuuuauuucuuuucauauuucuucuuauuauuuuccuccuccuccuccuucuauuauuauuauuauuauuauuauuaguaguaguaguaguaguauguacacuuguagauaguaguaguaguaguaguaguaguaguagaugcccuuaaaggccagaagagggcaucacaucccuuaguaguaguaguaguaguaguaguaguaguauguacacuuguagauaguaguaguaguaguaguaguaguaguagaugcccuuaaaggccagaagagggcaucacaucccuuagagcuggaguuauauacaugcaccaccaagcucauauauguuucuacagguagaauuuuauauuugcucccucaugccuccaccucaucccucaggguggcuuucaaagagcaggucggaacuucagugacacgaucucuaaucccauccuucaaggucuaaagaacccaaaugucuuucuggguacucaguuccuugagacuaauuuaccuggaacagcgccuucugcaacgaaucccucaaagaccggcuggguaaacucuggccuguugucauucugaucugucacugugaucacuaucuccaugggauccuccaccgcuuccccauuugaugacacggcaugagaauagagcugcaagagagucaagugaggguuacuuggaagaagauccaggguggcgagucuggcuagaauggcuccaucuagccuccacucuuucuacuaugacaccuucaugugagaauuuuccacauuguguguugcugcuuaaugaacucaugaugaagucucaaagcuagagacaaccaccagccagccagcccauuuaucacauaauacacaaauuucaguuggggucauuuucccucuggcuauuucagucuaauauuuuccugagauuuuucuauauuuggcaccuacagauuaucucccuccucccuaaguucacauugcaaccaagucucagaagugagcuuugcucccuauaguuauuaucagaacaaguaucaucuagguaagaaauuucuccccaagaacaaguugacauuuaaaaaaaauuauauauauauauauauauauauauauauauauauauauauauauauauggcuggagagguggcucagagguuacuaccauugccugcucuucuacagguccuuuguucuauuccuagcauccacauggugacucauaaccaccaugaccucugaugaucucuacugguguagagucauacaugcaggcaggaugccaauuuaaaaagauauauuuauuuauuuuuuauuuuuuuuaugugcacugcuguuuugucuacaucaugucugaguaagaguguugaauccuuaggaacuggaguuacagacaguucugagcugccaugugggcuacaaauuaaaccaggguccuuugaaggaguagcuagugcucuuaacugcuaagccaucucucuagugcccaaccuuucucccuuuuuuauguauauaaguguuuuggcuccagguagguauguguaccauaugugagcugguacccauggaggacacugaguuccuuggaaccugaguuacaaaugauuauaagcuaccuugucaguauggaaaaccacacucagguccuuuacaagaacaaccagugcucuuaacaacuaagccaucucccgagccaagacaacaucuuucacuuuauguguauguauguguauaagucagaagucaucuaggaaaggcuaaggcauacaaguaagcuuucuggagauggcccacccuucugaauaaguacaaugggugagcucugagaacacaggguccuuagaggcuucaucccaggauuguaucuuguugcugauaugccuuuccugucacuauuacauagccuaaugaucccugggcaucagcccacccaauugggcacauuuccugccgaaucaauaugaagaugugcuuucauacaguaaugcuguguagaagaauuaaugauuacauaaauacugauaaugaugaauuuagaauuccuaaauugauacaaguaaucucaaguccccuguagaagaaaaagcugcaaacagagcccuguaaugcuucaugugucacaggcuaauugcacuaggaaaagaaagcaggcuuggaacaaauuuaugaccaaggaaaacauuccuucugguuaggaacaaggucacuaucugguaacgaaaggucauaaacugggaauggauaauuuauuguaggugcaaagacaacaaauaaaauauugacuaguuuaucuauauaaaacuuuaaaauuaauaagacaaaagguaggugauuuaucuccacaaaaccgugcuaauuugugauaaaaaauuauuuacuuauauugaacuuauagagcuaaagauagauagcagauguuuagucagauacuaucuuaaugggaagagauuaaacauuucugcucuaacuccuuaaaccuuaugacaugaacugcugcuuuuacuaugaacuuacagaauggaaaaguguuuagaaaaucauguaagccuagcagcaguggcacacgccuuuaauccuaacacuugggaggcagaggcagguggaucucugaguucgaggucagccugaucuacagagugaguuccaggacagccagggcuacacagagaaacccugucuugaaaaaccaaaaaagaaaaaagaaaaaaagaaaaaaaaaaaucauguaaucaauucuaccugauagcuguaugagguaauuuucagagaauguguguauacugagaacagaaauaaagauuuguuggagauucuuuucucugcuucauccagagugaguagagucuuuuccuuucucucuggcccacaaagaguuaacagaacucucagccucagagucaaaaaggagacagccuaagcaacuaacuucuuuucuuaauccccugcugcuaucagcaggaguuaauugccagaaaucaucagcuuuuagccacagaauagugagagaguuaaauugccagacagcuucugacccccaaaacagcaaggaagaguucugaagcuaucaccagccuuuagcuuuauccaaggcucccccaccuccauaccuguuagagcaggcuaguccccagcauguauauguauguaugucucugucucuaucucuaucccugucucugccugucucugccucuguguguguucgcauacacuuuugugcaguuaucaagggaggucauacggugucagaacacccagagcugcaguuucaggugguugugagcuacccaugugaaugcugggaacucaacucaagauucucuucaagggcaacaaauguucuuauccacugagccauuccuccaggcccacuccuacagcuuccaucuaagcucauguaugaugugaggaaucccuacaacaucaacaacucaccaucccaacuuuaagauaaguuaagcuacuuauauguccagggcauccaaacuggggauaaaacaccagcugcucccaaaauuugacaaccguuacccaguggccaacaagugucuacaaaauuacucacgauguacuuggcaauggcuucucuauccagaggcugugucacuuucagccagccugucucccucucaaugaugaaaacgccaacgggggguuugucagcuccuuggccggugaugcuguagaaaaccuuuguuucuuugucccuguuggauuugaucugaacacaaaacagaagaggaucagaacuggccagggaagaucucaacauggggucuuuucauuuucucuucucucaagagggcagagccugccaccaacuuccucuccuaccugaaccagguucuuuggaaauucgcccuuuucauuuucggggcagcugaugggagggaugacccagucucguuucugucuucugagaccuggguacacgcugggaaacaugagcagcucuggguuggauucagaggcaggguccuaagagaaaagaagauuaacaaaaugagguaaugcagaagacauacgggucuaacaguucauccaucccauggacguccaccaucuugaauuuagugacucauucucaaugacaaauuaccuguaccauucaagaugaacaguuaaaguuuaagccaaagaaauaaacauacuguugucuggacgcugacuucccacaguuccuaugccuaaaagcuugguucccuaacuuaguggcuaaugagaggccuucagaucacagaagauauucagacccgagucucaucuuugcuuucuggaucauaugacaagugguuuacucuccaguacgcuagcccaauuagaggacagaauaaaguaucauaugggcuugaaccuccagaguuaaaaacccaagcaaaccccaccaccaccacccguguuaguauguuuuuuuguuguuguuuguugguugguugguugguugguuugagauaggauuucucuguguagcccuuugcuguccuggaacuuguuuugcagaccaggccggccuugaacucaagagaaauccaccugcaucugccuuccaagugcuggaauugaaggcaugugccaucaccaccagguuguucucauuaaauccuuaauguuuagcauucaaauaaucacugugcauacaaaauuuguggguccagacauuugacaauuguauuuaaaaguuauuucaaacuuauaugguacaugcccuuuaagccauacacugauaaugucagaaguaauucaguaacuagcuauuugggaguucuaggcuucucuucuuuuguuucccuagggauacagcucaccaaaguggagcuaucaaucaacgaguuuggggaauugcuauuaagaacuauuucugaggggcuggagagauggcucagugguuaagagcaccaacugcucuuccaaagguccugaguucaaaucccagcaaccacaugguggcucacaaccauccguaaugagaucugacgcccucuucuggugcaucugaagacagcuacaguguacuuagauauaauaauaaauaaaucuaaaaaaaaaaaaaaaaaaaaaagaacuauuucugagaucgauacaaacauguuaaucuuauuguguuauaucuguaaggguugcauuuguucuaacagaagcagcugggcuaggaaacaaaaauuaccuggagacuugcauugaacaguucucaugugcaauaaagauaacuuccugcacacucagggaaacaggaaagccuaagaugaaaggcgacaccuccuggauugguuuagaaugauuccugguaacaaaguuucuacaagaucucauccuuacccuccacaggaagacacuacaucaacagagaccacagccugccaaguucuagccaggcccucuuuccugucugucuguuguuugguuggaacauuuuuagaaacaaucucaugaagcccagucuggcuucaaauuaugcgggccaucggugaucuugaacuucagguccuccugccuccacucaacaaaggauggaugaugggugcauuuaugugauaguaggguauagaaaccagggccucauguacucuaaaucagaacucaucaacugagcuacauuuucagcccuucuggauugguccccccugcccccaagaaucaaaacaggaaagaccgacagacauaaaaugugaccaaguauucuagaacucagucucacauaccugucacacacacacagucuuaccaucccugcaucuguuacccacagaaaaaagccagcaugggcuaaaggcuggcucugggacuggcuaccuggcuaccagaauagcucccccucggucuccagaggaucacauaccuucugugagaacugucccaauaucuaaaguggggauuuguuuuguuuuguugagauagggcuucacagcauaauccuggcuggccugaaacuuacuauguaaaccagcacucgggaggcagagacaagcagauuucugaguucagugacagccuggucuaaacugugaguuccaggccagccagggcuacauaugagaaauccugucuugaaaaacaaaaaccaacgaaacaaacagaagaggugugcaccaccacaccuggcuuggggguuuccaaaaugcagacuugaaucaaaucaugauauggcagaaauggagaaugaagucagcggaggggaggaugagggugaggggaccagggcaaagacaaccuccaaacuguuguuggucuuagaaagcucccacagucaacugccugguggggacuuacugugcugaacaugcaugcaugcuugacugccagcaagcuggggcuugggucucaggaagccaugacuaacauaacagaacuaaguucuucacuucucuaauuccggagaggaaaacuacauccgggauuauuaaaucucaggagucucaagugucuucagagaacagaacagaaaucaacuuuaaaggcuuuggcacaauccacaccccgggagcagaaaucaaagcgugucuagaauguccccuagagagacaccauaggaagugcccagagaccauucucaaaauggacagaagcauuuauguggcuuuuggugacauccuccagggacauucccaagcagagucuagaccacacacaagcuguguaucugccucuucacuguacggguuuucgggacugcgcaggaccuaagagcagcacugcaaacaucaggagaaggaucuuacauaacgacagugcaaagaagacuuaaaacaaacaagcaaucuguuuaucaucucuguguauguuugcaugaauugaaggcaccauucauguguaagcacugcagaggcccgaaagggagccugugucuccuacagcugaguccuggcuguucuaugguaccuaauggagguuuggggagccaaaccuacagcugucucuucagcucuaaaaagggacaaagacuuacuggucuuccuucccccuccuugcuaaauaagacacucauucucucuccaggaaggcaaggccaacagagaguauuugauaagacucuaaccuuccacucagcccucccuccauagcuuagguucacauagguagucaaccaagagcagauagaaaugauuucuuuucaaagccaaauaugguaguacaugccuguaaucccaaacuuuggaggauugggaguucaaggucauccugggcuauagaucaaguuuggggacaaucuuggcuacacaaaaccauccuuuaaauaaaacaaaaagggggacagaaaggauucuacaagauuuuuuuuaagguaucuagaguaggggguguagcucaguuggcagaguacuaagucuagcaugcaugaacccauguauuuaaucccuagagccccacaaacccaggugugauggcacaagcuuacaacccuaucacuccggaaaugaaaaauuagaaguuaucuucugcaguacagugagcugggcaccaucguggcuauaagaaauccuguccaaaaaagagaaaaacgaggaagaaccaacccuguaugaaaccuauuaguacacacccacagucccagaucaagagucuaugaguuugaagccaaccugggcucaaaccaaaauaacuaugagaacaacucuguccgcgcagaacauaugcagacuuacuaauaagggugcaacagugacugucgcauagagucaugaguugagcauuaucuuauguagaggugcauucgcagcaggacaugcuggcuauaggcaaauauccucaccccuauugagcauuuagguuuucauauucauaaaggaagaagaugguccuuguggauaccaaguguauguacaugaucucggugucuccuguguguaaauucacucagucugcacaggggaaacgaccccucuggugucacugggguuguugucagagagaaagcaacugugggcuaacaauccaggcagggccaguaucuuccucaucaccccauacuaccagagccacagaacccaacagcaaaccccaagcccaauaggaauggauucagucagaacgaaagacuguccucaaugggggguauuuuugccacucccacccuaagagucaugaguuuauggagguucuucugcagguauuccaggcaucagggaugccacguagcauccuagagucuucccauaaaauuaucucgcccaacaaguccccagugcuaagacuagaggccccccagauuagacagcucccugaaaaauauacacauaucuaagaaauacccccaaguacguacgcggugguggugccggugaugguggugccccauggacuucagcgucacuuugguagacagcucccuaugacuggagucccgggcgcggacgaggaaacuggucuccagcuuguggagcuuuagaugccgcuucacugugauggugccgucugucgccacuuugaaucgggagucuuccgaaaagaaggcuguccuuggccggccagugcauccuucaaaucucacuacaggauggagaucacagagauuaggaaaguggacagaucacagacaggacauuucuucuccagaaagggaaccugauucaucuagcacaucauacaaaauauacacuaacucaacaaacuggcaaugaacaacccuacccggagagccuuggccucaucguuaaauucuucccaaauacagggcaacugacauuuggagucugggugguuuuuuguuuguuugauugguuggcugguuuucuucacuuagucgucaaugaguaucuugucuauaaagcaaaucuuucauuuucagagugaaagcaaaagagauacuuaauaugaaaccagaccgggaaaugucucaucgggucagagugcuugcagcgcggcauggugaccaaaguucggaccccugaacucagguagagcaagaugugguaaugugccucuauaagccuggcgcuccugcagcaagaugggagauucacccagaagcucaugggccagcuagcucaguguaugcagccaagucugcagagacaagagacccugccucaaagcaagacggaacagaagagucccaaaguuggccucugaccuuuauaccccuccauggcacaucuguaccugcacuuaugcaaacaucagacccacccacacacauacaccacacacaaacaaaacagguaugggggcaaggaacacugguuacauuuccagagguaagcaaaucugaggcuguaggaaacccugccuuauaaacccaaggcaccuagauggcucagcaggcaagcaugcuuacagccaauccugaguuccacuccuggaaccccacagugaaagaacucacucaaaugauaagagaacuaacuguguauagggggguugggaagugggguuucaagacugggcucuguguagcccugaccauccuggaacucacucuauagaccagacuggccuugaacucagagauccuccugccucugccucugccucaagugcuaggauuaaagguguguacuagcacuacccagcuaagagaacugacuugugagcuauccucagacuuccucaggcauaccauaugggacguucugugcucaugggcauaagggguguguguguguguguguguguguguguguauguauguguguguguauacacaaagagaaguguaauagaaaaaaaucucagagggcacauuugaaugaauucacaacaaaucucagaaguuagcuuacuuuccaaacuuucaaacaauugcccaucacuccccacaacggaacuucuacuuugccuaagcauucucuuaugaaaaucccuacuccccugccucuuacauucagguggacggaacacuuucugccccaggaggagaugccugugcuacagugcucauuucuuccaccaggggucacccuuguaaacaucucagaagccaaaagccccuguacuugacagagaaaauagauaugaauguuguuucagugagcaagaagagggagggugcaggcaccaccagucugacuggcaaaaauacacacuuuggagcaaaaggcaaaugagagauaacagucacaggaggaucugucuaaacuugaagcaacuauccuuucuuaugggaagaauggauauguaggaaaagagagagagacugagucugucugucugucugugcagucgaugcuauccaccuuguuuuguaagacuagagucucucauuggccuggaacucaacaaguaagacaggcuggcuagccagcaagcaccaggacuccaucugguaucugcccgugcauacugagauuacaaguccuacacugagaguggcagacuuucuucagggcauagcaagcaccuuacaggcucagccgucuccccuaguucccaguuagcacuuuuaaaguccagauuaggaacauuuaaaggugcucuuaaagaaacccucucaaccugcagcacagguacuggggugagggggaggggcaucugagucaucuuugggggccugucacauaagcagggaacaggagcuggccuugauuccuuucuccagcccgcacaaaucuagccagugaaaaaccaacaggaacaugacuggaccugccaagggugguagcaaaagagagcugagaggcuugguaaauaaccuggugcgaggcaauuaaccugcucaaggcaccucuuaauggcgacucggccucacccuuggagaagugacaccuuguaaguaugacaagagaggcccgaccugaauuuccaggugcugguuaaggcucauuaucuuucuguaaaaccagauccucugggcugagaaauaagggaaaguuggaggggcuugcuggcuccaggaagguucuagaaguugucuuccaccgggcucagcuaugcagaacucugagaacaccaagaucagcccaaggagcugggugugcauugauguuuccccaggggaagguacugaauaaagaaagcugccaagggacuaagucaaccucacccagugggacaccuuuccuuaaccagcugugcuaugcacugguccccaugggaauuaagaccccugagcaucugucucuuaauuggaaaaccuaccacaguagucaccaccaucaccauuauuaccaggaaacuccacaaccucaaacugggugugguagugcacaccugcaaucccaugauuggaaagucugaacuaauacuuucaauuacucuugucaacuacuuuggccacauuuuaaauauuugcagaacacuaucguuccaggcuccauuuuaagcacuuuacaaacauuaaaccguucaaacccagaacuuuauacaguugauauaugcuuugcuuucuauaucuugcuuuuucagacugggucucuucucuguacguagcccuggcuguccuggaacucacucuguagaccaggcuagucucgaacucacagagaucugccugccucugccuucugagugcugggauuaaaggcgugcgccaccacgccucuggcacauccucuuuuuacagaugcggaaaucggcaaggcugggauuuagacgaaggcaaucugagaucucuugcuccuugauugcauuccuugccucucuauagaggguccuugcucuggugguggucuuugccuuguauuuccuuaggcuuuuauuuuuguauguaugggucugucucucucucucucucucucucucucuguguguguguguguguguguguguguguguaggucagaugaugacaacuugcaggcaucaagucucuccuuccauguaggucccugggaucaaacucaggcugccaggcugggcggcaagcauuuuuacccacuuaauucuuuucauccucuagccccuuacuauauaugugcacagggguguauguggcaggggauauaugggggucagaggacaaccucaugggguuagcuuuaugcuccugcuguuacauauaucccauggacugauaugccacugagcuacuggggagggguggugcaacuucucccugcccccaucccagccuugcugaggccccuucagcaugggcuuucuuuuccugaaauuauacacugcugaguucagagcuuaauugguucaccccuaaaugagggcucuucacugcuauucaagacugucccugccccaccccaauuguuggcaaugcaaucgaaaacuuugcauacacagacuagcccgugcuaguaccucuaucaugggcaugaaugauaacuggagaaaacugauagaagagggguugaggugggcuuuuuucccccuaaauacagcucuguaguaaagcauuugccuauaacacguguaaaguuuugaguuaaauuaccaauagggggcaggggagggcuggucucaauccuagcacuugaaaguggaaagaggaccagaaauucaaggucauccugggcuacauagcagauuagauagaggccagcccaagaaacaucagacugccucaaacuacccacccaagaagggugugugugugugugacauuauuguuucuuuguugauuacaauuaaaauaaauucuuuaaaugacaaaaaaccaagaaugucuuuuuaguaugccuaaguuuuauauucauuguaagcaccccaucuuuuagcaggcuuggcagaaguaguagcuaacagcagaaaacccuggggacauaauucaauacaaauaaaaggcaggguuggugaaagccucuggucacgugggugggcgggcgggcgggcaagcgcgagccuucgcuacauucuuuuccaguaauugccaucgagccaaggccagccucacuugaaggaucccauuucuucuuccacuaggguggccaucucuggaaugugaguggguagagacaaggaaucucagaagccucugaacaucacagaaaaugcuggggcucgaggacaggguccugucaccaagggcagcuaaccaugguugaucgcuuuagcaacuaauaggugauccagucucugggaaacuguuugaaaauagaacccugcucauaccaugcacaaggcaggacaugaagaacagguguuuuuguuuuguuuuguuucuuuuuuuagacugccuccuuuguucaaaccucuucucugaguauccuugacgagagagguuccacagacaacucugagaccuccguucagcuauacuuaaaggaccauuuauuuauacacaggugguuggcucaagguaacaaagguaugaucagaguuuuccuucugagcuccaggguuacagagcuacacugcuacuguguaucccaaaaauaccucuguauuuucugacucaaacucugaagaccagaagacaaaaaguuuuacccugggcuggagagauggcuuagcgguuaagagcagugauugcucuuccggggguccugaguucaaaucccagcaaccacaugguggcucacaaccaucuguaaugggacccaauacccucuucuggugugucugaagauagcuacaguguacuuccauauaauaaauaaauaaaucuuaaaaaaaaaaaaguuucaccugaaggaugaggggacaggaguagacagucucuuguuuugugguucaguauuccuuucuaaagucuucacagaugucaccacccagaaaaccuccccccaggucauuuucuuagaugacauugggcaaugcaaugccggaacucccuccuuugauguaaaauauuaacaugucucauguaugagguugaugauaccuuugauagguguccacaaaacuagaaaggacuacaagcuugugaaacaaccacucccgcaggagaugucaccauagcuuuagaaacagggcaugguggggguggguggguaugggggacuuuugguauagcauuggaaauguaaaugagcuaaauaccuaauaaaaaauggaaaaaaaaaaaaagaaagaaagaaacagggcauggacaagcuacccuuuguugccaaggacacauggguucacucagauaggucgcuauuuguguccaucucuugaaagcugaagacaagaacuauaauguucuguuuauuagguacagaagcccuggguuggauacaccuagucaggcguauacaguaggaggcauuuagcaacucuuguucacaaaugaaauagcagaaacacagauagguaaaggauguggcccagccacauggcuaggaacagacaagaggcuguggucucugucuacacuguggcgagucgccuagguuaccuggcuauuaagugaagauuaacaggaaguagcuacagcuaccagcaaaagaucauuccguagacaagggccucagaaccacaaggauacuaacagaagagguuugaacaaaggaagaagucuaaagccagacucaagaaccucccuccuacaaagcaugccuuuagucccaucacuugggaggcagaggcaggcaaauuucuggguucaagaccagcuugaucuuauacagaguuccagaguucuacacagagacaccuugucuugaagaaccaaaaggaaaaagaaagaaagaaaaaaacaaacaaaaccuccacauuaugucaccacuugucauaaacugaaauaagcuguauuuccccuaauaggucacccauccccacuccugcaaggaccaggagcucgaaaggucauacuacacaagcaaacccccagccuguguuccuaaugccauagauaugugcgccuguguugaaaggagacucuggggugggggggggauuccaaggacaggaaacuuauuugcauuaaaguuaccagauuuucucccaacuucucuuaaauguccugguccaaaacaaagucacuaacuucacuaauucagaccaggaggccaggugugguggcauaccccuuuaauuccaacacucggaggcaggaggaucaagaggcuacagagcaaguuggagccuagaguggacuccuagugagacucugucucaaaaaacaacaucaacaaaaacaucucaaaggaggccagggauaacacccagaggagugcagcaaggagagcccagcaaaggcacagaagggagagaauucacucaggcucauuuaacccugacuucugagaguaaacaggacaaaggacacuccaucaucacccaggacugcccccccacccccagauguaaggucauucaugcugacuguagacauuggggcagugauuaucugcccagguucuaccucgccauguguuccaagcuccaugguaacuccagugagccaacuacaaucaacaggguaaaaccugccaucagccucagacaugagacguguuaauagucuugcagcuuggugaaugugguuaaacacauucaaggguucaggccccagucuugccucucuuuuacaccacagcucaccucugccaaggggcacuucccccacucacccccucaagaauguaaggauucuuucucaaaaaauauguggguuucuuuccucccaagaguugugacccaaggcagcugggguaacaaacacauaucagacagagaagguaacagggaccaaggugggugggacugauuuaaucaaggauagcagggaaggcuggacuuccagagacaugcucaagccacaaggcacaggguagugcagaagacccacccaagcuccuugugccugucacagccugggugcugcacagaagagccaggugagaacacagcagaugugaccacaguacuggaauugaaguuacgguagcugguagguauugaagucuacauaggcuugcaaccagcaauggccccuguuccuucaguucagaagagcuaagaucuccuccaucuaaagagccaagaucgccuccaucuacuuguccuucaugucaagaccaaggaaaagaaacagcagcuugaagucauuuuccucuccaggccccucuuagacaguccaguguccacaacccagguuucaauguuccuggaggcacuguccggugaggaggcaauucuuuuaagagaaacugaaauccggugcaagaagauggggaauuugucccuaccugcuguaauagggauaggguggggccagaaaugggccugaagagcuggcucaguuuuuaagagcacuuaacuucucuucugaagaugugguucaaaucccagcacccuccccagguaccucacaucugccuguaauucuaguuucaggggaucugauauccucucuucuggcccagcugacaccagcagacaaagggagacacauacagguuuaaaaaaaaagaaagaaagaaaaaaaaaaaaaaccuuuggcuuucaugccaagucagggcugugguguccuggcuuuuagcugcaagcagacaauaccaccgcacccuacugccuaaauacaggggugcucucuggcacugccacuggcuacagcccacggagcauuccuguggcuguuugggcgacuccacgacuuguuugcuuauugauuaggaaggaggcugcuucucuacuuuucccuucuguggauuuucccaagcccagagagaauccuguucuaaauuccauacagcugagucccccacccucaaccccugccaccccccgacaaaaggcaggcaggcaggccugagugccgcugagccaggcccuccuagcccucucuaguccuuaauguagccuuaugagcucucaggccuccagucccacucggggacuaaagcauguugaccaaaaugccuauaaucacccucucggaucugguguacagugcacauacuguccuggugugcuuugaaaacuacccaguccuggguccuaacuccaacuaacucaauacagauauccagagauggaagagcccaggaauuggcagaucuuaaauuuucuccaagcuccuauagaauccaaugugagcaaagaaucaccaauaaauaaauaaauaaauaaauaaauaaauaaaguaaguaaguaagucauugcaucaggcauaaagagggaaacaugacucagcaaaggcucagagauguuaaaugccucuuccaaggucacacagcauaaauggcaagaguagggcucaaacacugguugaauauagacgacucccacacagucuuucuccagccugaccugcuggguuuggggaauuuccuucacucccuuguccgggaauggaaagugagaacauaguccuuccacuuacuaacccugauggcuggguucuaaagugacggcacuccgucaggacgucuauuuugcacuccgacugggauuuggcuuaguuuugaauaucaacagcaaugccuucuguaugugcgugggagggaguguuacaaggugaaacugcagcguuagcuaacaugccagaguggagauagcagaugcugaaugacacaaaagaccacacagaccccgugccauuccuuugucacacucgaacgucccagaucaaaaagaucuacagauaggacuugggagauggcggguggcaaggggcacauuccuuuuuaauaacuaaauauauguuauauuuuuuucauuuuccucaaugugugaguguuuuagcuccaugucugucugucuguacaccacauggaugcuuaaugccacagaggucacagaaaggcaucaucagaucccuuagaacugggguuauagaugguggugaaccaccaugugggcgcugggaacagaacccgguuccucugugagaacagcaaacgcucuuaccuguugagccaucucucuaguacccaugaaaacgcucccaaguugaugggggaugguugcaaauucuguucauauaccaaaggcauuugauucacaugcgaaaugggaaugauaugugauaagugaauuaauacuuuucucuucucuucccucccccuucucuuuucaaaucugccuauaaaacaaaaacaaauaaaaagguggcugagagauggagagauggcuuggcuggaggguuaacuggagaguuaagagugcucacugcucuuacagaggaccugaguuugguucacagaacccuggggcagcucacaaccacccuguaacuccaacucugaaggaccuaaugcccuguucugacaccugagggcucaugcacucaugugguauacaugcauacacucaggcacacaugcagacacgugcauacacucaggcacacaugcagacacaugcaaacacccaggcacacaugcagacaccuauacuuuaaaacaaaacaaaccucuaaaagucuuacaaugaaucuauuguugccaggauggauaaauuaagcuauggcaacucacaacuccccaacaaauagaaacgccacauuuuccuuuugcaguguuuaggguagcaugcaggcccuugggcauguuaggccagcgcucugccuuugggcuacauuccuagcccucccaaaagcacagguauguaaagccucaacuacacuaagcauuaagugcucacccaaaaauguacuugucuuauuuacgcagcuacuagaaaaugaagagacugcggggugugguggcacaugcaaccuuugaucccagcacucaggaggcagaggcuugcagaacucugagccagccuaguuuacauccaugaaugaguucaggucagccaggacacauugcagacagaaagcaggcccacggaggccuggggcugaggcaaggcagguauuagauugccaauugacccaaagggggcuccugaguaaugcaaaucuaaaacuggauccgggugacgggugagccacugagugcaccuauaaaaauuaacacgcauuuccacugggcaaauuguaaggugugcaaauuacaacucaacgaacucgaagaaauauaguuauuaggguuucgugugagggguaccccaugagccaaagucuacacacccaauaauacugaggcugugaagaaguggagaaugacaaggucauaaacaguccuuaauuaacaguaauuacaggaguaacgaggagccaggugugguggcacaugccuguaauccaaacucuguggagguggagacaagaagaccaagaucauugucaucugcagacauuuuaaagcuugucuaggcuacagucucaauaaaacaaaauaggcaggucagacagguggcuuggcuggcaaggacaccugcugccaaaccugaaaacccaaguucaaccccagagaagcaugaagugaauuguuuuaugaccuccagaucccacuguggcguguguguacauggcguguguacacacacaugugcacgcacacacucauacuugcacacacaggcaacacugggagccaucuggguuuucuggggguuguauaguuguuguuuguuuaccuucuauuuuucaagacaggguuucucuguauagcucuggcuguccuggaacucacucugaagaccaggcuggcuuugaauucagagaucccccugccccugccccugccccugccuccugagugcuggaacuaaaaggauacaccaccaugccaggcuccuguuuguuuguuuguuuguuuguuuuuuaaagauuuauuuauuuauuauaugugaguauacuguagcugucuucagacacaccggaagagggcaucugaucucauuacagaugguugugagccacuaugugguugcugggauuugaacucaggaccuccggaagagcagauggugcucuuaacggcugagccaucucuccggccucucuuuuugguuuuaagcugauuuucuuuugggguuuugaaauagucucuuuggaacucaggcuggccuugaacucacgaagauccacuugcuucucugccucccaagugcugcgguuaaaggaaugcaccauugugcccagcugagguugggcuucugaucaccuucuugcugggggcagcucagagucaacagaaccagccaaccagaaacacucaucaauccagggccgcacuucccaagcacaaaagaauacagaaaugccacagcccaugugagaacaggggaaguugccauggaaguaagaacuuuuguuucagacagccuguguugcccaggcuggccuuuaacuccugggcucaagagguucuucugccucaggcucuggaguugcugagauuggaaauccagaauauucgguucauucaguagcucaagaaugagaugugaaaaccucuucuacagaggaagaacacgaggccugagcucuugccaaaugugggcugugccggaggagcggagacccuccgccuccgaccuuuaaacaaaacuccuaaacagacccaaagaaugucgaggaguccaagucacagagagaggccguuucucguucuccaggucacaugcaucagcagaugacucugugacaagcacccacuuguccaccagcgcuucuaagaggcggcuuuuucuuuaauggaugcuagcaucauuuuucauuauccaaaacaagcaagcauugaugggaaaggcagcugcuuccaagaguguuugcuaacccuacacagccugccuggaaagguaauuuacucagaaaauaagccccacaacaaugccgugucccucagaggggaggaggggaagguaucuccauuugggacguacauucuaagaauucaaggucagaaaacgugaaaaaaggaaacggaagagcuguggcgauagcucagugguacagugcuuagcagcuugccagagguucuggguucaaaccucucaguagcaccgaaaagguggggggaguaccacugaagagcccagaguaacgccguguauuauuguucugccaccccccuuuuuacuacaagcccucaagcccuacauuccuuucaguuacaguaaaaccugaccugcauuaaccccauaaaaguugagauaagaccccugccucagaguggccuugggccuauaguauaaagagucacaucgcaggacuaaaccucaauuuaugaauuccuucuucauugucuccugaauauugaucugcuugugauuuuaugcuucaaaaggagacuguugcugcuuucuggggggcaguugcugacuccgagcccaacuucaacccuaacuggguagaagcagcuagguugcuuuugguugauuucugaccuuggugggucccuuucucaucauuagcccuguucaccacgaguagugauuccagcacuggacggcagaggcaggaucaugaaucagaggcuggagugaguuugaauccagccugggcaccacaguaauacucugacaguaacaauuaacagcgaauuaaaaaaaaaaaaaaaaaaagaccaggcugcagauaucagaugcaggcuuuaguguacaauagcguacagccguaggucacauacucaagauaccacagucugagugcugugacaucugccccagaugagcuucucaaaucuuuuaccuccaugccugcgacucuuucaaaagacuccauuaucccuuuaccuagucuguucccaguuuccgauggaaucaagaauuggaaacuugcacacaugcaaauucccauucaagguuucucacuaaggcauuguuugcaaagcacaagccugggggacaacccaaggagccaccagugcaggauuaacuaaauaaaugauggcauuuucuuggggcaaacuauuaugcagcuguaagauaaauaaagcucuucacaccggggcguugagcaaacacuaauacauuaugucagugcugggcacaauggcucacgccuguaaggucagcaaugggaaaguugaggcaggaagaggauugucgcgagcuccaggucagcuccggaccagccuugaguuuuagaauggaaccccaucucaauaaacaaacagcagaauaauaaacauuuuuugcaaaugcucaggacuugggagcaagucacacaagguccuaccuggccacccccuggggacugagaacgucccuagaaucugugccucacaggacugaggaguccuuguggggaaggacaucugcaggguggugaggcaguugggaggcugacccacacaugagccaaagaggagggggaaccgcaggccgcugugggcugucuaaagagaaacauaacagaagccacgucugaugccuggcuccuccuacacccuuccuagcguucaucuguaaggcacagaggcugcacugaaccagcacagaugugggcucaagggcacaggaugcuggagcaagcacauauuagcauggaugggcaacauaucacuauguagccaggcugaacucuccaauaguccugccucuugcucuggucucucaaguucuagaaauauaaaaaugcacuaccacaucuggcucagucuaaugguuggaggcuauucuggcuaugcuuacagaucuuauacuugugaauccucuuuuccuacuucaauccacaagacuccggcaccugcccuagaggagcugaacaaggacgucagggcaggcuuguucucagugccacauaaacagcaaggcauagggcugaucucacacacucaacaggaaaggaugcagaaauucgaaaggaugcagcuaggcuguuuaugguggcaaaugccuggucuucauagugaguuccaggacagccaaagcuauauacaaagacccuguuuuaaaacaaaauaaaaacaaacaaacaaacaaaucccagcaccuggaggcaaagacagguggaucucugcgagucaaggccagccuggucuacagagaguuccaggacaguuaaggcuacacagggucucacuguauggcauggaacuguaugagaagaauuugucuuagaaaagcuaaggacaaggcggcacacccgggacccaccacucugaugacugagaaagaagaauugggaauuugaggccagccugggcuacacagaagaaagaccaugucuucuaacaaaaaaaaggcuaaaagggguggggugcgacucagcaaagcacuucccuagcaugaaggagguccuggguucaagccccaccacugcaaaagggggugggacuuuuccuguaucauuuaaauuggauuuggggggcaggggugagggaaugccugagugguccaaagcacuugcucuucaagccugagggccuguguuggaguccccaucacccacauaggaagcuggacauaacugcaugccugugaccucagcacugggguggacagagacaggcagauccagagcucucuggcugcccagccagcuuuacauuuagugagggaaacuuuguuuuuuccuuuuucuuuuuuuccaggacaggguuucucuguuguggcccugucuguccuggaacuggcuuugcagaccaggccgagaggaccuuucuuaagacaauaaggcuaagaaggaauacagcaaaggcaccugauccuguggguagccuccauguguguaagcauggauggguacaugcacuuacacucucacaugcaugugccauuacaauacaugcacacucaaucuaaguaaguaaagagguugcucuccucucuuuacguaacaaacguuuuccuugucuuuaacugagagcccaacugaaugaggaaccuguggucaacagcaaacaacugggugacauggcuuccaaaacccugagugugggucucaguugcauuaucgggcgaagacauuaaggacucagggagccuguggguuccgucagauucuuugcgguuugauaagaacaucuucagggcugcaaucuaacgacauaaaugauagaugauguuuugcucuuuccaaaagucaggcuuuaagagggacuuugaccccuggagcuagucccggggcacagggguaaugauaguaaguggcccucugcaaagggagagacagaaacggagaagaauccugagcgcuaagaguucauggcugacuucaccaggaagggccagucacacgggcaccugaggauaacgagaaaggccagcagagacuggaaacaaagauagcaaaggaacagagcuguuccuguacugagacuccucugauuggaccuaccccuuccugaaggccccuuuguugaccucugauuggaccagcccacuccgccccgccccuaaccaaagcccuuugcucuuuuagcacaggugccccacgcuacugccagggcugguuggaauuuggauaaaucugaacuagcuguggggcaucgggaaaacccacucgcccucuuucuaaaacagaaaguuggauacaguagcauuggggaggcaaaggcaagaaaaucuauuccaguuugagaccaaccugggcuacacaggguuuaagggugaccugggauacauaaaacaaaaacagacguaauggccguggaugauaagucauaccuguaacccuacacucugaaggcugaagcaggaaauuugucacaaaccugaauuguagggugaauucuuggccagccugagcuacagaauaacacugauucaaaauaacaaaaaaaaaaaaaaagucacugccucuuacagacucuauaaaaaaaaaaaaaaucugaagggagagccuaugaagugagcuacuaaguauugcugcugugauuacacugcaguggcccaauuggcagaacuagaauuuucugcagcugccucaggguagguggcgcccagguggcugagcaaccagcagggcucccuggccucagugcacacccuaagccuuggucaccccugccugcaggcguggcugccccuaccuguggggggugccugcacagcuccacucuggggaagcugauccguccccgccccuccucaucaaagcuucgguaccacagggaacagugucuguucgugccagccacucccuucccagaccacuuggaaacgaaucuguggacauaaaaggaagcucccuggguagcuauucugcuuuccugacccauccguaaagacucaggagugggcggagccaggguuuacuuagguuggagaaugggcaucagagaaaguugagucccugaaaugcuaagaacauggauauggaacauggauauucagauggaggcuccacaguguuggacugguaauucuccagagcaccucagacucucagaaaggaucccugccuuagagauaugcagagaggauuaaaauaggggagggggcuggagagacggccaucacucugagcauguccugcucuuccugccuggaguugggcucccagcuuucacguugggugugguucacaaccaauuauaagaccagcuccagaggaccuaguacaccuuuguacacagaugcacauauacacaaaagaaaaacccuuuuuaaaaauguggcccagguuuuaguguugaagauggaagugaaauaagaaaauucuggagaccccccccuguggccacaaugacuggcuauucccaauaccagcccuuuaacccaaacccucuaagcaccugcagaggaaucccuccaggccgaccugcauugcuguagauugcggaugggggcagcacuguggagggagggcagcacguccugggacaaaccacuggagcagcucaacacaucccacagggcagguagaggaccaaagugcugaugggacagauggcgcuggcacaggacccacuuagaaggagccucuggguacuuggacaaugcaggaacugcuucuaagagcugugccgauguuggcuccacaccuuggcuuuguuggcucuggcagaacuuuaaaaggccaucugaauaucccacaaaggccuucauuugcuuaaauaaaaagcaaagccuuuggguguagcucccagagaaagcccuggcuucucacaggaugccaggguuggguuggggguggggcuggggcugggggguggcccacagggcaaagcccuuucucuagucaguccugcaaauaccgugcauuaacccaacucuccccauugaugccagcuuuaaauaccuucauucuuaaugggccucuuuuuugcugacuggguacuucaggccagucacucucaagcuuucucucuuaaacacccucucaagcuaucagugcaggcucuccuggaaagccacuagcccuggccuccuucugaauauacaacauaucgauuguaucuaggcagguagcuggggcuucucagaauccugguugguuuguuuguuuuaaaggcugcaaagcaaaguuccucacaggaggugggcccaggaagacucacugguugguuuaggucauugccugagagauaggacagguuggaguagggaguucaaagcuagucugggcuccauagugagaaccuaucucaacaaggacaaaaggaaacaaaaauaaaaaggcuggcaagauggcucagcgggcaaaggcaugcagccaaguaaaaugacggcaggagaagacgcucauguuuucaaaccuccaugugcacaacgugguaugugugcacagacacaaacccaaaaguagauaaaauauaauaauaacaaaaacaagggacuggagagauggcucagcagcuaaaagcacuggcugcucuuccagagguccugaguucaauucccagcaaccacgugguggcucacagccaucuguaaugagaucucugaugcccucuucugaagacaucuauauuguacucauauacauaaaauaaauaauuuuuaaaacauaaaagcaaagcaaaaggaaacugguagguaauauuuaaaaguaauuaguauuuguccuuggcaaucaauuuuuaaaaucaaaacuacuguuaauaacacaaaauucagugguuuggauauagucuccaucuuguguagcaauaaccaguuucuaccuccagaacgcccuggccacuccccuaggcaacucugugcccaguagcuggucuccuccgauccccuguggccacucauccuuccugcucuggguauucugugcacaucuggugccuggucuagcauuuucuuuuuuucuauuuguacggcaguucaaaaucaaguaauacauguuugauggagacuauaaagauugcaucugggucccaggcuagcagucugcagccugcagcacucggccacugggcacuaugcuguauugcuaaaccauuuugcaguguuccaacugcacuuccaacuuagcaggauguuacccacuguaaguccagaagcuugugacgugagaggucaagugucccgcucugccucagucugauguuucauuuguuuuccaucuuucccagauagccucacuauauaugcauagccuuggcuggcuuugaauugccugcguggcccagguuggccuuaaacucagccaucuaagagguaugcauauaguucccugccuaguacugcuaauagcuguuuucagguguggcguguguguuccugggagugaagaagauauauauguuugggcagaaguagaugcuggauucccuucucuauuauucucuaccuuaaaaaaaaaauuuuuuuuugagacagugccucauguagccuaggcuuacgacuuagcaaaaauguccuugugcuggaauggaccaccaugaccaguuuaugcagcacugcagaacaaguccaggguuucauacacagcagacaagcacagcuugagcucuggauaaaccagaacucacuguguggacuaggcuagcuucaaacuuccaacguuccucuugccucugcugagcaguaaguaugcugugcugcuaaaccauucugcaguguacuaacugcacuuccaacuuuuaugauuacaagccugugacuccaaaccuggauggaaaacaauccaccacacgugaggcccaggcagaacugccacacgucugaggccagccuggucuauacaguugagcuccaggccugccuccagggacaaacagaaucagcuuucucuccuagauugcccgcuuugaggaaagaagucuguaaaggacagacagaccugggggcuugaccuucaugacuaacugcagcagcaucugcaucaaagcccuuuguuccuuguggaaguaacaugcagacacuaccagacacuucagauccagaaacgccagcuugccuuuauuacagggggagacauuauaugucuuuuuaaauuacaaacuugagcucuguguguggcuauuugugcgcauagauguagcuuauaugaaauccaugugcuuaaaaacacaaaaccagaaucuugacuccuauaauccaauaagaugcuuccuggcucaacccccaagagggagaagaaagagggauaggcaggcugaucaaaggcaggacuaccuccccuucuuuacauucuugacuguacagaauuggaggucaugucugagaugccuugcguuuaaguuccuacacuaaauaaaacauucuugggauaguuggggguguuugaauauggacuagacagcaaaugauacuguaaaucuccuacccaugagaacgggcagcaugguucagaaggggcaucaggcaucuuauccugacucauggaaugcuuuguuuuccuaaauacugacuuauuguuuggaauugaacaagcuggggcuggaaagauggcucagcagucaaaggugugcacuguucuugcagaggacccacauucgguucccagcacccauguuagguggcucaugaccaucuguaacuccaccucuggggauccgacaccuucuggccucuaaaugugugcauggccacacauauacagaaguuuuuaaaaauaaaauuagccagguguaguggugccugacuuucauugcagcacuugggaggccaaccuuuccccccaucccgcugcccuccuccccccagccuccaggaagcaccagggugaggacuucucaaccucugagugacccgcacuugcaaaugccugacacaaagcaacaagcuccauucacagaaugaacugcagaaggagguggcuccuugcaccucugggaaguuguuuuuuuuuuuuuuuuuuuuuuuuuauaacuaaaacauuuggggauaagggaagauccuacagaagaacucaaagcgagcauccaaccaugugcacaccgaggacacgauggaggcugacgugccaugagagcugcucacuccgcugcccugauggccucugcccugccccugggcauuuucccuaugcccacguggcucugcagcugcugcccaaggcaccucugaccaccacuaaaaaggucuaacacaaaaccaggcagcugccuguggugccagcacuagcagaauaaguaaggcaggaaggucaagaguucaaguccagcccgucucaaaagggucuguuugagaaccugucuccucaggagucgggagcagguaagaguuugaggcuagccugguuuacagauaggguucuaggacagcaagagcuauguagagagagacccuaucuugaaagaaaagaggaggaggaggaagaagagaaagagggaaggggaggaggaggacaagcagcagcagaaaagcaugucuuugaacuuaagguaagcacuuuaucgacugcccuauuccuccagcuuccuaguucuaucacucuuaaaacaaauauccugggcuggagagguggcucagcaguuaagagcacugacugcucuaccggaggucccgaguucaauucccagcaaccacauggugacucacaaccaacuguaaugguaucugaugcccucuucuagugugucugaagacagcuacacuguacucauauaaaauaaauaaauaaaucuuuaaaauaaacaaauguccagcacccaugacucagagacagguggaucucugugaauuccagguaagccuaggcuacacugagaagcccugucucaaaccugccugucccuuucucucccagucccaccccccacacacaccucucccuguccuucccccgacaggaaccuuuguccuuaaaucucagaaccucaguucacuucacugcaagguggagauaacaguccucuacagcaucuguuuggagagugcacauuccuuccagcacaagugaugaauuagcggacaacuuaagcauagcccagaggucuaccucacuuaagauuaacucagaggcuacuucucuuaugggugugaugauuucugcugcaagaaacaccaggugaaugcagaaaauuacacccagcugcaaaguaggaaggcacaaagccgaagcccgugacaugccacauccacugacaucuagagcucaaacucuaccagauagaucucucucugauaacccuugucccgaccacagcugcacaguaacagguacaaaacacguacgaaguucuuguaaggcaucaguuuaagugugguguuucuuuuuuuuuaauauuuauuuauuuauuuauuuauuuauuuauuuauuauauguaaguacacuguagugugucuucagacacuccagaagagagcaucagauuucguuacagaugguuguaagccaucaugugguuguugggauuugaacucaggaccuucauaagaacagucagugcucuuaaccgcugagccaucucuccagccccaaguaugguguuucuuucugcuuuauuuuuuaaaagagacagggaccugggaccuggcaugguggcauaugccuuuagucccagcacauggaaggcagaagcagaaacagaggcaaaaagaucucuaggaguucaaggccaugagaagaguuccagggcagacaaggcuacauauauugagacuaucucagucagucacacacacacacacacacacacacacacacacacacacacacacacacagacacaggguccugcuauguuaccucaucuucacuuaggcucaagggauuuuccugccucaacuccacaagaacuaagacuauagguauuacuaacaccacacuucccccuccuacauuacaugaugaacuuacagucgcuaagcuucaaaccccauucucccacuggccgguggcuugugucaguccauuuccauagugacuuuugaggaagcuacaucagguuucaagacaaugaacuauauagugcauaccuagaagcuaugggguaaggcucugguaagauugcacccagcacuuggaaggcagauuucugucucggaaacaaacaguaauaaacaaaacccacaaguaaguuaacauacuaucagaauagugauaguuccccuuggcacugugacacacagaauaaguguuugcuuuaauacugacugcugcuccagggcuagaacugaaaugagcaggaacucaccagcaaggaaugucagagucagcugggaccaaaaggcaggauauugagagcagcgcuaauccccaucaaacaugccccucggaucguuucugacacaagaugcugggcugagccauacccagugaugaaugagcuguguuauucuggucuccugcaauuguuuccaaaggacccagaagcuccugggcugaaggaacaaggaacgcacucacuuacuacucacgugcacacaccagugcaccacacccaccguaugcuuggccagaaggaagaaucgguuugaacacagacucaucacuccaucuuggcagaagcugauggauacagaggcaguuacccagucuucagaacugagaggcuggacccuggauaucauuuccauaacugugcagcaccuacagacccucaaggaucucagucacgggccuuggccuuuuccuucucggcacacugugcucauucugucuggagacucccugccuugguuguucuagaaccuucuuucuacucuucucauggaguccuuccucuauuagagaaucucuuuugcuuuuucucuugcagacuacucucuucaauccaggaccacccacaugcuagguacucuaucucugcacuauaucccuccccaauuuucuaaaaguggagauaaacaguauucuuuuuauaucuggauuuuuuuuuuucuuuuuaaaucucuggcugaugccugaaauggcacaccuuuaaucccagcacuuugggaggcaaguggacgccugagucuuugaggccaaccuggucuacagagcuaguucaagugaagucaaggcaaaagaacuguaacuggaggaguggggagagaaaaggagagagauccauauuccuggagccucgaugguagagcacuugccuagcauguguagcagguaaggugcuggguucaauucccagcaccugaucucaugcagcgagugugaggggggcgggguggggaggaucacuugaaaauuuucuaucagcaaccaaugaaauaaagcagguugcaccuucaaggagccuacauuuggaggggggggauguuggagaagcaaucaaauagcauacaguauuaagcuggauuauaauaaaggcuaugaaaaaggaacuguacauuuuauuaugugguagacuccacuaugggggaagcuuuaacagagccuggaguuauaagcuauaugccaaggcaaaggugcccagcagagggaauaguaaacacgugacccugaggcggcagagugcuggguagugaauagcauuaguaaaauccccaccauuacauaguuaugcuaugcauuauacaagacagaucuuacccggggagugggggagugcaaagaugcaaaaaugcuccucauggagcuguguagguggugacacacaugacugaaaucucugcccucuauugugcaauguuguccacccaagcauuaguugguuaucuaguaaagacaauugcaaaugggaagucuagcacauuagaguggugggagcuacaaugaagcaagaacucucuggaggagccaggcaccccacuaauggccagcacacugaaguccagcaggagggcugaucagauuucccucuuuauuuugccuggcaggaacagaggcaaauuuguggucugcuuucugcagaguucuaagcuguauggcacucacuuugccacucagcccuccuccucuuaucuuuauuuucccuuuguuuucccccuugugccugagauacggaugucaacaaauucuucacuggagcagguaaggauggaaggagggaagcagcaaaggagcaaaguucucaguuuagucuugaaaagagggcaucggcaucaggacacaggaaauucccacugcugggaaaaauucuaaauuucucacuuuuccagcacgcuccugguuguccaauaucacuguucuauugcugaagaggcaugugacuuaaggaacucauauccaaaaaagcguuuaacuggggacuugucuaacaguuucaaaaguuuggcccauuaaucaucaugguggcuugaauggugcuggagcaguagcugagagcuacaaccugauccaaagaggcagacagacagacagacagacacauacacacacacacacacacacacuggucuugacaugggcuuuugaaaccucaaagcccaccuccagugacauacuucccccaacaaggccacaccccuaauccuucuaauccuuucaaaugaugccacuccccagugaguaagcauuccaguuuaugagccuaauaggagccauucucuggucuggcucaucaggcuccaucauaagagaaucaaauggccuuccacaguaauaguaucucagagaucuccagaucaguauugaugaccagagauagaggccaaaguuuccucaaugagaagguuagaccugugaccccagcacucagaggacuuacagucagaagacuaggugcuaaaggcccugguggcuaaaauagugaguuuggggucaaccgaagcuacaugagaccccccugucaaggaaagauaagagacagagacacaaagacagagacagagagaacuaaaguaaaccugucacugguuaacuuguuacaagcaaaacaaauaaaugugaaaaacccucaggcucaugacuaauugcccuuucuaaaauaccaggcaaacaacuuggcagugguggugcgugccuuuaauuccaauacucaggaaacagaagcaggcaaaucuugaguuugaggacagucuagucuauagcaugaguucuaggacagccgggggaaaagagaaaccucaaaacaauaaacaacccccccccaaaaaguaccaggaauacauuuaaaaucaaauaucuguaacgcauuauguguucccuagaccugcuaucaaaccccaaaaucaaugaaucauaaacuaaaucagcacacacacacacacacccauaggaaagcaaaauaacgccccaucuguaguaaagaaaguccugaaauucuuggcccugcccaaaagugaaacuguagcugucuuaucuccauguuugaucuggucucugcucaguuugaguuucacacuggcuucucccagggcuuaguucaccguagauuuuuaacacugggcugggcaacucauaaacuagggagccguguuuauggauggaacaguccaaggucacgggaguuaauuuguaaagucacccacugguguggauuaaccaagccacucucccagcgagaagaaaaggcagacugaaggcuggauggacagagccaggucccuuggccauccagccucuucaacucuggaauucugucacacaucuuacauagccugcuugccugcuuaaaucuguucuucagaacacacgacucucagcacccgggaagcaaaggcacaagaucgggaccagccaaucuacaugacuuccagucacucagagcucaaaaagaaaaaagaagcggggagaaggacagggaggaggaggguacaguguacugucauuguugcccuacauuucuaccuggaaggacccugagauucauccccacuuuagaccugauucuacuucaggggugaaucaacacuucaaggagaauuuauaucccucaggggggaaaugugugcccauaaacagauaaaggggaauucagaguucaguguuauccuuggcuacauagcacacuugaaacaacugugugugugcaaggcauacagacacacuuacacauuggcacacuugcacacacacacacacacacacacacaccuugucuacaacuugaaguggcuucuccucacuccccaagucaagaaccaucagggagaguuucuaaauaaaccaucaaaccaucaacuaccaacaggucucuggccuccguuccuuaagauggacaggccugucagggucugugcuuugggggcaaacaaugucucucuauguagcccuggauguccuggaacucacagagaucuaccugcuucugccuccugaguacugggaucaaaggccugagccaccacauccagcgagagucuacgcuuuuaagcuuucuaggugaggcacuccccagcguaggcuugagaacgugcguucugguccagaugauccuuauaguaggaccaaaaagacaguccacagcccuaggccaagagguagaggcaggcagaccguuaggaguuugaggcuauccuagucuacacagugaguuccagaccgcccaaggcuaguaaagacccugucaaaagaaaaagaaacaaaaggggagaaaaaaggaaggaaaccuaccuagccuacaagaggucccauguccacccucagggcuauaaaaauaagugaaguuaaaaugcccaguccuugacagaccucaucccaaauauuuacgucagagucccuaggaauggauuuuuccuuagguaccaccacccuguagaaauacacugaggagcacaggggguggcacacaccugaaaucccaacagaggcagacagauacagauguaaaggcuaacccggagugugggggagcagagcuuaguaguuuagcaguaaaguguuugccuaggagacagguggcucuagacucauucccagcacugaagagacagacuagcagcucauuaaaaguaaaggcuuuccccagaauucggcagaaagcccuuuaacaauugauuaauuacucagcauuuccaaagauggagcuacagacaaaaggauuaagaggcugccucccuuuccccauucaucuggcuccuuagucuccccuguagguucaccucacccuuccacccacuacccuagccugccuuucuaaaccucagucuccuguuuguaaagaggggcagaaaggacugcagcaauaaaggaauuggacgugggacgcccccugucucaucucaauccuuugucuccuccgcauuggaccuauugauugcuauugauugauucugcauaaucugccucuccuccccaccugaugccaggaggaacagguugcccacauuuucacaggggacucugcagacucucugggcuggugcaggaugggcuguuggguacgcuuaagagugaacagaagccgggcagugguggcgcacaccuuuaaucccagcacucgggaggcagaggcaggcagauuucugaguucaaggccagccuggucuauaaaguggguuucaggauagccagggcuauacgagaaacccugucucaaaaaaaccaaaaauaaauaaauaaauaaauaaauaaauauuacaaauaaauaaaggguggccagaaagagggcaucagccgcgugcacgugugcgcgcacgcauguacacacacacacacguacacacacguacacacacacacacacacacacacacacacacacacacacacacacacacacgaugguuauaagaacaaagccaggaaaagaauccgacuuuccuguaaugaccuccccuccugucucuggggucccugaggcccaguucacaccucuccuaacugcuuagcgaguacuugagacaccaggugcuacucuggggaaacaggagaagccagugaacuucugcucuugaaaagaagccaagggaauggagauuagagaaggcuuccuggaggaagcauccaaugagcugaccuaacaguaggucuagcagcugggcaggaagcccagccaaguaccugcuggaaaggaagacagaaugugccagcugguagcagggaaccuagcggcacuaucaagaaugugaaucagggcccccacccugugccaccuggaucagaacccaaaggagaacaagggcucugaccagcugggaaccagagcagccagaggcugguguccaagccauuagcuauuaagacccuacugcuuguaaugggggugggggugggggaauaggcuagaggggucugagaguccuugucacaaaauggugccagggccucuguacagugccaccuaccucugugcuccuccugucuccugcugcccaccaccuaccugacucuacacacacugcccuuugcucagaggcuccguccuggcugugcccuuaaggcugcccccagccucugagcucuccccuaccacagcucuccaucuucaggcccagaaugaaugaacaaacaaacaaacaaacaagaugucugguaagcgaggaugcugccauuugcugagaugggcuccuagacgaaucuagaagcaaauggaaggggagggcugggagggagaagggcagucacagaacagggcagucacagagcagccccagaggucacaccaggccuggucugaccaugcaagccucuccaugggauagggaacaacacacccuuccuccucgcggguuuccagcuagccuggggcaggagagggaagagggccugcuggcuacuccaagcucuccaggauuucccaccucgauggcauccuaacaggccccagcccuauugcagacagucucuaugaccugggaaggacagucaggaaccaagaacaagcuuccaacaggaaguuugcucacagaccccgccccugucaugugagucaucguucaaacaucccuuugcucuggaaucuugugagggggggaucaccccccuccuuugcuuacuguggcccuccccucucagccagcagagagacugccucuucccucugcgcaugagcugcacccccugaggcuccgacagcugcuccagcccacacaggccuggccccaccugcauucucaaugugcccauugucugauaacuuggcaccccagcacuuuccaccaccucagaucccucuccagacccccuugggacauggggaggcuugugaccaacacaaaacuccugggaggcccucacggggugcagaggaggagugugugacggucggaaguagcaaaagcaccuuuccuaugggaagcuguucccacagacaaaacuauccaaggccuguugggaaggaagcaguuuuauauucuuuuuuuuaagauuuguuuauuuauuauauguaaguacacuguagcuaucuucagacacucuagaagagggagucagaucucguuaccgauggugagccaccaagugguugcugggauuugaacucaggaccucugugcucuuaccugcugauccaucucaccagcccccgcaguuuuauauucuuauucauggaaaacuccauuuaaaagaugaaauggggaaaaaaaaaaaaagccaaaccaccaggaagguguccacuagagucacguggaguuggucacagaggccacugagucagggagggagcuggagacuauggaaguuuccuuaucucugauccauauuuagauuuugguggagagguuccccucccaguuucagacuuaacagaguuuaagguuuggaaaacaucuacagaaaacaaaauaguugcucaugcaaagcgucugugguggugcggcuccgucucuccccauuguugccagcuacguaacuccacagaguucccucaccgugaacacccuccccuccaucacuaccaccguccaacaacuguccuuggcacucacagaguuaacugccuccacucccccucccacucccaccaaagugauuacuagaaaacuccuagguaguaauuuggaaaagaaaaaaaaaaaauagugauuaaaaggagcugggagaaagcggaagcacggaagcacggaagcacugcccacuuccaccuccaggugaccagauuucaagggagcacaaggcgggcaguaaguaaugcccuucuguuacaggcuucauuagcagucaggagcuugaggcuccaaguacccaaaggaccagagauagaaauggacugcaugggggcagggagcgcucagguuccuuccugggagcuugaaagugaacaaccccagguagggcugagcacagggagggggaauguaggcuggguugagaguagcuuuaucauguagaucucggcuggggacccugggauaguaagcagcuuuuacaagcuuccacuauauaucauuuggaaauggaauuaucuauauaguaacuaaaguuggugcaaagauuaaaaaucaaagucacacaucaacagcuaguuuaguauucaauggaggcacgccaugaacacuguagcuauuguuuggugaaaaauguuuccagucuggcucugaccccuggccaguucuucugcauucccugaacuugcuaauuuauguacaaacuaaagaacuagagggggcugaagagauggugcagugguuaagagcacauacuguucuugcagaggacuccaguucgauucccagcaccaccggagaaggcucgcagcuggggaggggggguugucucagggccuccugggcaccugcacuugugcacuuagguauuccuauuguucaggaggaaggauucgggaagaggagaacaaggaaguuucuaaaucagacuccuaucaccauaucuacagacaaagcagacggccccuguaaagccagugcuguuggggacacgaggaucaucucaaguuggaggccaaucuggauuacaucaucauucuaaggccugccugagcuauagagacccucucucaaaaacagcaacaacacaacaacaaaaaccaaaaacaaaccccuccauaugcuuaagcaccaggcacugaaagcagaagugaaugaauguuagcucacuggcucccuaucuccuuucacagguaaagggacagacggacugagguuaagcaauuuacugagguccaauggcaaggaggggccgcuguccaggccacccaggcccucuccucccucccugcugacugucauucuauguugccgcuguaauuucaccagcugaagaaagagcaagcacucaggagucaucuugacaucugcugauuaaccugacacuuggugacccggucccuaggguuuuuuuguuuuuuuuuucccccucuuaagacagggucucaucugaaagguauuuacuucccucccagguuuuaaggacuccuauuguucaagcgaaaggauuagcaagagaaggggggaaaggggagaaggcguaacagacuccagaagaaaaaccagcugaggcggccgaugaugaggaaauuucaaaaccaaagacuccaaucugagcccagagaccugugaggugcaccaagggugugagugaguuccuuccuucuucacugugaaauagucuccuaaugcugcccagacucacccuaaauuuccaggcuagauccuucugccucagucuccccgauggcuaggguaacagguagauguagacagggguucuccuuucagauguagauuagaaguucacccccuuuauuuuaugggcuuucuccacgggcuuagucaggccugagagcuggguggucaugaaacuggcuaccugaacuucaccaagaagcuacuaaacaccagccaugucugcagaacuccugagcaggaagccagggagaagggacaaauaacacguacagugagggaccuuggaacaaucaacccuaaauggaaugaauaccucugccaaaucccucaccuugggggccccagggagcccagcaaagaggagauuggaggacaucaaggaaacacaauuugaacaaugcaggcaugaacucagagacuguggcaggacgcauagggucugcaggggucugcaccaaacgggggacauuagagcugaguaaaguggacacacggccccaccccuaaccuagaagcuaucucaaacuacuaaccacuugcaaaugaaaaacuaguucaugaaaaauucucuaagagagaaacacaccacucaguuuaagggcccaugccggccaacacaaaacaaacucaacagcagcuugggaaguugucccauaauguugugccaggacauuuguuucuaaucuuacaggccauguacauauauuacggcuuccgguuuuguuuuuauggacccccuguuugcauguaaacgucugugucugcgucucuuaagcuuucucuuuaacuuuuucccuugucuguucuguccuauuuccaguuugcuuucaccuuauuauuccucuuuuagauuccuguuugcuaaggagagagacggcuugaaaggguguagauccagaugggugaugucaugguugauucacucuuugaaagagaaaccuucccaggugagaccucucuaugacucaggacccugccccaccuguuaaaguacccagguaugucccacuccugacucagagugugacguuuucugauaggaaagccacgacuuucccacaaacagguuggucagcuuguucccuuuucaaacacucccacacgggcauugugagaaaucugugggggaggaggucugcagucucaagucuugcugguguccacaucagcagcgggucaccaagggcagcgcccaaaagguugugauacaaauggacaaucucuccagacugccaugagaacacuggagaaccaggcuagagccauuuuccuuaggcaacaagccaagaggugggguggcuaggaaaagagcauucgauucugguuugaaccggauacccuuugaaagaugccagggcuguucccgcccucaggcuuguucagugaaugcuaccaauaagugcuugaaagcaugggaggucagcacccacaggauccaaucuaacuuuaugcaaaguccaaucgguuccauguuuuuaaacccauacugggcuuaagcccauggcugguggggucuaccuuuaaccccagagcuccagaggcagaggcagguggaucucugaguucaaggucagccuggucuacaaaguaagacccaggacagccagggcuacacagaaaaauccagucucagaaaauagauggaugggcaagccuggagcccauauaucuuagacaaggacucuaauacugagcuauuucacaacaauuuuuugcuuuuuauuuauguuuuacuuuuuuccuggguguguacuguguaaguggaggugugugucacuaaucuuagcacuugggaggcagaagcuagcaaaucucuguggguuccagggcagcauggucuacauagcuggucuacaaaggcuacaugguaagaccuugucucaaaaagauguaauguccuguauucugauuuggcacuccuguccaugaaagagaaugguguaucuuccauauggauguagaacuccacuaucaauggauauuggcuggucaauagacccaagagcugguaucugauggggguagcuuugcauuuuugucuuugagcuuucuacaucucucuucuagcuccuuccaagaugcucagaccugccaagaacuagaaggccuugaacaauuaaugggcugcaggaugaagguugagagggcacagcugagagagccugcuucaggaaugugcugccugacgacggaaaggcagccggugucggguguaccuugagacuuccaucuggugcuuccauacacccagaagugugaggcccaagugacucaucugaccuuuagacucugggcagcaaacuucuuuguaacaagacaauuagguaagguuacacuguagcugugcagggcucagagaaaccagggggugccaagaagaaacacagggccugagaacauagcaucccuuccucaugugcucacacgcugacagcccuguaucuguuugcuaguuugguguguguguguguuggggggggggggguuuacaggggguauggugcgcaucuggaagucacaggauaaauggguucuggaaaaauaaaacccaggaugccaaaagguacaacauuuacauuuacucugagccaugucacuggaccccauuuuaucuuagaaaaaacaaaacccacagcacagcuucuaaaaagaacuguacagcgccauauuuaccuucuggaccucucacuccuccguucacucauucaacagaugaggucuaagaacuuguuacggccugaaguacagcucaagaaccaacaaacacagaacacccugaccuccucacauuuaugguuuugguuuuuuuuuuuuuuuuuuuuuuuuuuugguuuugagacaggguuucucuauagcccuggcuguccuggaacucacuuuguagaccaggcuggccucgaacucagaaauccaccugccucugccucccgagugcugggauuaaaggcaugcgccaccacguccggccacauuuauguuuuuauggaagaagacuaugaacugaggaaauacacaaaccacaugacagguucaaugguggaaaauaccagaaaggcugggauguggaucagcaauaggguacuugcauaaccugcauaaggcccuguugucucaucccuaccaaaaccacccaaaaaacggggagguggggggcuacagaaaaauaaagcaaaaagagaagguccucauugcccaggcaacaucuuaaugucucaucccuaccaaaaccacccaaaaaacggggagguggggggcuacagaaaaauaaagcaaaaagagaagguccucauugcccaggcaacaucuuagcaaagcuuugaagggcacgggugagugauacagacaucacaaacaaggaauacauagagugugauuggacacaccugagaugcuacuacucccggacaggaguauuaagaguucaaaaccagccucagcccgagcugccaugguauucugaguacaaucaggaagcaaagcaucugaacgaagcacauguggggagugggguuaaaaugaaggcccaagccaugggcugcgggggaaggagggacccagagccuuggaagucaugggcaggauuuuuauucagugucaaacagggaaucccaggcaacuuuaaacaggaugaguacuuaucacucuggccaggaguaguagcacaucccuuuagucucagcacuugagaggcagaggcaaaggcaaguggauagauaugccucucugaguuugaagccagccacaucuacauagugaguuccaggcccaaggcuacauaaugagacccugucucauuaacacacacacacacacacacacacacacacacacugaccacuggacggagaaaaggcgauguggggagagaagggaaggaacagggaggagaaccccaaaaaaagcugcugcaggaccuccuuuggaaacagauggcucugcaugccaaaccacaggaacagguguuaguuuagucuugaacuuguccagguaaaauaaauccgaaacacuuucggcuucuuacaagcucuccuaauuacaaagcuaaguaauuauuaucuaggacgaggccaauuaucccacaggggccggugcugguccccauuuaugagcuggcucauggggaacagguucaucuucaggcacaccacaucagguccucgugguagcaucuaagcaucaucgcuuccccgccgcucacaucucccacgucugucugccuuaugugcccuaagcaaguccuaguuggaacucacuuguuagagguguggacugguuuccuucccaccucuccaugccugaacgaagaucuccccuccccaccucaccccccaacaggacccagaaaacugaguaagacaggccuguucagauagcacguaucagauguaugugaaggucaagaggcugagucucaggcccaccaucucacguacaaggcggugggcugaugcaggaggcugcagaguaagcucaaaaccagccuggguagcagugagacccugucucgaauuaauuaaguuuuuaaaaagcaagaggauggagcuguaucucaaggguagagggccugccuaggaguuaggguccucugcauagcaauaaagaagggaaaggaugugaaaggcaaaggggggaggggagcccucucaaagacaaauaacugaauuuuaacaccacaaaaaucaaugagauugaggcacagagaugagggaugucuuuccuagccucaggaaaggaaguggguuucucaggaagggcaaugggcuccacgggacagccuugagucugguaacaggcagaggaaaauuggguaagauuccuguuucugcuuuuccucaaugcuaggaaucaaagucagggccucacacucauuagguuuagccugaccacagagccacaccccaugacuaucucugccuuuuccacagaagaucuugagaaggcuaaccaagagaauucuguucaggggaagcucugggugaggagucagggugaagaggaagucucagugccagccauaaguaaacauuuguucauacugaguucgaggccagcccggucuaccuagcaaguuccaggacagccaggaaugaauacacagggaaacucugucuggaaagcccgggagguggggaggggggaacagaaagagaaaaaaagccucaccaguggauaaaaaggcccaagguccugggggagacuuuccuuuacugugccuggacacauccucuuacuuacaaaggcccagcauguaaaacugaucaugccugcugugcuggccccucuucccaaauacccugcagaagucucaguaagcagagauguuucugaacuucccugaggacagaggcuggaucucugaugcacuggcuacauuuccggguccccuagcaccauggaccacgggugcucuuggaucuugggccucaggguagauagccaaaugcccacacccugguuggcaccggguguuuacuagucaaacaccugugaccugacuccuggucugucaggaaaaugaauguuguguccauccgugugguaccguggcccuuuaaaauccuagcacuugggaggcagaggcaggcggaucuuuuuuugguugagguucaguaaauugggggagggagguuaaucuguauuugugaauggcaccagaugacucaauucuuauccauggggggugaaccagucucagaagcugggucagagagcauuuugcaaugggucaacaaauggguauccuuaagcauguguauuaugaaauaguucuagaaaaagugaggguuuggggaacaacaaacuugaggccauccugaauccccaacccccagcuacucuggggcccuacuuccagcccaguuugaacccuuucuaaggcacagcaaacccacucccggcauugcaaggaagaaaacaccauuggacuuccuucucuaacaaaggcaagcuccuggucaaccguuugcaaagcaguguuugcuuaguacagaagcccggggaaugaggaaacugguuugacugguuugcugggcgggagagagcuuaggggaacuuucaaccaacuuuagaaccaaggguauaauggaaagggaaaggcuucuacugcuagcccgcaggggguccuacauacucuacuguauucacugaacuuuugguauaugcccuuaggauacguaugcauaugguuauacccauuuuggagauggggauacuaaggcuuagagaagacaggccuggcaagagucccagcuaggggcucuuggguggugcacacugguuauuccaacacuuaggagguauaagugagacgacccgacauucuaagccugaugaguucgaagccagcucguaagagcauagaguggugaaucccuguauaucaacacccaggcaggaggcaggcagaucucugaccaaccuagggagcucugggccagccaaggcuacccagugagugucaaaaaauaaagacggaagaaaaaaaaucacuaaaaaagacuaaucguucauuucuagguccgaguuugaugcgucccuucuguggcuucagaagcucugagagagaaggaagaggcuaaggccaggcucagcuuccagggagacugcuaggcagagcccucacaaguacaaucagagauuccagcagaccuaccgugcccugcucacuuuccugggccgggggugcucuggggacacagaauagagccugaaagguagcaaagauugauucaugcauccauucauuuguucaaaacaagacuugcaggccuacugggugccuaagaaauuacuuuuuuuuccuucuguuuccuccuccuccucuuacuaaaacaagguugagaccuuguuuaguauguagcccuagcuagccugaaccccacuacagaaucagauuguccuuauugaacuucuaacaauccuccugccuuauauuucaccgugauaaauauuuuuuaaaagccugcuccccaaaaaaaggcaggguuccacaggcagcccaggcuagccucacacuugagacccucugccucagccuucgaagcacuggaauacagauguggaccaucacagcuggcuuuauuuagugauucuugguaaauuucugaagcaacuuaagagacuggaagcagaaaaaaagacugaagacugaccucaacagacaggacuguuuauuucaaacagugcaggacagauacucucccguaggggaggggugucugugaaagguggaggggcacuugaggcuuauauaggugguuuuggggaauacgacugcuaagguucuuuacagccggcaguuucuccuuccuggaguuauuuauccagacaaggcugauuuaucuuuacaaacggucuagcccuggcuaucaugaugugggucauagagggagacugaguuuggcaauagcagugaugagggaggggaccagaguuucacuauaggacuuuggucaggguguggaagagugcaagacuuuuuuccuuuaaucuuccuuugaaacaggguuucacuguauaggccuacaauuuccuauguagaccaggcugcccuugaacucugccuucugggugcuaugauuaaaugccugaaccaccagacuuggcuuuaaaaacaaacaaaacauaacaggaacaaaacaaacaaacaaacauuacuuaaguguacacucacauauaaguauggagguuagagaauaacccuuggaaguucuuucuuuccuaccacguggauccuguggaccaaauucaggucuucagccucgauggcaggugccuuuccccacugauuuuuuuuuuuuuuuuuggacaggauuucucuguggagcccugaugacuguccuugaacucagagguccgccuggcucugucuccaaggugcacugccacacccaacucacugguccuacuuaugccagcauucuuuacauucaugcauuccaccccccucccauauuuauguucagccaaauacguuuuacucauugcuuuagccccagagucuagccuagggcuggcuuaaaacaguaacucaauauggacagccagaugcacauacuccaguuagcaugagguguuuaugaaucaaauaugcauugauacauauagcauaacaaauauauaugauuuuuuuucauacucaacaaauggguaaacugagucucacaguaguaaaaugacuuauuuaugacacauugguagcagacacugaaguucaaccugagccuuucuauacuuucucaaugaccugcuauacugauuucauucuucuccuuggaaaacuuuaugcccugaaaagagaucagggagaggcagaauaaaacagcugagucuggacuaugaggggugucucuugcugauuuuagggguuuggcagcuucugggagauuucaagagcugauugucuccacaccuggcuuaucuagcucugcucuuggaagggaauguguaacagauaccaaggugagcauuucagccaauaaaaggccccagagaguaaaccgggauuuccauauccaccuggcagagagggcugggcuggagcugaggcagcuuuccuuaaauggccuggcuuagccugugaccucaccaccuacacuccuccucgggagacacaaagaccaggacagaauggcagccacuagucuccuuccugggauggcccacaugagcccuagucacuggcaugaguaauuacagaaaguucaggaagccgggggugggaaguggguaucugaugguguaaggugauccuacagcaggcuuccauguuugcuuuucucacuguccaaggcggcuuucagcacauccuucagaauggagaagaaauggguguauuuaguccacacagguggcugccugagaacuaggucaauccaucaaauaaccaaagcccaggcccguuuguccuacagacauuauaaagcuguggaagccgggcgugguggcgcacgccuuuaaucccaguacucggggaggcagaggcaggcggauuucugaguucgaggccagccuggucuacagagugaguuccaggacagccagggcuauacagagaaacccugucucgaaaaaaaaaaaaaaaaaccaaaaaaaaaaaaaaaaaaaaaaaaaaaaaaaaaaagcuguggaagccaucaauuaaaggauuuaccagcacccuacauggauguaacuuuguguauuaauccuguagcucugaaaggcaaaggccagaucccugaaaagauugugcuuaaaaaaauaauaauaaucaacaacucuaaagaaacaacuuaaacuggacuuggugauuguuguugggaaucccagcacucaggaagcugaggcaggaggaucaccaugaauucaaggcuaaucugcgcuacacuguugaguuccacacuagccuggguuagacccugucucaaaccacagagugcuucacucugccacacauaaacuaaaauuagaacgggacagagauuagucccugaaaagaaugacacacaaacauacauauuaaauaaaaguaaaaacaaacaaacaaacaaaaacagugaaucagcuuuaaaacaagcaagaaccagcauagugguauacacuuguauccuagccccaggaaagugggagcagaaagaucacaaauucaaucauccucuacuacauagaggguugcaggccagccugaacuaccugggacccugucucaaaaaaacaaaaacaagaaauagaaaccgaagagccacagcuggugugucugcccagcacucaggaagcagaagcagaaagaucucugugaaaucaagggcagccuggucuacaacagugaaguccagcccagcuaaggcuaauagugagauccuaucucaaaaacaaacaacaaaaacccaaaacagaaaaaauaaacaaaucaaccuaacuaaaggauaugcuuggguaguggagggguuuggguuuucaguuuuuaagauucugcauuuuagaagccagagauucuacaggcaagcuuacagggcaucgggacgaugcuaacagagcucaucaaagccuguuugugaccuuuaagccaccugugucagauucucagaagccugcauaguggaaccuggagccaaggucacaauccucgguuuccccagaaggucgaaagaguguccccaccuuccuaaaugaaggcaauucauuuucaauuuucuggggugcagugugugauuucuggaaagauaccucugaucuagcgcaaucccacacuccacuggugcaauuagaccccgggugagcagugguggagucucagacuuaaagggaacuggaaccagccgcgggaagcauggaagcuugugggaugcuguguggagggugcuucucccaccuaaaccaccggcgggggcggggcucucuaccucccacugggugugcucucagcggggugaaguggcucccugccuuugggggcgggggcaaugcucucagcgggggcucucuaccucccgcggagcauguucuaucuccaucaacaccagccacucucagcucccccuacguuaagaccucuguccacagucuauuucacaauggacuguuuuccccaaaagcacacacauaucccucccucccucccucccuuccuuccuuuccacccuucucucuuucuuuccuuccuccuuccuuccuuuuuccuuguuuuuuuuuuuaaaggucucauuucacucuguagcccagguuagucuguaacccacuacuuagaccaggcugaccucaaaccuacaacuuuuagcaauccucuugccuuggccucccaagggcugaucacgaaugggaaccaccacagcugcagcucacacacuucacuuccgggagugcaggucacaggugugaccaccgcuggggcagcucacucacuucccucucuuuuguuuuguuuucauccccucucuuuuugagagaaaagaaaaccaaaaagaggaggaccagucguagaugcuucaggcuccugauuuccuugaggacuggaaugguguccacccuccagaaguucucauuuuuaccuuagguaaaugacucacucgccuuaaggggcgugagugagcaggugguacuaucaguuuuuaagugaucuugucacugauaugcaguggugugagugaccagacacuagcacguagagguguaaauuaaagcugggucagcgucaaggugacccuggaaucccagcacuggagucugaagcaggaaaaucaaacugugaauuucugaccagcccaugucacacagggacauccugucucauaaacaaacaaaucgacccaaccaacacacuggugguuaggugccuggcuaacauguaacaacaggcugaagguuucauccuuagcacugcuaccaaagacugucguaacucaggcacacauacgcaucagcaagccaccaggacuugcacugaucccuaauauauaagcauuccugucuccaagcccaccaagcucaacccugagugacacgacgucuacuuauuuauucucagacacucacugcgguccuuggaaacauccuagaacacucaugccucgcuagcccaucccaacgugccacugaaggcaggccggaugcucccugcucucagcaaccuaccagaggcucagauucguccuugggcaagagucacguggagacuggcugaaggaucccugaccauuccaaccucaggaccacagggcugcagccuuucuggacccaaagaaagcuccacaaaaccagucagaucucagaaaagcaaguuaagaccaaccagucgggccgcuauuucucuguaaggugcaccaccaaaccuggacccaacuuccaaagcucacagcaaacuuuuagacaccaucaugagugcuguagauuuuucagguggcuuacgacuggaagaagaaccucggugaaucuauucccagaaagggauugugugugacuucuccuuuuaaaauuauugcuuuuuguuuaucauacuuuggggaucaacuaaaaucaugaggggggaggucauuuuggugcaaaagaagcaccuagaaacuagggaaaauaguuaaaaaagaaacaacauuaacaaaaaccugguccucuugccuugcucccagccauucccuacaguuauacaaagaaaauucuagauuaucacaauaagaccucaauauauauugaguguuugaauguaugagucagagcuaccuuuucuuuuuuuuucuuaaagaaaacaaaaaacaaaaaaacaaaaaaacaaaacaaaaaaaaccuauuccuugggaaagcagcaccuguaucgaguauuuuuauccuuaugaacaaaaaccacaagucauuaugaaccgguuccucagugacuauaccuaaauagugggagucaaaucccgguucaaaugccugcccugcugacccugugaagucacucuaugagccuccaauugcucaucauuaaauggaacuacaguccaacuggcucuacccagcagguuuggcggucugaaaugauagaccggcuccaguaaucaguuggaggaauaccgaugaccucuaaauacccuuggcccauuucugccccguauaaauagcagagccagacauaucuaccuugaucaaccacaaucgauaaauaagacucccaaaucugccguaaauuccaaggaagaguuuuguccauuccacccuaccagcaugguagcacgauuucuuggcgccuucacuacccgaccccacucggccgaguaacaccaucaguuucccuuaccucugcccaggacauggccucucuccaggugccucuccggcaccgggaagguguagaccucggaacugaagccgggacugcaggacucaggcuccagcuccuggcaaagccaugaggagaccugggauggagguaaaguaagcaaacuggugacuugaggggguucccagcagcccacaccgaaaccaaggguaacccuucccucgccucgggcgccgggauuaguggggaggaccccccucagggcacacagggacgcuauccgcucaucccgaaaccagccgccaagcuccaaaagccuuugggggaggggacaucuggggccaccaccuggcaaccuaguccaccuuccucuccuagcuccauuugcaucucacuggagacgccuugacucuuccggacaccacuuuccuucgaccgcgaacggucucaacgcacacccgcagacuccucucggguaccccaaucuacggucccucccuaacaggacaggugcuuuuauaauacuaaaaucccuucccuuaucucggaucguccgcgcuacuucagcaccccaccuucuacaggcaggcccccauccugcuccacgccuccucugucucaaacagggacccugcucaacccggggacccgggagccggcagcguggcgcgcccccaccugggaaccugcgccagaggcgaccacuccgcgcccgccuggaccucccucccacuccaccgcacucagccccgcaccgcgcagcgcccagggcgaucuggcccuccggaucccaacuuucuuggaagaagggaagcgggaccacagccggcagaaaaacacagcgaagcggaucauggggcacgagucaggacccuccacauaccugcagcaggagcaggagcgcggaaaagcugcggcaccgggcucccauggcggacccggcagacgccgagcaaacacugagcucgggugcggucgggcagggccggguuaggccgggcaggagucuagcagaaguucuugggaacucaguagugcgccgcggcucccacaccagugagcagcgcagaggcugcg

SEQ ID NO: 4744 - RNA, 878 nt, Mus musculus
uuuauuuuuuauuuuuacagugcugagauauaaacugugccuuuuuuuguuuguuuguuucuguuuuuguucuuuugagcuaugaucugccccagacacaacagccccaagccccucacaccucacuaauuuuuuacauuguguacuugcccucaauuaccauguuugcuguauucuaauagucacucauguuccugaauucuguugcccugcccaggugauauucuaggaugcagaaaugccugggcccuuuuauggugagagacagguaucuuggugugggugcaacugcgcuggauaguguguguguucccaagaucuuucgugguauucccucuccaccuccagagaacucauuuacaguggcauuccuuguucggcuaugugucuggggcagaacaaaaaaaagggaccacuaugcaugcugcacacgucucagauucuuagguacacaccugauucuuaggugcaugccauagugggauauguugcuuugaucagaaccugcagggagguuuucgggcaccacuuaaguuucuuggcguuucuuucaaaccaaaacuaaagaaugguuguucucugagagagacuggagugccaccaccaaagacagaggagagaaaaggagagaaaccaaacuuggggacagcaacaucagcgaacccggcuaguuggcacaccgauggugaggguacacaggcggugagaccuaucccacaagauuucuggaagacuaggcuuaucucaaccaauguuuucuggcuggaaucuuuguccauguauuccugaagcccaggaaaugcaccccuccaaugccugcucuugaugguagcuacagaaaaugcuggccgauuuaaacccaaguugcccaguucuga

SEQ ID NO: 4745 - RNA, 878 nt, Mus musculus
ucagaacugggcaacuuggguuuaaaucggccagcauuuucuguagcuaccaucaagagcaggcauuggaggggugcauuuccugggcuucaggaauacauggacaaagauuccagccagaaaacauugguugagauaagccuagucuuccagaaaucuugugggauaggucucaccgccuguguacccucaccaucggugugccaacuagccggguucgcugauguugcuguccccaaguuugguuucucuccuuuucucuccucugucuuuggugguggcacuccagucucucucagagaacaaccauucuuuaguuuugguuugaaagaaacgccaagaaacuuaaguggugcccgaaaaccucccugcagguucugaucaaagcaacauaucccacuauggcaugcaccuaagaaucagguguguaccuaagaaucugagacgugugcagcaugcauaguggucccuuuuuuuuguucugccccagacacauagccgaacaaggaaugccacuguaaaugaguucucuggagguggagagggaauaccacgaaagaucuugggaacacacacacuauccagcgcaguugcacccacaccaagauaccugucucucaccauaaaagggcccaggcauuucugcauccuagaauaucaccugggcagggcaacagaauucaggaacaugagugacuauuagaauacagcaaacaugguaauugagggcaaguacacaauguaaaaaauuagugaggugugaggggcuuggggcuguugugucuggggcagaucauagcucaaaagaacaaaaacagaaacaaacaaacaaaaaaaggcacaguuuauaucucagcacuguaaaaauaaaaaauaaa

SEQ ID NO: 4746 - RNA, 168375 nt, Mus musculus
aggacacgccuccgccacauucaaaauggcggccgcgcuggcccacuuggguguuugagcacgucgcaggucgcuccacuccaaucauggcggccuccggaccggcggcggcugcgccgaguggcguucuggugacauguggucuggagcagguucuggaagcgcugaaguugcugcugagcccgggaggugagaggacgagucucggcgcggggcuggaccugaggcucgcggggucgcgggucacccaggcucgcccuggcugcuaccgcauguuucccgcaggcccucccggcaucuccauccccacucccgggagcgcuugggcucugugcagucucacuuaaaacuuaaacugaagcuccaggaaagggccugcaguccgcugaccgcugaugccggccgagguccguugggcgccucgcugagcagcggcuucgguccacuguuugcuccagcacagcccugacacagggacuggagacgccuucacacagguguaaugugaugucccaaccgcuugagggcuccgagccuggugugcacgcuugagauuuguacaaaaugccaagugaccagagaugcccagcagggacguuuuuuggcugaauuugaggaagauuuuuaaggguuucuguuuugguaucagaggugcacagucaccuuuaaucacuuguugaguuaacuucccaguuuaguauuugaagagaccuugggaauagugagaccuugcauucucacuguugagucccaauuuguggugguuugaacugccucugccuccccagugcugggauuaaaggcaagcaugaccauucacaccuccugccccuuucuuucuuuagacaggguaucacuguauaguuaagguuuguccuggaacucacaccucaaaucaggugguuauauuagagggauguccauggaccuagaacucaguucugccugaucuccuugucagacuaaggcagauuauucagaauagaacuucugauggcaucuggaaacguagaaggguguaagaaaauaggauccuaauuauaagcacagcaugucugggugcguguagaauuaucaagguaaaggcaacgugugugauuacaaggugaacacucucggucuuaaaugucgacccccaaacuacagcugcaaacauuacagaguacuuagugggacgugaaaagcaauuaguaguagaugauugccuacuaagcgccagucccuauaguccauuuacuuguagaucauuuaguccucacagcagucuccuaaguauuaauaggcauuaauuuuugcagaggaacauacauguacauuggaaauugcccaaaguaaaucaaguucgugacaaaccucaguuccuucacuaaaagcuugcaaaauauacucucuugccccaauuaagagucaacggcaggauacguauuuuauuuauuuauguuugaaugccuauuucugugaguguauguaugcugugugcaugcaguagcccacagaggccaaaagagggugucaguuuaucuggaacuggaguuacaggcaguuguaucacaugggugcuaagacccaaaccccagugcagaaaguggucuugcccaaugaaccauccuuccggcuuccacauuaaaaggaaaaagaaaaaaagauuauuuuauuuuuuuaauaauauguauguguggguauguaugugugagugaaguuauccagagaaaccagaagugucagaucucccuggagcuggaguuaugggcaguugaggcaucugacauggguacugggaacugagcuuguaccuucugucuuuuaacuuacuaauggagagaucccuuguucagcauuuggcagucguagcuauuggguugguuuaguuuugauuuguuuuuucccccaguuuugagauagggucucauguaccccacauaaugaaggguaaucuugaauuucuguaccauauaaugaacuuaaauuucugauucuuuuaccucagucaccugaaugcugggauuacaggccugcagugucacacugguuuauguaguacuggggcaucaaaccgagggcaucuugccugcugggcaauuagucuaccagcugaacuacauccacaccacuguuuccaaacacucuuguuuggaaggggaaaaaaaauaguaugcuaaaauucuucguuuuuaaagaagguuuaugcuauauuuauuuauguguaugcgugugggugcccauggagaccagaagagggcacuaaauccuuuggaaauggaguuauaugagguugugaacccuuuuaugugggcgcugggaacuagauucugguucugugagagggcgcuaagugcucucugcugcugagccaucucuccagcccccuaaauuauucuauguuguguauguagacuauuguguacugcauggaucuggauguggcuuuuuuguucuuuucugucuuuuuucuuuucauuuuucuuuuuuuuuuuugguaugacuuuuuaaagagaacguuucauguuauagcccaggcugcccuggaacucucuguguagugcaggcuggacucaaacuaauggcaauaacugccucagucuccugaguaacucgguuacaggugucagucuccugcguaacgggguuacaggugugcaccaccaagcuggcuguuucguucuuuuguuuugguguuggggaucaaacaccaggucugugcuugcauaugcuguaucagguuuaguuuacuccugcaguguguguguguguguguguguguguguguguguguguguguguguguuugggauaggguguagcucugugcccuugacaccugcuuuauagaacaggcuagccucagauuuuggggauuugcuugccucuaccucccaaguucucaaguuugagugccuguacuggucaucuggaucuuuuuuggugaggguagacccccucuauccccggguuugggucagggucuuacucuuuagcuaaagcuagucuagaauuuacuguggagacuaggcuggccuugcagcagucuuugugccucauuguccugagugcugcguuaacagaugucaccacuaugacuuccuguaguaacauuuuaaaggagaaauaacugguaaagugcggcauugcuuuauauguuuaauauauguuuaaucucuuuuuugugugugaugcugcagaucaaacugacauauguaccuguguacauccccagcccuggcucacaguuacuguacuagucagucagucagucagucagucagucagucuauuuaucugucaacuugacacgaccuagggucauucgcuaagagggacucucaguugagaaaaugccuccaucagauuggccuguagucgagucagcggugcauuuucuucuuuaugauugaugugggaacgcccaacacacugugggcagugccugggcaggugguccaggguuguauaaaaaggaagggaagcagccaugggucacaagccaggaagcagcauuucucguggucucugcuucagguccugccacagcaucccuagaugccguaagccagagaaacccuguccuccccaagcugcuuuuggucuugguguuugucaaagcagucggugcaaacuagcgcgguuauuggggaauuguuuucuccuugcagacuucuugacauggguccuucaugccacauuuugagaacugcuacuuuagcuucaguguuggcguauuuauuguuuuauuguggucuaaucccucuaccagcagguaggagagcgaggagguuagaggggagggguguaaaccuuuauaggcugcuuccugcugguuagggcuguuggguuccuugggcaaguccggucuucagugucauaucucuaauuucugucaaacugcaacaguaucuaggaaaagugagggugggggaggggagcagcagccaccuucuucuucaccucccaccaguccuggggcucugguauuuauacuuucuccagaauccccagaacuaaaccaucugcagcugacaaagaucaugcccccuccuagagcauugagacagucacaauuaacggcuguagacaaacugaagcagucccauaucccacaccagggauuaaacaaaaaaauauauucauauaacauaaccgaaaucaaaauucucagaacucaccagacauggugccucuaaucccagcacucaggaagcagagaccagucuggacuugaaacagcaagaccguguuucaaagcuaagcuggugcuggggggacggaugugggguuugcugcugaagaaaaagaggagccaagccagguggcccaugccuuuaauuucagcacucuggugguagauggggguggaucucugugaguucaaggccagucuggugcucagagcaguuccagggcagccagggcuacacagagaaacccugucucaaaacaaacaaacaaacaaacaaacaaacaaacaaaaaccaaaauaaacaaaaacaaaaaaccaaagaacccaccaaaacaaaaacaaacaccccaacccccaucaaccaaacaaaccccuccccaaaaaaagggaaggaaaaaaagaagcgaacauuuugagguauuuuauuucaucauauggccaguagagggcagugaagacugcaguaucacaggucuccagcacugcacuaagcucuugcuuuaaucacugucuguuuggccacggaaaugggauaaaaucacagggagucguguagagucguguguguguguguguguguguguguguguguguguguguguguguguuuuguugaaaugggauaaaaucacagggagucguguagagucguguguguguguguguguguguguguguguguguguuuuguugcuguuuuuaaacuaccccaggauggccugacacucaucaucucccugccucugcuuuccaaaugcucugauacacuugauuacaucuugugguuuagagagaaagaggaaauugagaaaauuuccauaugccugcuucauuacccaccugaaucccaggucuguuauuaguaauauguuuuaauguggugaagaauguucacacauggucauuaacccaaaucuauggcuuacauuaggucagucuuccugguguacaguuuggguaaauuagauugaaauuuuuuauuucauuacuacugugugcggguguauggucauguuggcaugggcacauacaugccaccaccacaugcgugugaggucagaagacaauuugcaggagucguucuccgccacguggcuucuguggaaggagcucaguuuguuuucucccgcugacccaccuugccagcuauagcugugugucuuaaggcuuggguuagaagcaguguucaguggcagaacuguuaccuagcaugugccaggcccuggauucgauccucagcaccucacgaaugacucccccacaaagagaauauuugaucugccuaacaggcuuauaguuagcaccuccaguuuuucccuucuucacuggcuggagugggcaguaugcuccacacagaagaaaguaucauuuguuuucuuugcuuguuuuucccccccucucccuucaaaaggaucaggcucaaguucacuacagaacacaaagcacgauguccugcugcagacucuaaaaucuaaccugucugcguuggaggccaaguuucugaaggaugcucaguggaagaaacucaaagcccuaagagaugaacuugcugauaaggcugaauggccgcagagcuccgaggauaucacuuggaguuucaccucucaaaccuuguugcugcugcugugucugaaggaaguccuggcccgccucguagcugauuucaauccuggcaaaccuaaccccaggacuccagaagccgccccugcccucaguccagauacacucagcgucucccaacagaagaccuuccagucuguucugcaguuuguagucaccuugggcgucugccccuaccucauuccuggcgugggagucccucugagagacaggacugaguuuggagcuguuguucaggauguuguacgucuggaggcugccccccaugccacccggagacuguacaucugcugcaggguccuucucgaccuggcgcagcaugcaucucuggggagcuugauuuuuugccgccauuuuggggauauugcagcaggucugugccagcugggauucugcccaaccaaaagaaaaccaccaggaccuguggaagagguaaauguacggcguggguggggguggguggggggaauaugaaugcugggguguauuuuugugucagguuucgaaaggcauuucuuauucuuuagaaaugagcugauugagggcuggugagauggcucagcgguuaagagcacugacugcucuuccagagguccugaguucaaaucucagcaaucacaugguggcucaugaccaucugcacagcuacaguguacucauaugcauaaaauaaauaaauaaaucuuaaaaaaaagaaaugagcuaauugaaagauauagaauuucugucuagcugggcgugguggcacacgccuuuaaucccagcacucgggaggcagaggcagguggaucucugaguucgaggccagccuggucuacaaagugaguuccaggacagccagggcuauacagagaaacccugucucaaaaaaccaaaaaaaaaaaaaaaaagagagagagaauuucugucuaaugccaagcacacccagaguuguaaccuguagucuuuugggagaagggguauggaggcuccauucuuugggggcuagccuucugcacacuuugagagcugucauguaacuguuucauccgucuguaucauucugugggacagcuauuuuaggcuguuucuuggaacuucuauucucccugcccccucguuugguuuuguuuuguuuuaucgagacaggguuucucuguguagcugugguuauccuggaacucaaucuauagaccaggcuggucuugaacucauagagauccgccugucucugccucccaaguucugggaucaaaggugugcaccacccgacuuguuuccguuuuuauuuaacuuauuuuuuaauuuauguguaugaugugacucugugaguguauaugccuaugugugcagauggccuuggauccuuuaggaacuggaauuauagguuacuggguaugggugcuggaaaccaaauuuaggcucucuagagaagagcagcaagagcucuuuauaguuaucucuccaguccuuuauaaagugaauauaauaauauaagccuuagaagaugguggacaggauaaugaugaagugcuuuaaguaccuaaaccaguucccccuagugcuaauucagaaaacuauuagagucgugccuucuuucucagguggucaaugauaaagggugagcagcucagucccugcuuauuguauuggauguuggggagggggugucugcgcucauaccaccugaaugcacuggaucuuaugugcuaguuggaggcuaagcaagguugcgccugguuaauacuuggaugggggguacuggaggaacgagccuauuccuugcugucacucagucagugcgcagcugaguagcaguugguaucuggagcacagaauuuguguggaggauacaggagcgugagacauuguccuaguuagcuacagcugacaacuugaagcagcccacugucauuuaaggaugucucaacucaaggauugcccagguaagcuuggccccuggugacaucugugggugagggauugucuucauuaacaguugaugugggagggcccgccccacccacuguggguuguaccauccuugggcagguggucccaggcaguauacaaaagcuagcgagcagagaccucugugguaaacacaguccuccucugugguaaacacaguccucugugguaaacacaguccucugugguaucugcuuuagcucuccugcccugcccucccucaauaauggacugugaccuggaaguguaagccaaauaaaccccuuucuccucaacuuguuuuuggucaguguuuugucccaguaacagaaagcaaaccagaauagacauauucuugcucuucauauaacucaagcucacacaguaauugaggaguuaagauuuauaaaugagacuccauugugucucuaauuugugggccaggcucagaagguagccagagaagcugcuauuaaaauauaaaugggucaggagucaucagcccuggcucacuccucccuguucacugcccacccuuguucuuacuccuuuguguuccuuaaaauaacccuccuccuccuccucuucuuccuccuccucuuccucuucuuccuccuccucuucucccuccuccuccuccuccuucuucuucuccuucuucuucuuuuucuucuucuuuuugacaggguuucucuguguagcccuggcuguccuggaacucacucuguagaccaggcuggccucgaacucagaaauccuccugccucugccucccaagugcuggauuaaaggcgcacucuggucuacagagugagugccaggacagccagggcugcacagagaaacccugucucgaaaaaccaaaagaaaaaaggaaaaggaaaaggaaaaggaaaagaguacccaaaguaacuugcauccucuuugagagucaaguucugaauucaugaaaaaacaaacaaacaaacaauaaaaaauaaaaaaccaucaucagagcaagagaugaaaagucaaaauaugggagugaugguagguaggugauggcucaguggguaaagauguuuaccaugcaccccuggugaccugaguuuaauccccagagcccacauaaauauacaguuccacagugaaguaaaaacaucaccacuguugcucauaaagacaaagguggagggggcugcagagauggcucagagauugagagcacuagcugcucuuccagagguccugaguucaauucccagcaaccacaugguggcucacaaccaucuguaaugagaucuggugcccucuucuggugugcaugcauauaugcaggcaggacacuguacauaauacauaaauaaauugauuuaaaaacaaagggcaaagguggagaagagaucucuuaaauaaagauggagcucucccagugcccucuagucagagauacuuacugcucauccagucuuaggagcccuggaaaacuguggugccugcggucucccccacggcaggggauccaccucugcccugucucacucccacggagagaagaggagcauccaagcggcacucacucacuggacagugagcggguauaucccaccaucaucagcaaggaaaucacagcuccugcccagaauggaggaucgagggauggagggagggccaugaguguucacaaagaaggaaauaagaggaagccuuccuccucuccacucucaagcugugcuaaaacauuaccuuccauucucugcuuggucuguauuccaagucaaaugcgcauuucuuuuagguuuuaacagaagaggaaagaaccuuaucaaggcgggccuugcgagacaucuuggaucaagucuaucaaccauuggcuguccgggaauuacuuacccuccagggaggaccacgccagguacucaggccuugggaccuggugggugaguugcugugugguguugucuccuuugucuggagacuuagcugucuuuaguuucccauaaaaucaucuaguugaaccuugcugcugcuguugcugcugcucuuccucuucuccuuccucauccucuucuucaucuuccuccucuuccuccuccuccuuuuucuaguagugguaauaguagguaguaguagcaguagcagaagcaguaguauuuuguagauaagguuucacuauguagcccugauugaccuggaacucucacaaagaugugccugucuuuucuucccaagugcuaggauuaaaggcauguaccaccgcacauagccuguauuuacacuuuguuucuuugguguuuaucuuuuugucauguuugucucuguaccacugugucuagugucaaagaguccagccgggugugguggcgcacgccuuugaucccagcacucuggaggcagaggcaugcgaauuucugaguuugaggucagccuggucuacaaagugaguuccaggacagccagggcuauacagagaaacccugucucgagagaaaaaaaaaaaaaaagaguccagaaguguggguuggaucuccuggaguuaaacuggugaagggugguuguaaaccgacaugucggugcuaggaauugaaccuggguccuuuggaagaguggauagugcucugaagugcugagccaucucuccagaccccuacaggcuaguuuugaauuuugauugcuucugucuccuaaguguggagauugcagguauaagccacuauacccuacucuuaguuuauuagaccaucaagugguauuuauaaaacaaagugacauuaaaauucagguuaauuuaagacuuuuuguuaaugggaugaugcauacuuucucaagacuacaaucauuuuuuaaaggcuuauggcaauuuaaugugaaacauacacacacacauacacagagacacauauauacacacacacauacacauagacacacacacauacacacauagacacauacagacacacacagucauguguauuuuuguuuuguuuuugagacagucuuaaguagcccaggcuaguuuugcaucugugguccugcugccuucuagcuccugacugcuggaauucuagguguguauauuauguaagccccuauaaaacuacauaagcauacauauauuugcuuuucuauaauuauaaaaaaagauuuauuuuauuugaugggugugaauguuuugcuugcaugugcaccaugucuuuuuuagugucugcagaggucagaaaaggggcuuggguauccugaaacuggaguuguagauguuuggaauugaacucaggaccucugcuaagagcagcuaaugcgcuuaugccgucuaacuaccucuuuaguucauauacuuguuuugagacaaagucucacucuauaguucaggcuggcuacucacuauguagcacaggcaggccuuaaauuaguggcucuccucuugcuucagcugccuaagugccaggagccauuaugccuggcuuuggaucuuuuuauuugugaugaacccaagagauugaacccagguucuuguacaugcuagguaaauagucugugguggaggugguggcagagguagggaacacuuuuaaucccagcauucaagaggcagaggcaggcagaucucugaguuucaggccagccuggucuacaaagagaguuccaggauagacaagguuacauagagaaacacugucucaaaagaaacaaauaaacccaaaagaaagaaagaaacaaacaagcaaaaaagaccccccaaaauccuagucuaccacugaguuacauuguuagccucuguauuaauuuuaaaauuacacuuauuuguuuuguugggaguaggguguguaugccagaucaugcaggccauggggugcuuguggagggagauccugcagcagcuagcaggaguugggacucccugucuaccaugugggugcuguggcucaaacucagggcguuuuacccucuagccauccuuuuggucuugaguuuuuguuuuuuaauuacaaaauuuggcuauugaacaauguauuuucugacagaaguauuuggauaccuuaugcuuugauuggaaucauuugagcucaagaaauuuaaaccagagcuguuacuauaguucucagcaucuuuguuuagaaaacauucuaauauauauuguuggcauuaagauggcuuauuuuuuccuuaagagaguuuugauaacuuaccaggcuggucuugaguuaggccuguagccuagacaagcuuugaauuugggaauccuucuguuuuaacuuuuaaaauagcuaggauuaugggccuguaucauuaggucagcuuaguuuuucucucaaaaauaauuauuggagagacugggugugguggugcaugccuuuaaucccaccgcuuaggaggcagaggcagguggaucuuuugugaguaagacuguggcucagugguggggggcuugccuagaacucacaaggcccuggguucacuuaccaacacuuaaaggagagaguagggggaacauugcacauguaccugcccccucuguguggagugugugguguaugugugagaucaaacaugguccuugcacauauuaaauacaugauguaccacugagcuacaucuccagcacaaaaaugaaaaacagugucuucaaaccguauguugcauugaugcucaguuuauccuuuccccuuugauuaucagcccuguacagaugugaagacacagcuaaggugucgggcccaggccccagcauggcuccgccgucuaugugggcagcugcucucugagagguugaugagacccaacggcguucaggcaguagugcggggcauucuggaaggagcaggugguaagaaguaacauguuucuguuacuuugguaucgguuucccuuuggguuagagucagagguaaauugcugcccuuugccuugaaauuucacugaaagcuggcgguagagcucagccuagcccucuuaccuggcaucucugaggcccugcauucucaaaggcaugcagauggcggcugcucuaagaauacgauguuuccaagucagcuguguuggcacaugcucugaucucccaacucagggcucuugagaguuagagguuaaacugggcuacauucuacuaaugagaaacagucucaaaacaaaacaacauggaacaaggaaaaggaucagaagagauggcuuagugguuaaaagcacuggcuguucuuguccagaaccuggguucaguucccaacacccucaugguggggguucaaaccgucuguaacuccaguuccagaggaucgucuagccuuaucggugcauguacaucaugcaagcuaaacaauuauacaaaugauagaaaauaaauaaaucugugaaaaaugaacuucaguucauauuuccuucugccuaaacuuaaaaaaaaaugcuucuuagggcuacuagcaaugaauccuucuuuucucuauguaacccuagauggaacucuuuauguagaccaggcuggucuuaguuuugugacaugucucaccacaccuggcuuuuuucccccuuuagagacagcuucccaagcacugggauuggaggcaugcaccaccacacccagcucagaguuuuauuuuuuuuucgggggaaauuuuuuuggugggagguagaagagauuaagagaggguauggggaggacuuugauaaaacaacaucuuauauauuuaugaaauuaaaauagaauaaauaaaauauaaaaaauaguguuucuagcagagaaaaagaaacauuucuuauuccaaauuuuaaggccacuccaucacuuagcacuuuugugaggacuguugugagccuuugaugucucuuuccaugugacagcgggcgcggcuggugggagcgaugcugaggccacagcugccgacuggaggaagugugacuugauugcaaagauccuggccucuuguccccagcagucccuuuccccagagagcuacuacaaggacaucugcccgcagguaagucaucuuguuacugcugauccaucaagugugucugcucauucacacacagggcagcgaaugcuccgagacugaagcacaagcaguguaguuuuucauuucacuauuuagugggcagccguaggcuaagacuggcucagaauuugaugcacuacagcccagauugggagugaugcuccugcuguagcgucccuagugcugggguuacuaguggaaggcgcugugccugguggggccaaacaccaguccugccacuuccuccugcgugcacgugcauguauaugcccacaccauccuguguccuggagcuaaggguauuugcuggucaguugucaacaugacacaaacuagagugacuugagaagaagaagccucagcugaggaacugucucucucagccuggccugugugcaucuguggggcauuuucuuacuaaugauuauuguggaaggcccagcucacugugggcagugccacccguggucaucagcuguauaagaaggcaagcugacaagccagucaguagcauuccuccuuccucccugauuucuguuucaguuccucccuuggcuucccaugaggaaggacuguauaaccuggaaacuauaauaaacccuuuccuuccacaaggugcucuuggucagaguggccuaccacuguaacagaaaccaaacuagaacaaggcaguugggagcuuccuggugugggugcucugguccucugcaagagcagucagugcucuugacugcugagccagcucuccagccccacguccuucuuaauaauaaacaccuguggacgaauacagccugauuguuagguuugagaauggcagugacucacacucccagaguugaggacgucagggcagguagaucucuugaguuuggacuguacuguugggggaaaagccucaucaaaauuucaucugguugucucuuuuuuccauguuuuuaauuuuuaaauuaaaaugagcuaaguguuaaaugaguuaaguuaacuugguaacaauuuaaaaagaaaaaaaacuauacuggaggguugguugacuuaagggugauugcuacucuuuuagaggucucaaguuugguugccagcacccaucuuaggcaacucacauaacccuguagcucucguuccagagaaucugacauucucugcuagcccccaagggcaugcacgcacacacacacacacacacacacacacacacacacacuaaaaauaaaucuuggccagggaugcuggcacacacuuauaauccaagcacuugggaggaagagacagaugggucuuugaguuuaagugguauacauauaugugaaucucugauccugguaaucauaacaaguuucaggccaggcagaguuauacaguaagacccugucucaaacuaccagcugccuacgucccccaaagcaaaaaacaaaacugcaaauugccaccauuaaccaccaccaauagcuuguauccuuugauguuugguuguuaaaacaguucugucaacucaguauucaguagucucucagugacuuuauaauuuuggcuuaaauaaaugcuuugggaggcuggugagaaggcguagcaguuaagaacacugguugcucuucuauaggacccagguuuaauuuccugcuccuacauaaggacuugcucucaggaaguccagucucagagcauccaucacuccuuccucgagucuguggcaaggcaugcauauggugcccauagcacacaugcaugggaaacaccuauaacacacaugcaugggaaacaaccaugacacacaugcaugggaaacacccaugacacacaugcaugggaaacacccauaacacacaugcaugggaaaaaccuaugacacacauguaugugaaacacccauaacacaugcaugggaaacaccuaugacacacauguaugugaaauacccauaacacacaugcaugggaaacacccauacauauuuuaucguuuauuucuguugcuguuguuauuuugcuuuuuugagacaggguuucucugugcagcucuggcuguccuggcacucacucuguagaccaggcuggcuucaaacuugcagagaucccccugccucugcuccugagugcugggauuaaaggaguauguaacccugcuugguucucauacacauuuuaaaaaauuaaaaacuaucguuuccccuuuuauuuacuguuacuuuuuguuguagauucuggacuuauuccaccuucaagauaaauugacagcacggcaguuucagagaguggccacuaccaccuucauaacucuguccagggagcgcccagaacuggcagcaaaguauuugcuucagcccauguuagcaccucugcagcgcuguuugagcacagcagguaagggagcgagcugcagugugccuccuuaccgugcagacuuaaaggauuaagucuggggucuuucuauccucaguuuuccuucucccuccuagcuuuauacuuggaaaacuacuucccccaaguuccaagaggagagcacugagucccucggacacacuuccccaguuaccaacuguucccauuuuggucccguuugcuucucucugcacacaugaauguaguuuuuucuggaacgcugagaguugauuguagacgugaugacacaucacuccuaaauccuucagcauaaauccucaaagaaagaugccagcuucugucuuuuaaaaaaaacuuuaaaaacaaccguccaaauuucaaaaagaaccagccagauagcucagugggaaaggugccugcugccaagccugaggacuugaguucaguccccaggacccagcugguagaaggcaagaaggaacuucugcagguuguccucugaccuccucacguggcucguggcaggcaggugagcaggugcacaggggugcacauacaaaugagucaaugucguuuuaacaguuagagaaaguccauagcauuuugccugcauguaugucugugcaccacaugcaugcagugccugagaaggccagaagagggcaucagaucccaggaauuggcauuaggaaugguugguagccaccaagugauuguuggaacaaccuugguucucugcgaaagcagcaaguucucuuuuccacugagccuuaucucuagcccuaauuuuagauuuuggugacaaaguuaugcuauagagcaacagagcacagaauggcuuugcgcugaagacaaaagugcucugucuuagaacucauuuuuccugaacaagaguaacaucaguagcgucagagguucugugaauaucacauguaaguggcaugucauacaguggugacacucaucuucugguucuaccugcacuauauuacuaauaaaaccuugcuuuauuagugucuucuauucagaaaaguaaugagugggguuaauuuuauuuauuuuccaagagauuccagagagugacauggugccaggagcuauuuuggugacugaagaggaacuuagucgguguguugaagauguguuuaagguuaguaauucaggucgcugaugcugcuaguuaauguucauacuugacggccuuuuguuuuuggaggcucuggacuuugaacacaggccuucugcuggcaagcacuguaccacugaacugugucuguagcuuugccucauaaccaguacuuccaggauuugaaugaauaggggcuagauggcucagcgggugagagcacagaggaccuggguccguucucagcacccacaucaggugccucucaacugccucccuccagucccgggggaucucaugccucugggcuacucaggcaccuguaccugcacacacccacauaugcaggugugcacacaaauacacauaauuaaagaaggaaagaagauagugggucugacuagcuggcccuggagguagacgccuguaaucccuaugcucaggaggaucauuguaaagccaaagccagccuguuugcuauagugaguucuagcuucuagggcuucacagugaguacuggcugucaccaucuccuuucccuucccuacugcuaugucucuauguauuuuauuuauuuuaaaaagauaacauguuaugcuucaucaguggacagagguuugguuagcuuaugaauggcaacauuuagccacuuauuucuguaaaacggaaaggaaggaggaagcuguugucacuggaagcugagacugugguaaccaccauauacugcucguuuuuguaccuuuuuacugcuaacgucuguugcaugauauaccacauuucugcuuguuaguugguacacauuuggauguauaguacauuuuuucuuuuaacagcuuuacugacauaugcauacaguuuguacauucagaaauauaaguagcagucaauggcauuaaacucagauuuguacacgcgucaccaucauuaauauuagagcauuucauugccucagagaaacucccggaacugcuuagcucucacuccugaaucccugcaucaccacuucccaguccucugggccuggagagggaacuguuugccuguauucugccucuagauccaccuguucuagacauugccuguaaaucauggugaacagucugaucuuugugacuggcuuuuuucauuugguauguuuuagugccauucuauaucauaucauagcauggaucuuucugacuaccgaauaauucuugauuguaugaguaggcugcauuuuugcuuagccacuccucagcuuuuaugacuagugcugcuuuggacaguucauguacacauuuccguaugugcugugguuaggcugugguuugagaggaucccccaggguuuccugugguggaagcuuucucuuuaguguggcaauauuugggagguguuauggaauccuuaagagauugugccuagagccaggcagugguggcacacgccuuuaauccuagcacuugggaggcagaggcagguagaucucagaguuugaggccagccugguuuacagagugaguuccaggacagccagggcugcacaaagaaacccugucucgaaaaaccuaaaaaaaagagauugugccuaagugugagugguggcacaugauuauacccuggcauuugggaagcugacgcaggaggauuagaaguuccaagucauccucagcuguguagugaguuagaggccagcccggguacaugggacccuauuuuaagagauagagagggagggaacacaugcacacacacacacacacauauauauauauacauagacauauacacacacacucacacauauacacacacacucacacacgcacacacacgaaagagagagagagagagaaagagaaagcuugaauguaaugaaaggcagauggguaaacugaggcacagagagagagagaaagagagagaaagcuugaauguaaugaaaggcagauggguaaacugaggcaccgcucucagaagguauugauggaguucuauggaacccuggcuagcucuuagagaggguuguuaggaaagaauaggcugugcccucccuggugaucucccagucacauguccucuguuguuccacugugugccuuaccccauggagcucugccccccucuccucggggccagcacaaugcuguugggaccuucaguuuccaaaagugauugcucagaacaaaacaagaccagagagagggcucagccguuaagagcacugccugcucuuccaagggacguggcuuugauuuccagcauccacauggugguucaugaccaucuguaacucuauuucaguggaucucaaccuaccagucacagucccuuugggguugaacuacccuuccacagggucaccuaagacccuuggaaaauacagguacuuacauuauguuucauaacaguggaaaaauuauaguuaugaaguagcaacaaaaauaauuuuaugcuugggagucacacagcauaggaacuguaugaaagggugaaggcaucagggagucagacugcucuaaugccaggaaagccagugccuucucuggguuaccucaggcaccaggcguguacaugguacacagauaacaaaaugcaagcaaaacaugcauacacguaaaauaaucuuuuuaaaaguuaaaaaaauccaaacaaaaccuccaaacuccugggcugaauguuacaguucaugccuaugacccagcauuugggaggcagagucugaguuugagaguagacugguguacguaacgaguccaaggacagcaaggcugcauauugagacccuaucucaaaaaauaaacaauagcuaggugcuggcagugcacuccuuuaaucuuagcaucuagggucagaggcagguggaacucugugaguuugaggcuagccuggucuacagaguuuguuccgggucagccagaguacacagugaacccuugucuuguagaaaacaagaacucuguaagccuuacccagucaugugcauuucauuauaguaucacgguuucugcucuccuggauaaguccuagggacaggagggacugcugggucucugguuacucugagggaacugucagccugcuuuacccuucuccuagcagacugugagggcagaguggauguuuauuuugauguuuuaauuuuuaauuuauuuuuuauuuuguuguuguuuuuaagauuuauuuuguuauauguaaguacacuguagcugucuucagacacuccagaagagggcgucagaucuuguuacagaugguugugagccaccaugugguugcugggauuugaacucaggaccucuggaagagcagugagugcucuuaaccacugagccauuucaccagagccccuaauuuuuauuuuuuaagacagggucugauuguguagcccuggcugugcuggaauucacaauguagaccaggcugguccugaacucacagcgaucuaccugucucugccuccugagugcugggauuaaaggcaugugccaccacguguagcccccagagagugaaucugaaaucauugucuuucauguaagugggugaauacguuggcuguguuuaaaauuuuacaugugacacuaauaacuguagcuauaagugugagaccccgacuuagagcguuucucccuggaaggugaagccccuggacguuccccaagcuuguuuuccccgcucuugaaaaauacagcuagaaagcagcucuuuguucucuauagccagcaaaaagccuuuuuguuccuauacuuuacaaccagagaugccugccuuccugugccgaggacacggagauaaaaauucagaaagaacucacuccccacuccugccuuguaaauuucaccaaggacacucggaauagaagaacucuucccaacuccucccaacuccucagcuagcuguuaaaagcccccuacagucaccguucagggucgaacuccccugcccugcacgguggagggacuucauccucagcuagcugauaauaaaaccucuugcaguuugcaucaggugugguuuucuuguugggguguuggccagcucaucccgggacuugaguggaggcccagcaucgggggucuuucaaagcugcucgcuuaaaauuuugaaagucagccagguagugguaccuuacgucuuuaaucccaaaacuugggaagcaggggcagguggaucucugugagcuugaagccagccuggauauuccaggauagccagggcuacacaaaggaacccuaugucaacccuccuugugcccuccuccccuggucccauaucccuaccaaaaaaacuuucaaaaaucagcugugcaugguggcucaugucuuuaaucccagcacuuuagaagcagaggcaggccaaucucugugaguucaaagccagccuggucuacagagugagugacaguucccucccagccacugccacacagugggacucuguaucaaaccucgcuuccccaaccagaaagagaaacaaauaacaacagcauuaaagaccgucuccaugaggagaguaagugcuaaguguggccuacacuguagugaaggcacggggacacugcagacaguuaucgcucccuacgaggacuuggcagcccagcugcaguuggaaaacagaggaacuguguuuguuggaggaaaaugguaaacacuguguggaauuuagcaacaaaggcaguguaaucuuuauuaacauucugcuaaugcuaaauuauaguguaccguuuacacgcaggaaaugaggaagacaucuggaaagcgugaguugauccagccacucgauggguaacaagaggcuguuuaguuuccaagaggcgucugggaacguuuccagcuguuuucucucucuuccuucugugaauggauuugcugagauaaaagccacacaacacacaguacacucauuggaaguggacaguucaggguugugcagccguggucacaguauaaucgcaggaagucuucuccccaagggaagccucccagccuucccagcauucuucacuccagcccugagcagcgcuauucuacuuccugugucuguagacucucccacaggaggccacacagagugugcucucagcaggucuuucucccccugaggcaggaucuccccacucguaguccaggcuagccuugaaugauuaucgucccaugcucuuauccauccuuuccuuuucuauuuuguaaauauagaauacauuuuuauagugacuuuaacgucugucuucuaauuccuuuaaauccuuuacauuuuuuucuguguuuggacguuuugcaugcaugugucuguguaccucaugcacacagcacccucagagugaguagagagcauugcauccccugagucugcaauuguaaaugguugugggaauugaacucaggucccccugaggaacagucagugcucuaaccacagggccugcucuccagccuucuucugguggggugagagcaggucagucuacuuaugagggaaucaaccuccuuuuggauggggaucaauccuauugauuuuuucccccgagaugaggugacaguguagcccuggcuguccuggaagucacucuguagaccaggcuggccucaacucggagaucugauccaccugccucucucugccucccaugugcugggguuaaaggugugagccaccaccaucgccuagcuuugagugguuuuguuguuucugauuauggguucuagcuucuagcuuccuugcauauccacuaauuucuaugcauuuugagauauuauucacgucauaaaauucacuugguuuugguagugcugagguuguaacucaggcucucaggcauacuagccauaagcugugucugagcguccaguacuaaguuuaccuguauuucuuaaaagauugcccagguaaccuugugcccuucauccucccgcuucagucuuccuagugcugugccaccacaccuggugaauauuuugagggcccuccauagggaucuggcaugcacccccagaaaaggccagagacugcaugcuagaaauacauccuuugaaaagcauuaaacucuguuuauaaaagacuaagcacucaacucucugacuuuuuaauuuuguuuugauuuuccuguggcacaucagaauuguguggcgggagugaggggaaggaagaucuucugacaugugcauccugcucuacagcagagagagagcgagcgcuugauuaugauagauagcucuggagggccagguggagcgcucucaguggccguguaggugcacacuucuuccuguaaauuauccacauccaggaaggacuaaggggcaacuccagugacugaguugagggucugggacugggccccucccuaauggaccccgugguacuuacauucuuuuguccuccuggcacaacugauuucauguuuucuuugucgagacaagaacaggcccaggugucuuguuggccccagaaacucauugugcuuuccuauuuggucguguccugcucuguagcaggcaggccaauucucagaugggggaagggguuguccugaaguauuuauuaaucacagcauuugcccagggcuucugaagagcagaagugcagugugggaaagacuagaagauaguuaauuccuuuauuuuguacuuucucauuuccauuuuaucucuguuuccagauuuggugaaucucgacuuuaauuauccaggucauuucccauccagugcaguggguuucuaauuacgguugcuuugucagauugcgaguuugacucucucuggauuuuuaauuaaucuuacagagaaaguuggaauaauagaaacagugaugagaagaaccuuuagaaaaaauuuagaauaacuauuuuuaaaaaauauagacucuauaguuguuucuuagacucguuaggggauuggcuuaagaauuucuaaagucuuaaaaauucaaggaugcuuaagucgcucaugucaaggguuagaauuugcagauaaccugggcauaucuuucaauauaaauuguuguuccuuuguuugagacgcucuuggguugcccaggcuggccuucaacucaacucaauauguguguguguguguguauguauauauauagcuuaccuugaauuucugauucuccagccugccuuucgagugcuguuacaauugaugaacuuacauugacauaucaauacuacguuaaucuaugguuuauaguaguaccuuuuuuuguuuguuuuuuuagagacaggauuucucuguguagaaauccuggcuguccuggaauuugcucuguagaccaggcuggccucgaacucagaaauccccuugccucugccucccaagugcugggauugcagguguccacacagugccuguuugaugccacacuagggcugaacccaaggauucauguuugcuuggcaagcuagucuacaccugagcaacuuccucagcccauguuuguuugcuuggcaagcuagucuacaccugaacagcauccucagccccuguuuguuugguuuuuuguuuuuagcauggggucuuuaaggcccaggcuggcuucaaacucacaauguggcuuacauugaagucuugaucuuccugcuuucacuucccagauucuuuuuguuguaguuguuguuuguuuuuguuuguuuauuuguuuguuggggggcaggguuucuuuguguaucucugacuguccuggaacuagcccuguagcccuguaguccuguuggccucaaacucauaagagacccaccugucugccuccugaggacaaggauuaaaggugugugccccuaccacuuggcccgauucuauuuuuuaagggcuaaugacaggggaaaugucugucuguauucaguacauauguaccugccacaguguuuuugucugucauugaaacuacagauguguaguccaugaguauggaaagcugacuucuucccuucuucucuucuuuuccuuuccuccucacuccccaucucucccucccucaguuuucauccccuccccaccuuccucuuccuccugcccucuuugguguuuugagacagggccuuguauguaguccaagccagccucuaacucaccauucucccacuucagugggcuguauguuuagagaaguuuucguuuuacagaguucccuuauaccccggcccucagccuccccacuagccauguucccuccaugguagaacagcuacaauugaugaacuuacauugacauaucaauacuacguuaaucuaugguuuauaguaguaccuuuuuuuguuuguuuuuuuagagacaggauuucucuguguagaaauccuggcuguccuggaauuugcucuguagaccaggcuggccucgaacucagaaauccccuugccucugccucccaagugcugggaucaaaggugugugccaccacugcccggcuaaaaguaacuuuuauuuuccuguaguaauuguugucucugaggcuugcugcccccgucugcuaaccuaggccuuguccuggaagcuucuagccuccgugcaguguuuccaaccucugagguuuacugcugaauaaacucacccuuuuuaguucuuuaucaacucugccugguucagcuuagcuguucuggcucaaacuccucucaagacugauugauucaaucuagucucucccucccucccucccucccucccucccucccucccucccuccccaccccccucucucauucugugccucuccugaauugcucugcuuggccucauacugacuuuggcaaucuauucuaaucuucugguuucuucuuguucucuggcucguucugucuucaccugugucuagcuaguucucucucuaccugccuguguacagcuguccugguaaagcugccuucucucucucucucucucucucucucucucucucucucucucuuucucucucucugucugcacugccccuuaaguagcuuccguucuucucucucuucucaugagacuugggcguauccuauucugucaaaucuuucucugauucauuuuuuugucugccacccaauuagacaucacucucuaacaugggugcuuccuucuacaaacuaacuuugggauuaaaggugugugcuuaaaaaucaaaaacaaaacaaaacauaaaaaaaccuagaaauaguuuuguuuuguuuuguuuuuuuuuuucaguaaauaccauaaucucagugugaucuaguacccuacagcucuaguuuccguggaucugacgucugaguuugaccucugcagguauuaggcaugcaccugguacacagacaugcaugcaggaaaagugcucguauacauaaaauagauauaucuaaaaauaagaaagaaaaauccagaaacucgaacuuuuuuuccagagcucacaacucugguagagagaaucaaguaaccucucccucccccaccucacuccucugccacccagaccccacagaccguguguguguguguguguguguguguguguguguguguguguguaagugugacaaauuuaagaaguuuuaaggcuuucuagggagccucuuccuagaagcagaccuuuuuagaagugucgugugauugagcuaugcgcuuacauuuggagcagaggaccagcugcagucucugggugcuguggaguuacagauguuggguuaucagcucugacucugguguaaagcagcgcaaaugcugggccuuccaaacauaugugagcucugggcuggucuccuggaggacuuacugugugacuuuagguaacauaauuaccauuugaguuguagggaugacaaagguaacuuuuuuuguuugagagguguucucauguagccuaggcuggccagaaacuugcuauguagccaaggcuggccuuaaacuucucaucccuuuuccuccacuucccuagugcugguuuuauaagcauaugccacuaugcccggugaaauaagguaacuuuugguggguucauagcauacugcggcacauaagugcucaaaaacugucaguuccuuuuuggcucaaagaaacucuuuuuaaaaaaagacuguuuuaggcaauauguucugagagcuugcacagugcaaaguacuugcuauauuagguaacagucuuguucuuuuucuucucacaugucuuaauuaaacucagcaagugcauuagaaguucuggaauaccacuaucaaagggaucccuguucugcagucaagggcagcauuugacuaacuuagucuuuaacagguaaaaucaagguccagccugcucuaaaugucauuguuuuauucagccaucuugauuccaucugaugugaguagccccaucaugauuguauuaaaauaaauccauacauuaagaaugacaguuucauuuacuauaguaucaaaaguaauuuuaauagcauaaaacuaaauuugcauuguauacugcugugcauuugauuuaaaacauuaacugucauaaucgacccuuuuaauagcuauaugguaagcugagaugggagcuggagagagggcucagcagcuaagagcacuggcuacucuuccagagaaccuggguucaauucccauugcuuguaauuucaguuucugggaucaagacccaccucugacuuccucaggcacgggcacauuugcggugagcauacauaugugcacccaggcaaacauacacguaaagugaaaaaucaaaaaauuaaaaaaaaaaaaaaccccaaagguuuaaaugacuugagaacugggaguauaauucaaugguagauuauuugccuagcacacaagaaacucugaguugguccccagcacuacaucaaaacaaauaucauuuucaugauaguaugggcuagacucccaguauuuaggaagcagaggcaggaggauuacugugaauuuaaggccauccuugacuaccuagugaguauuagcucaguggaggcuacaugguaagaaccuguuucaaaaauaccaaaguauccagcuagagagauggcucagcgguuaagaguaauacugcucuccaaagaacugaaguuaaggucccuguacccauagcugguggcucaaaacuucaugggacuccagcugcaggggauuucauccccuuuucuagcuuccacgcacauauggcacauuugcauacacauuaaaaaaaaucacuagguaaauuccaaacaaacaagcaaacaaccuuccaaaaguguuugauccuucagacaucguggcacaugucucuaaucccagcauugcauaaucagaaguagguccaucucugugaguucaaggacagucugguuuacauaaugaaacccugucucaaaaauaaaaaggucuuauccauguuuacucauacacauaacauacauauauaaucauauguaugauuuugagcaaccucauagguggcagaaucaaaauucacacccaaguuuccuauccccugguucccuaguuaguucucaguagcuauaguggucucuggggcuguacucuagacuguagucauaaggcuggagaauggcuuagcaguucagaaucuguacugcagugacagaaggccagggucagauucccagcacccaugucggguggcuugucacugccuguaaccccagcuccagggggauucagcugcucuggcucccaugggcaccugcagcgccacucagacacaauuaugaggagaagacuguagugacagucucugaaaugagggguggagcucgggacgaugccuuucuguuuuguuuucucugaaacagaaacacaugauucuuuuaccagcuuuuuucuuuguaauuuaaguuuuuagcaaauccuacuagagauccuccagcagccagaaauauaaauugaucaauauaaaauuuagccuuauguucagauuuuucuucuguagcugagguucuauaauccuguuaaguuaguuaguacucagugaguagucuagcuauaaguuugauaaagagagggcuggggaguguggccaaguugcugggaugcuugcuuggaggugugaagcuacguucaucuccaacguagcacguaugcaugugauggcccauccccagucccaggacuggagagggugacucaggaggauuagaaaguucauaguaaguaaguaagugaacacaugaauaacagaacaaaaauagccuggcauaguuguauacgccuuuaauccuagcacucgagaggcagaggcaggcggaucucugaguuugaggccagccuggucuacacagugaguuccaggacagcuaauauaauaagacacugucucaaaaaaaaaaaaguucauaaugaguuagagguuagucuggacuacaugagccccuccccauucaaacaaaaaaagaugcaggcuauuuuaacuucuccacauacguagacuguugugaaaauaaaagccagacucuuuugaccacugugucuuuucucuagucccucucaggaaugugugccaggcccuacugcuugugggugcuuugccagguugauacagacauggcugagggccagucucuauccucagggaccucccagugaagcagagaguggcaguaguguucaguguguaccuacugaacaaugcccagaaaugugggucuauccucuguuguaccgcagcccucugaaccuacauaaagaccugaaggccuguagaacuuaacauagacaccuuugaaagcugcggugcagucucuggcauguggaaaucuccugaaagggacaaaggaaccccagacugccuucaggguugccugcacaacucuauugucaguguagucugcuuugagccguaacaguuuccacagcucccuucuggucuguacguuacacccugcaacccucugacuagaaaaccacagccccguuccuccacccucggaaagcauuuucugaagcagaguugaaacuggucuucagagccugcucccuugccggcuucagaguuagcaucccuucgcauuuuauuaaugaucuuuacuuguguaaacacucccaguaaccaggaacauuucagccaaauaggguuuuauuuugauaccaggacuuuugauagaacagaaaacaaauuuguuacacuuuaaucaaguugaaaguuuagauguuucaauaaacauuuaaaacaguaaaguauaaaauagguucauaaaaccaagaaaauaugagcucgggcuuuaauuuuuaaaaaaauuuuaaaaauuuuuauguguuugaauauuuugccagcauguagguaugugaagccauugccuguggaggccagaagaggucuuuggaucucauggaacuggaguuacacauaguugugaaucaccaugugggugcugggaacugaaccaugcuuugcuagagcagccagugcuccuaauugcugagccaucucuccaugccugagcugggucacuuuaauauguacuguugggggccggcaagauggccgagagagggaaucuuagcuugcugcuauaucugaugcccugaauucaugugguggaaggagagaacugacucuuguaaauaauaaucugauuucuagauuuuuuuuuucgaggcaggauuucucuguauagcccuggcaguccuggaacucacucuguagaccaggcuggccucgaacucagaaauccaccuggcucugccucccaagugcugggaggcugggugugcgcuaccaccacccagcuaccuagugacuguuuucugccucccucccgggaauauaagcuucuuugaagccagcuuugcccuguauucucagcaccuugccuuuguauaaaaauuaaauaggugggacgugguggugcacacuuuuaaucccaguucucaggagacaggcggaucuaagaccagccuggucuacagagugaguuccaggacagccagggcuacacagagaaacccuuucuugaaaaaaaauuuuuuuuaauuaaauaauauauuuguauaaauugcuguacuguuuuuuucuucuaaauauaaaaucaccuuuuuuuuuaaaaauuggaaaauguuugagauugaagccauguuaaaauuugaguucaggcuguagcucagggguggagggcuuggcaagcugagcucugcgcucagugucuaucacugcaagaacaaaccaaaacagaacaaaaauaguaaaauucaaagugugguggcuggugcagaaggaaggcuccacaguacuuacucugagaacagggcuccagagcaagacaauaggcccuuacguuaccuggugaucucuucuuuucccuccugcaguuggugaugcuguaauuaggccugcauauugccucugaacacagcccuacaaggcccuucauuugcagcuuauggaaauuagaucaugcacaggaaacaggcucuuuaguuaucagguugcacagaggagucaagaggcacgagggccaggguuugcugggaagacagagcuuuucccaaucuacacggagcucucuacagacuuucuuagcaacagcacugauuuguaccccagcgcucucuucaagguucccauccucaucuuuaaauagaacagcuaaaacuaacagggagaguuagauaugcauuuacauuguguggucauacguaugugcguguguauguauguauacaugcauguaugcauguaccccugugugauauguagcccuggcuggccugcagcaauauagaugaggcugggcuugaacuugugugccgcaguccgcccaccucugucuccugaguacuagaguugcaggcauuugccaccaugugcagguucagaguguuauaaguuuuuaaaauaccagagugauuauuacauuuauuuuuguuuguuuguuguauguguguguacauguucaugaguauauguguacauaugugugucuguauguacauucagaggccagagaucaguguuagcuggcuucccgagucgcuccacuuucuguuuugagauagggucuuucacuaagcugggcucauccaguuggguagauggggucagugaguccugggguuacuccugucucugcuuccuagcacucagggaauccuuaugccuguguccacuuuuuaugugggugcuggggaucaaauucaggugcuccuguucucacagcaagugcuuuacugacugggcucgcucuccaauacccgcaccuccccccguuccuguccugacuuucucucuuuuaaagacaagguauuucuauguaacccaguuuaaucuggaacuugcugcuuaguccaggcuggccuaaaacuuucagugauuuugcucauucugcuuccgugaugcugagauuauagacaugagcuauaaugccuuuuuuaaaaaaaaguuuuuauuuauuauuguaugcauaugaguacacuguugcuuucuucagacacaccagaagaaggcaucagaucccauuacagaugguugugagccaccaugugguuucugggaauugaacucaggaccucuggaauagcagucagugcucuuaaccaccgagccaucucuccagccccacauaaugccuuuuuuuuuuuuuaauuaaagauuuaucuauuuauuuauuuauuuauuauauguaaguacacuguagcugucuucagacacuccagaagagggagucagaucuugugaucggaugguugugagccaccaugugguugcugggauuugaacuccggaccuuuggaagagcaguugggugcucuuacccacugagccaucucaccagcccccauaaugccuuuuuuuaaaagacagggcuucucacuauagccccagcuggaucaaacucagagcaguccuuugcuuuggucuccugaaugcugggauuucgaguuugggcuacugugagcauaucuuuugaacaauucuuaauuuaaagaauauagagcauccauuaaacaucaugguuuggaagagaugaaccacagugagcuguuuuguuucuaacgaagguuuuaguuuaauuuuccuuuucuuucagcccuaaggacaguccagcagcacaggccccaccacugagcucagugccuugcccuucugacuggguuuuaguuuuccuaauugauaauaagcuguuacaccagccuucugcagugggaaagcuacuguggagauuacaguagccacaucaggaggcucagaggcagccggaagcuaggaaagcaagggucaggaagugggugaguugccuuguguuugggcuguuuuucagucugcgugugggagaaggugcuggaaaccacccuucccugcuuucaaccagcauggcuccauuggcaggcugagcacagacuagaacuuugugucucggaagaaaaugcuguuuaagauaaacugcagguuccuugcaaggcuggcaaugagcucucguugcccuggccuggucguaguuugucucucuguguccuugucccuagguguaugugguggcaaaugaaccugucccaguguugcuggacucgcugcuuccgcuccuccggguguucuuuucucucuacuguuuuacccagcagagugugucucacauaagguaagcaagcagaccggauacgcuuagaauuagaaucccauuugucuguaaacggucaaguuuaaauuagggcgagacuuucucucaaagucaggaagauguuuggggacucuuacucagccuacacagaaagaaagaaugaggauuuugcagguugagggaaauuggguguaguuuuggggaugauuuuccauagccuauucuguacaguagaagggaaagguaucuccauggaccaccaugccauuguuugaucgguaagaaauccugcguuuuauugucucugggaagugggaaaccagugggaguuuaugaugcccaaguggaguguuggagaguaaguuugaaaagugcagauuugaugugacugcauaguuuaaccuggaauuuggccuuaauaugcagagucuucaguauagaagaaaggggcuucuuagucaucuacaauccccuuucuguguuacuuuaaaacggauucaguuaggggcuggagagauggcuccacgguuuaggcgcccuggcugcucuuccauucccagcacccacauggaggcuaacaacuguaacggcagucccaggacaucugauacacaaacauaaguacaggcagagcauucacacacauaacauuaaauaaauacauuuuuaaaaagauugauuuuuggauuagcucuauuuucagucguuuguggcauuucuuccacaugguaggaguuuauaguuccauccuuuccugggucacuaugaagacacuguguaaacuggagucccuagaaaggucccugacaaauuauaagcucaauaacucagagcagucauuaguauggcugcuaauggugaagaaagacacucagcccuguaguuaagacuaaauguccagccuaaaaauaaaaauaaaaucuuuuuaaaaaguaaaaaaaaaauuaaguucucauagcaccguuccauccucaucaaagacugacgggggagcaugggccuaccccagccccuucuagugagugggguggcuucuagagccaaggguuaagcuaccccugggugaccuccagggcacuguacucugaaauuuguaagaugcaugcuucccugucgagugucagcagccaguggccgggcagcauugggaucaaguggaaccugacggucaucgugucuuccccccccccccccccccccccgcauagcuugcuagcuucauggaauaagaugacaagcucauucauucauaacugcuucaucuaccaggucacuuugccaagagaucuuguuauggauucuggugaagcuggaaaggaagaaggcaaucgccagccugaaaggauuuucgggguuggacaaaaccgugcccacucuccacccucagugucaguuuagagccgcuacgcacgguggcaucgugauuaccgccaaagaggccauuaggugagcuuaccaacccccgauugucacgccugacagaaguuuuuauacgacacuguucugugagucagccgcuaaggggcgcugauggaaaggaaaccagaaacaggcagccaaggcgcuugcuauuuauaaucuuuaaagaaaccagagccuuaaaugauccucuggguguuauuccaagaugccagcuaauaguaggugugguuugcuggcgccucccggcucuacaccgcagcaagcccagcuacugcccaguguucgccagugacucagagcacagggcagcacauguucaccgcagcucccgagcagucaguccagucugucucugacucaaagagcaggaugcaugugugccuuauuacgauuauuacuguauuugucuugucugugucugugcauugcuugcaugccugauggagcagaggguauccagucccugggaacuguguggauauugggaaucaaacccagauccuccacucccaccccagccuuauucuuaggggaaauugucugauuacugucauugguaauuuuguaaugaguuuguuucucauaagaauggauuagaacguacuaaauagacuuuaguggaguggaucauuuauuucuccaaugucucacaaguauuuuauuuuauuuuauucauuuuuuuguuuuguuuuguuuuguuuuauuuuuguccugcugagacugacccuagggccgcaugcacacugggcaucugagcuuugccccuagcgccgugagcauguauuuuagacuguuugcgcuuucugagauuuguggagggugcuguuuucucagaaccuaggcuucccuuggcuguccacauggagugugucgcugguccagcugcucacuuccgccacauccaaagaguugcugcuuguugaagugcuuacauuuaacuuuauagucaugauuaaucuagugaacauuuaaaacauaaacaaauaugauugacuugacgaaaauagaaaaaaauauguauuaaaguagaauuaucagaaugaauggaagcuuccugagaacugaugaauuuuagcagcuuuaucacugugcccauugaguguaagaauuuagaauuauuuggcaugcuuaauuagugcacauguauaugaaaacccacaguucucacugaaauuacuauuuugcuuccugaugagaauauaguuagcaaccagugauuaaaugaaucuccauccacugccagaagcaaccacuccuuaaaaucuggggugucugcucagguuagggguauaguccuuuugauauuauacacaaacacauacauacacacacacacacaaaaguuacaugaacaccuggguuuaaauagggcccacagacacuuaaagcagucagaguucccaaaaaauugaaaauuucaugugugugugugugugugugugugugugugugugugugugguguguguguaugugugugugugugguguguauguguguauguguuguguauguauauguauguguauauguaugugguguguguguguaaucauuuguucccaaagcagcugaucuguuucaccacuuuccuuucacccugccauuagcccagcagaaguuuccaguaagaaaguguuuuaaagaaaauuuaagccaggcacaguaguacacaccuuuaaucccaacauuuaggaggcagaggcaggcagaucucugugaguucagagcuagucugguuuuccuagcgaguuccaugcagccugggcuauauaaugagacugucucagaagaaacagacaaaaacaaaagcccagcucuauuugagcgcuuagauaggaguguuggaggcagaucuuuuuaaacuucuuuauuguugcugcuuguucacuauggagcucagguuggucuagaauuuacuguguaguccaggcuggccucaaacuugaagcaaucauccuacauuagccuaaguaugugcuauagggaugaaccaccacacccagcaucaaugaucauuuucuuuagacacaccugaccuuuuuuuuuuuuuuaauuuuucaauaaaucaugucuaaagccacuuccuuuacaaaucuuuuccuauuugagaaauaaaugaucauacagacuaaagcaguuuagcuucuaauaauaaauaccuugcauucuucagcccgaacauaaaggaaaauauuuucaagaucugucugaagauuaccuauauggaaauauuguuacuuuagaaugucacucugagguuucagcuuccgagguggcauagcaggugaaugugcugugcgcaggccugaaccugaguuggauuccuggaucccacaaggugucagcagauaacugauuccugagaauuguccccugucacccacaugcaaccuugugccaacacacaugugccucuguagccacacauauaguauaaaauaacccuuuuaaaaaagagaauuauggagauuucuaggaaacaugcugcuuuaucaacacugacgugggcgaucuugcccuguguugcagcgaugaugaagaugaagcccuguaccagaaggugucuucagagcagagccagguggagcaccuuggggacuugcugcugcacugccagcaguguggguuggcaggagauuucuucaucuuuugucugaagguaagaauccacacagucacaccaauccauucugggguagcucuaggagagccuuugucuuuaugagcauucauaauuuuagguccuaaaauuuagcuuccaguuuaggaccaauaaacagaagacagagaguaauuaacucagcugcucauaggcucuggaauggacaagggagggaccgucagugggacaggugaguuaccggugugcucugccuacucugcuagcucaucugcauugaaauguuagacaugaacaaagcugccucguuagucuaugaaaggguuaaucuuugcuccguguugacaguaagaucucuuuugaaguuaauagcagguucugaagccaagaguaaucccuuauccuuucuuggccuggugugcagucagguauuuggaagggaaacucagccauucugccucccucuuuucgcucuguaaccacuuaaaaccuuuuccuguuccugccgagugccauuguuggcacuucccuuggccccagucuccaguaguaacuuguacuccauaacguuagcgcugccugguaucugcugcuguccgcucucucaagucugucccgagagagugucugaaguuuaaggaugagugguggcugggcacgggaagcucaugucucuagaacuugaaguagggauguuucuuuuggugcuuucucaucucuauguucaggcccgucucugcgucagccacacacucugaugucuaaggaggcgugagcccaguuguaugcuuuguuuccaguugcucuuuggguaggagcacuggcugcuuucacaaaagaccugaguucaguucucagcaccuacauuguggcucacaaccucuguaacuccaguuccaggggauccuucugaucuuuacaugcaccacacacacucagacacacacacacucagacacacacucacacacacacacacacacacacacacucacacacacacacucagacacacacacacacacacucacucacacacacacucagacacacacacacacacacacacucacucacacacacacucagacacacacacucagacacacacacacucagacacacacacacucagacacacacacacucacacacacacucacacacacacucagacacacacacacacacucagacacacacacacucagacacacacacucagacacacacacacucagacacacacacacucagacacacacacacucagacacacacacacacacacacucagacacacacacacacacacucagacacacacacacucagacacacacacacacacacacacacacacacacacacacaguauccauacacacauguaggcaaaacacucauacacauaaaauaaaaauaaaugaaaugccaggcagugguggcgcaugccucuaaucccagcacucgggaggcagaggcagguggauuucugaguucaaggccagccuggucuacagagugaguuccaggacagccagggcuacacagagaaacaccgucucgaaaaaccaaaauaaauaaauaaauaaauaaauaaauaaauaaauaaauaaauaaaauuaaauuaaaucuuuuuuuuuuuuuaaagggcccaaaucagccaaguguggugguacaugccuguaauagcagaggucuggaagcugaggcaggaaaacgauuuugaauuucaggccagcacagguuauuuaaggagacuguuuccaaaacaaacaaaacaaaaugcuaccaucacgcaaucaaagggcuuuauucuaaaucccaguuuguuuguuauuugaagggucucauguagccugcguggccucaaacuauuuagccagugaugaccuugaacuucugcucuuccugccucuacuuccugagugcuaggauuacaggcaugcgugguacaguuccugggauggaaccuaggaauacacgcauccuaggcaaguccucuaccagcuaagcuguauccggucaacccaagccccuuaaacuauggguccugauuccagaggaggucacauaguaaaugugugugugugggugugugugugugggagggaggggucacaaaacauuugucaacacuaagauuucugaacacaaaauagccaaaacauaauucaacacgacgagauggggaaugagcuuggggcguuucugagagcuugugcaccaggcagccucaccgaggccuugguucugagcacauagcauaugcacuuugcacugcacaggcugucaugccauucaacgcgacaauauuuccacucagauuugaggucauuguaggcuguaaaucauagcaccucugcuuucaaagaaacaauguuuuaacaguggggaacaaagaccaucauucuuuagcaggcaaauaauaagcuaguauguuuuuuaauuuuauugcaucagaauuguugauuuuaaacaaucguuggcugaggggcuggagagaggcucagguuaggagcacuugcuguucuuccagaggcucucaguuauguucucagcauccaggccaggccacuccaccuacuugagucccacaggauccagcauccuuucugcccaccuuggguuucugugcucacaugagcacaccccuguccccccacauacauguauauugauaaauauucaaacauuucugguugggcugcugaacuugaucuuucauuuuaaaaaaaucaugaaaugauuuuuggccuuggauuaggucagaauuuugaauaaguucugaaauggccuuugacugauuucuccuauuuuuguauuuuauauauauaaggaaagcugaauuuuuagcauugaugauaaaaaaaaaucaaaauguggaugugcucuaagaaacacugaagaugcugugcuuucugcaguauuaaauagucacaauugaauccuuaauguaaaauuaaucaagcaccacaucucauuaguaugcaaauuuauucaucuuuaauagacaguaaaaacauaugcaugccaaagaauugcuuuaaaguaaauuuccuuauaauuuauugccacuauaggcuugaccaguacaccuacuuuaugcucauccauacauggaguuguauuaaaauuccucagggaaaagagauuaugaguucaaauguuaaagaagcccugcuugaaaccaggaaaacuuaaucuuggcaaaauugacauuugaucuagauaaguguguucuucggugugguugucuuguucuuuguaggauauuuaguaccaucugugaccucuacccacuaaaugccuuuguuacccccccaauuaugacaaccaaaaauguccugcaggcauuucaaaauguccccuggggaggaaaauuacccaagcacgguugaacaccaucacucucagcugucagcuacuuuagcaaagcacuaauugugagggaacuuaagguuuucccuuuccaugggaauucacaauggagaagcuuaccaaacccacaauaaugaauucucuguuaaauagagguuuauuucugacuugucuuaaaggaaaggcuucuaauggucucuaaaaggacuuuggcuaaguaauaucacugagggcucaguucaaggaaggcuugugacagaauugugaaaguguuauaaaaugucaaacaaguccuuuuuuggggaaaggggggguucaaaacagggcuucucuguguagcccuggcuguccuggaacucacucuguagaccaggcuggccuugaacucagaaauugaccugccugugccucccaagugcugggauuagaggcaugugccacaacugccuggcaaguccuuuuuuuuuuuuuuuuuuuuuuuuuucuuaaaaaaaaauacuuauuauuuguguguguguuuguguacguguuggugaggggagcuuccugugccacugugcauguguggaguucagaggcugaucuccaugaguugguuuugucccucaaaccaugguuugugcucucucucucugucucuguguguauguguguguguguguguguguguguguaaguucauguacuugguaucacuaugcauauauuucuguacagcguguuuuucuuuccuuuucuuucagcuucuauaccccuaggguuuguuuuuuauuuuuuuuuaaggcaggucucacuagguccccuugggugguccugggcacacucuguagccucagugggccugggaccugcaguccucuucccccaggcuccugaggagcugagacuucaggagucuuucuuaugcauaaacuuccuauguuuuucguguccuuagggccucugccucucucuuccugcuuuaggaguugucucaccugcuggaggacagagaagcagaguucacucccaagcccuccugcuaugcgagccuccuugaguuagagcaccaccagacucugcucauagaagaccaggagcggaagcugcagguucugcagcugcuggccguucugugugagaagaugucugagcagauauucacacacgucacucaggugaguggcugucgcaccuggauccagccugcugguauuuuaguuccuuuacaauuuuuuuuuuuaauguuccuuaacugggcauggcggugcauaccuuuaauccuaguacuugggggcagaaguaggcaaaucucugugagugagaggccaaucuugucuacaaaguaaauuccaggccagccagggcuauguacugagacccugucucaaaaacagaaguuuagagugcaguuugauaucacccuuucccuguuucuuggaauucugguuaaaaaugaaggcucuuacuuaaguuuacuagcugaauucauaccagcggucuuacauacuacuccaugugcuuaacaugcuccccaugugagccucaccuaagaaaaccccaagaacugcuuuacauauuuuuuaugauauagugauauucaacuuugaguacaaauaaacucaccuaguauuuuaaaaauauaccacuaccuaucuggcuaccuuuuagaggcuuugauuuaguuugcugaaauaagagcccuuccugaaggccuuuuuauuuuuuuuauuuuuucaaguugcacauggguccgagguuaugaauggagggcaggagugauggcucacucacugugcaaacacgagaaggagcguuuggauccucagugcccaccuagacagccuggugugacugcgcaugugccuguaaccccagauccguguaggucaugcacaaaagaucugcagcuugcugacccaccagcauagggucaggcucagugagagacucugggucaaguaaauaggguagacaggaauagagccccugacauccucucuggccccuucauacauacugguacauguacuuacauaugugcacauaugccacauacauauauacacaaauaaguugagaacaauuggaauucaaauuugaaaagcaagucuuacccuuguaugguugugcacacuuuuugucccagcacucaggagacagaggcaggaggaucucuaaggucaagaucagccugaucuacagagcaaguccuaggauagccagagcuacacagagaaacucuggaaaaaccaagcagccaagcaagcagccagccaaacaaacaagcaaacaagaaacugugaagugggaacuucugguuucuuugggaagucaguuaugucaaaugauguuuuggugggcacacaugugaaaggauguuuugcugaagcagacacaggaaaggacacgugauguuuagaaagaauauaaauaugaccccacagacagugggagcucaagcauugguuugucuuacuucagcuugcuagucuuugcugacaacacggauguauugguuugcccuacguugcauuguugagcuucacguguggugacuucauagagggaaacucaccaaagagcuucuccugaggcuccuguggcuuuuugccacuucaguggccugggccgauuggcaagccucaggguuucuucuggauugaacugccuucccugauucaugugcugugucugccaaguggacuggacugcagcugcugguuugugugugguguuugcuaguggaccggacugaaaacaaggaagguugggaucaccucaaagaauauuucuaaacagguccacuucccccguauccugauaaucuuucuuuuccacugccucuguuggguggugggcuaaaggggagguugaacucuuauuaaaguaggcuauaaaaaaauaugccuacaaaacuguguuaauaagaccacuuuaaauuucaugcauccuccaauuuacagcuuaucuccauagcauccugugcaguuuuaagauauucuaaaaacaauacuuucagaguagaguugcuuagugggucaguuccugcaguguauugacugagacauaauuuuuacuaccuucuuuaaaaguaggagauaaaagugaaaaauacauuggcaaugcagggaccauauuuuaccacuuaacuagaauuaguugugccugacuggugaagagucauuuguaagaugguaugauugucacacuuaaaucugauccuccaugucuuugugugguugucauugucaucugcaguucguguugcuaagcagcgugucacugagagcucccgcugagaacgcuagcugcugccugucagcucuggcuuagcuugccuguuuaauguuccugguuucugcccaagccccucacuccuucaguucaccgaccucauguugcucggcggggugauuuguuuuguaugguuccugacaacuuccucaucccagcuugugucugugucgggggcuggguggaagggaaaaugguuuaaaaaccgauagagccugugccucugcacuuaccucccucacuccuaauuaagaaaccgugggguuagguuggcacaaaagaugcgcugaccuauuguagcgcccuucgcacagguuauucaaaaugcaccagaacaaaagaacccccaggaaguaccaaagugugcuuugugaucucacugcucgugaugauguuggcguauuauuuugaaacccaugagcacguucacaugcacacacacagagaaaauaaaguaaaugucaugugguuaauauuaucaggaauaaagauuuuuaguauaaggaaaauguauaaaagccaaagaacuagcaugaaauccguauacucuugaauuacaguuggggacauuagugugagugaaugauugaugcuuuucucugaaaacaauggguauuuccuagugugguccccugucauugccaggaacagugacaggcagcagcagcagcagcauuaagugcccuaguuccagaguggagacuauaaaaaccauuccuacucagaauacucagugaucucugggaugaagguugauuugaggucuaggguagagauuguacauuauaagcuucaaggcagcuugaugugcccaggcacaaggaagccaucugaauuuaauggggucauggcaguagcagucaggagccaccuugaagggacucuuguugcaacacaccacacaacuacagcauucagaggaacaauggcuagagcagacacaucaaagauagaaaaugagguuuuaaaccucucaggauuccuuagagauugucagggccucuggucacuauuuucuaaguugauaaucgaggagaaugaggauagcacaugucuagccuuucuuguagugaucagauuucaucagacacgcaauggagaauuuuccauaggagaaucacaggcuagcgacuaguugguugcuugccuucugggacagucacagccaaaccauucagaaggaccuagaaaacuacuucuuaaaucucuaaugauuuuauggguuuagggaaugaucaccauugccugcaaaugguuagaagggcuguggauggaauauucuuauguucccagugaaauugacuguccccccuuuuauaaaaaauuucaaguuugaaguaauuuuuaguaauuauucuguuuauuuuugguuuuggguuuugagaguguuucacugcauaucccuggcugaccugggauuugcuauauagaacucauagagauccuccugccucugccucccggugcugggauuacauuuguguaccaccauaccuggcuuuuucuuucuuucuuuuuuuuuuuuuauuaaguauuuucuucaauuacauuuccaaugcuaucccaaaagucccccacccccucccccuccacuccccuacccacccauucccauuuuuuggcccuggcguuccccuguacuggggcauauaaaguuugccugaccaaugggccucucuuuccagugauggccgacuaggucaucuuuugauacauaugcagcuagagucaagagcuccgggguacugguuaguucauaauguuguuccaccgauaggguuguagaucucuuuagcuccuuggauacuuucucuagcuccuccauugggggcccugugauccauccaauaguugacugugagcauccacuucuguguuugcuaggccccggccuagucucacaagggacagcuauaucaccguccuugcaacaaaggcuugcuaguauaugcaaucauaccuggcuuuuucuuuugugugugugcagcauguauuaauugaacauauuaaugaggacuauuuguugagagaacuuccuagugaauaccuuguuccuacuuccuacguagauauuggaguauaauuuuacuguacuccgucaaaucuucuuucaugauuucauuccuccgugucuuauuuuucagaacauuacaggguuagugcagacagcagugcacgcugugccaaauauuuuggacagauuggucuucugucacccucgauggccaaacagguugucguggguucccacauguaugcagugggaaguauagggcacuugggaaggauucugaccuaagcccagaaccuugacccugaauccaauuaaggaaaugcagacgccagaguacuguguuagcaaaggccagaggaagcagucagccagguccaaacugcgagaaucugcagugcuugugugucugcuucuucaccaaauagauggcauaaaaaaaaagggggaacccagcugggcaugguagucacgccuuuaaucccagcaaugaagaggcggagguaggcagaucucaaagccauccuggucuacauagugaguuccaggacagccagaucuacauagugacacucugucucaaaaaagccuggauggauggauggaugaauggauggauggauggacgagugagugggugaaccaguacuagauucagauaaauaacugggggacuggagagguggcucugucaguuaagugcuuaccaugcaagcaugaagaccugaguuuggauccccguguaagaagcugggcuuggcagaguucaucuguaaccccaacucuuaugggguugggcaagagugguggagacaaguagauaccuagcucuuacuacccaggcagucugcuaacuggugagugcuauguucagugagauacccuaucuucuaaagucaaaagcaauagaggaaaaugccuaaaguuaaccugugugcacacaaacacaugcacacauacguuuaaaaaauuauaggcaaauuguggcugggcaugguggcauguaccuuuaaugcgaacacucaggagguacgacaggcuaugccugagucucaggccuuucuggucuacauagacaguuuagacccugucuuaaagaaaaaggaauuauaugagauauuccuuauaacaguugugggccaggcauuaagcucagcuuaaaaaaauauuuuuaaaagaaagcaaagaaugucauauggcaguaauuuauuaugaagugugucagauggugauuauuucuggaggaagauggaauaaggaaaagggaugguaaguagguggcuguggagagcugcauugaagagaugaccuguagccagggagggugugaagacuugcagagagagggaugauacccaagaguaucaggaccagcgaggagcccagugccagugcagggugugagcaagguuccuagucucugcccuuucagaaacuacauccuuuguacacugcugaguuagaucacuguagucagcagaguagaaaugguucuuccugguguuuuucuuuuuuugacucugugugugugugugugugugugugugugugugugugugugauagacucguuacaaaaacagaacacagagagaguugcccguuauaaagacaagguauugaccuauucuggaaaucauaggucagcaucagcagggcagaugugugugcuuguagaggugagaguugggaaaggagacacuaacaguuggaagcuacagagccauagcugaucagcagccugagaaacugggagacggagcaucugcacggagagaagcauggaaugaaccucaacagagcugcugaaaagggagccaggcaucaaggugugguaugccaauaauccuagcacagaggggaggcaggaggauugccacaacgacauagugacauugucucaauaagcaaacaaacaaauaaauaaauaaagucucucccugaagcaaguguggcauugcuccagaaacagugcgaguaaaaggggcaaacagugugaguuccuucugcagcagccugggcauagcacuaacuaauuaggaaagggacugagugcaggucauaacacaguguuaaggcuaucugagacuuaggggaacccuucucuuccccagcaaaacaauagaggcuuuaaaacuacuuuuuaaaaaugucuuauguuguacgcauguguauaggguaggagucacauggaggucacaggauggcuuugugaguugguucucccgucuuuacuugggcuccagugaguagacucaguugacuggcuugcauggcaagaacuguccccugcugaaccaucucaccagcuuagagguuuccucuuacccagggcuuugccuguggauggaagucgcaucugaagagcaggagacuugugcuguguggauguguccugucucaucucuccccaccugauucugcaucuacugagucaacugcucauaauuacuucacucuuuaauaauaacauuagguauuugcuguuuaccaggcuccauucugaacccaugacggguauuaacucauuuaauccucuuaaugacccuauggagauguguaacuugcugacgaagugcugacagaguggaaggggcuggaggcuggcuugauugugugcauuucagcagccuccugagggaugcugaacucgaggaacucugccuugggugggagucaauugaaaaacuccccugaguuccaaagggcuucaaucacugaggaccucuuggguuggcaguccugucagaaccacaaaaagugggaaacuagggaaagcugcugucaaaauggcgcuccaggaaggaagucugguuggacauugcagcgauccuacaugugggggaucgaucaggaaguucaagcucauccuuggcuacauagcgacugggaggccagccuaggcuguaucagagucugucucaguguccuuccaacaaauaauaaggaaguuugggagaaaggauauuuuuauugaugacauacauuaauaaauggcccucccuuuauaguuagcaguuccuaguuuuuaaauauuuuuuucaagucuuugaauuuuuauacauuuauacgauguauuuuaucauauccauccacuaccuuuguucagcucuccuagagccccaccagccuuuugucucucuguuuucugcucuguugauucucaguuguuuguuuuauguuugcaugcauacaaacagaacucuucuguuucucugggaagcccuggcuguccuagaacuugcuuuguagaccagguuagccuugaaccugccucugccucugccucccaaagucgauuaaaguauggcuuccagccuuuuaaaaacagguacauaguggaucaggugagauggcucaguacauaaaggugcuugccaccaagucucacagccugaguucagacccuagaacccauuccaaagagagaacucacuccuaaacugcucuaaccuccacacaaauguggcauguugcacuuguggacacacacagggauaaacaaauguaauguuuuuaacaauaaaaaaaaugccuaggaaggagcuuaggaaagcuaguucuagcaauuaacaaaucuugugcuaacauagaagguaaauaaaagcaaggcacccuuuaaaauuuuuucucuggcuuaacuagauggccccaaaugguuuauaaaucaggaaagcgucaggguuagagagggaggcgcguuucccccauuguuuccgugcgaggaacauuuaaauaaccuuugcaguuuccugccuugccccagaagacaaguguuaacaggccauucucccagcuuuaagcuugcagugaggaaucuagcauagcaugugauuuguccagagaguuaaacaugcagcauugcauagugguuagaggcuuauuauggccuaucucaacuuucccauuuucaaaaugauaucuccccuuugagccauuaauccugaauauccacgugugcauguguacgugcaugaaugccugucugcuguuguuuaacggugauuauacgaggcucaguucaaaugaugcugaccaaauuaauuccauugaaagguuguugguagucuguauaaaaccuuacguaugaaugaugguaagucuguagaaauagugacacuuagaauuugacucuggauuucuuacagguugauugaggacgcaggauuauaaauaacaccaggaaccuucuccccuguucauugcuuacuagaauuagacugucacgugaaacugagaaaucucugaggaggaaaccuccuucagagaacauuuuagaugaccagaaaguacuacuuacuuuuauguaugcauuugauaguauauguguauaugugcauucucaugugugcaugugcguguggagcuaagaggcugaccuugaacauucauuuucuaucuccugccgacuugauuuugaaguaagauaucucuugucacuugcugcugugcuauauaaaccccaggcaggcugcccugucagguuccuuucagcugggccuccuugacuuuguaauauugcucccgucucugccuccugugucacuguaggagugcugggucacagacauuuccagcaguggguucuggaucuaaaccuguaauuagacuuacaaggcaagugcuuucacuugccuaguuaucucccaggcacagaguuuauuuuuuuagaguaguuuuagggucacaacaaaauugagcagauacagacguuucucagauaucuccuaugcccucaugucccuagccuccccauuguuaccaaagaguaacggcuuuuuagaauucuuuaccucguguguguguguguguguguguguguguguguguguuuguguguaucuccuggggacucaacccuuucaccugcuagguguacccugagcuacauucugggcucuuuguuguaacugaggaauccacauaaccacaucaguguggcucccagucugcagcuuacaucaggguucacucuggggcuuguacuguuaauagguuccacaugucugccauccuccuguauccuaaaaauagguucacucucacaucugcccccuguacucacucacuuacacucucucucucucucucucucucucucucucucucucucucucucucaccuguauccuugcagauugcuuccucucacuuuguauuauuucuccucacuaauauuccuccaugucuuuucauggcuugcuagcgcaccgacaguacuaaaugacacugucuugacaagucuguuuaugcacucaccuuauggaggucaucuuagucaccucugagcuucgagauucaugacuagagcugcuauaaacaaccagcugcagguucuucugugagccugaguuucuaccuccuuugguaaaugucaaaugcaguggcuggggcaaaggagaauucuuugcuuuauaagugauggauucuugggacagaguuuuuagcucaaugguagaacccuugccuaacaugugcaaguacuugcuugccaguacugaauuaaaaauggauggauggauggauggauggauggauggauggauggauagauagauagauagauagauagauagauagauagauagauagauagauagauagaaugccaggaguaacugaugcuuauacucccagcacuuaggaggaaaucugcuguguauuauuggagacuagcuugggcuacaugagacccucaucucaacagacaaguacauugcuugcuuagcaugcaagaagcccugagucugauuuuccagcaccacauuaacugggcuuagugacacauaccuauaaucccaacacuugggaacugaaagcaggaagagcagaaguccaaggccauccuuaacuacuuagcaaauuugaggccagccugggcuauaugauuacauaagacccuguaucaaaaagaaaaaagagagagagagauucauacucuacauaugaaagauucggaagcuucugcauugcuaaacuccuccugaaggugcuugguggaguagauuguuuagagcacuauaugcucguggguugucuucuccaucucgacauuuagcuauuacuguuucuuuuaaaccauccuauauaaacugucagguguaaaacagaaacccaugaaaaacagcagagaaucacagagcuccgcgucugcuacccaggagcagccgugacgugcuugugaugcaaagggggguaguacagacgucagauggaaggauucuacaguugcuuccugccccucacucauucuaacuuccuucucuggcagguaguggacuuuguagcagcaacacugcagagagcaugugcaggccuggcucaugaggcagagagcgccgugggaucccaaacccugagcauguccauggggcugguggcugucaugcuaggaggagcuguucaggugagcguaagugugagcaaaacuugaaugucacauggggaagaggaccugccgcccuucuuccauaccuucauggaaagcaagaauggauauugcacccaggagaacugggauggccaagcuggguugcugaugagaaucaucuccaacauagaugacaagccugcucccuucacagugcccugcgcagaugucaucaucaaaagggcagggcucuuucccucgcagaaggagcuuguuuuggaaacagugagcaaagugguuugcgccugaggcagacacuccguucucuggcucccauucuucaaaggguuggugggaaaucccuagcaaccuccuggcggcucagauggcauugguuacacaguuucacguuagcucaggaucuguuguugagcacaugccgugcagugugcuugagccccuugccagucacuuuuaagaguuuuguuuuguuuugagacagaaucgcauguagcccaggcuggccucggauucagucugacguuguugauugauuuuccuuuccaccucccgagagagagcuaggauuacagguguacaccaccauggccagcuuagcuuaugugcuuuuuacauaauuaauuucuagguuuuaagaucuauuucuauuuuuaaauuaugugugugcgugugucuguguguacaugcguguaggugccugcugagacuaaaagagggugucagauccccugaagccagauuuacaaacgacugugagccuccuuacaugggcacuggggaccacacacagguccuuugccacccacugagccaucucuucagcucuaauuuauaguuuuaaaaauuuauucaaacauuauugguuauuauuugccacaugccagauauugagcuaaaagaucugggaauauagcagugggcaagacggacauggcuuauaucucauacugcagcccagggagggaggcacacacagaaugaccauuuaaaaauaugauagaauugagucaaaucccuccaaagaagagggacgggaacggaggggacauaacaucuaagcuaggccaagaggucuucagugagcagaugggauuuaacuagaccugaagaggaguaugugugugaguggguagaacucgcggaaggaagccuuucauuagagaagcucgugcaaggucucagaaccagagaaaagccccguugguuuucuugaggcacugauaagaggaaguuguaaagccccggcgaggcacugccaaagggaaagggagaggcagggccagaccgugcuugugagaccugcgugugagggugacugguuaaggagaggcagguacagaccaugcucgugagggugacuggcuaauugggugacacauuaagcaaggagacugcaagaaaguaggccagcgucagagcagguaucacagacucaagcucaucccgugagaagggagcccgcagguucauucugaguuugagcauucacaucugggugauuccugacauucuagauuuugccuuucucuugacuuauuuuuuuuggcucuguguuuuuuuuuuuuuuguggucucucucucucucucucucucucucucucucucucucucucucucucucucucucucucucucucucucagaucaaacccagagccuuucacuuccccauguguuacaucuccagcacucuuaacaagcguguccagccagcagcccacagcugacagccugggucccagacuacaacauuauauuuuagugucaaaaggugggauacuccuaccuggagaaaaaaaggagaaaaaggauuuuuaucugggcuaguugucaauaugaaucccauuucucacuggauuuacauuccuaauuuuauauuuuguaugucaucugaaaaaaauaagcuuuuggcuaagguuccggagucauaugaaauguaacaaggaagaguucacagauggaauagcuuaaguuggauuguuacuggauuuaauuagcuuaguugaauuuuguuuucugauugaauauuaauuuggauagucuuuauagguugaaagcauagauuguguuuaaucuucuuauuuaguacuuauuuuagacaauagaacaaaugggaaagaaaucgcuaaaaucuauuacugcauuuuuagagcccauuguuggaggccgugccucacuugcuaucucugcacagcccuggcccauccuugcccuccuaugagccauccugacucauugccacuuccugggcuccccugauuuugcaguuuaagugaacacacaucaccuuguuuacuuuugcccuagauuugcuaauuuauuguuuccugcuugauucauucauuuauaagaguuuccucuuccuccuccuccucuacuuuuuuuuuuucuuucugguuuucucuguucucuguguaguccuggcuguccuagaacuugcacuguauaccaggcuggccuagaacucauagacccaucugccucugccucccaagugcuaggauggcaugugccaccacugccuggcaaaggugcccuuuuuuuaaaauuuuagauuuaguuuauuuguguguaugaauguuuuaccuccauguauguauguauguaugccaccugugugccuggggccgcaggaggucagaagagggucguaggaucuccuggaucuggaauuuggaugguucugagccacuauguuggaugcuaggauuugaaugcagguucucuggaagaguacccagugcuuuuaacagcugcgccaucuaucucuccagccccguaaggcuucuuaguaaugcuggguuuugucuuguauucacaauaaggucacauuugaaaaucaugguugacuacagucacucuuuagagccuacaacauuuucccuguuaggagucauuguuuuggccaaugaaacagaaucuaacagcaucgggccuuucuucauuccuuucugauucauguaaguaaggugauuauuaaaacagcaugucugggaagaggaguuaguguugagaaagugcagguuaagauugcuaacaagaugacuguaacuccacauucauuuucuaaauuccaggcuuggucaucacuaaaguauuacauuggggagucucccuguccccccaagaagcaguuucugcuugguguuguagagccugugggccccgcuauugcccugguuggugaagcugagcagaccauucuggccuuucuuuaggaaauguauuaccuaaaggcuggacuccuaaucuuuaggcccagauaucauaguaagauucacuacugagagagcaaaaguuuaucuuucucuaaaggaacauccaucuucagcuuguccuuacaccauacuauccaggucuucaugucucucccuucccuccccuccccuccauucguccauccuaucuuccuuucuuugucaaaggccaauguuuaaacacuucauuuauaaaaacuuucuccugaggacggcuccgagguagaguucuuguugcucuuagagacaugggucugguucgcugugcccacauggcuccucacaaccaucuguaacuccaguuccaggggaccugaugccucuccuggccuucugaggcacugcacucaugaggugcacagacacacaugcagacaaaccauugguaaacauaaaauaaaauaaaucucaaaaaaucccauuguuauaagcauaugccuauauuuuaggugaggcugacgaacacaucagaaccauagcaaaacaaggagaaugaagugguuccacuucuacccuuugccccuucacugggcuggacacucucucuauagaacaucauuuauucuugauugugguugccucaagcaggcacuuccugcuuccuacccgguguuagggagccaaaccugccacagcagcuaauaaacagcauggguggaugacaaauggcaggaagcaagaagaaaggaaaauauuuuaaacuaaggagggaguggguuuugguuuuuuuuuuuaaaccuauccaagggcauagacuuuuaaagguuuaagaacacugcucucucccuuuacgagagcacccuucagaccucaguaacccaugggugugaggacagcauuagucaugaguugcuacagggaaaggagagcuuguuauccucuagguaacucacacgggucccagaaguucaagcauuuaugguagguagauggucaccgccagcaaaagcccuugcugaggaugggcaguuacgucaagcagggcccugugcaagcuaagcccuugcuuuagcccucaccuuagcuugcaucucugcacgaccguucacacauccagagcuucaggacaucucaggugucuacucugucauucucugccuaguccuuugggacagucucucaucaucucacuagcccugaaauaacuaacaggcccgugugcagccuucccagcuuuuuacacaggugcuggggauucaaacucagguccucacgcuuacacaacgagugccguaccaccaagcugucugcucugccccuaauuuuacauccuuuuuuaaaaaugugguuaacaagauggcucaggagggaaagguauuugccgcacaaaccugaaaaccugagcucagccccuuggcccugugugaaaguggaaggaaagagcugacuccacgagauugcccucugaccugcucauucaugaccaggcacuugugugccacaacugugugcaugcacgaguacauguaugcacacacaugcaugauuaauacaaguaauuuuuaaacgaucuuuaaguuagcuacagacuauuuguuuccaaugccuuuagcuuuugagauuaauccaucuaucuauggaguugucuucauuauauucauuuauaaauguuacagauuuucagagccuucuauaguuuuuuaugaaaugauuucuguugcuaccaguguccagugaaagguuuuuuguuuucuuuuaaugccuguuuuaaaggacuacaccauugagauaaaugcuucaaagaucuagaaucugguuagguauggugguacacaccuuuagucccagcacucgauggucaaaggcaggcagaucucugugaguucaaggcuaguccagucuucauggugaguuaggauagccagaacucuguagagagaccuggucuucaaaacaaaacaaaauaaaacaaaacaaaaaacaaaaagaucuagaaucuuuaaggacugccaauauccaaaaaccuagcagaaaucaguauuuuuaaaaaacauuuuuuuauuuuuauaaauauuuuuauuuuuauuuuuauaaauauuuuuuauaaauuuuauaaauauuauuuauuuguuuguauaugugcgccuguguguguacauguguguaugcacuuguguguguacguguguauauguaccuguguguacauguguguauguacauauguguauguaccuguguguguucauguguguaugcacauguguauaugcaccuguguguguacagagaccugagcaggguaugagguaucuauccuucuguaucacucucuaccuauugucgagacagggucuuuuuuugaaccuaaggcucacaguuuuucugcuaugcuagaagccagggauccuccuguuuucacugaacuuggagcugggauuaccgagaugcauggaaaauguggcuuguuguguggguacuggguugugagcucuggucccucauaguaaaggauggcuuuuaggcauaauuuaauuuuuauauaccaaacuauuacuuuuuguuuauuuuauuuuuucuuuugagacaggcucacaggcuauucuagaacucauuauguagaucaguccagccuuguacucaggguaguucuccugcuccagcucuccauugugaugacacgcaugagccacacugucaggauuguaaccucuugacuuuacaaucagcuguguuccaguugacaguucuggacaucuuacuuaagugucuguuucagaugcaggaacuaaugggcacucucccucagggauacagaguguguucuuguucacuuagaaggugccucuguguggcagugcucaauacuuguuagcugcaauuauguagcaaauagcucagggcagugcugagugcaucaugaaccugaugugacuguugccccucugugcucuugguaacauuguccacauuaguuuuuaaccuacuaguuuuauauuucccuuuauaguugaagucaagugauuuugcaguccugaagcagcugcugccucuguuggagagggucucuaacacauacccugacccugucauccaagaacucgccgccgaucuccgaauuaccaucuccacucauggagccuucuccacugaugccgucagcacagcagcccagaguacccuaaaccaaaaggacccgggacagaaaauagaagaacagcgacaaaccaguccugacauaucuacagaaggagcucagaagccccccagaacaggccaagguuccagugggcccugcacugccacaagccagccaccuggaagcauaaccacacaacaguuccgggagguucucuuaucggccugugaucccgagguuccaacccgggcugcugcccuccgcacccuugcccgcuggguagagcagagggaagcgagggcccuggaggaacaaaagaagcuucuccaggugaguaggcgacacugccccgggcacaggaccuagugcaggcagcugcccagggcuaauauucaacucagggccuuugcuguuuugagacaggaucucacuguagaucccuggcuggccuggaacuuguuccauagaccaagcugaccuggaacucagagauccaccuguucugccuccugagugcugggacuaaagguguguccccucaugaccagcccaacucggguauguuuuaaacauugacuugugucaagcacucucuuggauuauccuccaggaauuuaaauuguugaaaagucagauuaagauaggaaggguguuuuauauauaagccaugugauggguaacugggggaaaaagaaagugggcaaggcugauuuucaucuagcuuuagcuaaacagccaaguguuagcauaugaaagacaggcagugggcuagcaugaacgaacuccccgaguugggaugguacccaucccagguaaaccccaugucugacugggucccuucuagaggagcuuugggucuaacuggcucuccuccucuuuuuugccuccaucacagcaaaaaaguugucuuggguguucuagacuggcauagcagcgugcacacugcuucguuaggaucuuuuccuuuuguggaaaucuuugggacuugagugugggcuacaguaugaacaaggggccuggaaacuacugccugggaccagucuucuggacagagcucaagaccgcccucagcccuucugagccuugguggugauggcggugaucuagcaguguguccuuagacugcaauuguaacucugguggaaaacauguguuuuaguuagcaugguacuggaacuacuauauaguuugcucuuuuguaaacuguauauugaauaccugcucuuuuuuggggcaagccauauaucucacugauaacugucucucauccucacagcuguaauauguguucucuucauccugcagaugaaacacagacacaugccaaggacuuucugucaggaaaauaauauugaaacucacaaaucuucuuugaguagcucucauccccuaaccauccauuaguaugcugcuguagaugugugugcugggaccauugcaauuuccaccauguagaugugugugcugggaccaccauugcaauuuccuuuaacugcauguaaucuucaucuaccacauucaccaccuuuugccggugauuuuuaauaagaaauguaaauugcuggggauacuccacaaauguuucucuuauuuguguguaugugugugugugugugugugugugugugugugugugagagagagagagagagagagagagugauaugugcguguaugcaugcauguguguguuugugugugugugcgcgugcaugcgcacgugagugcacgcaugcguguguuugcaugucuggaggcuaaaggucaacacugggugucuucgucuaccacucuccaucuuauuuucagacagagucucucacuggaccugggacucaccaguugguuaaacugacugucuggcaagcuuauauaaugcuucugucuccuccugcaggugcugagcuuugaaacaggaugcggaagagcuuuaggucuugauguuugcacagcagaaguuuuucccagcccuuaguccucccuccugcccccuucccccucuucccccucuucccccucuuccuuuuccuuccucucucucucucucucucucucuuucgcucucucuuuuccuuuuuuuuuuucugaaacagucucagguagccccaggcuguucuugaacuugguccaucauccaaggguaauccugaaacccacaucuucuucacucuguacccaaagggcuaggauuacaagcaugucccaucaugccagacuuauuuuugaauuaaagugggggggcuuauguagcccagacugacuuggaacuccugauccuccuaccuaccaagugcugggaucucaggcaugcaucaucacacuccuguccuuuuuuuuuuuuuuuuuuuuuuuuuaguuuuugguuaucauuaaaggaaauagguuuuauugugaaauuuuuauauuccuguaucauuauauuuuuucuuucucucuuuuuuuuuuuuuuguuuugauuuuuuaguauagaguagacuuuaguuagggcauagggaggggagcuaagaggguaauagagucagagagaaaagcagagagagagaagagaaguagaggccggccaugagcaugugugugugugugugugugugugugugugugugugugugugugguguuggaggauggagaaggcucggggcaacagagcaggagcaagaaggcaaaagaccaggagaacaaaagcuauauuuucuucuuauuugucccguuucuuuucucauugguguaauaacacacugggcaagaaguuuaaggagagggucggauuggcucauaguuugagaacgcagucugugggcuggagagaugccucagcgguuaagagcacugacugcucuccugaguucaauucccaguacccacaugguggcucacaaccaucuguaaugggauccgauguccucuucugguaugucugaagacagcuacaaugaacucacuuacauuaaauaaauagagagagagagagagagagagugaguguguguguguaaguauucggugacggcagaagccaugguguuagcugcucacucuguacugcagcaggaggcagacagcuccuuucuacuuuaaaaaaaauaagcaagcauguuugguuacacacauaagcauguucgguuacacuuacauuuuuauuuuguacggcaggauaggggagacguaugggcaccacagcgaguauguggggcucggaggacagauuauaaggagucaguuccugggacggguucagaucagaucgucucccuccgcaacagccaccguugcucagccagucacuggcuuccuuuccccuuuugauucacucccagacccgacucauggagucgugccacccacagccuggguggcucuuccaccucaaguaacucacagaugugcccagagguuuauuccuggggugacucugaaccucaugcagcugaugaucaagauuaggcagcucaccucucacauccggccuccuguucccucucuggacucuugcugacccccuucuuccccagauaaaaccccuucugcuguccugacauguauacuuuauaacccucucauuccucucuucugccuuuuagacuucuuuucuuaguuaggaaggguuucuauugcuaugaccaaagcaacuuugaggagaaaaggacuuauuuggcuugcauauccuaaguugcaguccauuuggggaagucagagcagaagcucaggacaggaccacgaaggcaggaacugauacaaaagccguggagugcacugcuuccuggcuugcucuccuuggcuugcucccagcauccagagccaccugcccaggaucggcccacaaugggcugggcccacccacaucaguucuuaaugaagaaaaugcccuccagcuuugccuacaggccaaucugaugauggacauuuucucaauugaggucuuccuuuuccagaugacagaaacuagcugagauaccugccaaguguuugucugugaaguguuuaaaauaucuacuuauccucauggcuguuaaucuggaugaagucuuccucauuccauaugcaaucccaacaucuuccaaccucgucaucuucccauacagacuaaucuucagcucucccucaguaggguagauaccagcagcaugaagucaagaccguccagugaaggacacgguaugugagcaggcccuccuaccagcccuccacagcaagcaggaggagcgugggcacaugccgcugccuuucccuugcgcccauguuagggcccaaguuuaacauggcaucagaguguuuucuaggcacaccauacugcauuuggcaccccaguaacuuccaaauuuggcaaagaaugagaguaguuuguuagcaguguccaucaaagggcuacaguuugcaagacacuuaaaaaguagaauagacaagauugcgucuguaauaauacaguggucucccuuggagucccuuaugccguguuagcucaggggaacggaugcacccucuaacuguaacuggccacuuguguugacaauuuguccgugggcuagcacagaagaauguugagaauuacucuuucuaaaaagcuuuaugagccaggugugguggugcacaccuuuaaacccagcacuugggaggcagaggcaggcagaccuccgugaguucaaagccagccuggucuacaaagcgaguuucaggacagcuaggacuacacagagaaauccugucucaacccaacccaaccccaaguuuuauuuauggcuauuauugugugugaguaugauguccaugugugagugugagcacgcgugugcuggagugugcucguacaggucagaggaugaguuuugggaauugguuucuucauccacgaugggcuccagauccagggaucaaacuccggcugcuaggcuugcacagcagguucucuuucuggcuguucucauacauguugacugccaugacuagugagcgcuugaugaccucaagaaguuuuccccaacccuuccccuuuaaacuauuaaacuucaagcaaauacacacuuuuccucacacaguucuaugucagaccaguuucuaccaagaggaaaagcauguaucucucauaggcagcagaaaaggggcucuguaucuuucuugcucuuugaggauugucuuauucuguuuuguacuucuagauauuccuggagaacuuggagcaugaagacucuuuuguguaucuaucugcaauucaggguaaguuaacauggacaaagaugauaucguguuccuugagggguacagccacaagacauaacuggcuauuuguccaucuuucugcucccuaagugggacgcucugagugauaauagcauuccuggaaaguuucacaauaauaauguuucauguuuacuuugucacuguauaguugaaaugcuauuuccuucaaaguuaggacucuuuucaaaaagaugagaaucacaccacgagacagcuagaguuagccauuuccuuuggugccaagagcugggacucuggaggcagauggccuaggugcaccugccccucagccgaacagacuuuggcguacacuucacugcuccugggcuccaguuucuuaggaguuaaauggagcucaguggguacauuaguuacuuuucucauuguuacaacauucuuacagacaaacaaacaaacaaauaaauaagcaagcaccuuucuaaagggaaguauuuguuaggcucacaguuugagagcacugucuguccguccaucuguccaucugucauggcgggaggcaggacagcaggaggugaagcauccaugcagcauggucacacugcauccacaggggaggcggaaaagggugacuggcagcuucuuguuguuucucgggaaccccagccuguggaaauggugcugaccacauuuaggguggcucuucccauuucagcuaauugaacauagagguucccucacugguaugcccggaggcuuauugccagccccagcaaugugacaauauuacccagucacaugaggaagauacaguggcagugcuaggcacgagcgccuggcugucccugcccaguggccuguucuuauaucgaugucagaagugucagaagacaagcaugaaugcuagaggcauuucgagggacagcuguccugccgcuucucuuucauuuuuuuuuuuuuuggccaaagcaagucuuguggccuagucagggaugaggacgaugcucugugccugccgugggacgggcagucgagucuaauagugaagggcauggaugcagacugguacccacagugcagauccucacacugcuguucuguuuaccuagaagcagggcccacaacaagcacaacgguacauccaggcuccuacggccuugauguuccugaaugcaccuugggcuugcucuauacagacaauauuugaagcuuaagagaguacagaggagaaagaguacaguggcgagggccugaguuuaagaauucuuucuuuacacagcaaacaagccuugaggggcuacuccacaugagacacuuagcugaguuacuaagaaaaaaaaaaagaaaaagagaagucaaggagacagagugaccuuccaggaugugggaggacagcuaggagaguugagaguuuccggaaaagcugauggaucugcagcuguggagguggacaaggcugggcucagcagggcacaggaggccccaggaggcuacaggccaugaagugacacuuauggaaaccagagaaaucaaugaauggagaacuugagacucuucuaaauguaagucucagaagccaagucaccugucaccugcccuuuuccaaggagaagauguguuucacagacuugcuuuuccguuuugagggcuggguuuuuggaagcagcgucaugcuauucuacuauggcagccuggcagcuugggaaaagcuuggcugguuaacccgcugagcucauuggccucugggaccagcuauaaaaacugcagcugugguguccuguguguuuucacugguuuuaauuggugugcuaaucagucaguagcuaauuuggugaugaaaaacagggcagguaggaagauguagaauuucuguucucaccuccccaggacggacagauuggaguaauugauguuuuuggugccuguacuguguacuuaaaagccaaggccuuaggugaguuucccauuaagaaaagcaggagaugaauuuucccaccuguguggucagugccacuugcacaggcccaacucacuccaagaagcugcuuccccccucaggacaagggguccuagacacgcuuugggggcugugaaugccuguauagcuuucuuucucauagacugcguacauggcuccauggggauuuucuguucaacguagugauauuuuggaaauguuuguacaagcucaccaauucuguuuacaguaaaggcagugagcagagaggggcugaguaaacucauucguacagaagauagccauucuugccugauuuaagaauuccagcuacgugugcugucugcccauggagaacuaaauuucugaauaguuaaaguugacguuuguggaaaaauaucugcauaucugcucuucaucccgggaaggugcugguguuuuggcugucccagcagcuccuucagacagaaaacuguuaaaaguugcugaguuccaugcugaggguaguggcacaaaccuuuaauucuagcacccagaggcacagaggcacagagaggcagaggcaucuuugugaguuucuggucuacauagugaguuugaggccagccagggcuacuuaguaauaccauguugcaaaaagugaaaaaaaauuuuuuucaaugacaaggaaauguauacaaaguuaaagucuucccucucccccaaauaggaguuaagcuauguccuugguuguucuauaauguguugagggguuggcaguuguuuuaguguguggguguguguacugcaugcacauauauguauaaguaugcauauguacacaugcauggggaagccagaaguucucuagcugaaccugaagcccccugauuugacuaaucugauugguuagcucaccccagggauucucugucugucgcuuaagugcugacaugacagguggcugccauauccacccagauuuuaugugggaucugggguucaaacucugguccucgcgcuugcauggcgaacgagugucuuaccucccgagcaauuuccuuagccugcacuguaggacuuuaaggacaguuuuguuguucaguaaugaaugugauaaauacaugaaugauauucuuuagcaaacucuuauagccagacaauuuauccagcuaugauagaucugcuuagaugcccucgaagucacuucccuugaacauucugcauuucagggguucaagugaucccucucagugucaaaagaaucuuuggcugcagugguguuuucgggagaaugaugguauugaauucagggccccuugcaugcuacagaggcacacuaccagccaggcaguggcgcacaccuuuaaucccagcacuuagaaggcagaggcacguggaucucugaguucgaggccagccuggucuacagagcaaguuccaggacagccagagcuauacacagagaaacccugucucaaaaaaucaaaaacaaacaaacaaagcaaaggcauacuaccacugagcuucacgcuuaggcccaaaaugccuuuggauaaaacaauuauaacaaacugaaaggaaggaaggaaggagggagggagggagggagggagggagggagggaggaaggaaggaaggaaggaaggaaggaaggaaggaaggaaggaaggaaggagagaaacccauacccugagccaggcauaggaggugaaagugugcuguguguaaggaagggaauguaggcacugacaugcccagacaaaccauacccuucccacccccucucuuuuuucauuucuuucaaagcaccaaagggagugaaggcaaaagguggggggggggggcaguggaguauaaaaagaugacaagauuuuuacagaguuucaaacugagcagaaguacaagccuugacuugcuaggcaccaaccuuugucuuaggcuccaauuucuaccucaaguuaaaguaagucaagaaaccaucagcugaaaauaauucccucucccuugaagagucaucuuauuggauuuggcauggaaauuuggaauguaguccugugaaguuugccuucuccauuuauguccuugaaacaggaagauuucuuucugcucugaucggguuucuguagagccuagcugaggacugaucgcgucucuagugucucuccuuaggcauucaguaaagcccugagaugagcagggaaguaaacacuguccucauccuuuagaacuuacacuugcgauguaauuuacauuucuaaaaugucccaaauuguaaacaaugcaagucaguguuucuuaguaucuagagauguaacccaacauuugagaaggcaagacaggagguucuacuguucaaagucacccuuggcuacaaaguaaauuuaaugccagccugagcugucuuucugagccccucuccccauaaaaaaggaggucuggggagauggaaauuuuuucuuucuaauuuguaauacuuguccuuacauaugccaggcaagugcuauaucacaccacuaaacucaucacacacccccaucccauaaucagccaccaaacccagacacuauugcauaugccagcaagauuuugcugaagggacccugauauagcugucucgagugacacuaugccagugccuggcaaauacagaaguagaugcucacagucaucuauaggauggaacacagggcccccaauggaggagcuagagaaaguaccgaaggagcugaaggggucugcaacccuauauguggaacaacaguaugaacuaaccaguaccacuagagcucaugucucuagcugcauauguaucagaagauggccuagucggccaucauugggaagagaggccccuuguucuugcaaacuuuauauggcccaguacaggggaacgccagggccaaagugggaguggguggguagaggagcagggcgagagaaggguauaggaaacuuucaggguagcauuugagauguaaauaaagaaaauaacuaauuaaauaaaaaacaaaaacucaucaccccugagcuacguuuugucucaguaauugccuuaucuagacagucacauaaauggagucauauggcaauggagucagaccccuguuuuuucuuuccauagagaauuauuuuuuaaaguucuuccugacuauaacauggcuaauuccuuuuuuuuaaagauuuauuuauugguuauaaauaaguacacuguaaguacacuguagcuucaauguuuuuauccauguuauuuauuaacaacgaucaaaaaguggaaacaacucagcuguccagcagccaccgcaggagacaaaugugacuguucagcagcugacuaauucagugcccgaguaaacacugggaaacucuucagacacuccagaagagggcgucagaucucguuacggaggguugugagccaccaugugguugcugggauuugaacucuggaccuucggaagagcagucgggugcucuuacccacugagccaucucaccagcccggcuaauuccuuuuuauaaauuauuuuuucaucaguugauaaacagcugaguuguuuguaucuuuaacauuaucucucucucugugcauguguauauguguguugugccugugugugugugugugugugugugagagagagagagagagagaaagagagagagagagagagagagagagagagagagagagagagggagagggagagggagagagagagagagagagagagagaaagaauauacaugcaaguguguguguguguguguguguguguguguguauacacaaucuguaagagagagccuguucucucuugccguccaguggauugguucuaggcuaagucaguucgucacaugugguagugagcaccccccaucucccaucuucugggccugagagauugcucuuugccuccuaggauucauagguuguuuagaauuuuucaaauaauaguagaaauugauccuguuguuugcuuuaguuuuuacuuauguguguggguguuuuuuuuauguauguauguuuuuucuuauguauguauguauguauguauguauguauguauguauguauguuggugcaucauauguaugucugcagaggccagaagagcacuagacccucuggaacugaaguuucaggcaauuguggguaaccauguggguucugggaagugauuguggauccucugucagagcagccagugcuuuuaacaguugagccaucucuccagcccccccuuguuguuagccuaaaaaaaaaggaguagccagauagugauagcacaugacuguacucugucacagagguggggaaucucugaggacagcuuggucuucauaguaagugucaggacagucagggcuacacagagaaacaaauaaacaacaacaaaacaaauaaagccccuaaaacagaacaaaacaaauaaaagggaagcagagugcugacagacgucagugauucccaguguuuacucgggcacugaauuagucagcugcugaacagccacauuugucuccugcgguggcugcuggacagcugaguuguuuccacuuuuugaucguuguuaauaaauaacauggauaaaaacauuggauucuaucagucauccugaaauauaagaaagcauuauaguuuuaucuaucuaucaucugucuauauaucuaucacucaucugucugucuguccgucugucuacuuuuuuuuuuuuuuugacagagccuuauggacucucuucugaccuuagacuugaaguucaaggauggccuugaacuucugacuccucccuccuccucccuagugcuaggauuccaggcauauguccccaugucagcuugguuuauguguugcucaggagugaaccauggcuaggcaagcacucuaccaauuauuuuuuguuuuuguuuuuguuuuuuuguuuuuuuaaaggcagacacuauauuuagccuuggcuagcaaggaacucacuauguagaccugccuggccuuaaacuuacagagauccaccugccucuaccuuccuaguucugaaauuaaagacguacaccaucaugccuggcucucuaacaacaacaacaacaacaacaauaacaacuucuucuucuucuauauauguaauuauauauauuuauuauuauuaucaucauuauuauuauaauauguaaguacacuguagcugucuuuagacacaucagaagagggcaucagaucucauuauggaugguuguaagccaccaugugguugcugggauuugaacucaggaccuuuggaagagcagucagugcucuuacccauugagucaucucaccagccccuaacaacuuuuuuuuuucuuuuuccaauuuuuuacuggguauuuucuuuauuuacaauucaaaugcuaucccgaaaguccccuauacccucuccccccugcuccccuacccauccacucccacuucuuggcccugguguuccccuguuuauacuggggcauauaaaguuugcaagaacaaggggccucucuucccaaugauggccgacuaggccaucuucugcuacauaugcagcuaaagacacgagcucuggggguacugguuaguucauauuguuguuccacccucaggguugcagaccccuucagcuccuuggguacuuucucuagcuccuccauugggggcccuguguuccauccaauagcugauugugagcauccacuucugugcuugccaggcaccagcauagccucacaagagacagcuauaucaggcccuaacaacuucuuaaaugaagguuugcugguacucacaaaagcuagaggaguguggagcuggaaccagaguuuuugaagauuccuaaucuuuuguacuucaucuuauuauuguucucaaggucuacaugaugccuacacccccucuuucacacugggggcuggggguauuucaaauacuuaaguuucauaguagcuuuauuuuuagacuuccugaccagugguuucuucugucagucaaaaaccaauauucagauuuauaucagagaacuuagcagauugguacuguuaucuauaaagaagagaauaauagccacuucacaaucacuugcacuuuucaagauugccccgauaauugucaugucagagagauggcaguagguuguguaaaguuaccaccuacugagugccugucaaucauagcaacccugcagguuucagaaugagggaauugaggcucaaagauguuaacuaccuggcccaaagugacauggauacuaagugacaggacgaggauuugaaaauaagucucuuugguucuaaaagccaugugccagaggcaaagcuugugagagccacagugcugaggaugccucagccccagcugagucucgccaugcucucuacuacaggagcccagcugccugcgggcagcgguucugucauaaaccagcucuauauaagcgugccgaucucaugauuccuugcuuuugucuucaucugcccguuugacaauguagggugcgacuuuugagguucucucuggaucuuugagacucaucucgcucccucacuccacuugcucuccuucccuuuuucucagugcucacuggcucuugguacaacagcuauugucaucgcuuaggagcaucugggaaggcuucagaucuauauggucaucuguuuuguacuacuguaacaauaccugagccugguauuuacuuauaaaggacagaggcuauuuuccuacaguucuguaaaguugagagucaguugauugucugaaggcaauaagugggcaggaccugggugcugcaccauccuauggcagaagguggggucugaggaccagagacagggaaguguggagagcgagaggcugaacucaucuuuuucaggacuccccaguuccaaggccuuggcaucaauacauuugugaaagccgagucuucgugacuuagucaccgcuuguauucgccaggcuucucuggaagagcagaaccagcagagucaauaaucaaguuagacgugaaucuauuagauuggcuccugaaauaggguugggaagcaacaaugccgaaugcgagcuggggacgcuaaaagcccauagcugcuuagcccacauggcgggugcucagcccucccagcugcuucugaaggucuguaggauuagaaagggaaggguguggugacuguaauuucagcauuuagggggucgaggcaggugcgccaucaaaaguuaaagacuagcgugcucuauauagugagcucuagaugaaauucucucucagagagaagaaaggagugagggccagggacauagcucaaugguagagugcuuaccuggcaugcacaggccccauugaaaagaaguagcagcaagcagucuacacacaagcccagcauuuuacacaguagccccuaaguagcaacaaccaaaaccccugccaccugaugggagauaaguaagaucugguauaguuauacaaugagauauuauuauucaguaauaaaaaugaauggaauucuacugauucauacuagggcauaaauaaaccuugauaagugaaagaagucagacacagaaaacuacauggcauaugauuccauuuaugugcaauguucaaaauaagucaauccauagauaucaaagaagaguagugguuccuagggccugggagauggaacagugugugacauauggacacgaguuucuuuuugaaguagaauuauauaguagugaucauugcacaacaguguaaaauuauacucaugcuuaccagcuauccauuuuacccuuuuuaaaguuuguaugcgugcacauauggacacacaugcauguaaguacccuugagguuagaacaggguguuggguccuuuacagcuggaguuaaaggagggugggagccaccaacaagggugccgagaaccaaacucaugucuucauaaagagcagcagcaaacccucuuaggcauggagccaucguccagccccagcuaauaugcuuuaaauauuaacuuaaaaauucagagcaggccaggacagugguggcgcaugccuuaaucccagcacuugggaggcagaggcagguggauuucugaguucgaggccagccuggucuauggagugaguuccaggacagccaaggcugcacacagaaacccugucuugaaaacaaaaagaaagaaacaaacaaacaaaaucaaaccaaacagagacaaaacgaaauucagaagaguugauuuucaugaaacucuugggaguguaaggaugcaggggcagaauuuagauacaacuggaguaagaagcugaggccgaagggaagcaaaagucugaagaugguccaaagagggcagggauagaggagagaguaggcaguggguugucagggagcaugcugggugugaaggggguggugaucaagcuacugagagccauuugcaggcaggcacccuggccuuccaugagacugcaggguaccuuuccaggugccugccagucccaccugaaccaugguuugguggcaggauuguuuucugaauugaaagggcagugcuuauucauuguuguucuugcucucacuuucacccacagucuuaagggcugccuauggcccagaagcaacuuguuccauuagcuucuccacacaaggcugugaggaaccaauagccaaggaaugauggaguccucagucaacccccuagcccaaggcucuuaucccggcuccaccagugccuccccaccuuccucaggucccuagggccucugcucucacaaacaguagaacaggccauggcagcugcacaugaacaggcucauccuugauuucaugguucccagaauuuccuucaaaucucucaccuccuguuccuguagaugagcugcuagcaaggcagcauccaugcaaaaggccaauguaagacaguguggggcggaauccuugcaagugucuccuuuguaagguauuaaggaaucaguaaggaccuucccugaagaaucgcuauguaaaauuugcccucaaaauuaccacccuuuuuuuuuuaaagauuuuuaaauuauuuuauuuauuauuauauguaaguacacuauagcugucuucagacacaccagaggagggcaucagaucucauuauggauggcuaugagccaccaugugguugcugggauuugaacucaagaccuucaggagagcagucagugcucuuaaccacugagccaucucuccagccccccccccuuuuuuuuuaaaguugagaccuguuuuuuguuuuuuuuaaaggaacaaaucaaaaagaauaaagaaagaguccauaaguaagaugcagccccaguuagcuugcauucucuguucacuggagcugugccagcugagggggucaccacaucacaaagcaaguagcuuacauuauccuucauuucaaauacaaauuaaaauaccuaaccuuaccagaugugauuaagaugauccuugaaguuguucacacacuuaauaagcccaguuacauuuuuuauuaacccugacauagauccuguuguugcugaaucacaaguuuagcauuuuuugauuuaucgaagcauugauuuucccuucuccagucaugucagaucgugggcaguggugggaaaaugccccuacauggugucugcucaaugugccagcuuguuuuagauuuggauuuauacuuugguaauugguuuugcuuccugaucagggaugccucugcuggucccuaagaaagaaggugagcugggggugaauugacuucagggagagacuggcagacccugagagucuggaggucuaauuagguugccaggguaauugcuaaggcuucuuuucuuagaaggccguuuucaaggaacaucucugcauguuguggccaacauuuguaauccuggaguguugacuugacuuuauauaggaaccaaaagagaagugaggacugugggggauggcuuuguuuguaaaaguacacacuaugcaaguauggggaccuggaauuggaucuucaccaggacccacauaaaagcaucuauaacucuaacguguggggguggggguggggguggagagcauggacagagacuggcaagugcccagaguucacucaccagucagccuaguuaaauagaugagcuccagguucaaugagagacugucucaaaaauaagaagggacuggcaugauuauucuuuaaaugugccagcugccacacccauugacccgacuucaauccccagaacccccaugguggaaggagaguaccaguucccacuaguuguacucuggccuccacacgugcgcuauggcacauauaugacucccccuccccccgaaaaaugaauaaauaagcauguaauuaaaacaguuuaauuagaggguuaaagagaugacucaguaguuggcaucucuuccagaggacaccaguuugguucccauaauccacaaggugguucacaaccaucuguaacucuaguuccaggguauccaacacucucuucuggccucuacagacaugcacauguagggugcacagaggacauacaugaggguaaaacacuuacacauagaaguaaagggagagaaauuaaaagucagagaaugauaguggcugccaggggcuaccacugaccuucauauaaauacacacauauucacauacacagaauacacagagagagagagacagaauauacacacagagagagagagagagagagagagagagagagaggaaucaauggucuuuuccuaugcuuucuuuaggcucuguguguguguguguguguguguguguguguguguguguguguguguguguaguaugguauguggggggguggggguagggaggagggggaggaggaaggagagcagaagagagcauaugcauccaggugccuaaggaggccagggauguuggaucuccugaagcuggaguuacaggugguugugagcugccauauuuaugugugcugagaucugaaccugaguccuacaagagaaucaaacuuuuuuaaccaaugaauauuucucuagcccugaaauaagucuuuagaaaacaaaguucagagacuggagagauggcucagagguuaagggcacuggcuguucuuccagaguuccugaguucaauucccagcaaccacaugguggcucacaaacaucuguaauaggauucggugcccucuucuggugugucugaugagagcaacaguauagucauacaaauaaaauaaauaaaacuuuaagaaaaaaauauaaaaacaaaaacuguuuuuuguuuuuuugagacaguguuucucuguauagcccuggcuguccuggaacucacuuuguagaccaggcuggccucgaacucgaacucagaaaucugccugccucugccuccggagugcugggauuaaaggcgugcgacaccaugcccgaccaaaaacaaaauguguauaguuaaguguugauuuauuccuuuagcaguuuguuuuguuuuugguuuuuugguuuuuuugagacaggguuucucuguagcccugacuguccuggaacucacucuguagaccaggcuguccucaaacucagaaauucgccgguguagaagagauugacagguuccucuuuggauuuggucaguagucagaaccucugcuuuugccucucaaguguuggaauuaaaggcgugagcuaccacuacccggcccuuuagauguuuguauuaaacaguauugauuguguuugagagaaacguuguaggaaagcuucagagaacaauugccaugcucugccuugguggaguuuauggucagagggccgguguaaucacacagauguaaacuaguugugaggagugcuguaaagaaccgauacucugaagggugucccuguuuagggauguuucacuggacagagggggcaggggcaugggacccagucuccagagcugggggauuaguaauccgcacagggaggccuggaugaagaguguuucaaacuguggggacagcaacggcaagggcugugugagcacagcguucccuggauccuggugaagugggugggcugcaugggcuccuagcaugggcaagcucauuguaacaaggcagccucagcucuuccucagcagguucuguugcuuuaaaacaaaccaagaggaauuuguaagcagucccuguccugggccgucucugccuuucaggacacuaucccauacaccaugaguccuuguccuccuccaccuuguccuccucucuaacacucacacauagugcuuucuccucgcugcugacagacaugcuguucucugucucuaaucuguuuuaugaaaagcagcaagaaugcauggcuauucugugcagaucucugagaacgcagcccauagcauuaugaaaaucauucugauugcacgggaaaacagcagagcccuguggaguuauuuuaggccaauaguuuuguuuuuaauuuucucuccuaacaguagaauucauuuucaaaugagucuaccagcaccaagcagucaggugauauuuuuuucuucuuugugccuuuuuacuucuggcuuuucauguuuucuaguaugaacaugucuugcuuuuauaaucaagagaauuuuuuuuuuuaaauuauaugucugccacaggaagcugaauuguuucaugaugacaagguucagggacuaguacagauugaaacagauggcucccucuguuguaguacccccuggugacccuuucacaaccagggauuaccaaagcacagagugacccuggcuucuucaccaugaaauuacacaagacagcaggaaccuuacugacaaccagauguggguuuucccccccaacuagugcuuuucuuaaugaaaugguugcuuagaaaccagaccauaauaauaacuuuucuauauuuagucugugaaaugauucaguuuacaaaguuauuaagucagagaaugcuaauuagauagaacugagcucgcccauuauuucuugucuggcaguucagcaacuaaacgguuaaaucggccgcaucuccuccagcaucucuccagaugcuccucauaacaggggacccaccaggaaaccgacagcuccugcuccaauuuuuccugggccacucaagagugccccgguggcgccugcucccucacugcauguguuuggagcuguucccauguaguagcuauuaggcugcugagaagaucaguuaggucagugggucaaaaauuggaugugaaaaaaugaaaauaaacucaauucacaauaaguucacugaaacagcagugugaaaagaagaagcuaggacugaagaugguuuagaacgucagaacuuagaaguggacacucugcugugcaguacuggcaauaggaaaucuuuguacuauaauuggcagguaauuaaagcaaguauuuuagucagguguuguaguaaguaucuauaaucccagggaggaugauggagaauucuaguugacccugugcuacagagugaaacauugccuaaaucaaacaaaauucuuaacuugaaccuaauaaaaucuaggggaaaguagaccucuaucugccuuucauugauuagauggcugcuuaguucaucugucacauaguagcacauucaaaagcacugaaaagcauuaaggaauccaaagagcagagaaugaccaaaguaacugagagaaagccagagcuccugaggugugaacucagccugagaacgugcguuugcccugcagacauuugccugaaauuaagcugugagcaaguuguagaaaugaaaacuugcagcaacuccaugugagauuaaacaacaaauacccucuaauccuaaacuuagaccccuaaggaaucuaccucaagucagucagagauauuagugugaaccccugaauuccuggcacuugggacguagaggcaggaggagcgugaauuguaagcuaaucuagacucucuagcaagacccuguuuuuuguuguuguuguuuuuaauguauuguguuuuuaugcaugugugacuauaacauaaaauuugacacuugagccuuuuuaacauuucauuggcacuaauuuuuucauaguauuguauagcugucaucacuaccauuaaaacuuucauccuccaaaacaaacacucugcugcccauuccaguagcacccacuucucccuccacaguaauucuuaaagucagucacuagcacagagcuguucauaaucaaauacaaaaaaacaagguccagugcuacuucagauacuagauuuguugcucacaaaugaagaaauaauucugcuuacuguauuuaaagaaauacaggauaaacuugacaauaacauuaggaagugagaaacaacaacaacaaaaacccaaacaaaccaucaaacuuuguuuuuaagggaacaucucaaaacaaagaguaacuaaacaaagacaaacacaaccagggagagaauuaaugaaccaaaagggaaaaaaauuacaggaaaugagcacagaaaauauuucuaggcagagaaaucaggaagaaagccgaaaagauuugaccuccuaaggucuuaaaacacauuuguguccaaaagccaacauaguuuuaauuuaaugcaaagucaacaaccaaagauuuccuaggaaaacggcuuuuggguguaaguguauugagauagaagauguaucugcagucucugaggcucaggaugaaaagggaaaguggcaaaggagggggagccucccuuuuggagccaugaagauguuacacaguuaacagagcgaugguugcacaaggcuugugagucuccuaaaaagcacauaguuaugcauauagaaugacauggauuaugucauagcuuuaucacagugaaccucuuucucuuaccaaaaggcaagcaguuaauaccuuuaucacauaaggaguuccuagauauuaauaagaaaggcaccuaguagguaaauacauaaauaggcaauuuuaaaaugagacuucugguucucucuugguaagaaaauuaauuagaacauuuugaagugcaguuuuauguuuguaccuaugagguggguugucucuuuggggaauucacccugaggccucagugggaacuggguccuacagagguucugugaaagccugugugagaggcuuuguggggagccuuggagggcugcacucuuaguugaauauuuagugaguggguuuguuuuguggaguguuuugcuguuuaguugguugguuggggguuuuguuuguuuauuuuguuugagaccaucugucccaggcuggccucaaacucacucuguggccaaauccugggaaccuaggaccuuaagcuuucuaccacugaguuacacaucaccaccccccuuuguauuuaguuucauuuauuuuuguuuguuuugagaguaccuccuaggcuacccccaucucucucaaaggaugaccuugaaccucugacccuccuaccucugcccucugaguucugggauuacaaacuguaccaucaggccauuucaugcugugcuggggcuggaacucagggcuucaggccagcacucaccaacugugcuccauccccaacugguccugcuuuuugcaaccauucaucugcccaucuuccagaagcccagcuuucauuuuacauccuuucucuauuccucuuuugcccccucuccuugaacccuuaugauucacaaaacacguuguugcccauagagucuugugaucaacuggagaagcacugcuggcuacauuuguuuuguuuuguuuuguuuuguuuuguuuuacaguccagccauuuucccccucuugcuccccccucccacaguuccuuaucccauuucuccucucccuugucuccaagaggauguccccccccccccaccagaccuccucacuccccggggccuccggucucuugagggugaggugcgucuucucacacugagacccaacaguccucugcugucuauguguuggggccuuggaccgacucaugugugcugccugguugguggcucagugucugagagaucucaggggucugggcuaguugagacuguuggucuuccuaucgggccgccuuccuccucagcuucuuccagcauuccucuaauucgaccacaggagacccugacuacaguccaaugguuggguguaaguaucuucaucugucucagucagcugauuuuugggccucuaagaggaccaccaagcuaggcuccugucuguaagcaccucauagcaucagugauagugucaggucuugaagccuccccuugagauggguuccagguugggcuggccacuggaucaucuuucccucagucucuucuccauuuuugucccugaaguucuuuuagacaggaacaauucugaggcagaauuuuugacugugggaaggcaaccccauuccuccaguucaugcccugucuuucuacuggagguggacucuuggaguuuccucucuucacuguuggacauuucauccaaggcccuucucuuugaguccugacagucucucaccucccaggucugcauuucuaucacuaaguaaccaugcucaggaucugcugguuaauggaugagaaaacugccccugacuuaaugcuagcaugcauuacuauuguuuuaauuaaccauuuacugccucuguuuuguuguuguaguacuaaggauugagccuagggcaucacaaauguuagacaagcucucuacgauugaguuauauuucuagccuccguuuaacuuuuuuuuguuuuguuuuuuuuuuugguggauauggucugcauguuuguaugcauggauguggguaugcuuggcuuggggcacaugcacauuguauguauguguguauguguguauguguguguugauguugaaugucuuuuuuuuuuuuuuuuuuuuuuuuugaggcaggguuucucuguguagcccuggcuguccuggaucucacuuuguagaccaggcuggccucgaacucagaaacccaccugccucugccucccaagugcugggauuaaaggcuugugccaccacugcccagccagaguguuuuuuuuuuuuaagcuugcuugcuugcuugcuuccuuccuuccuuccuuccuuccuuccuuccuuccuuccuuccuuucuuucuuucuuucuuucuuucuuucuuucuuucuuucuuucuuucuuucuuucuuuccccaagacaggguuucucugucuagcccuggcuguccuggaacucacucuguagaccaggcuggccucgaacucagaaaucugccugccucugccucccaagugcugggauuaaaggcuugugccaccacugcccagccaguguuuuuuuuuuuuuuuaagcuugcuugcuuucuuucuuucuuucuuucuuucuuucuuucuuucuuucuuucuuucuuucuuucucugucucucucucugucucucugucucucugucucuuucuuccuuccuuccuuucucucuuucuuucuuucuuucuuucuuucuuucuuucuuucuuucuuucuuucuuucuuucuuucuuuucuuugaguacacuguagcugucuucagacacaccagaagguagcaucagaucccguuacagaugguugugagcauguggcugaugggaauuguacucaggaagagcagucagugcucuugacugcugagcgguuucugcagcucccuugagugucuuucuugaccuccacccccacuccaccuuauuuguuggcaggaucucuuguugaaccuugggcuugcugucuuagccagucuagcuagccagauggcuuucccgucucagcuaggucccaaacugagauuaugugugcugcugugcacagccaucuuccaaguggacucugaggauuagaaccccaucuucacgcuccugcagcaagcguuuuucccagagccaucuugccaaaccucuuagcuuuuuuuuuuuuuuucucuuuuauugugagacauggccucacuaaguugcccaggccagcuuuaacucacauuauagcgcugguaggccuuggacuuggacucuaguguccuuguacuguaaaggccauauauagccuucagaguacaguggcuacagaccuguacuaccaggcccgggucuacuucccccccccccuuuuuuuuuuuuuuuuugagacaggauuucucuguguagcccuggcuguccuggaacucacucuguagaccaggcuggcuuugaacucagaaaucugccugccucugccucccgaaugcugggauuaaaagcgugugccaccacgcccagcuuuuuuuuuuuucccuuuuuuaagauuuacuuauuuuauguguaugaguguucugauguauguauguauaucacaugugugucuggugccuguagaggucagaaaaggguauuagaucuucuggaacuauaguuauagauguuuugccagccacugugaaugcuaggaaucaagguggcgucaucuaaaagcagcagguccucuuauuccugagccuucccuccagcccccuucauucucucucuuuuuuuuuaauaauauuuuuaaagauuuauuuauuauuauaucuaaguacacuguagcugucuucagaugcaccagaagagggugucaggucucauuacagacgguuguaagccacuauaugguugcugggauuugaacucaggaccuucggaagagcucuuaaccacugagccaucucuccaguccucauucuuuuauuguuuuuuuuuuuuuuguuuuauuuuuguuuuucgagacaggguuucucuguauagcccuggcuguccuggaacucacuuuguagaccaagcuggccucgaacucagaaauccaccugccucagucuuccgaguacugggauuaaaggugugugccaccauguccagcucauucucuuuuuuuaaugcaacuaauuuuuuaauuuauuuuuuauguauauuuuugaaugccucuauguguguguguguguguguguguguguguguguguguguguguguguguacuaugugcaugcauggugcccuugagggccagaagagggcacugggccuucuggaaguggagaugcaggugguuaugagcugccauuaggugcugggaaucaaaccuggguccccuauaagaccagcaagugcucuuaacuuuggagccaccucuucagacccugaagcucaauuuuuaaauaauuauuuacuucaaccauuuuaugaauauauuaugauuuuuaaggcuuuaaacaucaacauuuugggucacuuaccuuguuuagucaggaucucacuguguaguacaggcugaccuagaguucaccauguagcccaagcuagccucaaacucuugauccucacgccccagccucccaagccaugggaccccaggugugcaccuccacaccugcaauauuuuguuucccuuuuuacuucuuuguaguguuugagucuuuuacaguggccugucauuuugucacccugggacggaaucaaauuuuuugacuguagaagcaaaguuacuuaauuuuuuuaaaaagauguauauagguguuuuaccugaauguaugcuaugaaccaguugugugcagugccccuggaguccagaagaggacaaugaaucuccuagcacuggagucagagacaguuguagcugcuauguggguggagggaaucgaaccucuauccucugggagaacaacuggugcucuuaacugcagagccuacucucugcuccccaacgucacuuuuuagcgguccuccucucuccucuguuuacagaugucucacuccccuugccuuuugccgugccuguaauugaacccauggcuucacacaugcuaaacaaauauucugccucuaagccaucuugucauuucuaaccacaucuuauuguaaguugguacuuucugcaggauuugaaucugaugggugaaagucagucccugacuaggucugguaaccccugaggcuauagggagagugcuccugugugcacacgucuucaggagagaagugccucuguggcauguuaacggcagcccugcuuggucucgcucggaugaugcuguaguuauaagcccugggcaucgugguugcugguuuugcaaugaucacuuucucuaagccaguuauagccuuggguuucugucaccaugcuugccuaaucaccuuauuaguacaucugcuaggcguaacuaaggggaaagggcacuuuaagaagugccucuauccugucucugucacuggcuggcgccccaggcauaaggagacccugagcaaguagaagaucagccccaucuugcccaagcuuuagggcuaguggcugccgucagucagcugugcugacgcagcagcuucuguaggccggaggugaaauggcacuggaacccgggguucaguuggccccuccugcccugucauccaggugcugaguacacagagcagugguuaccugccucggcuugaggauugcaagaaguguggagaggguuuuauuucuuaccuggagaugacucagggaaugaaucagcucaaguucucgggaaagucaggggcccugcuggucuucuuaccaguaacugucucuuggugugcuugcucacucugggaaagcugcguaaagaaaaguuaauguuaauagaagugaucccuggaaaugucucuggagaauucagcaagugacaucuuuauuucucacucaugagcagcugaaaugcaaggugcucugaauacauagagcagugaugacugucaaagcuguggucucucugucugucucucucucucccccccccuccuucucucucucucucucucucucucucucucucucucucucucgugugugugugugugugugugugugugcgcguguaugugcgugugaggauucauguguacaugguguaugugagcaccuucauguguagguguugcauauacacaugugugcacuucagugcucauguguaggucggaggccaacuccaggugucaguccagcauuuucaccucaucugagguggucucuguugcucaccacugcuagccucccaucucgcccuaaguacacggggauuacagaugcccacugccuuauccagcaacgcaugaguuuugacguuucagacuuggguugucagacuuacagugagcacuuugcccacugaacugucuccacagccuacuugaugguuuucuugaucucuacucuuauugcuucucucugggcucaccuauaagcucuuacuugguagaggcagcccugggaagaccagguagagggcuugcaguggccuauaaaacugucggguagaggggaguuugagcagcugguuagaaagcaggcugaagccuucgcuuuccauuucccguuugugcgacucuucuggcaucacuaaugcuggcaacauuucacauuagaagcauuuguaaauugcauuaacaucacuaaguuccuuuuucacaagcuuauuuagcuugugaaguguacaaguggagaaaaguuuccccaggaagcccaucuggacccugggacuguggacuugguacacagcgugggccaccacccacuguggaccuuggaguccugcagaaagugcauguccuggagcaaggcugggguugccuguucuugaaagcaugagguuugcuaucuuuaggguuagagugcugugaggcucguacuauuccuguagucauuuccccaggcacugcugccaggugggccguggugugagggauggcagcucagcuuugucaugugccagcucuguucucaacucucuguucuucacugucucccaguaaaauuagaaaugauaauggguccucuucaaaggacuggcuggcgcaugcgauaggaugggcacaugugaugggcgcaugcgcagugcuugguguuuacaggacgcucagugugguguguguuaguggcuuccuguuaguuucuuaggaauaaugccucauggggcagggaugcucauuugguaaaguguuugcugugcaaacaugaggcccugagauucaucugauuccucgcacucacauaaaacccagauguggccaugcgcacugauagucccaguacugagaaggcagagacaagggcauccccagggcucacuagccagcccagucaacuggugagacuuugucucuaaaacugaaguggaggugacuaagaaagacaccucauguugaccucugaccaccacauacguaugcacagauaacccaggcugggcauuguggcacacaccuguauucccagcacucacgugguaggaucagaaauucaaguccagccuuagcuacauauggaauucaagacuagcugggcuacacgagacucugucuugccucaaaaaauaagaacggagggugguuauaaucgucagugugcagguuaaauguguaugcaaucaucaaagaacaaacucaguaaguauuuaaaagaggaaaaaauauaauuucaugauucaggggacuucuguguggcugucaggaaacacagguucccauauucaaagugaaaauuaggaaacuacuuaaacaaacuucacaguauuaccuuggguaugcauuuauuacucggauccuuauuaaagagcucacugagauagcugagugguaaacacuccuguugaccugaguuugaucugcagaacccauguaaugaaagugacucccacaaguuguccucugacuuccacaugcccuccaggauaugcuugagcaagaacacacacaaacacaaacaaauaaaauaaguaagugaaaagauuugauagcuagcuggcugcucuagguucuuucugagcuucagccguuggccaccaguguuccuuaguguaacucugcuuuucuucagacuugacuaacuauccugccucuguaggaauuuuuagaccugucuguagucagcacagcuuuggagccuucguaauuaaacaucauauuggcaugccugauguuaucauucacuguaauuacaaagacagccguuacucagucgaucuccacacuuccuugauauaauaaccagcuucccuaguuugugcaauuuccuggaauuuugguguugaaauuauuauuaguuuccacuguaaugagaacgccccuauaucagcggacauaccuggcugaggcauggccucccucuuccuuucccuucugacauggucuccauuucuuuguaaucuagagucaauacauaaucagugauuguuucugcguaaucauaaagaaagggucucugcaucugaucccuucucccugucuuuugucuccucugucccuccccccucccuccuccuccuccuccuccuccuccuccuuccucucucucucucucucucucucucucugucucugucuuucucucucucucucucucucucucuuucucccccuccccccaccuagccauccuuucucccuccuuugucaggcuagccuuaagguauguaacccaggcuggccuugaacuuaugacccuccucugccucccaaaugcuggaauugugggagucaucgaugucucaggggaccauuuuucuggacuguuauucauuguccuuucaaacuagaacuucuccuacagauggauacauauguucuuaucauucuaguuuucgaaauaaauuuauuaauuacguugaacaacauucuuuguuguugcuguuguuauuuggcuuuuugagacaguauuucacucaauugcucaggcuugucuguaauuacgcgucccaggcuggcuuuccacagccuucugagugcuggggucacaggcccgugacuaugcccaguacuuggacacugccaucugcccuacuuuuaucccacuaguuugaaggcccaaagaucauuuccagcuuuaaguuuucucuuggcaacagggucuugcuguagcccaggcuggcuucagucuugucaucccccugcacccugucucuggaugccagggugucagugugcccuguuacuuggcucaccucucuaacuuuuaaaaguacuuuugucuaauaaugaccucuccaguucuagauaaaacacuuauauggaucuuucuuguugaagaaaaaguuggacaucauguacucuuuuccuuuuaauuauuaucccacuauuuuauguguaugaguauuuuguuuacauggcuguguacugcuuguguauauugcccauagaagccagagggucggauuccccgaaacagcccugugugugcagggaacugaacccaggucgucuggaguagcaggcagcgagccaucucuccaguccugacugcuccuuucuaguccugagaggcgggcugaguacaagugcagacacauucccaguuaccccauccuccugacaacacugcuuguguuuguuugguuaggguuuuuggagacagaggcucauacagccuaaaaugaccucaaacucaccauguaauugaguauagcuuugaacuugugaucuuucuaccucuaccucccaaggguuagaauuacacauggaugcuaccauguacagccaugcccccuucccccuccccccuuuuaaagaccuacccuuuaaauuuuuuuaagauuuuguuuuuacguauuuguaugaguguuuggcucacauguauguguguacacucuguguacuugcacagaggcgcaagagggugcugguucuccucgaacugauguugugauugugaguuucuuugugagugcuggaaagagaacccugguuuucugcaggaguaacacacgcucugauccccgacccaccccauuccaacuuagugacuggguuuuguuuguuuguuuguuuguuuguuuuuuguuuuuuuugagacaggguuucucuguauagcccuggcuguccuggaacucacuuuguagaccagaacucagaaaucugccugccucugccucagaaugcugggauuaaaggcgugcgccaccacgcccggcaaugaccgugucuuugggcagugcuugcugcuggcccuguggauguucaucggccagugaagcccagugaucacccugucuucuaccuuugcuuccucaaguucuugucccuaaguguuuccagaggacccaacaguuuugccaaacacagaccauuguucugcuccuugaucuggcuguugcucuggacugcagacucuuaucucagacucuuuuguccuuauuuguagacuuacaccuuuccuucccuucuucccacccgcugcuucauucuccugccccucuccuccccuccccuccucuccccuccccuccucuccccuccccuccuccauugccacucaagggaaauuuaaggaagaugaaaacauagauauuuaugguuauuaugccacauuuggucacaaauguagcuuagauuuccaugucuauucugggaauauuugauaaauguguauuuccucuguuuuaaguacaguugaauucugaacacgcuguucuaaucuccguuuucccuuaauaacaggacuuagaauuaauucgguaacagcucuuaaaaagcugcggcuucaucugugugggggaggggcacaccagguuucacugaugaaugaccgugauuuaacagcucucuauucguuagcauuucauuugauuugagucacuucuauuauaaauagugcuacagugaugauuuuuuaugcauaguaaugaucuccuuguacugauguguguuagaauaaauucuuaguguagaauuucugacuuaaugcagaauuuagauaguuuuucaacccaguggaccauucucaccauuuucuuaaggaugcaagacauucuaugaaaugugaaaucuugacuuuucccucuuuagcucacaggaagccauuuucuuuugcacugcaggggcagccaaagccaguuuggagcugagacucugcccuuggcauuucccucagcauuugagauaugccaugcuguuuuagccuauuuuuaucuaucuaaaagccugaaaaagaagacaggaaguacucucuauuuggauuuuuguuuagcucuaucaagcacucgggaaauaggagaaagagaaguucaaggucuuccgcagcuauagagugaguuuaaggccagccuggguuacaugaaaaacugucucaaaagaaggggagggggaaggaagcaaaguaauacauaaacaaaugaggggcucagcgcugacggcacauccuagcacgugggaggcagaggcagguggguuucuguagaccaaccuggucuacacagugaguuacaggccuccagggcuauguaaugagauccuguugucauccccuuccccuuccccuuccccuuccccuuccccuuccccuuccccuucuuccucuucuugauuuuucaagacaggguucuuuguguucacugugcuuuaccuggcugagauccugucuugaaagggggaagaaagagagagagaaagagauagaaaaacuagagagaaagaaggaggaggagcaagauaguucaguggguagaggcaccugcugccaagccccaagaccugaguuuaaucucagggaucaacaugguggaaggagagaaacaacuccugcaaguuguccucugaccuccacauauacacauggcacaugcacacacacaugcauaaauacauguaauaaaaauuuaagccaggcgugguggugcacgccuuuaaucccagcacucgggaggcagaggcagaggcagguggauuucugaguuugaggccagccuggucuacagagugaguuccaggaccgccagggcuauacagagaaacccugucucgaaaaacaaaacaaaaauuuaaauuguacauguucauagugugccauguaauguuucaguacauguaauagcuuucugagauacuguauucacuucccucaucauaggguucauccgcauguacaguuuaagcuagagguguaaucaacggcccuggugaaucccagcacuagaaaucaucaucuguacaguucaugaaauccagaugugguggugugugauuauacuccaucauuugggagggaggcuggggcaggaggaucagaaggucaguagccugggccaaauaaaucgugaaacucucccuuaaaacaauaauaacaacagguuuuuccuuauuaggaaguuaugggauuuaaggcauguuauaucauacccagaauuuugugugugugucugucucagugagagagagagagagagagagaauaugaauaugaauaugaauaugaauaugaauaugauaugcucgggcccucagaggccaaaggcauuagaaccccuggaauuggagggugaccagaacaaaacucagguccagugcaagagcaguucauacucuaaaccucugacccaucucuagccccacagaacaauuuuuuuaaaguguacaauugauuaggguuuuuuguuuguuugcuugguugguugguuuguuuuuugaaacaguguuucucuguguagcccuggcuguccuggaacucacucuguagaccaggcaggccucgaacucagaaauccgccugccucugccucccaagugcugggauuaaaggcaugugccaccacugcccagcuugaguaguuuuguuuuguuuuguuuuuaauaguccuagggugcgugccauuuugacagucaguuuuagaguguuuugaaucacuggagaaagaugcuguauccaguaguguagcucaucacucauccaacuccagggccuuagcuaaccaccucaucuguaugcagauuggccucaucagagcggcccuuguaaauggagucguacaaucugugugguuuguaugccuccuacaguuuuguuugcagaagcgccugaggaguuggagugagucggucauuuuccagauuccacaaguacugugggugguuguucucugcccaggaaaagggaggcagauuaguugugaaguugggauggcuuagcuggcucccaagauggagccagucagccacaccauuuagagcuauccaucuuagagugauucgaagucagccuuccucugcucucccugucuccugugagaggcucuacagaucacuuggcggucugcuaagggaucgucuggggggagccacaguuacuuugcaaggcugcuuguuuugaagaguuuccaguuuaccuaugccccaugcugugacucggcuaugauggagcugaaucccgugaacccucgugguuuggcuucaccuuuccucugcacaucucaccugcugccuggcgcccuggcagcagucagcuccuguagucagaguggaaggcaccuugauggcucaugugcugacccugaaguuggcccaguuuuucaaauuacaaagggaauugccaggugggagggaccaaagguuauguguagguuauaaaaaaaaccugggccugacagcguuagaguaauaaccaucaaaaucuaaaauaaacgcaaucuuugcacuguuguggucucaccuuuauaugagguucuuacugccuggugaguaaggcuggugcauccuggaucccacagagccacucuuaagguagcagcuguauucuagaaggaaaacagcaagcaguagucagagggcucucagugguugucuguggagcggccuagcaggaugauaauaaauuggcaggugaauccaggacugugggaagcgggcugugcucagccauugguggccuuuuugcggaagaguugguaguaaaugcugccugguggagcuucaacuucagauuacagaaagagaagagaaaagaaaagaaaucuaaaagggggugucccagcuaggauuucuuuugcugugaugaaccaccauuaccaaagcaaccuggguaagaaagggcucguuuggcuuaugcuuucacaucauaguucaccacugaaggauggccaggacaggagcucacacagggcaggaagcuggaggcaugagcuguuugcagaggccaugcagggugcugcuaaccugcuuucuccucauggcuugcucagccugcuuucuuauagagccuaggacaaccagcugcgggaugccguuacccacaaugggcugagccacaaggggcccagccccuccccucaaucacuaauuaagaaaauguccugcagucugaucuuauggaagcaucuucucaauugagguucccucucaaauagcuggagccuaugucaaguugacacaggauguuagaagguuggagaacugggaaaaaaaagacagaaggaaaggaaaggaaaguccagguaaugugagugcacaccuuuaauccuagcacuuuggaggcagaggcaaccagaucucugugaguucaaggccagccugauguacagugugaguccaggacagccaaugcuacacaaagaaacccugccuugaaacauaagcuaguguuuauuagcuucuguguccaaaaagccugcugagcaucccagucagaccuggaggcucggagaaucuauccaggcucuucccuucccuccucuuguagauugcuacuuguuucuauguugguguguugcuggguggguuuuaucuucacaguggccacuggaaguccaggacacuaaacaaaggggugacgggcuaccuuuucuuggaguuccaaucuggguucuagacuccuuuccuauuccugaaccaaucauugugguagggauggcacagaguguucuaauuugucagccuaagucccagccagagggagggcagguggguuuccagcacacuuaaguagcccucagacagagacuggagcguggaccacugauucccaaaggaaucccaagguagugucaagagacauagagagacacagcuauaugucugagcuuguuuggcuagaagaguaugucugaagaagggaauaacuauuucugcuaaagacuggagaaagagaaaauagaaauaaaugcuagcacgagagacauuaggaaagggugguuuaagaauccuagauaacaaaguucuguccagcaaaugccccuucccccauuguucacugcucuacuucccaaagggaacauccacaggcucgcugagugugggccccaaugagagucggccgcagccaaggcucgccauccauccauccucuuucuuaguaaacaauucauuuaccuuuucuuuaagccacagacauauuuccuaagcgagaauauucccugauuccacccugaacuuccaaagacuuccccaccaguuuacauaguagagugggcugcauucccuuccugucacagccugaaacuccacaugagcagagcuucugcuuacaugauguuugagcccacgugcaggugcagaguggagacugggugucaugcaaaggagaguagaguagacucacaaccuauaccuuagaacacaguaugcagccaugccugaagauggucagguuagucaagagaaugcacaccugaguauaaauaauuauagaucccaaacgugcugcugcuucuccuucaccauccauucuuggcugccacuuccuccucuuccucuucuuccucuuuccuccucucccuucuuuucucuccuuccuuccuuccuuccuuccuuccuuccuuccuuccuuccuuccuccucuuccuccuccucucccucuuauuccuccuccucuuccuuccuccuccucuucuucuuucuuccuccuccuccuccccuccuuguuuuucuucucuuucccuucauggccuuuaaaacagcuucaguuugcagcccuggcugcuguggagucugcuaucuguagcccagacuccugcuaucuguggccucuacuccugguucuucugggccccaugauugcagguguaaagcuccacgucuggcucuuugagcccuuucuacucauucguucauugacccaugagcaaauaguuacuaaacaccuacugugugcuggcuugucacuaggcguugaggaugcagcacagaauaaaaacaaaucauugacucugcggucugcauugcaaggagaagagcaagcaauccauaaaggagugugugagcggaacagcagugcucugugcucaggagagaacagagcaggcgggagggccaggugauggcuggaccgagacugcuaccuuaggagguggggagugagccaacagucugccagaggagaagccccugcucgagcagaggaagugaggcccagaaacaggccuagaacagcuugcuaugcuaaaaguuaaaaauaacaaacagacaaaaccuagguaggcagaauuguucaggacaagggaacaaagaauagcauccucagagaggguuccuugguccuuggguuuuggagagagggaugggcaagacagagaguagacagaggaggggauggggcaucuucagaggaaaacaggaaccauugagggguugacacacagaaugaagagggcucauuuguauuuuuaaacaguuguucccaccauaugcaguaaggguggaagcaggcagaacaauuagaggcuuaggaaaagcagaccugguguuggugaccugagaggcugagcugcaaguggggaggccuaggaaacacuuccuucauuaugugugguuccuuuuuccugacugcaggagagaugcccguccucccuuuagaagggauaaccuuuccucucugagcaagaauuucuacaguguggagagcagcaggcuuauucucuagggucauuuuccccuuaccgcauccaugcugagguugaguauaaagcuggccucaggugugaaagcacuuuugcaggguacauacuguggaggcccugcauggauggcggaagggauccaagaaaucggccaucagcugaaaucugauacccgcugugcccagaaggcucugaaaaauggggaaauugcuaugacaaucacaguuuuacaagagaaaucagacuguaaugaagagcuauggcaaagguaggaagcacaacugugcuuugggcugaaguccacagaacgauuccacucaucaaacccuagaaugguaaaauccggaggaucccugguggucccuugcugcugugccaauuccagccaugacuuauagggaucuagccuguacugcagauguccauagcucauagauuacagaauguccauggcaauaccugagagcccuggcuaggauuagcaaauccagagaucuggguucccagucaccaucuuccacuuacaauccuaauagagacagccuuggccugcaguguuacagguagguuuaagugugggcugcugagaugacuuagagucaagaugccuuaccaccaaggcugauggccugaguuaauaccgaggaugaaggugagagaaaggacagaauugacuccuacacuuguccuuugauacacacacacacaagaauguaaaaauaaauaaauaaaucuuuguauccaucccaucacaggauaucuagguuauuugucuccccauccuaaauaaugaguucuuucuuucuguuuugaaccccagggauugcccuucuuucagauguguacccugaagaaaucuugguugaucuguuggccaaauaugacagugggaaagacaagcacacuccugagaccagaaugaagguuggcgagguccugaugcgaguugucagagcacugggugaguuuuguuuguuuacuccauuucucugacacugagcaguguaguacugcucugucuauguacugaaggcucguucuagcagacgaggggaucagaggggaugaugacuguuuagggauucaacacaugcucagccaaaccuaugugaagagcucuuuccccauggcugcuuaguuucccucucccagagcugugcuuugcugggguccgugugaguggggugggcucucggaaugcaggcuagcugaccugagauacacuguucaggcaguacucaagcaggccgaccuccacaucacaaccugcugucucagccgcuagagcgcugggaguaugggugcccccagcuuggaggccaauguauaauggaccugaaaagagacuuuacacccgagagcagcaagcacaccagggugagauccaagcaggccgggaauggagaacuggcgaggacugucugccguguauguauggucgcaaccaauuucccaaccaguccuuuaagcaaguugucagaggugugguggauguggggcuguggcucagccgccuucagcaguguguccaggauuccuuugccgaugagugauggugugaagaacuggcaugcccacaugaaguugcucucugccuagaagcugcagagguguuuucugugagcugcucuggcuccauuagggauccucgucucuccuuccuggugcuucuuaauucaguguccgcauguacagaugaggauauucaugcuauauaaggccauauucaaauaauaaaauuaaaagaagcaaguggaccuagcgacugugaucccagcuacugaagaggcugagguugggggggggggggucauaguucgaguccugccugcuuuacagaaagaguucaaaaacaaccugcccaacuuagugaaacccuaccucaaaaguuagggauguagcucaaugguagagugcuugccuaaacucuguaagggccuggguucaaucccuaauauuaccaaaaauaaaaaauaaaaauaacccaacaaguuuaagagaaacagaaaccauaaagggggcacuagagugauggaucagaccauaccagaaagccccggcuguccuggaacucacucuguagaccagaguggccucaaacucacagagauccacuugccucugccucccaagugcuggaguuaaaggcgugcgccacuccuggccagucaucuuguucacaucaucauccaacacccagaaucugaaaaccugaaaucccaaaugguccaaaaucugagcuuuuugagagcuugucaugacgucauaagugaaaaucucuguaccauaaaacuuuguuuuauuagaaaaaauguuuuaaguaaaauugcuuucauuuuaugcauacgaugguacucaaaacagaaaugaauuuuguauuuauacuuaggcauauucaaguauugcaaaguucagaaaguuaugacaucugaagagcucugauacucagcuucuugaauaagggggcagcaccugugccggugugcugggcgcacagagggagggccuugugccggugugccgggcgcacagagggagggccuugugccggugugccaggcgcacagagggagggccuugugccugugugccgggugcagagggagggccuuggagcccuuuacagguaaauaaggcuuaccuguguggcacagcaguaucuuauugugcuaauguuugagguccucgugagcaucaguguuaugaagcuggccuauuucgcaccccaguugccuugccuggaccuuguucccaagucaucaguuuguaguggugaggagggagcuggguacagugcugcacugccugcucuuggccuccccuuagcuccuagguggugaugggaaagcagcaagaauucaguucucuuucuguuuuuaaaacgugggcuggcggugguagcagagacaggcaagucucugugaguucaaggccagcaugguucacauaguaaguuccaggcaagcaggccuacauagugaugcucucaaaaaucaaaaucagccaaacaaauauaaaaugaaacaaaaaucccucaggguagacuauauaaucagcaaugcuugccguacacugauuuuauggcacuugguguucuuacuaccacucaaaucaaaaacacccaauaaccccgaaaacuucccuuugcccuuucuggucugccugccccagaguuaagcagucuucugaaaacuuuguuuuaucauuuucaguuuacuuugauuguucuugaaccucauuuuaauggaauuaaccccguuucuagugugcugggagaggcaggugcuuaugaucuggguuaaauguggacguguaaacgugcuguccuucuuuguugcugugccuggaggggcacacaguugucaggucacccacgcucagugguguugagcuugacccuggucuuuccggggggaccucuuuguuagagacgcguuaacugccguggauuaacuaaucauggacaaucuuaucuagagacuuuuuuuucugguuuuuggcauuuuuuuaauuacuucuuuuauuucuugaguuaauaauugcaucauuuucuccuucccuuuccucccuacguacccucccauauaccucccauauuccgguuuuugcugucuuucaaauuuauggcccauuuuuucauuaauugguauugcauauauguauauauauauugcauauauguauagguaauguaauauauguauugcauauauguauagguaauggcugaccccuugguacuggauaaccaguuggugguuugucccugggaaggcuauuucucuugcucucagcuuucuuugguugcuggaguucuuugugugggguagaggccccucggucuuccccuguccacuuugguaugucuaucguuguucuugaucaguacgucuuuaggaagucauguuggugagacuuuaugcuauuucucuugcucucagcuuucuuugguugcuggaguucuuugugugggguagaggccccacggucuuccccuguccacuuugguaugucuaucguuguucuugaucaguacgucuuuaggaagucauguuggugagacuuuauggauauaacuacuacuacuucuuccuccucuuucuccuuuuuuuagacaaaguccugcuuuacaucccgggcuggccuuccacuugcagucuucccgcuuaaguuucucaaaugcugaauuugaggguuauagaucuauaucaccauacccagacaggauucacuuuauaaagguuuauuuuuauuauuuuuaacauuguguguaugcaaguauuuuggaauuuagacacacuggacuccaggcuguggaguuacaguggucguaagccaccugauuugggugcugggaacuaagguccucccuaagagcaguaugcagucuuaggcaggcagaucucuaugaguucaaggucaguuggcucuacaaagcuaggucuagggcagccaaggcuaccaaagaaaccaugaaaaaccaaaagggagggaggaaggaaggaaagaaagaaaaggaagaaggaaagaaagaggagaggaaaggagagaagggaggaaggacuaugcauucuaccugcugagcuaacucuccagcccuacaauuucauuuuuuugagucuguguguuuaaagaucuugaaucauugauguuuauaguguagauauuuucuucuucuguuguuaauauuucaguuuuguuucugaaacacaguuauaauuuuauuuguuuugguauagguaaaucuaucuuaacgugugugugugugugugugugugugugugugugucccuuuugauguagagaucauuaugguaggauuuuggcuuuguuugucuuuuuaaagaaacgauucaauuuuuuuuuaacuuuuagaaauguaaucuuaacaaauuguuaaguuacuagucaucucgaauauuuuuccaucuguuuccucuugugugguccaguguugauaaucugugugcuauuauguaauauugcauuaaaagaaaaaccaccuaggaacauguaagacauuaacugggugugcugacacacagcuguaaucuuagcacuaggaagguagagcugggagaucuggagauccagggaauucuccuccacguagugaaguugaggucagcugggacuuuaggagacccaucccgcaguugcuuaacaguuauguaaagcuggacaagguggcgcaugcuuuuaaucccagcacuugggaggcagaggcaggcggauuucugaguucaaggccagccuggucuacaaagugaguuccaggacagccagggcuacacagagaaacccugucucgaaaaaccaaaaaaaaaaaaaaaaaaaaaccaaaaaaacaacaacaaacaaacaaaccaguuauguaaauuucgucuuuguaugaaugauauacuccaaauuuucuguuccucagccuagggaguaagcaccucugcugcccggguauaugcugacaugucacacaaccuaagaugcaguuccaguuauuaggcugaguuucucauucuuuuuuuuuggggggggggggagugguuucgagacaguguuucucuguguagcccugcuguccuggaacucacuuuguagaccaggcuggccucgaacucagaaaucugccugccucugccucccaagugcugggacuaaaggcgugggccaccacugcccugcucuuuguuuccuuuuuugaagacaggaucacuauauaaccugagugcugggauuaaaggcgugcaccaccacaccuggcuugaauuuaguuuuuaucaaguuagaaaccacaaauuccucauugucugucuuuucuaauguucaaaaaucuuuuuuggggggggcuggagagauggcucagcgguuaagagcaccaacugcucuuccaaaagguccugaguucaaaucccagcaacacugaguucaaaucccagcaaccacacaguggcucacaaccauccguaacaaaagucugaugcccucuucuggugugucugaagacagcuacaguguacacacauauaauaaauaaauaaaucuuuuuaaaaaaucuuuguuuguuuuguuuuuucaagacaggguuucucuuuauagcucuggcuguccuggagcucacucuguagaccaggcuggccucaaacugagaaaucagccugccucugccucccaagugcugggauuaaaggugugcaccaccacugcccggcucaaaauucuuuaucuuaacuauuccccaccuacuccaucuugggaacgaggacaucauaguucaguucagagacauuuacugaagugagugugacucuccucuuagaacuaaggaucccgaaggagggagucaggaguucuaggccagccugggcugcauagcaagauccugggggaaggggucaggaggcagggaggaaggaagagagauagacagacacacaaacucagacauuuauugaguagccacuuaaguuagacccguggacagcugaaaguuggagcagggagcuuugaguucagcuccaggugacagugguggggagggaccugccauggcauugugcggacauaccugacuguggcagugugcagugugugcagagaccuguguugcugguguuccuucgcuuuguuuuguuuguagcacagcauggcugggcagucugagaaaguaacuuugcuaugguucagagauuucuccccucacagcagagguuuaaggugaaaggugggaagauaugugaauaauaugucaccaggccagacgcucacagaccucagcugcacuaaaccaacauaguggcagauucuaacucaacggguuuucuuucuuccuuccuuccuuccuuccuuccuuccuuccuuccuuccuuccuuccuuccuuccucucucucucucucucucucucucucucucucucucuuucucucucucuuucuuucuuucuuugaaacuaaguuggccucaagcuuauuauauagucaaggcuagccuugaccuccuuauccuccugccucuaccuggcaaguacuggaauuacagacaugaaugcuacacaccuagcuuuagaaucauguuuuuagggucagggauauggugacuagaaguccuugccacaaaaguuugcugaccugaguuuuguucccagagccuauguaaaaucagaugugagaguguguccguaggacuaguacuuccacaggaagauggaaguggacacaggcgcaucccuggaggcucccaggccagccagccuggcuugcucaguggggaacaagagauucucuccccagcaagaugaaggauaaggacuaacaccuaagaugguccaggcacugugacaugcaugccccaucacacaauacacucacaaacacacaaacacacucauagacauaaaugcgcacacacacacauacacgcccugccacaugugaucuggucaccucggguguggcucagcuccucaagccuuuagacucauauaauuugggaacuaguaauguggucggagcuaaaggcuaaaguccagucuaacuuauuaguuuauuuuaaaauauauaaauagacauuucucaucccccaauuauacaauaacacaagguuauuucaugucuuuuuuuuuuuuuuuuuugguuuuucaaggcaggguuucucuguauagcccuagaacucacuuuguagaccaggcuggccuugaacucagaaauccgccugcuucuaccucccaagugcuaggauuaaaggcaugcgccaccacgcccggccauaucuuuuuuuuuuuuuuuuaaguauuugaaaguaugaaaaaugagacucucaucgucauuccugguuuaaauuuuacuuuccugacugaugcuaaggacuagaccuaggguuucgugcaugcaugaucuauaccauugagcuauaguagggccagccuucagguuagguuuuaauaauuuuuuucucagaauuauauuuauauguauauucuuguuuucaucuaacauuauucaugaauacuucuuucauuuuaucuauuuauccuguagugugugugucuguguauaugugugugcaugucugugugugagugcuauguguaggucagagggcagcaugcaguaguucucaucuuucagcgugcaggucccaggauugauuguauugcuuagcagcaagugucuuuacuucagaguccccacugcagccuguuuucuuccuuucucccuuacuuccuggcuugcuuucucucauucucuuuccuuuucuuuuuaauggucuugcaauguugcgaagacuagccuugaacucucagcucaagcuaucccuguccaguucaugaguaccuuucuuuaucaauaccuuccuaaaaaugcagugguuaacaauuaugcuauugucaaugaccugaaugggccgugauuuaauuuagauaucguuuagggagacguucucuaauuaggcugaugcugguuucuuucugauugcaagaagaaugcugcugauuuuucuauucacuccccugguuccuuugauuccuuucuuagacuuggcuccuaagggaggaaugauuagguuagagcucacgugugcuucuaaggcucuucauuuuuacagcgagauuuuccuucagaaauguacauuuugacagcaacaaaugagacugccacugucucccagauaaaaacucucccaugguuucuaacuaaacuuccaaauccagccauuugucucccacugugugugccuuugcuccacaaugagagggaagguggaaugugugacuaagugagagccucuuguaagagcagcuacaggcugguagugucaccacgaagcagaaagaacagcacuucuuaauuauuuuuagagguaggauguagucuuucaaucagcaagcucagacagguuuucguuugcagcaucagacuuguaaagaggagaguggaaggccaaggucacgccacuccaucuggaguuugccuguaggacaucgggaauccagguuugaaugaggguggggcagaggacucaaucauggguuuuuguugucaugugccauggcagauggaauuacccagaauccugaggcaaauccaugucuucucucagcauacucuuuucuagaaaaagggugggucugggcucuaaguauuucuaacuguugaaacaugcaaaacuuccugucaaccccuuuccaugcugccggcuuggacguuauguuuaaagcuagcaaacacuuugccccucaaaguucacucaagugaugagaaaccuaggauccauguuucucccagcucaaccagcuccagaauaaagcccauaaucugauuuuagaaaaccuauaaucuguccagagacuagaauauucagucucaguuccugcucugacaacccauuuucuuccaaccaauuauagaaaacaaaggaaaauggaacacagucagccuucauaucccuguguucaguuucucuuaauucaaccaacuguacauugaagacauuuuuuaaaaaaaauuuuuugugcacuaagugugugugcaaaccuuuucuuacaauuauccugaaagcaauaaaauagaagagcuauuuauauagcauuuauguuauaguagauacuaugagccuucuagagaugagcuaaacuuucugggaagcuaugcguagguuuuauaagggauuuucucucauauagauuuuggaaucugcuaguggagccagagaccagucccucacagacccugaguaacagcuguaauuggaugugucuaacaggcugugaugaguuccaguuggguuagccugguaauuaagaugagagaaugacuauuaaauagcuacauauuauuuuacagaacgaugucacaauucauaccaucuauucaauaaaaagugugaccuccuuuuaaagugaaaguuauuuuaucauuugcuuucauugcaaagaguaaaaaugcacuguuuuaagaaauucgaagcugaguauguuagcacaccuuuaauuccagcacuggggagauaaaggcaggcagaucucugaguuggaggccaaccuggucaagauaaugaugaguuccaggauagccagagcuuuauagacccugucuaaaauaagaacaaacaaacugagaugggggagggagagacagagacagagagagacacagaggucaggauaauaaauaugaaauaugaauccagaggcuggagagauugcuccauaguuaagagcacugacuuccacaggaccuagguucuauucccagcaccccauuggcagcuaauaucucugcagcuccacuuccaguugacccagcacucuuauguggccccuaugggcacugcaugcacacagacauaugugaaaacaaaccacacaugcacaguaaauaaaaacaaauaaaaucuaaaaaaauuguaaaagaaauaagagacaggcauaaugacucagcuuuaaugacaguacuuacgaagcagaggacggugguucucagggagguugaggccagccugggcuacagagcaaguucagaccagcuagagcuaucugggaagauccugucucaaaaagggaagacccugucucaagaacaaagaaagagcaagaggaaggaaggaaggaaggaaggaaggaaggaaggaaggaaggaaggaaggaaaacacacacacacacacacacacacacacacacacagaguguggccuaaugaugucgauuuagccaaguggaagagugcuugcuuagcuugugagugguccuggguuuuauuuccagcacacaaaaaacaaaaaacccaaaaccccccaaaaaccuaaaaagcaacuccaacaccauuacauuuugauuuauuuuuauuguauuagauauuuucuuuauuuacauuucaaaugcuaucccgaaaguuuccuauacucucccuccacccugcuccccuacccacccacucccacuucuuggcccuggcguuucccuguacugggccauauaaaguuugcaagaacaaggggccucucuucccaaugauggccgacuaggccaucuucugauacauaugcagcuagagacaugagcucugaggguacugguuaguucauauuguugucccaccuauaggguugcacaccccuucagcuccuucgauacuuucucuagcuccuccauugggggcccuguguuccauccuauagaugacugugagcauccacuucuguauuugcuaggcacuggcauagugucacucgagacagcuauaucagggucccuucagcaaaaucuugcuggcauaugcaauagugccuggguuuuguggcugauuaugggauggauuccauaaugagugggguagucucuggauaauccauccuuucgucuuagcuccaaacauugucucuguaacuccuuucauggguauuuuguuccuauuuuaaggaggaaugaaguauccacauauuggucuuccuucuuguuccauucuuaucuccuuguacaaagcucaagucuaagugaaucaaagaccuccacauaaaaccagagacacugaaauuuauagagaagaaagcagggaaaagccuugaagauaugggcacaggggaaaaauuccuaaacagaacagcaauggcuuguguuguaagaucaagaauugacaaaugggaccucauaaaauugcaaagcuucuguaaggcaaaagacacugucaauaagacaaaaaggccaccaacagauuuggaaaggauuuuuaccaauccuaaaucugauaggggacuaauauacaauauauacaaagagcucaagaagcuggacuccagaaauucaaauaaccccauuaaaaaugggguacagagcuaaacaaagaauucucaauugaggaauaccaaauggcugagaagcaccugaaaaaauguucaacauccuuaaucaucagggaaaugcaaaucaaaacaacccugagauuucaccucacaccagucagaauggcuaggaucaaaaauucaggugacagcagaugcuggcgaggauguggagaaagaagaacacuccuccauugcuggugggauugcaagcuuguacaaccacucuggaaaucagucuggcaauuccucagaaaauuggacauaguauuaccggaggauccagcaauaccucuccugggcauauacccagaaaaaguuccgaccgguaauaaggacacaugcuccacuauguucauagcagcccuauuuauaauagccagaagcuggaaagaacccagaugucccucaacagaggaauggauacagaaaaugugguccauuuacacaguggaguacuacucagcuauuaaaaagaaugaauuuaugaaauucuugggcaaauggauguaccuggagggcaucauccugagugagguaacccaaucacaaaagaacacacaugauaugcacucacugauauguggacauuagcccagaaacuuagaaccuccaggauacaauuugcauugugauuuuaggugaccuguacugagcaugcagaggauggugaaguaaaucaccuuuagaaguuuguuccugaugaaaggcucugugcuuuacuccagucuccauguagauaguggaguauuggguaggagucuuacauguuagaugcaugacagccacauacaugcugugacaugugcauguaugcacaugcacacauaaauauguuucaaguuaaauaauguuaaggacuugguuguugucucugcagugcuuuguuuguugagcccaauaccucaugaguucuaagcaagucuucuauuguccugcaugcaaacacacauacacacaugcaugcgcgcacacacacacacacacacacacacacacacauauacacaugcaugcgcacacacacaugccaucauggaagacuaauuagguagcuuguccaguuagcuuuauacuuuuuuuuuuuuuuuaaaauaaaacaugcucuuguuaauauagccuagacuggcaguaaacccauuguccuccugucuuggccuccugcgugguggguuuguggauauuacacuuacaccuggaacugaguuuuguuuuuaauuguuguuuuucuuuuaauuauuaauguguaauaagauugaucuuaguuuuucagacuuugcuucgauuaucuaagggacugucgugaucaauuuccuaaugcuaagcuauugggucucuugauagaaccacuuacugcuccuuugcuugaucaugcuuuguuacaugcuagugccuuuuuuaugaaagaacuaugguauauagucucagauuuuuuggagguggguaugguuucuuuggaucguuguuuugaguuuguuuuagggcaauucagucuucagaaaugauuuaggaauuguucucuguucucuuuuuuuaaaaaagauuuuguauaaaguucguuauuucuaaauacuucauagaauuuucuugugaagacauuugguaguucucaggaugugagagguuuauugaugauuuguuuuguuuuguuuuguugagacaggauaucacucugaaguacaggcuggucuaaaauucauuaugguggcuacccuucugccucagccucucaaguucuggggucacagguauaugcugccaugacuagcugaagguucuaacauuucuuuuguagauauaggacaucuaagauuuucuuuucuuuuaaagucaauuuuacugguuaaugucuuaauuaaagcaauuuacuuauuaucuaaguuauugaauugaucauaaaaugauuuaguauucucucaucauuuugauguuuguaggcuuagucuuguucccuugcuucauuuucucuguuggcaauuugaacguucucuuucuguccuucaacaugugcagucuagcuagcgguuuauuaacugagugcagcuuccuucucagccagccaagcuucagucucauucauuccuccaaauggcuuuuggcucuuugguuuauugguuucugucuucuauaucuauuucauccuauuuuaauaauuuauuauaggaaaacaaauaaccuggaaacauggucaguuaaagugacagauauuauaucccaguuucuguagagcaggaguccaggcagggcuuggcugagcgccucuccucaggcugugucaaggaagcugaacuguagucaucugaagaguaagcugaaggcagagccacuuucagucugacucauuucguuaaugguauuuggguuucaggcuguuggagaccaaaaaccccagguuuguuuuagcaucuuuuuuauauuuaguguguguguuggguguuuguaugauguuggguauauguuuguggcauuaauguauguauucauaugugcaugugcaugcagguacagccacccaugcauguggagacuagacauaagugcuggguaauuuccucccuuauucucuuuuuuuucuuucuuucuuuuuuuuuuuuuccgagacaggguuuuucuguguagcccuggcuguccuggaacucacucuguagaccaggcuggccuugaacucagaaaucugccugccucugccuccugagugcugggauuaaaggcaugcgccaccacguccggcuuuuuuuuuuuuuuuuuuugaaacaggguuuuauguaguucaggcuagcacugaacuuaguauauagauaagacugucauuauucuuuuaaaaaauauguauuuuuauugagugugugcauguauauauuauauauacauauauauguauaugugggauaugugcacaugugaauaugugagugcagguuccuucagaagccagcaucagauccacuggagauacaagcaguugugagagcagccagcgugugugcccguaauucaacucagguccucuggaaagagcagggaaugcucuuaacuacugaaucauucuucaagccccucuuuuuauuauucuuaauuuccacucuuggguuuacuguggcaaauacuguuggguacuuuggugcuauaaagcuggauagagccgggcguggugacacacaccuuuaauuauacuuucgagguagaggcaggugaauuucugaguucgaggccagccuggucuacagaguggguuccaggauagccaggaguacacagagaaauccugucucaaaaaaaaaaaaagcuggauagagaugggguaccauacuacagaagauuuugaaaguugggcagcuuaauuggacuugaagugaugagcauuugggaaacaguaugauauaagagauguagguguggcugguaggggaugaaggauggaugaaaacggggaagcuuggagucagagacagcugggaggcuguuaggauguuucuuggcacagagaguccaggauuugaucagaguuauguguugaaaauuaauuuuaaaaauagcuauuauagcaguucagaggaagagcugagagacugccauuuuguuuguuuguuuaauagcuaguggauauagaauuaccauucaucuagcaacuauuguucucagaggauauugaaagacucaaaugagccuggcaugguggugcauaccuuuaauuccagcacccagguggcagagacaggcagaucucugugaguuucaggacagccaaggcuguuaaacagagaaacuaugucucaaaaaaaaaaaaaaaaaaaaaaaaaaagaaagaaagaaagaaagaaaaaggaaaaggaaagaaaaagaaaaugaucuuaaaugaaaugguuuauaugaaauuaucuacaauauaagaaugucacuauagagaugcauguaucccuauauuaacucugagaauggaaauuugagauacccaaguagagagguuagagcaucuacuauggcagccauugggaagaauuugauguauguggaacuuaauguuggacagccuuuaucggggguaugcacugugacaugugccaugcaugaugccuugggguucuuucuugacucuuaccaugaagugggguagacaaguugcaucucuguuccagucuguaaauuagggagaauugcagcuacuaccugagugggcaguuacacaauuaaaccagauuacacagguaaaguguuuagacccaaccucuuucuuuccuggucaggguaguuaacuguggcgugugggcuuguuuuucugugagagccucacauuuccucauucucccaguaagcagccguggucaucaagugugcgaucauccuguccagcugcuggacuaggcacuuccgaugugugucuucccguagcggcugcuuuggacaguuacuaacccugagguuacaauuuuuggaggaaaggaaagagauucuaagaaugaguggcuuccucagaaccacacuggaccagagacucagguuagaaagauguugcccuuaaccuaaacuaaccuaaaucaacauuuguuuguuugguuugguuugguuugguuugguuugguuugguuugguuuggggaacaggaucucacuguagcucuggcuguccuggaacucaauaugugaaagaggcuggccucaaacucacagaaguccaacaggccucagccucccaaaggcaaagccacuaagucugacuuugccuguuuguuuuaauaagagaauuuauuauugguaagaacacaauaaaaccaaauuauguugagacagugggcugaagaaaugguuuagcaauuaagaaaaguugguucccagcaccagcgugauaggucacagccagcuguggucuaguuccagagggucugauuuccucuucugggugcacauguaauacacucaggcacacacacacacacacacauugaauuuguuuguuuguuuguuaagacaggguuucucuguauagcucuggcuguccuggaacuugcuuuguagaccaggcuggccucagacugagagauccuccugucucugccuuccaggagauuaaaggcgugugccaccucugccugguuuaaauuuuuucuuuuuucuuuuuuuguuuguuugguuuuuuuuuuuuguuuuguuuuuuguuuuuuugagacaggguuucucuguguagcccuggcuguccuggaccucacuuuguagaccaggcuggccuugaacucagaaauccaccugccucugucucccaagugcugggauuaaaggcgugugccaccacugcccggcuuaaauuuuuucuaauuuuaaaauuauacuguaaaauuagaaaaacagcugucugguaauagcauaaagucuuaggggcagaguguacacuggugacuacagcagcaaguagggguuuaauucuguaaaaaguaagggagcuuuuuguguagggaugguagaguuccacaagccguggcccuuaagcuaaaucuaagucgcugccauuuucugucuuguaaguucagaaugaauuucucaguuugaaacggcugggaagcaaggggagaaagaacaguccuuugugucauggucuuguaauugugcucgugcaguuuacagugcccacaaauaaagucccauccaaacaguugcagucauuugcaaauuuccuguggcugcaaagcugagaagcaggcgcugaguggaaugugaucaaggugagaaaccuucguggacaggccuguugaaugacccuuagggagccauugcccgaauucacagugugucucauagcaacccucacuguuugcuucucaaccguuacuccucauucugaauuauuccauguuagguuccagucuguucuucccauagaacgcggcauagcauacauucagagcggaauuugaucucuuuaaagggagggugaguaggaauuguuguuuuucucuaaaaugaccagugaaggagucacugguuggaagggaccaggugccauuggcaaggcauccuuucuuuaaaguuaacaaacuaauugugccugcauguuucaggauucuguucuguuguuuuuauuuuugguguucucauacauuuucucccaacccauucccuuauuccaauguagacucugcuucccugugugugugagagaaugugaggcacuuaggcacccgauucacucugcucucugccaacugugaaaucuuuucaaauugcaaaugacuaaaccaaagauaggacuaaaagacaguauuccucuaggaagaaaguacuacuuaauuuuuuaucuuaucaaacuucauuuaguaagaauugauuucuuagcacuugaaagauacuguuguguguguguguguguguguguaaaugagugcuuugcuuacauuuaucucugugcacagugugcuugccuggugccuguagaggccaaaagaggacgucagaucccugaaccgugguucugaugauugagagccacagugugggugcugagaauggaacuggcuccucuggaggagcagccggugcucuuaacugcugauccaucucuccagguccccuguuaauaauuuaaacauaagaucuuaguguuaggcuacggacuuccuaguuuguacaugucaauauaauaagccuggaggcugggguucagcugugauacacuugcacaaacuaugaggagcugaguuuggauccccaguacuuguguaaaagccacauaugggcauauaccuauaaccccaacacuggagggcugugugcaggacaggagcuugcuagccagguggagagcaauagaaggagucauuaaauaucaaccucuggucuccacauauguacacucaggugaguguaccugcacacacaugcacacacacaacacagacacacuauuaagaagcucacuaaccccuggcaugcuugaacaaguuugaacaauuauguagcaaauuaaagucauuaaaucaucuaaauaguuuuaauacuuucaucaccaaaugcaaaaaaaaaucaucaagucuaagcuuuuguguccucuuucaucuuuuaaaauaacuuaaaacuuggguauuuuauucuugugaucaugauucuggauuuugaauucuacccuugaaguaaguuucuggagucuguuucugccuggggcacccuuuucaggagaaaggaucuguuugucuuguugguacaguuucucacugcacacuuucugcacacagugccuuugugcagaugaagcccaucuggggugggggucagugagcauuugaagucuaauaaguuaaucgaaugucuaacuuaguuaauacauaacugcacacucugggaaaccuacaugacuguagccuccuggguugccaggaauccacugauacaaagaauuuccuguacauuguuuggcucuuucaagaagauacugaucucugcuccuaauuuguacaucccugcucucugaagagauggaaaaaacccagaguuuugccaguuggcauaugaguuaggaccucagucccucccucggcaccucuggcccucuucuuucuucucuuuccuguuucaaaucuuucuguauaaaucuuaaugcagauuugaccaucagguguagguaaucaguuuuuaaaaguuguuccaccuuuaaaucuuucucauucacagcucauaaaaagcaagugggagguauauuaagauuuucuggggcugagggauauagcucaguugguagaaugcuugccuaguaugaaugacgcccuggguucccuccccagcaguauauaaauugugaucccagcacucuggaaguggaagcagaagcaucagaaguucaaggccagccugagguaucuagagauuuuugagaccugucucaaaaaacaaacaaacaaacaaacaaacaaaaacauguaaggcauuuauuauuguguagaugacagcuuccaauuguauuacugcaggauuauuuuacauuuuuaccuggugggcugucuaauccauaggaauggauuuugcaugguuaacuagguccugaagcaggauaguuagucagaaacuauuugccaauccgugccuuaaacacucagcuauuuccguaguagaaauguuuggaagggggcuagagagauggcuuagcaauuaaaaguguguaacccucuuucagacuccagaggcccugaguucccagggccauuucaggaagcucacagccaccuguaacucuguuucccagggacucugccuccuuaggcaacugcauacauacacacagacaugcucauauacacauuauuuaaaaauguuuaaaggaauauuuggagguaagguguuucugcagcaucuuugagacauccuugauacauuacugguaccaacaacaugucuacacuguguguuuaauacuuugucacaugaggaacuugccaggucucacugaagccugucaaagucugcauucagucugcuucugaaucgcucucucuuagguuguccaugugauaaagcaauaaggugcccugaaacaaaaucaggaaggagccuggaaaucucagcuagcuuaccagggcucagggucagucaccucuugguuacugcaccucacgaaagagggcgacgagguaauggaaaacacugguggccggucaccagccauugggagaagagugggcccugacauguggacaccagugggggaauccauuuagagacuacccagcaucccugccccgugacugcugugacuugccugcccgaccagccccaucagaacagaggauguagccuuugcgcgcucacgggccauuuaccagcccuccccucuggucaggaaaucacaaguucucaguugugaaacuaagaaagaaguggagacucaagccaggcaugguggcacacaccuuuaaucccagcacucaggaggcagaggcaggcggauuucagaguucgaggccagccuggucuacaaagugaguuccaggacagccagggcuauacagagaaacccugucucgaaaaaacaaacaaacaacaacaacaacaaaaaguggagacucuuguucucuacggccuaggaugagaaggaccccagcccuuugcccaggcuguugagugcagauucgugucuguccgugaacuaaaggcccucccgcccauugugcccugugguuauuacugccucucuccugcccaugccuuauaaaguuaaacaaagaaguaugaagauuauaaggaccuugaaaugucagagaaguggagcagucaguuggccacguucaugccccuuuguuucagaacggaaguuccuacuguucuuaauggggagccaaguaagugucccugugucagaaagaaggagaccucugccugggaaccagucagcuuuugaaagucccuugguggccugggagcaaccucuuuucaaguuuacuuuugugacuugugacacaaggcuagagguguuuguuuguuuguuuuguuuaaucuaccucaaaaucuugguuguuuaaacaaggguagagagcauccuggccuugcagcuaggcagcuucaggagcaggcggcacggguucauugcugcgcagccugcacugcaccugcguguucccccauaauccucuguaucagcagcugugugcaaagggaaggagaaugaaacuggaaaagaagcgguuucccccccagccacugggacauucaaggccaaaaaguaauuguuaauagaucaaaauuuacccaugauuuuuuuaaaagaugaauuccgucaaaaguuaauuacauuuaaauuguuuaauuuucuaaauggcuuuuaaagaggaaauccugccuguuagauaugccauguuggacugauuuuucucgugaccuugacagaauugcaguguugacucugggacacgugguaacaagucaguuuaucacagcaaggacagacuagcaggugacagaucagaucuuuuuuuuuuuuuuuuuuuuuuuuuuuuaagauuuauuuauuuauuuauuuauuuauuauauguaaguacacuguagcugucuucagaugcaccagaagagggcaucagaucucauuacagaugguugugagccaccaugugguugcugggauuugaacuucggaccuucggaagagcagucgggugcucuuacccacugagccaucucaccagcccccgacagaucagaucuuaccaucugucuccuguuugccccuuggaucagcaggcgucugcagugucacauggcccuaccgcucugugccugucucaguaaugggaauccagccugagaaguacuuguuccuuucugcaguuacugacuuagucacaggaaacacugugguuuugacgauuugacacuguuagucggccgaguccaagacaggguuaaaucuucucugcuuucuuugcacugugggcuuaauauuuuuucaccuacuaaaguacuuucuuuuuaugaacuuuuuaugaaguuguucaaacaaauuuaaauucuuccagaauuuccuugaacauacaacuuaggaaggugguugcugaguucagggaagaaagagaguugcagauagccaggugauauuaccaugucgugaaguaaaagcccuuagauguaggcuggaacagacaggcugacuaggcccuacccaggcuucacuguguucuccugccugagauguggggaaucgcccgaggagguagcgcggcuccagccucaguuuccaggagggucugaggcugcggcugaccaucugcaggaagaacgucuggaaaguaggagugggaaauuugagaguuguucuucaugaaacccguaagucaugcauauuguuaaggagacaagaauaaaacagugaauguuugcccguggggaugggguuagggguguagggcgcuuguguugugcuccauuguccaaacaaaaggucgggaagguuuuaggggcuggugacuccaggaagagucaacgaagacauuggagcauuugguaaaggaaacaaagaaaugaaagccccagccuggguaggguaagugugguucacagccgggcaguggcaaaccaaaacaaacaaacaaaaaagugugguuuguugcuuaagcagauaacaaggaauaauaguggguaucuuagagccucagauuuguuuuguuuuguuuuguuuuucaagacaggguuucucuguguagcccuggcuguccuggaacucacucuguagaccaggcuggccucuaacucagaaauccgccugccucugccucccaagugcugggauuaaaggcaugcgccaccacgcccagcugagccucagauuuaaauguacaauuaaaugaguuagccaauagguaugaaauacugagcauauaaccuauccucccaggcuucuacuagaaauaguggguuuauuuuugguuuuuaaguagauuaacagguaucuaaauaugacuuagcuuuuuugcaaguucuuguauguauguauguguguguguguguguguguguguguguguuacucauccagaggacaagaacuauucccagcacccacauggcagcucaauacccucuguaacuccaagaucugacuccaucacauagacauacaugcaggcaaagcaccaaugcacauaaagaaaugaauacauuauuuaaaaagagaaugugaaaauauaagaguugugcugguuaccaagcuauugacucaguuaaauuuuccuucaaaaaaggaaaauagccagggagugguggcgcacaccguuaaucccagcacucgggagacagaggcaggugaauuucugaguccgaggccagccuggucuacagagugaguuccaggacagccagggcuacauagggagaccccaucucaaaacaaacaacaaaacccauaaauaaauaaauaaauaaauaaauaaauaaauaaguuaauuuggaagcugcuuuauuagucuaugcuuugagucaagauaaaaaaccuuuuaagaggcuggagagguaacugggugguuaagacugucugccauucuuucagaugauacaaauucaguucccagcacccacauggcagcucacaaccaccuguagcuccagcugcaaggaacucagcgcccuccucuguagucuguggugcauauccgugcacauggacacucauauacauauaauuuuaaaguaguaaaaucuuuuaaaaauaauauacaaauauucauuuccuauauuuuggcauguuuagcuuuuuuggauuuuguacuguuagaugcaaaaccugcacagaagcacucuacaguuuacaaagcaggaaguuucaauaaucucuccaggugcuggagccccuggaaguggagguacuggcggcuguuggccuccugagguggguccuaggguuugcaagagcagugcaaacuucuagccacugggccacugggccaccucuccagcacgcaccauucaugcuguauuuaagaacaucguugugauauuguuggugcucaagcuuugcuggagcaggguugggaauguggcucagggguagagugcucgccuggcaugcgugaggccuuaguucaauuaucagcccugccgguggcacccagcccucccccaaaaaacgaguugcugauugaguugaugagacacuccuuaguauucauccuucagcuuuucucuuccagugaauuuuguucuuucuuuauuggauaaugagagcuauguuucccuuucugacuuagcuaccgagaauuacuaaacuaaauuuugaauucauuuacaauaacuauacuuagcacgggaugucugcagucuucacuguggaguuguaaaauauuuauuuuggggcuggagaugucgaucaguugguagaaauguuucugggcacgcacacagcccugggcuugcucuccagcaccacauaagccgagagccauagggagcacaugucugugauucuaguguuuggagggaagagacaggaggaucaggucaagggcguucucaacuauuuagggaguuugaggacagccuggucugugugaaagccugucucaaaaauuuauauucauaauggcugauuucaauguuagcuauugucaguugucucauauccuuaguauggaaugagcaaugaacaauauaguaagugagcugagucaugagugacagcgaagggucacuccagggacaccaugguuagguugggugaaauaguacuggcugcgggcuggagaggugguccagugguuaagagcacucugcugcucuuccagaggauuagaguucaguucccagcacccacaggguggcucacagcuaucaguaaccccaguuccaagagauuuacugcccucuucuggcuucugugaguacugcauacaugugguacacagcuauccaugcaggcaaaaugcccuucccauaaaacacaauaauggugcuuauccucaugaagagaaugcugucucuguucucaguagaaaagaaaccagauuacugaugagagccgggcaggggugggcacgccugcaaucccagcacucaggaggcagaagcagccagaucucuugaguuugagcucugccuguucuacacaguaaguuccagaacugucaggguuacacagagaaacugcuucaaucaaucaaccaaucaaucacugaucagagccucucuaacuaaauggauaaauaaaugaguagcugaucagagcaucuccaugguacuaugugguccguuuuccuucaguuguauuuucaguuggcauuggacuuacuaucuaauugaggaucacuuugaauuuuugacuuuacugccucuucugaguccugggauuguagcucucaaccacacugaguuucugucagugcuagggauccgacccagagcuaugugcaugccaggcaaguacuuucccaucggagcucugucuccagcccugaguauguucuguuuucuaggcugaaaacagacuguggcagggcagagugagacacagacccgcauggagagugauaagaccacaguggucagcgcuugucugucugcacccaccaucuaaacuuuaggccucuuaaaggaugcuuuauuaauuuuuauaucuaaagaacauuagcguaucuaacagagggugccuugaagccagcuguggaguucaagcugacuuugaacacaggaacuuccuucauccucuauauuacagugcuauauuauagacaugcaccaucaugagcccugagcacaacuuucagugguugucuauguccacugcagaguguaaggccgcaugcagccauggcaguggcucuguuucaccagugcggagcugaaauguuaaaggauuuuuauguuucuuuuccuacaggggacauggucucgaaauaccgggaaccuuugauccacaccuuccugcggggagugagagauccagaugcugcacacagggccagcagcuuagccaaccugggagagcugugccagugccugcacuuccugcugggccccgugguucaugaggugcuguaugcagaguuguuuucccugagacugugauaacaugggaucuugagucagaucuguggucuuucccaucuguugcugucuuccucugacuggacagaucagucauuuaaccucacugggcuguccauuuagacucccccuccucaacuuaguccauuuugaagcuguauuuauuuuuaaauauuaaacaaagcuuuccaugaggagguuuucauguagguauugcagcucccagaggaggaaucaccugcugagcccgggagccacagccuguucuucccuuccucccuuccucagugcuuccuggcuucucaugagacaguacaucuccuaagauuuaucggaggguccagaguguggaaggaggcauccagggauggcacccucugcucugagcgcacacagccuuuauauaggcugucuucggggguggagcucucuuaggggguggagcucucuuaggggguggagcuuucaagggcagagcuuucuagcaugagcauuggugggauuucaaauccugagcuugggggagcucagggauuaguggguuuuccuguccaaggauugguggguuuucaugcucaaaaaaugguuggguuucugugagaaguucagagauugauggguuuucguauuuagggauugguggcuuuuguucagacuuuucaccauaaauuagcauaaucuggggaggguccuguuaaggagcuggagaugacuuuugugauaguugcuuaggcuagaaauaccguucugacaguuagggaggucuggagaggggccuggcugcuggagcuccucagguguggccuugccacucuccugcccugaggguuuacaaaguuuucaaagggagcccacagcagggaaggcacuuaguggcauggauagccaacacuacaccuauggccuucuuuucuaccuuucacagucccuauuuuaauuucaugauuucuacacacacacacacacacacacacacagagaugcaagcuugcaggcagaugaacauguacacacauguacagggcacauauauaaaaauaaaauauuugauucaaacaugagaaaaagccugcagcauuugucuuuuuaaauguaagauacuuuuuuucaagauaauuuucaguucaacucacuuucuuguaacucaucuauauuuucucauugugugugugugugugugugugugcucaacccauuuucuuuccucauucaucuuuugauagacaucuagguugggcuuguuuccuaacucuaguggauaguacagcaaucaagcauauaugugcuaguagaucuaugguaggacacagagcccuuuggggauccuauuaauuauugauucccuaauaaucuauauacuugucauaguaauuuguuaccuuaacuuucccuauuuguuucuuuauugaaagaugucuuucaaauugaacaucucuacucuaaaauccacaauguugaugccaauaugaugucacaauuagaaaauucucuauaccaugaaacuugguacaauccauaaaauuauuuaaaauguuguauagagccaggcagugguagcacacaccuuuaaucccagcccuugagagcagagggagacagaucuccaggcuuaaggccagccuggucuacagagugaguucuaggacagccagugcuacacagagaaacccaaucuugaaaaacaaacaaacaaacaaaaagguauauagaauuaucuucugaccaacugucuaaaauuuauaugaaauauaauuaaacuucauguucaacaaaaaaaaaaccuaaacuccauaacaguuuggucccaagcauuuuagaaaagaggcgcucggcccgugcaguuagagucucaaguuccauuuuccucacccgugcauagaaacaacuaguaaauuguuggaaagauucuggugcagcugacaaaucugaagaagcuuugagguugagcuagacugaccuuuucuucauugucuggaacuucugggagucauuucuauuuaccaaaaaagucuuagacaaauacucuuugauggcccuucuuggucacacaggcaccagguggucagcucggaacccccaggaaccauacuuacuguaaaauuaugaggccaaacagucccuggacaucguggucccugaacccaaacgugaagaccacuugcuuccuccauccccggccuagucccugucacuuagagaugucacagcauguagcagagugagcuaucuuuuguaacaccuaggaaaugucggauuuuguuucucuuuucauuauuggagcccccccgacauguugacagcaaaccacauuuccaggccuucuugggaguggggcuggggcccagcuugacccuuuacugaccuguuucacuugagcaaauggaucccgugggcuucuuuguuguugguuauuuguuguuguugcuugguuuuacugcagugugaugaggcggcgucugugucucauguaagaucuauucaacggcuuuucuugggagccuacuacaugcccaagcaguuucccgagacaucucauucuucagaguacacagcagugcuuaucuuccuagaaaugcuucucuaggagacagacaguaaagaaucuccagggcugggcccgcgagacagcucagaaggucgggugcugggucagagccugaugagcucuuaaccccaggacccacgcgagccacugaucaaagagaggcuuuaauguggcucacaggcugucacgguggggacauugcagcaagagcaugaggucacacugaucuacaaacaggaaagcagagagacagugcugccugcuuacccucuuuaugcucuaguuucuaucauaguucuuggccuguggugggcacuguguuaccugauuaacggcgacugcagagggcaguaaggcuaucugggaaggcuaguccccacaaguuugaaagucgucauaacagcgggcaguuaauaccuuacauaugccaacugaucuagugcuaacagaggaaacugaggcacagaaagacuaaacaaguuaccaagguaugcagggagcagguggcagggcugggauuugaaugugggcaguuccaggauucacccucucuaccauuuuccugaauugccuugcaaauguuuucaguuuacuuacaagauugccuuugugucuugaaacgaaacaguacugccauuugagaaaagccacaggcagcagcucuugcuuuaauagagccugaauuggggggggggagcuucagacagcaauguauucucucugauuugaaaaacuguuucccucccauauaauuucugccugcuccucuuagauuuucuucuucuguagcaucccacgcuugccuugucaucagugccaaagcagcuaccucagguggacgacaaguuugaacacgcuuggagaccugccaggcuuaccguuucauccucccagcucuucuuuagucauucacaugaaaagagagggggaucuuugcugugcacgcugcacgugccugcgugcaugcaugugugcauguguguuugugugcaugugugcuugugugacagagagagaaacacacagagauggagauggaacccagaaccuugcauaugcaaggcaagucuuucccacgagcuguauuccuagccauuguuuuuuccugagacugccacagcuuucaagauacuugaauuacaaguaugcuucacucucauuaucaacuugacuggacuucuagcccucucuggcuguugguucugugaggguaauuuccaggagauugagcuuagaaggaaagaccugccaugaaugugguggucccaugaucugggcugaauaaaaagagacaaaggggaaaccagcugugcacuagcgaucauaugucccugcuuccugacugcagagggaagaggaccuuagucaucuucugccaugccuccccacuguaauggacuguagucucuuauacuaugagccagaaucaaucccuccucccuuaggaugcuucugucaaguguuuugucacaagggaaguaacgaauacagacaauugauaccaagaaguggagccuuugcugugguaacccugaccacccagagaagggcaacggucagcugccaaggucccacagaggccacuauaacugaauagaagaggcauucugggucucaggcuggcagcaacacuugaugacaucauccauaggcaugcaaaaugcaaguugucaugcgaggaugcaccaagguuucagugcaugguggggugggauucccugcagggaggacaucacaggcccuugggaaaaaauaugaaggggaaucuaaauugaaauggaaaccuaugauguuggagcuacaggacccugagcucaggcucagagcagacucagcugaagggagaacugcauaugacagaacuggaggaugggggcuuccaugcauacaugaugucgcuaagggucccaaggcgccagauggagagguaggguuuaguucuguucugagguuucagguuugcuuggucuuuucuggauauucucucauucuucccuauggaagcguguuuagccugugccguuguaucuuagacguauguuuuccuuuuuucuuuucucuucuuuucuuuccuuuucuuuucuuuccuuguuuguuuuguuuuguggggcucacauuaggagauugccuuaaguauuaaaugagacuugaauagugguagaacuguuaagacuuuagagccuugaagaauugacuuugccuuaugagauggcucuuacucuuugaggacagaaggugguugugauuuuaaggaauauugugauuuuuaaagcaguguguuuagccuggcagugguuugcacagaccuuuaucccagcacccgcaggcagagguagaucucugucugauggagguauauuuguaguuaaucuucauuugucaacuugcugggauuuauaauccccuagaggcacacucagagguaucaauggagauguuucuagagagguuuaacugagaagagaacacucaccccaugguuggagucucagacugaaugaaaagagaaaggggggagauaagaugaaauucugcauucaucugucuaauuccuagcuguggcugcaaugugaaccugccucauguuccuaucuccaugccauuccacagugagagacugcauuccuucuuacgcucugagccaaaaugaaucuuuauucucuaaguuguuccuggaaggcauuuggucucaacaaugaaagagauaacuaauaaaacacugcuuagcugcugauuuuuuguuuuguuuuguuuuuaggaguuuuguuuuguuguuguuguuuuuuuguuuuuugacagaguuucucuguguagcccuggcuguccuggaacucacucuauagaccaggcuggccuugaacucagaaauccgccugccucugccucccaagugcugggauuaaaggcgugcaccaucaccacucagcagcuguggauucuuuaguaggucauuuugcuuagucauucaguacacauauuuugaacauauacucugccaguugggccuacagccaagcuaugugcuggaugguaagagccagaugugaguacaggaaaaaucucuguccucauagaucugacacuuuggagaugaggcacacagaguagauaaauaaauauaucacgcacaacggcaagucaccuggaaguuacaccuacugagauaagaggcaguuuguuguugaacacaaaugacauggacaagcaaaguuuuccguuaagugacaucugagcaaagauguaagggaagagguucuccauguaccuggaggauagcauucuagguagggaccuaagagggggaggguaagagaaagaguagaagccagcguuggaaagggggucgagaguccacagagggcuugcgucaucuuugggcuuuuccuuugugugagaugagcagacagagcagaagaaaugcagugaucugauuuguuccagaucacugugacaucuucauuagcucuucagcauuuaaggaaggcuacugaaaccuccugucugagagguaccuagccuccggcacugagagagaaggaacauuaacguauagagacaaaggacucuuucugucaagaaauaucaguagaauaaauguauaaaauggaugacaagaaaaugauugaguagaccaagcacaaagggcgagcacaaagcugggacccugugugaagucauacugaugagugcuaggaagaggaggcacagucauacugaugagugcuaggaagaggaggcacagucauacugaugagugcuaggaagaggaggcccagucauacugaugagugcuaggaagaggaggcacagucauacugauaagugcuaggaagaggagacacagucauacugaugagugcuaggaagaggaggcacagucauacugaugagugcuaggaagaggagacacagucauacugaugagugcuaggaagaggaggcacagucauacugaugagugcuaggaagaggaggcacagucauacugauaagugcuaggaagaggagacacagucauacugaugagugcuaggaagaggaggcacagucauacugauaagugcuaggaagaggaggcacagucauacugaugagugcuaggaagaggaggcacagucauacugauaagugcuaggaagaggagacacagucauacugaugagugcuaggaagaggaggcacagucauacugauaagugcuaggaagaggaggcacagucauacugaugagugcuaggaagaagaggcacaaucuacuuuguuagaaaguuggacuagccaugaaacuuccucugaugcccucugccuggggacauuugccucucgcuguagcaucugaagagaaguguccggauuugucagugguccagguuugggagcauauuguauuucauaugguguugacugguugggaaggaagagaagagguucaucuuccaucuucauacugggaauucaaguuuuucuucuuuguugaugucaagauuuggccuguuuagcguacauuaucauuuuuuccacacuuucuuguucauguuaaacacuguguugcuugaaaccaaaucuugauaggcucuuucaucuuuaucacacugugugaaguaaugugaucuuagugcaccacaggaagaggccuguccucaauccagcaaauucggugugccccaggcgaaaggccuuugaacagucuacuuaaagaaaugugcaaaauuccacauacuugagcugugaauucugguaccagguuacuguuuauaguaauuacuuuucuauugcugugauaaaacaugacugaauuaaccuuuguaugaaggaguuuauuuggucuuacaacuggagagagcuggugguggagugaaggcaugguagcaggaagcugaaggcuuacagcuuuucaucuuucuuuccuuuuuccuuuuuuucuuuuuuugagacagggucucucuauguagcccuggcuguccuagaacuuucuuuauagaccaggcuggccuugaacucacagagauaugcaugucucugccucccaagugcuaggaucagaggugugagccagcacauccagcaaggcucacauugugaaccauaagcauaaaauaaagagagcaaccuagaaauguugcgaggugaacacucagagccuacccccauugauguacuuccuccagcaaggucauaccugcugagggucccaacagcacuaucaacuggggaccacguauucaaaugccagagucuuuggggguauucuuacucaagguucuccaccaucaguguaguuuccuacguggcaggguaccugagaggagaccuuaaugcuuggggagcccugaagaagcucaggucgccaucaugguuccuagcagacugagugagucaggugagcucauagcaaaugguggcuugcaguuccccaguggacugagcgucagacacuuuagcacacuaacugaauuguaacaaacaaagcucuggggaagggaagaaagacagcugggauauugcagucguguuuucuugguucauaccccaacuccaguggcuucccuccuggaugguccaaagucgguuauuggcaauuuugccauuugauugguuaugguuauguuugcauagucuuacuuauacuuggugugugccagcucuuuggggaaugaugguuuuccaugauucaaccugugaagaaaaagccuuuagcagucuuguuuauuagaauucguacacugacucuuggagcaagugucauggauuaacacaaaaugauuucuguccugugggagaacguagaauuggaaaguggggguguuauaccaauucauaaauuaguaaagaucuuacaucaugucugugguucagcgagacuucuagagauggaaggcaacaaugggccuguccuuuggaguuggaggugagagacaagccauggaguagcuggucagacuagacagguagaaggugacagacagccuugcagucucccugugucuugugucagacagaagcucauggcagcagccuacaggaagcugcauguaagcugggccuuaggccuggccugagcgaaaggagcuauuucagccuuuaaauagcacaaggccauacaaaaaucucagggccuugauaagccauugcauauucgaaggaugugguccugguggcagagguauugaagaagguccaugggacucuuccauucucaggucccaggcagugauugcccugcugcggccugccaucccagcagucccuagaggaacacaguucuuuccacuuuaccuucaagauaccauagggacugaagaauuaacuguaaagagaaagcccuuuuccaagcaggaugcuucucccuggauauccaaaugcuagcuuaacagugagagccaggcucucucacugagaacugaggcacagggaggcaccaguaggcuucuaaaaggggaaccaugcucgcccaaacuggaaucauggcucucaagcuaaaccuugagaggcacagacaagcauguaggagccuuggcuuaggagauuguucuggguuggcuuccuauguuaugaaagucuggagaacuuucaugugucuggaaagacacagccuagcuguaacuuguuucuccaccuucaguuccuaucuuguaaauacuaagcuugaaaguagagguagcuauuauauuguugccucuuuggaggugguccaaggaauuccuccuaggacuaaaaugcuucuaccguuaaugccaggggcauggaaguugcuccugcuggccuuggguugggaguucuagguccaaagcagagaaguagcuuacuggaucuuacugaacaauggcucuccguagguugcaguuucucuagggcuugucuucccuuccaaacugcacguuuguguaauggaugcgcgacuugacagaaugccagcgcauggcagaugcaauuauauuucagaacaagccuccuccuucuaaucucucugccaucacugauuaauuagauacuuugaacucugcccaacuguuugaaagcugugaaaaauacaaccugcauaguuaaaauuucuacacaagccaguuuccucauugugccugcauucuccaugcuuugaacauaauaaguauuuauacauguuuucuaauacacgaucuggcuauuuucuuaucacggcuaaaauucccuccacuguuagccaagaagugcaagcacacaaugaaaaccuaauagcaaaacuaugugagaaaccagcuuaacaguuuagacaaacucacagucuguuaguaccacgugacacacaaguccugcuugucaucuugaaacuugcaugggugcuucagaaaagcugguugucucuuuauugaaguuuuacaguauuuuucugcauuaugacaaacagugguagguuaggugguacaggauuagagaaucucucuuucucugucucucccuuccccucccccucccccucucccacucccuuucccucccuccuccccucccuccuccccucccuccuguguguguuccagcuucaaacucagguccucaugccuguacagccugcaguaccaacagugcuacccccagccccacacugcucuguuacauacaauuauuagguauguauauauggcaccagugcgugcguguguguguguguguguguguguguguguguguguguguguauccgaggacaguguucaggggucaguucuucccuuuccccuuucuguggguuucagagauagagcucaggccggcaggcuucaguaacucaugccuccacccauuuaaccagcccacagcaccauguuuuacaaguagauuccuuucugagauacaauugucagggccugagugcuaaaagaucuguuccacaaaggaaggaacucaggcagaaucaaucucucucucucucuccuucucccccuccccuccccuucccucuuucccucuccuucucacccucccccuucuccucucccuuucuuucacucccucuuccuuucucucuuccucucccuccccccucucuuccccuuccccacauccccaucccucccccaccuucucuuucucuuuccuuccuucuugugugggcacauuucacacucggguccucguacuugaaacuggcugugcugacuucccagaguggacacuagguuugcagggcugggugggcagcagaggggaaggagucucucucuccuccuaacccugugcugcacagaggcuuaagaacaucuggccgggaacugacacuccuuagcuagguccuagcaccuaccaugaccagucccuccuuccucugaugugaaguuccgaaagacgagcaccuaacacccuuucccuagguuuagagagaaucuugcauuuugaccuuuccuuuuuucaaaaacucccugguuccauccaugaauuuccaaucagauuaugaccuuuuccaggaaagcuugucuauaccaaaccucugccacuaaaucucagcuucuucuuuuuuuuuuuugauuuuccgagacaggguuucccuguguagcgcuggcuguccuggaacucacuucgaggcuggccuugaacucugaaauccaccugccucugccucccaagugccagacugcuccugaggacugugacugagagagacaguuggaggccuguagguaauuaugcaacccugauuccucuugacuucucccaucucccuccuaggugacagccugccugauugcuguggcuaagacagacaaugauguucaagugcgcagagcugcaguccacguaguugugcugcugcuucggggacucagccagaaagcaacagagguaagcccgccuccccuuccuuccguuguccugauauccagucuucuuguacagguccagcucaacccuuuucuuagauaugagcuggucaacagaguuuucaucauuugcaucuccagcuagagucucugcagugcauuagaguugcacgguaacugacucaggaaaaccacacaggcuuaccgaggcccugaguccuggcacucucgcggggcagguuccaaggugagcuuggagugcagucaccgugcucugcagucugaacucuggugagugguauuucugacucacuccguuguucaugcuuaggcacaagaggcuucaugucagagacuggcuuccuugccaggccugacuucaguccauacuuccacuguggcacuuuuuucuuccuucaggggguuugauuggaccucucccugguguauagcuaauauaggaagaaaguuuaugcauccgaaugugugccuagaucaagugaccucaaauuaauuucuuucuugcuucuaauggaaccgccuucccagcugauuucagauagagccugcauuaauaauucacuugcuggcacacacagacucaucuguggccugcacaucaguauuuaaccaaaccuccaggaagccauugugagagugauuguucugccacacagaacagcuuuauucaugcuuauaguuaccgugucagguugcggaggccuguuuguacauguaggcacucucagucacccucuucccaccucacacagccaugcuuccuccaucaguaccuccuugccauuguucagcccggcagcugaacuuccaaagggccacuucccugaucgucacccucagcugcgccucucugccugcccgccuucucaugcgcccugucuguggugcggguuggccugaaugagcucauguggcaugaacuuguuuuaaaagccugacuaucguggccucaacaaguaaggaucuguuuuugucaagucucaggaaccaaggauagcaggagagacaguucuaggcacauuuacacccuuugggggggggggcaguuuccuagaaucaccaccccuaccccaccccaacuuacuuuuguuuuauucauuagccagaaugcucaccuaaccacuccccacuguaagguaucuccauguugcaguuagcuggcacauuucugcuuggaacagaaucaaaguuuaguuagcaaaaaggaaggcaggaaauggauauugggacuguggcuaauagugacucaaaggacguggggagaagggucuggcugagucaccaagcuucucuagaggagcagugugcagugauggaguucucagggacgcgugcaccaugaccugacaauucauagaauuaaaugaauuauaaauucucaacaaaacacagcucuuauggaaaaccuguuguacacaugagaauuaagaaacaucuguguuaggugggugguggugcacgccuuuaauuguagcaccaaggggcagaggcagguggaucucugaguuccaggcuagccuggucugcagagcagccaaggccacacagagaaacccugucucaaaacaauacaaugcaauacaauacaagagaaaagaaaaagaaagguuugcuguuuucugucuuaguuaagauccacagggcugggauguagcucagcggucuagcaccugcccagcacucagcacaggaaaagcccuagacucaaucaccaaccacucaagaaacaacuuaggcuaggcuuagugucagauauuuaaaauccagcauuuaggaagcaaggccgguggaucaugaguuuaaggauagccugggcuacagagcaagagccuaccucaagcacaacacaacuugugaagcuuuuggcaaauauaucaugguccccguguuguucuuguugcuguuuuuuuuuuccuuuuggggccagggguugauuuacauguucuagucugcacuaaacuaugucccuacucaauaucacuauucauauaaauugcuaauaacugggaagauggggugaggggaauaucgggacucuauauuaaaaucuucuauaagccuaaaauuaauuaacaauaaaagucgguuuaaaggcuggacacauggcucaguaguuaagaucaugcgcuguucuugcauagggcccaaguuucauuuccaguacccauauuagucagcacccugcuuccuguaacuccagcuucagccaguaggauauauaucugaccucaggcacacacagauacacaucuacacacaaauaaauaauaaaauauauuuaauauuaaguuacagcuuuguaaggagaaaucuaagcucaguguguugguuuacccucguaaucccaaaacuuggaagcuagaagcaggagggacagggguuaaaguucauugucugcuacagaacaggagcuccugggccgcaugcauucaaugaagcggaucucugagacucuagcuguggaguguagcuuacuuggaaaccucauacuucgugguuaaaggcccugauuuugaccccuaaggcccaaaaagaaaaaauucuguuaguucaugaauccuuagcaagugugaguuacaguaugcacacaugaacacacacaaaggagaauguguaugugugugugaguuagagagaaaugaugggcuugcacagugaaagaugaagcggaaacuccaagccagcugugcugucgugugccugugauccuggcacucagggguugagagcaggaggaucagguggcugcgcuggcuacauggcaaggucaagacugacauggguuacaggaagggaaaugaacggaaacauuauccuggugucucucgucuguaacuagcuaauggaagcagcacucuaccucgucgaacaggaaucagccuguggucuugcagaucuuugucacuuucaaaaugugguguagacaggaaaugccucuccuguucuccaagccucauucuacucgcacucacugaaacuuauagguugugcuuacgcagugagugaaggaaaggaaggaggacggaaagacugucuccccacugcaucccugagaccagguguguggaaucuuguaagcguggugugauuacacccggggcgcuguaaugaguggagacacuggccagagcucacgcugacauuucuccuuggagcuguuuugccccccaggaacagcugaagugaaaacccugcucuguuggugaaguuguguauuuucuguucugucccgcuccaucacugucucuacagcuacagccagaagacaaugcuggguuucaucuguugcucauggaugugaagcccagaaccuguggugauggcaucuggacagggagggagagggauagagcaggauaaagagggaagccaccacugcucuuaguucacgaggcaguuuuuagcucauucccauuugaaaguagccagaguuuuguuuuguggcagucaacccaaaaucuguaugcacuuucucauaggggggaagaugggucucuucuuaacuuuguuuuagcuuuagaugguaucuauuuaauuuacagcaugacaguuaauaagccagaaguuaccuucuuuaaacuccuaucuaccuaaccuuauugaaggauaaauuugcuaagaauacccaggagaggcggcauggccuguucggaccuguaacuaguguugcuuucagagguaagaacagccuucuugacacagaaagagcgagcugggcaacaggguaaagagguggcacgugacucccacccucuucccauguuugaucucugcccagggacuugcucguucuaugcaguagucuagaauauacacauucauaaauuuauuccaaaaacaguaauuagggcaguggacguugggcacuguccugugacgcuggcacugcuucccagagcagccacacagucugugugauacagugagcgaccugccugagagagggagcaggcagguuuaagaggcauccaggcuuagagggcugacugugugcacaggagugucugucuucuuggcuuucacugcagggacaaaguuaagaaguuauuugcugaggcacacaguacuguagggacauagcaaggaggacuucuuagcccauacuggaaggaguagucuaagacagcaagcuggugagaagagacugacaaucugagagaagaugcagagagcaggucccaguccuguguguuuuugucuguggcuaaccucugaagcaggcaguauagcugccugcuuuacaaaacaaaacaaaacaacccagagaauccggagaaauggccaggugaguaagagcacuggaugggcaagcaucucccugugaccccagcucucagcacaggaacauguguacugaggggcaaggcagcgaggacaggauggccaggccaccaguuuagcucuagguucaaagaaaugagagagcaaggggguggagggagagugagcuauaccccugacauccuccuuuggccucugcacauguaaacagguacauguacacauacaagcacacaugcacacauguguagucauauacacauaugcacaugaaccacauucagugcacugauacacaacacacauaaucacucacacacagaaaauaaauaaauaaauauguagcacagugauggaacacuggcuuaccaugcacaggcccuggguucaguccccagcacuccaaaaagacaaaaggaaaaaagaaagaugcauccuuuggaaagcaggauucaggguuuccauaacuucacauuucuaauaccuaagguacaauucaaaauugcacaggcuggggcuggcucagcagugaagagagcuugcugcucucaggaaggauccagguucgggucuugucacuggcaugguggcuaacaacugucuggaacgcccucucuggccuccaaguacauucauugcacacuugugcuacacaaacacauaaaauaaaaaauaaguaaaccuuuuaaaaaaguuacuggauguauuuaaaagaaaaaagagacaaugaaaaaauaaaucaguucaaaaguagaaguuaccaauucuaggaacaaaggguuuuguuucuuuuuaaaguacuuaaaaguaaaugcuuuagcagagccaaggcuauaaggaaccugccuguuauuuccagugggaacgaaacaccaaugcucacugauucuguacucagugacuuuauaaaguguaacuaccaugaauaauggagaaauggaaauaaagcuacauauauaauaggaagaagggagcagccgggcauggugacacaugccuauaaucucagccccaaaggcaaagaaagacaagaggauugcucaaagccagcccagucuacacagcaagccagaacuacguaacaaaacucucaauuaaaaaaacaaaaacaaaaaccuggcuguggaggggccacugguaggauauguugaagaggggcucaggaguuccaggccagccugagcuagacauauuaaacaaaaaaaggccuggugaugcucaccuguaacacuagcccuggagaggcuagaagagguaggaagagcuuugugaacucaaagccacccuggucugcucagggaguucuagacuaucuaucuaucuaucuaucuaucuaucuaucuaucuaucuauagugagaccacgucucaaaacaaacaaacuaaagugauuuaguguugacuauaaaguaucuacauaacuugugccuuccgcauaguuuucccagaagaacuaugacagcuuagcuucuuuugcauguaguuugcagugaccaagcauuuuguucugaagcucaugugugaagagguauguagugguacacaucuguagucuuggcucugggagacuaggcaggagagaauuuaccugagccaucuuaaaaccugccucaaaagaccaaaaagaaaauuccuccuuccagccccuaacuuuaacgccaacagaguacucucucucucucucucucucucucucucuguuaugucuagugggagaucagcaguagacuuuggaauucauucuuucaaaaugagaaaaaaaaacaauuauuuucuuuuuuuuuuuuuuuuuuuaaagauuuauuuuauuaauauauguaaguacacuguagcugucuucagacacuccaggagagggcgucagaucuuguuguggaugguugugagccaccaugugguugcugggauuugaacucuggaccuuuggaggagcagucgggugcucuuacccacugagccaucucaccagcccacaauuauuuucuaguauguauuuacugugggggcugugcaugccacagcguguguguguguguguguguggggggggggguuauaggacagcuuucaggaguucauucucuccugcuaacauguaagucuuggggcucaaacucagucaucaggcuuagaggcaaguaccuuacccacugaaccaucuugcuuccuggaggaggagggaaggaaagaucuuaacaacaggucauuuauuugaaaauaaagcaagccugcaguuucuacagggguagguguuugguuuuauuaauuugaugguugagucaacuucugaaucagaugcaagcuuucauccugcagugacuuuuuguuucaaguacagcauuggaccguuuuguuggauuuuguuuauuugguugguuggcaguuuguuuuguuuuguuuugagacaagauccuuuguagcccaggcugacucaaaacgcacuauguagccaaggauggccuucaacaggauccucugcuuccaucgcuugugugcagggguuacaugugaagaccaccauguguagcuuuuguuuuuugagcuggggugucuuagucuuuauugcugugauaaaacaccaagaccaaagcaacauccugaagaaaggguuuauuugacuuacacuuccauaucacuguucaucauugaaggaagucagggcaagaacuuggggcaggagcuaaugcagaggccaugaaaguugcuuauuggcuugcuuacuugucuugcucagccugcuuucuuauggaagccaggacuaaccagcccagggauggccccucccccaucagucacuaauuaaaauaaugcacagguuugcgcacagcccaaccuuauggaggcauuuucucaacugaggcucccuucucucugaugacuguugcuuuuauguuaaagcaaugacauaaaacuagccagcacacggaaccucuauaaagcccaaacuagccuagaacucacgaugaucugcaucugccucagagugggaucacaggagugugccaucauagcugacauccaguguuaggcucuggugguagaagccucccucuuaacauuguuauccggaaggcacgagugucuguacaguucauacucaauaaagaccaggcauuuaauuauuaauuuaauuaauaagaauuaaucuuguguccggcguuguuuguagugucauuggaguuaaaaguugucaugggauuuaaaaguaacuuaaguuucuaaguugucuuuugcuggucuguguacugggcgcuguccgagggggucugaggggcucugaaccaacuggagcuggcaaagaguuaucgauuucugagggaaagccagaguaaggugggcuguugggccucuuccguggcucccacugccccagaguugguggcagguggcaggaaagcuucaggagagaaaacuucccuggagcauuacggcacaauaagacaggcacacucaggugaucuuuggugucuuuggcgaaauaacuccugcacuuucuuccuuguggcuaggacuuuauaaacauguuggguggguugggaucuagaggcaagugcuuucuauuggcuuggucugagauguuagggauaccuccucuguauguggaaggacaucagguguuguccccuaugugacugauugucacagucuucucaauggggugugguggucauguguuucccaggacaggaaccaggccgugagaacgccucccauucucaguuaugagaauugcugggguuccugaauccauuggaccuuaguagguccucugucuggagugguagcacaguccacagcccccagucuucuacgaaccuuccuuuauccucuccaacucaucaaccaagcaacacuaagugacuguagauucugucgcauugacaagcaguaucagccaucauuaggucuacccuacugcauuauggccuuauuuagaaagaugugaccauuacagugacccuguuucuaaacaaggucacauucuggggcacuggauuucaggacuucaguguagcuuuuucaggaaguagaaacacacagauccuaagaguccacggcccucgcucuucacauccauccugcuccauugguuacugcugucaucucagaagagccugugccuaguauggagucuccacucuuccucuccuuuccaccuuccagcuccagcaagacaagaggagcaguucuucugucaugcuuaccuugaaagaagucaauucugucacaugaacagagaaaacaaaugagaaacccaaggagauauacauauguauaguauguauguauguauguauguauguauguauauaguguguguauauaugaaguauguauguguguaguauguaugcauguaguaugaauguauguauguccauauauauacauguuguauguauguacguaguaaacaagauccuggugcaaauucugguuuuugugaaaaucccuagaccucuguaacccucuuuucacgucuguuggaucugucugacacagaagugcccaagggagguggcucggcauguaugagccccucugacucucaagguugucaucuaagagcagugaugaugguggucaccaguggccauuacagugcugugcugggcuucugcugccaucgucaccacugcacaaccugcuaaacucucuggcccacuuauugguuauuuugcucuaggguuguauuuuucuuguuuuaguuucuuuugugauuagauucuuuuuauuccuucauuucuuuuuuuguggcagaaucuccuguagcccaagcuagccucgaacuugccguguauccaaggaugaccuugaacuccugaucucugccuucaccucucaugcugggauggcaggugugcacugucauguuuaguuuauauggugcugggcauagaaucccaggcuguuggcucacgugcuagccagguacuggacccacugagcuacauccccaguccuuucuuuauuuccccucaccccugccaaggcuaaucaaacucaagaucuaacaaauacuagggaagcauucggccacugagaugucauaaucccaaccccuuacagugacuagggaagcacuccaccacugagauaucauagucccaacuccuugcagugacuuuaaaaaaaucuacuaaagauaauuuuauagacugaucagauuauauccauauggaaggauauguaauuaacuugauaucuauaauuuuacaauuaaguuuauuguagcugaugcauaagaacacaaaagcacauguacuaauggaaugacuuguacuguuuuauacauucauaaaaacacuuuuggcucagaccaaguacaguaucaugcauggauguguacaauaacuuuagguaccucacauuucauugugccaggcacucaccugucaccaugggucaucucaaaacaaaggauuuuuuuguuuguuuguuucuugagacaggguuucucucuguaauccuggcugucuuaguacucacucuguacuggccuugaacucagaaaucuaccugccucugccuccugaguccugggauuaaagguguguaucuaccacccggcaaaaguggucguguuuuaagccaggccaucugacccuaaaaccuaugcucugccugccucuaccauccccuaaauuuacuagauggccuauguuguaaagaaagggcacagaaaaauguuuaauaucuguguaugguguaugugcauguguagauguaaguguacaucugugugggagcacauguauacgcagaugugcauagucgaugcugguguucucaaguacucaguuuuauuuauugaggcagggucuguugcugaacuugaagcucacugauucuagcuaguccagccagccagcuugcccuggggaaccccugucucugacucuaaaguguaaggauuauagguggcuccuacgccugccuggaguuuuguaguaguacaggggauccaaacucuuguccucaugcuuguccaggaagcauuuucccuaagccguaucccuagccuccuaaaaacacuaucuuaaagcaaacaauuucacuagugauaccugagaguagacaguagucacucucagguuuaauuacccacacuaacaaaauguaaagugaccucucaacaauugucuggagauuuagaaugugaugacagucccaaggcuucuggagcaagcugucacaugugaaaaagaguggcucccauaggcucauggauuugaauacuugguccccagcugauggaacuguuaggagguguggccuuguuggaggaggcgugucacaggggcgggcucauccucaaugccuugugcuuguggaucugauggaaggucucagcuucugcuccagugccaugcuuguugccgugcuccccgccaugguggaaacccucugggaacaugagccccaaguuaaaauugucguggucaugguguuucguuauagcaauaguaaagugacugaggcaaaagggaugucucuuuucuccuauguacauauugagacgauugacuuacucuguugucucaagccugauuuaaucugcugucuuuugcuuucaaggagucaaucagaacagaagcaguuuucaaaagauuguuccuacacauuaaaaacaauguuuagcugggcagugguggcacacaacuuuaaucccagcacuugggaggcagagacaggcugaucucugaguuaaaguccagccuauucuacagaguguguuccaggacagcuggagcuacacagagaaacccugucucaaaaacaauguuuacucaccaauuaaugccgguuuuuccaagguccaucaucugccaaaccugaggugcauuugugggguugcagcugucagaucauagccucaagcccuggaguuagagauuaaagugacuucagaggcauguuccaggggcacauuuguccaaggaucugagccaggagccugagagaacaggacaaaacggugucaggagaggaacggugccaggccagggacagacacaacccaaggaaagcuggcaaacuggaaaaaggccaggcugggacgagccagguggggacaggcuccuagaaggccacuguggcagacacagaaaagaggucaugugacuguaugcugucuccuacgauuucuuaaauccauauaaauuauauaucauaaaauucacucuuuuaaaugaggaacucaucacuauacuaaagucacaaagcaugcaaccaucaccaccauccagucgcagagcauuuuugccaucacaagauacaaccccucucugggcugggguugcuguguagcugaggagaaccuugaauuucugguccuccugcuuccaccucccaagugcugagggacugcaggcauguauuaccaugcccaucuucauuaauuaauuagguaaucuuccaaacuaggcuaugugaaagugagcaggaugcuaccugugacuauacacaacaccaagucaagauaggcuauccugagaaaaccagagccaugacuccaagauucauccaccuguaggucuuuugugacuguuguucccacguuaguucuuuuuguucuacauaauaccacuuuuaaaaccccuuccugucauuucaagagggacaggugcauuuuacuuucaggagguaugaaaggugggcuuaacucagaauuuguuuggauuaaaauaguagauaccauaggggacuaauauccaauauauauaaagaacucaagaagguggacuccagaaaaucaaauaaccccauuaaaaaauggggcucagagcuaaacaaagaauucucaccugaggaauaccgaauggcugagaagcaccugaaaaaauguucagcauccuuaaucaucagggaaauacaaaucaaaacaacccugagauuccaccucacaccauucagaauggcuaagaucaaaaauucaggugacagcagaugcuggcaaggauguggagaaagaagaacacuccuccauugcuggugggauugcaagcuuguacaaccacucuggaaaucagucuggcaauuccucaaaaaauuggacauaguacuaccagaggaucccacaauaccuguccugggcauauauccagauguuccaaccgguaagaaggacacaugcuccacuauguucauagccgccuuauuuauaauagccaaaagcuggaaagaacccagaugccccucaacagaggaauggauacagaaaaugugguacauuuacacaauggagugcuacucagcuauuaaaaagaaugaacuuaugaaauuccuaggcaaauggauggaccuggagggcaucauccugagugagguaacccaaucacaaaagaacucacaugauaugcacucacugauaaguggauauuagccuagauacuuagaauacccaagauauaagauacaauuugugaaauacaugaaauucaagaagaacgaagaccaaaguguggacacuuugccccuucuuagaauugggaacaaaacacccauagaaggaguuacagagacaaaguuuggagcugagacgaaaggauggaccaucuagagacugccauauccggggauccaccccauaaucagcuuccaaacgcugacaccauugcauacacuagcaagauuuugcugacaggaccccgauauagcugucucuugugagacuaugccagggccuagcaaacacagaaguggaugcucacagucagcuauuggauggaucacagggcccccaauggaggagcuagagaaaguacccaaggaccuggggggaucugcaacccuauaggaggaacaacaauaugaauuaaccaguaacccccagagcuacauauguaucagaagauggccuagucggccaucaguggaaagagaggcccauuggucauacaaacuuuauaugccucaguacaggggaaugccagggccaagaagugggaguggauggggaggggagugggggaggggagaguaugggggauuugaaauguaaaugaagaaaauaccuaauuaaaaaagaauagaaaauaauaauaauaauaauagacaccuaguaugaucuagcuaaaguaaagacgugagcuuuuuuuuuuaaucauuuuaugugugggguguucuaucugaaucuguaucugugcauuuuggugcccacagagaucagaggagaagggaucacaucuccuggaacuagaguagauggucaugagcuaccacguagaugaaguagguacugggaaucgacuuggguccucugcaaguucagcuaguccucuugaccacugagccuccugucuacucuucuugcgugugggcuccaugcccuugcccugcaauccagcucuucugagggagguggcaucacugcugaccgugacucacugugcagcauacaguacucagagcacccaacacucagaguccuguucuggcuccaaaggcaaacaucacaaauaagagacaugacguuccaacuaagauuguagggccauccgcagcuuccaugggcucagugggggaugggauucacagucuguaugaaaguggguucagucucggcguuggucaucugugagaggugagugcuguggacgugagugugugcccuucacuccucaacaaugacagaugcguaugacacugggaagaugaggcuuuggcaccucgcugcggccauuaagccucuucuagugacugacauaggugacagcuuguaagaccuaacacugaaacuucucuguuccugucccccacauccccauuacacagaccugcaugugggaggccuggcuuugacuucuggauaccucagugucuguagaaggccuuuuccucauccuucucauccuugucuaaaaggaccaaaaagauucucuuuuuuuuuuuuuuuuuuaagauuuauuuauuuauuuauuuauuuauuuauuuauuuauuuauuguaaguacacuguagcuguccucagacacuccagaagagggagucagaucucguuacggaugguugugagccaccaugugguugcugggauuugaacuccugaccuucggaagagcagucgggugcucuuacccacugagccaucucaccagccccaagacucucuuacuuauauauauauauacuuuuauuuuuuuuuauuuuuuugguuuuucgagauggguuuacuuauauauuuaaagcuccagaauuuuuggauauaagaaguagaaaagaucuuugagauacuuaauguauauaccacaaagauguccauuggcauaguaacucgugaguuucuccuuuaaaauaaggucaaauaaguuuggaaagcccuagagauucaguucguguuagccaucauaagaauccagacgucucauauuaugaaugaaggaagggcuuguggguuuuccagaguuuuccaaagcuaaugccaggaagcagcaguacugguuuccuggugucucuggcaaccugcauugccaaaugcuagugaaagucagcuucuucccgcucucccuguguuuaauuuacuuguucaucaggaacaagauuugucauguuaucgagggcaccuuagugacaucaucaagaucuguuauguuacccaggguaccuuagguaacauuauuaaggugagucaguauacaaaagaggaccaaggcuugagaccgaggacauggcuuagugggcaagaauccucagacccaagcugggcaggggccauguaugcuuuaaucccagcacucagaaggcggaggcaggcagaucucugugaguuugaggucagcguggucuacagagcaaguuccaggacacccagagagaaacccugccuaggugguggaauacgcagacauguauuuggaaucuccgugcuccacaggcacauaggaggcaaaaguucacggguuagacaccugcauacuuagcagaaaaucaagagacuccuguuucaaacaaacaaaaggcaaggaccuuuaccaagauuguccucugaccucuguaccucuacacuacauuuacacacacacacacacaugaauguacacacaaauacauauccagaaucagguuugcaagaauccauucuaucagccuugucuagaucagaccaaugaguuuuuauuaggacauauauuguuauaaccccuuuuuauaguauugccuacauucugcuaaguagaagggauagcugcuuacacagcagguguguuucuuuucucguuuccuuuuuuuuuuuuuuucgguuuuccgagacaggguuucucuuuguagcccuggcuguccuggaacucacucgguagaccaggcugaccucgaacucagaaacccgccugccucugccucccaagugcugggauuaaaggcgugcgcuaccaucgcccagcaauaaugcaugucuuauucugaguuagcacccuguucuuucuucucuguauugagguugggucauugcaguggcuuagaaacacaccuguugccgggcgugguggcacacaccuuuaaucccagcacuugggaggcagaggcaggcggauuucugaguucgaggccagccuggucuacagagugaguuccaggacagccagggcuacacagaaaaacccugucucgaaaaacaacaaaaaaaagacauucauuauucaguugcucuugcguguagaaucuccaugagugggguagcuacagauacagacagacucagguaagugcuuuugguaaauuccaaacaaaucaaaacacucuuucucgauaugcauaguaguuuccucaaaacaaaacaaaacaaaaacuacauguguaugaaaacuccccaaaagacuuugacugagcacgcacuguugggcauuuauuauguaacagcacugaugucugcgugcucuccaugaauugacccauucugucuuuguaacuauuugguuuagggucuaguuucaugugccuguuguuaagaugaagagacuaaggcaaggaagauagguuaacugucccccaacuguccagugguagcuucagaacacagucucagucuucugugucccugucaucugaaagacccagaaagguaguguccuggauauuuauucuacagaucaugaccagauaaaggcuguuugagaucugugaauccauaauauccaaaaggaauccagaccaggucaccucucccaccacaguuccugucuacccaggagaaggacagaggagcuguuggaggguguuugggcuggcguugggcccaggagcccuccaggaccugucaacaagucuucagagaacacagacaggaaacaggcagguugccuuuguccuuccucaugucccuccaucucuugccaaaaacccagcccuagauuuugcauuuagcaaguucccaucacagagaagaugagaaauaucagggagcagagagaaagcacaggagaccaaaccccuuccagguugccaggcuagggagagucuugggacuuuucucccuccgaaaguaauuacacugcugugacaggugucuggguggcaaacauuccucuguaucccuuccucugaaaagaagaaauccugaguacacuugucuugggguggugugagaugacaccaguuugauacuggguagacugggcaaggugggacaaacguaggaagugggggugggaggcagcccagggacuggcugcaccuacaucuucugugaguguucuggugccgauuuccccaauugugcauaaggacaaaagugaugacucuggcccuggugauugucagugggaaauuaacucacgauguugguugcuuccaaacacgagugaauuagacuucccaguagugccaguugauaaggagguauaugauguuacagguuaagcucuacagaaugaaaaugaaugugaaaaaauuuuaugaaguuaaucaucuguuauaggcucaagacaacccaguaaacucugguaugcaucauucacaaaagguagccuaauagaaauuaagguucauuuucaacaaaaauuaagacaagaaugagaaaugaggaggcuagccaggcuguggcacucaggauacagucagguggaucucggugaguuuagaggccauccuggucuacagagggaguuccauaaaaacugaggcuacacagagaaacccuauauggaaagagagaaaaagagagaaggggcugaugaggggcuggagacggcacagugguuaagaacacugucugcucuuacagaggaucuagguucaguucccagcacccacauggaggcucacagcugucuguuacuccaggccuaugagauccaaccucuccugaccucuaaggucauacauacauacauaauggcauacacacauagcacaguacguuuacucagugcauuuauuggugagauagucauacacauacuacaaauaaaaucuuuuuuggggggggggggaggggaggauuugguuuuucgagacaggguuucucuguguagccuugacuguccuggaacucacuuuguagaccaggcuggccucgaacuuagaaauccgccugccucugccucccaagugcugggauuaaaggcaugugccaccaccacccagcugaaauaaaaucuuuaaguaaguaacaguuuuuaaagagcaggaguugaaggucaucuccagcuacuuaguuugagggcuggggagauagguggcucaguggacaaaacauuugcugcaagacugacagccugcauuugauccaccagaccaaugucugaaggagaggaccagguccuuguuggucguuguucucugaccucaccacaggcacuguggucugagucuccuccacacaaaguaaauaaacgcuguaaguccucuugucgcucacuguucauugcccugugguuugugugcucaggcagugguuccuggggaagcccacacccuccaagcgucugcacugaacauugcuaacacucacuaaugacuaauuauaccucaaaacucuuuagguccuaaauccucauagcaacucugugacaaguaggcucccaaccuauccacagaugggacgcuggggcacagcacgcuuaugucuccauguucaggucacgaagccagcagagguagaaguaaggggccagcucugcucuuccugaaggguuuaccugaccaagccugaggcuguacuggagaaacaugugaacuguuagagauguguucagacacagauggcuucccaggaccccuuugcuucaccacugggcuuucuucuggucuccaguucuccugaguuagcggguauugugucacuggaaugaggaaacggaagccugccaccuuguugaggcagguuuuucuuuuugucucaacugagcuucacacuguaggcuagcuggugggguggggaguucuggggaaggcucucccugugcugagaauguaaugcgugcucccaaguccagcuuuuauguagguucuaggggacccaacucagguuguagagacggcauagccaucucacuugccugggagacacaguacaaauguacauguaagagcuauucucuguucugggaaaacuucuuuguucauaauuaagaaaauuccaagaaauauaguccaagucucuuugccuugucauuggcacuuagcugcaucuugggcagccucuuaacacauugacauugaaguaaugguagaucccuacuaaggcuccugucagcuuuuuuaggucuuuuauuguuuuguuuuucagcuauccugugcugccucauccuuauuuguauuagauuacugauucuggggggcugggagguugcuuggggggugagugcuugcuccaagaucaugggcaucugaauucacacccccagcacccacagaagagccaguggcagagacaagcaggucacaagagcagccagguuugcagaaaugaguggucagugggagacccugccucaacaaacuguaugcuagaggaaggucuccaaaagugaccucugacuuucucucucucucucucucucucucucucucucucucucucucucucucucucucucucucucucucacacacacacacacacacacacacacacacacacacguugaguuucuuguugauacaucauuguuaagucgucagaaucaccuacaaaguauaagaaguguuaaaauuuuuaaagucauaagucccaaacuuuaagaaucugauucuuaggaaucuggcaaguuccagacauuuuaaaaguuuuucauccaggcagugguggcgccuuuaaucccagcacuugggaggcagagacaggcggauuucugcguucgaggccagccugaucuacauagugaguuccaggacagccagggcuacacagagaaacccugucucgaaaaacaaaaaacaaacaaacaaaaaguuuuucauggggguucagggagcaguuggagagaugguucagcaaagagcacuuguuguucuuccagaggaccuggguucaguucccagcgcucaauuggcagcuggcagccaucaguagauccaguuccaggaagucugacacucucuucugaccuccaccagcaccagucauguaugugauacacagacauccaugcagacaaaacaggcacacaugcaaaauaaaauguuucauagaggcaacggcuguggcuugccuaucaugcacaaaguaugucccccuauaccacuaaauaauacugaggcuuuucauuugcaucaguagauuaaguguguguggagaggggggggucacuaacuacuuagacaguaucccuugggggcaauguguccacccucuguggugagggccgggguuauaaucucuagcauguuucacacucccaugugcauuagcaaacaauacagacccuagccucauccguauguccacacgucugguucucuccagccuuuggucaagcucuacagccuuuucuuccugggucauugcagcacugaguuccacuaagcagaugaucuagggucugcaaccagcacuuucucuaccugcaaagaccuggcuaacuccagggacacccaggcuguuugagcaagcuaagauuauaaugauucggggugucccaaagcaaacuggcacuuccuggaaucagacacuagccagucagcucccccuaugcccuacuagccaggcgccauccaaauaaguaaggucggcagugcaggagagggacaaguccuuccugcagaacagauuuccuaguaacgggcaccuuuaaaggcaagguuuguagagucgucaaacuuggcaguuaccuguuugaauaauaaaccucuaaaccccagucccaguuauguaaacugugaucgauaaucccugugucacaggauucagugguaaaaccgguggaaagggcucagccccgugaccaguguagaaccaccaauaaauggcaacagggaucuguuuccugccccuuggcugucuggcagaaugcuuucagggaaggaaggaaacaggaccuccacccuuggcaggugucugcauagagauccggggauuggaagcaauaaagccugucuccagguguggcagcuagugcccuuugaagggugaauuugucauggaucucugagaugcugccagucucgcagcagcagcugcagccaccuuugcacaagcucuggccauucucccugcugucuuuguucuauuucggugccuguggaggugcagggaagcugcugucuuccucggguugcuauuuaaagacauucugaaagaggcugcacuauuccuacugcaguggcggcuguggcuccugcuccugccacagaaggcugcaagcccuguggccgcugaaaccuuggguggagugccucagcaaaagcuagccuggaagcacacacauuagaccuggggacuucugcucucugucuuuuguuuaggacccugagccgucaucucuaccaggagcuuacagccagcagccacuuugaucucugucccugcacugccucaccuaccuauaucccuggaaggauuuuuaaccaguuagcuucucccuuguucuccagggaaagucaugcgcaauacuccccuccucuuccaccccaucgacaguucacacuugggauucuuuccccauuguacagcuaggcacaauccaggaggggucagggugacgcuugucucuagucuaauagaaauauuuugaaaauaaaugcucucugaaaggcucaguaaccuucaguuaauaauaacagcagcuugggcuuuagugagccuguguucucuagccaccaggcguggauagaaucccuuagguggcaggacuccugccccucugcugacuucccugcacucgcgaugcagugucucaaaagccuggccuugcuguugguuggagucagcccuaauuucuuuuuccuagaccucucaaagcgaagcuuuagauuuuaucaguaaaguagcugggccagcagccgccuccauuuggcucccccaacuacccccuuucucauuaugguggagaggcugccugccuuguaggcuuggagcccaggccuguuugcuggccucgcagaauucccccagugcccucagcgcugcacaguagcaccaucagauguuucagugugacacacaugccacuaccaccugacccacacuggccccuacacugcacugaagguuuccuaaggugcacaacucgcuguagcuguuuuauacuacagaaauucugugucugucuguuacacacgaguagaaauugaacauauuaggugaaauggaaagcucucucccaccugaaaccucauuguuccucuuguuccuuguuguucuuuuuacuuacacauuuuagugaugauuuagacagaauuguucuuuaugaguuauaaauaguugugguccuucaaauuuccuaucugccuuuuuguuuuaccuuguuugguuuuuuugagucagggguuuucuguguagucuuggcuguccuggaacucucucugucgacuaggcugguuuaaaaagcacagagauccaccugccucucucucugccucccaagugaguguucagauuauauguuuuauaacauuaacuuuggcugaugggauggcucagaaaguaaggguauuuacuaagcaugaaugguagguacccugaucugguccccagaccccaccuaaagguggagagaaccaauccacaaagguauccucuuaccucuaugcacaugcauacacauuauuuacauacaauaauaaauaaauaaaugagcugggcauggugguacacaccuuuagucccagcacugaugggggggggagaaucugugaauucaaggccagcuuggucuacagagaguuacacgauagccagaguuacauaagagaccugaucucaaaaaaccaaaacaauaauaauaauaauuaauaaauaaauaaaauuuagggucuggagagaugacucaguaguuaagcacauguauuaucucaugcagaggacccagguucaauucccagcacccagauuggacaccuuacagcugcuuguauacccagccacaaaggggucugacacuccucaccuuggcagcaggccuaacucuaauguacagaccaacacacauauaauuaaaaacaaaauaaaucuuuuuuuuuaaucuaagggaguaaggggacauugagauaacucagagggcaaaggcacaaaaaagcacuugccacugugccacccagcauugugagucugagcccuggauccuacgugauagaaaagagagucucuacuguggcauacauauccacauguggacauaaaugccaaauaaauaaauauaaacaacuaacguguguguguguguguguguguguguguguguguguguguaacaguaaccagccaucaagguguggcaagcagugacaccauuuuguuuuuuucuccaaauaaagccuuagugggaaauaaauaaaugaucuuuuauuacgaaaagcaaacuaguggugguggcacacaccuucauucucagcacuuggaagacaaggugggccgccuggucuacagagugaauuccaggauagccaaggcuacacagagaaacuuugucucgaacuacucuguccccacaaaauuacaaaaagcaaauauauacaaaauaaaccauguucccaacuuaccccuuccuuuucugccugcucauauuuggggcuucucucuauucuuugucuugagagccgugucuuugcccuuagccccugauagcaagccagauuucucaaagugucaguaauaauaaggauccuggagauauagauauuugcuuaagaaagcaaaauauucucacaugcguuccaucuguuagagccuacaauagacuuguaaggguggcagcagauuggcuuucuguacacuucuuuguaguaguaagaaggagaugcaguagugagugauauuuaauagagucacaucugcaaaguccaugccauugggucugccccccuucuuuacuagcuguagggcccuagaaaaacuggagaugauguucguggcuuuccuuuuaugaugauguagucuugucuauuuauuuaguguaggaugccauggcucacaugcagaagguagaggacaguauaaauauaugggaaucgucucuccuagauguggaccccaaggggucaaauucagguuuccaggcucggcaguaagugacuuuauuugcugagcuaccucaucgacauuacucuuuaaaagcuuuuuaagggaccagaggcuuaauucaguuguaagagcacuuguuccaucagggucucagaacauacacagcagcuuacaaccaucuguaacuccagccccagggcaucugauacccucuucugaccucuauuggcaccagguacauacaugcaggcaaaaacauucgcacacauaauaaaauaaaaauuuuuuucuccgggcaugguggcgcacaccuugcaggcggauuucugaguucgaggccaacguggucuacaaagugaguaccaggacagccagggcuauacagagaaacccugucucgaaaaaacaaacaaacaaacaaacaaacaauuuccagccuggucuacagagcaaguuccagacagccaaagcuacacagagaaacccugacucaaagcuacucccccugcacccccaaaaagaauuuguauggauuuucacaagaauguuuuguguagaggcuaguaagauggcucaguagucaauagcaguugcuguucuugcagaggaucuagguuugggucuauaacuccaguucuagggaauucaacaccuucuucuggccuccaugggaacagggcacauacuugguacacaugcacauguaggcucuugaaaauacccauauuuacccauaggauaaacauaaauuguuuaaaauauacauuuaugucuagcauguuggcacaugcuugaauccuagcacuugggaggcaaaggcucaucucuaugaauucgaggccaggcugaucuacauagcuaguuccaggacuacagagaggggcagugucucaaaacaaaacaaaccagaccacaguaccuguguggcuuccgaggccaccugcacacacauggagcauauaaacaaacucaugcaggcgcacauacauagacauaaagaguaaagaaagaaacuugguuguuuuguuuuguuuuuuaaauuuuuuucccuugggcuggagcuauagcccaguagguaauaccugaguucagccaccagaaccugcaccagcguuuguccucugaccgccacguguaugugcacacacuggaaacaugcuacacacaaaagaaaaaauucucuuuuuguuuguuuuuuagagagugccuggccuccgacucucuguguaugaccgcuuugcugcauguaugucugugcaccagaggagggaguugcauguucuagaacugauggcgugacaguugguugugaggcaccaggugggugcuaggaaucgaucccaguccucuaccaaagcuguccugcucuuaaucacuuucauggcaauccuccagccuccgugaucuuuccugauucacacuccuacugccaucucuccucugagcuccccacagaguuccucucagacuucacaugauauacacacuacauauguaagaaaaaaauugacaucuuguuuuucugcuucucccuuauguuugaaaucauuuuuuaaaaaauuaaagcaagggcuugagagaugacucggggguuaugagcacugguuggccuuccacaggacccaaguucaauuccuaucacucacauggcagcucacagcucucugucugaagcuucaguuccaggaauucuagcuucuaagggaucuauccacauguggugcacagccacacaugagacaaaauacccauacaaauaaauuguauguacauuaaaauaaaucauauauuuaguguguguguguguguguguguguguguguguguguucaucuugaugggaauuguggcacacacacaccuuuuauccuaacacugggaagucagaguaagcacaucuuaaagaguucaaggccagccuggccuacauagcaagugccaagcuaaccagagcgaacauaucaagacucugucucaaauaacaaaaauaucucuguguguguuagaaagguaggucuggcuagagauuuuuuuuucuuccucccuguaguuuccaaauauucugacuuaugguuauguggcuuuuauaaccaaauaaauaaacauauuuaggaucuaacaagaagaauaccugccauuuauuucuucuuuugaucuuaacucaaagacacagcuuuguaggaauguucugagcguccggaaagaguccucggcuguuuuucugcuuuuccauuugaaagugcaccugugugcccaaggcacuucugcucacauguucuguuuacuaagccuucugugucucagccaugccaaccccaaacauugcccuuguugcugaaacccccaagcuggugaacaggaugggugggaaaauggcugugugugguacacagucgccccugucugcuggugaggcaccucagcuucagcccuuccagggagguuucacacaaggaagcuggugcugcuuuaagcucuccugaccuaggggcuagguggaggugugcacaccucaguauagaggacauguuuagcauuagguccaaugucuaugugagaguccaacuccaaaaaggaaacuccccugaaaccacaaagggcuucuucuguccagugcuuuuggcagccaccugcugcucugagcccuucugaaugagaggaggcaccucccuccccacaagcacacacuacccaugcccuguccucucccugcaguuuuggggcuugauuggggugggguggugugggguguguguguguguguguguguguguguguguguguauagauggcagguauaggguauguguuguauguguguguagauggcagguguuggggguuauagaugggguguaugugugugugugugugugguguauguaugugugugaguaugugugugugguguguauguguguagauggcaggguguugaagucuuaaugagagccccccccccacaggauugcuuguauccugccuaccucagaggguccugugaauaacuuuaccuuugaacuuuucuuguauucagccccugauccuuaggauuuggugacaauccuuggcugacaggaggcuuugauccuuggggaguucagaggaagucccaugauauggaggaggauuggagaucggcacaggagggggggcugcuaagauggacccguuaauuaagaagaaggcuuugcuuaacacucacacagacacacaaaaaaagcccagagccugaugacaggagcucagccaggaugccauguguuagcacgagcaugacuguuauuuaagacacaacagugcccaggagagauuccuacccccaccccaggaagagcagaauaccugagaaccgccccauuuaaagagguaaagcuggcuuucuuugaguggugggugucuccaggagaaagaagucuugcaggucucugaauguagcucagauggcagagcgcuugccuggcccuggguucagucccugcauggcugaaaccugaccaggugacaugcacuguacucucggccucuggaaggaggcagggaagauucacagucauccuuggcugccuagagaguuagaagccagggacagcaagauaguucaguggguaaaggcacuugcugccaaaccugaggaccugaguucaaguccugggacccgcaaggcauaagaagaaaacuuacacaugugugagucauggcacaugugcauucacauacauauagacauacuaaauaaauaaauauaguuuuuauuauaaauauaacauuuuaaaaugcuuuugcuuagggacgacuuuaucucaaguggcuaaagccauucccugguaccacccaaucggugucacagugacacuccuuucaccagcagaacguuguagcuugucucccucccaccuccaaggcagguguucuccuuugauccugauaaucaggcacaccauuuaccucucaguagagaccucacuguguaaccugugccuccugccucucugggcuuuggcugcuagaggcugguucauggaccauccaucucuuuagcccgguacauggccuggguaccacguaggcccuucauaaugaucagagugagugguaacuaugggcaggagcuguacaguuguccucuuucuggcaucaucucauuuucacucugccaaaaaagaugaagaccaguuagcagagugugggcagggcuagucagggugggaugcccgucuuacuccuggugugucuaacagcuccuugagaaaguccaggacagcaucuuagugagcuuggcucacgggcucaggacuuaauggagcaacacuuggaaaaggaacagacauggcagaacuacuguguaagaccuguguucccaugcaaaaccaaaacacaaggcccccacuaauagggagggggugggggcagagagacgguccagcaguugagcauaugcuguccuuguagaggacccaaguucaauuccuagcacucacauagcagcucacaacuguccauaaguccaguacuaggaugcacaugaugcacagauauccaugcaaacaaagcacucauacacauagaauaaaugcauccuuaaaaacauuuuuaaagccagucaugguggcucacgccuuuaaucccagcacucgggaggcagaggcaggcgcauuucugaguucgaggccagucuggucuacaaagugaguuccaggacagccagggcuauacagaggaacccugucuccaaaaacaagaaaauauauuuuuuaaaaagaggggccaggcagugguggcacacgccuuuaaucucagcacuugggagacagaggaggcaaaucucuguaaguucaaggccaaccuggccuauagagcaaguucaaguucagaacagccaaggcuacacagagaaacccugucucaaaaaaaaaaaaaaaaaagaaaagaaaagggguguguguggcauuuauucuaaucagaugcagcuucccucccccccagaauccccguuugcguguccaggugguuacugauugccauugagguugcucugaggagaaacugacgugugaaauaauugcaugcuuuuuacagcucauuuuuacucugugcagugucgaucugaaaugcaaauagaagaguauuuaccucuauauacagaauugccagaauuacaguguguauccccccucaucuugcacgugcacgugccuuuccgugauugaaaacuggaagaacaugcaaaagugagcacaacuguguccuuacucgccugccugcugucagccugcaccuccaucaggcuggccagccagggcagcaaggacgacaggcuggccugcuucauucucugucacugucuuuagguaaauguuucacuaaaacaaagaagugggugggugggagagggugucacauagagcucccugaccguccgucuuucugagacagccauuacucuugugugguagucauagguucuagcacuccuugaccaucuguccuucugagacagccauuacuuucuuguguggugggcacagguucuagcuggaauggaaaacuggaacucuccaggcugucaguaggucuauuuacucaguuguaggaguaacagacaccuggaccugcuucuggcuggaauuauucucccacucgcuguaagucuaccagagucuuguguugauggcguauaauuaacacagucaaaaauaacuugugagagacggcgugcaucuccucugcucacauuccugcuccaucguuucacuagaugucauuuacaagucauaaauccaguaacaauuauuaguaguuuuaauaguucaauuguaggucauuaaagccggcgcaugggcuugggggacuagacuggcugucuggcacuguuugguagauguucuuagagucacgaggcuggucaggaguggcaugugugccuucaucccaucauggauguguuagagcaucugccagaugccaguuuugugaaguccuggcccucuguagaagaagcaaggcacuuggcaucgguaguaccugugaucuaaugaggaaaacauuuuuuuguuuugguuuuuuuuguuuguuuguuuguuuucaagacaggguuucucuguguaguccuggcuguccuggaacucacucuguagaccaggcuggccucgaacucagaaaucgccugccucugccucccaagugcugggauuaaaagugugcgccuucacugcccgacgaggaaaacauuuuaaauuauauaauaucaauucccaaccuaaauaaaaaaacaaaaucacaagaaauauuuaaauuacaauugugauaggggcugcaaacagaauuugaggauggguguuagagagaaaagcccucgcaagugguaucuuggcccuauauauaggauaagcaagcagggcaugaaacagccuugcagcagaaagcaugugcagagguggagcccuggaaaggcgcucugcuuagagaaagauccacagagccagaguucaggcagcacaggaaguccagguauaggcaggaagagcccagggcuuuuaggggaacccuguucccuaccuugcccuacucauccccagugccaugaugaccaaaaaccucacaagcuagagggguucuauuuucucauagcaaguccaggacaccaagcagcacgcuggggguugugugggacugaggugccugcaugagucugggccagaccauguguuugccgcccacuguuucuggucauuucugcaauucacuauacccaaaguauaaucugcccucugucuucugcccuuggggccucaaauguuuucuguuuuguuuuguuuuguuuuuuuuuuuuuuuacuuguuuuauuguuguuuguuuugcucuaguuugagacagggucucauagccuaggcuggcacugucuccucuauuguagcugaggccagcuuugaacugcugacccuucugcugcuaccuuccaggagugggaucagaagcaggugccaccaugcugagucagguucuguuuuacacucucaugggcuugucuacuccauccugcuuuccuguaauucuuuccaggguggguucuaaguguagccuugacuguucugggauuuacaguagagaccaggcuggccucgaacucaaagagaucugucuucugagugcugggauuaaaggucugugccacuauaaccagccuuaacaaaaaucuuaaacuagaaccaaacauaucucucucccuccgaaggaugaggcauggggaccccacguuugaggucagucuguaccccagaagaccaggagacggugagcugggucagugguaaagacugucgccaucaggccuuuggccuuaguucuacaucaggcuccacauugcaaagggagcgcugacuccuauaugugugcuuauauagacacacagagacccugaggaagaugcaggcagccauuugugcccacacacucuuggcugccuuuguccugaggccucugcuaucuuuugacuaaagggggagggucuaggagcuauacuagggucuggaaauaaugaggcacagacuuaaaaaucauagugagguguugcgggcagaaaccacaaaggaaucuuauguggggcacagccagcuccaugcuccagguuggaaggucccugcauuaucuuacaaggacgccagagacugcuucccaguagacaugugcucaugaccccaucucuccauccaggugcugagcgacguccucagggaucucuaucacuugcugaagcacguggugcgcuuggaaccugaugacgucgccaagcugcaugcccagcuggcccuggaggagcucgaugagaucaugaggaacuuccuguucccgccccagaagcuggagaagaagauugugguccugccauagaccugguucacagaacauggaagaaggcaggggaaaccaagcagccaaagcaguggucacacaccucccagcaggugucuccaccgccuccuuggugcagaccugaggucugcuauaaccugaagguagcuauacggugcuggcaccacuuggguguucagggcuaccuuucuagagcguccauuuggucacucugcaucuggcccaaagcuugugcagugagaagggugaaccccaucuaacuacacccuucaucgucccagccuuuagaggaggccuguguauaacuguggagcauuuucuuccggcuggagaagccgccccaccccccuggucccaccuugauauccugucauagggagaugauucugccugugaugagggacaggcagagcuaucaucugggugugcagcuguggggaggggaaggaagcauugcugcuuaaacuacacaauacgagagaauaaaagaauaaaauuaccuuggcuggaaugaucagccaaugugaaugcugucaccgagcugguugacuuuugcagaagaagaguaagcccugucuguccucuggggccuuuuuucuuuuuauugcuccucuguuuuuacuugagcugccauucagucuucugcaccucucagggugaugcugugacaguggaguggucugagaaaggcaggcagggcuuauguggcacaggaguggccugccaccagcucacugaaacaacuucagauuuagcacuguguucauccgcucuuggauuuauguauuuugguauuuucauugcaaaagacaagaaaggguuaaaagaagaagaagaaggaagaggaggaggaggagacuggggagauauggagauaccuuagucccugaaguacuuaugcaaacuugaggaccugcgcuccauccucugcauccagguaaaaacacugcuugagguggcaugugccugcaggccuaaggagcaggggagggugcagggacaggugcauccuggaggcucacaggcuagccagucuaguuaauuagucugugagcucucagccaccaagagaccccacccccaucccuuucucucucucucuaa

SEQ ID NO: 4747 - RNA, 4213 nt, Mus musculus
gggcgcaugagaaggcgggcaggcagagaggcgcagcugagggugacgaucagggaaguggcccuuuggaaguucagcugccgggcugaacaauggcaaggagguacugauggaggaagcauggcugugugaggugggaagagggugacugagagugccuacauguacaaacaggccuccgcaaccugacacgguaacuauaagcaugaauaaagcuguucuguguggcagaacaaucacucucacaauggcuuccuggagguuugguuaaauacugaugugcaggccacagaugagucugugugugccagcaagugaauuauuaaugcaggcucuaucugaaaucagcugggaaggcgguuccauuagaagcaagaaagaaauuaauuugaggucacuugaucuaggcacacauucggaugcauaaacuuucuuccuauauuagcuauacaccagggagagguccaaucaaacccccugaaggaagaaaaaagugccacaguggaaguauggacugaagucaggccuggcaaggaagccagucucugacaugaagccucuugugccuaagcaugaacaacggagugagucagaaauaccacucaccagaguucagacugcagagcacggugacugcacuccaagcucaccuuggaaccugccccgcgagagugccaggacucagggccucgguaagccugugugguuuuccugagucaguuaccgugcaacucuaaugcacugcagagacucuagcuggagaugcaaaugaugaaaacucuguugaccagcucauaucuaagaaaaggguugagcuggaccuguacaagaagacuggauaucaggacaacggaaggaaggggaggcgggcuuaccucuguugcuuucuggcugaguccccgaagcagcagcacaacuacguggacugcagcucugcgcacuugaacaucauugucugucuuagccacagcaaucaggcaggcugucaccuaggagggagaugggagaagucaagaggaaucaggguugcauaauuaccuacaggccuccaacugucucucucagucacaguccucaggagcagucuggcacuugggaggcagaggcagguggauuucagaguucaaggccagccucgaagugaguuccaggacagccagcgcuacacagggaaacccugucucggaaaaucaaaaaaaaaaaagaagaagcugagauuuaguggcagagguuugguauagacaagcuuuccuggaaaaggucauaaucugauuggaaauucauggauggaaccagggaguuuuugaaaaaaggaaaggucaaaaugcaagauucucucuaaaccuagggaaaggguguuaggugcucgucuuucggaacuucacaucagaggaaggagggacuggucaugguaggugcuaggaccuagcuaaggagugucaguucccggccagauguucuuaagccucugugcagcacaggguuaggaggagagagagacuccuuccccucugcugcccacccagcccugcaaaccuaguguccacucugggaagucagcacagccaguuucaaguacgaggacccgagugugaaaugugcccacacaagaaggaaggaaagagaaagagaaggugggggagggauggggauguggggaaggggaagagaggggggagggagaggaagagagaaaggaagagggagugaaagaaagggagaggagaagggggagggugagaaggagagggaaagagggaaggggaggggagggggagaaggagagagagagagagauugauucugccugaguuccuuccuuuguggaacagaucuuuuagcacucaggcccugacaauuguaucucagaaaggaaucuacuuguaaaacauggugcugugggcugguuaaauggguggaggcaugaguuacugaagccugccggccugagcucuaucucugaaacccacagaaaggggaaagggaagaacugaccccugaacacuguccucggauacacacacacacacacacacacacacacacacacacacacacgcacgcacuggugccauauauacauaccuaauaauuguauguaacagagcaguguggggcuggggguagcacuguugguacugcaggcuguacaggcaugaggaccugaguuugaagcuggaacacacacaggagggaggggaggagggaggggaggagggagggaaagggagugggagagggggagggggaggggaagggagagacagagaaagagagauucucuaauccuguaccaccuaaccuaccacuguuugucauaaugcagaaaaauacuguaaaacuucaauaaagagacaaccagcuuuucugaagcacccaugcaaguuucaagaugacaagcaggacuugugugucacgugguacuaacagacugugaguuugucuaaacuguuaagcugguuucucacauaguuuugcuauuagguuuucauugugugcuugcacuucuuggcuaacaguggagggaauuuuagccgugauaagaaaauagccagaucguguauuagaaaacauguauaaauacuuauuauguucaaagcauggagaaugcaggcacaaugaggaaacuggcuuguguagaaauuuuaacuaugcagguuguauuuuucacagcuuucaaacaguugggcagaguucaaaguaucuaauuaaucagugauggcagagagauuagaaggaggaggcuuguucugaaauauaauugcaucugccaugcgcuggcauucugucaagucgcgcauccauuacacaaacgugcaguuuggaagggaagacaagcccuagagaaacugcaaccuacggagagccauuguucaguaagauccaguaagcuacuucucugcuuuggaccuagaacucccaacccaaggccagcaggagcaacuuccaugccccuggcauuaacgguagaagcauuuuaguccuaggaggaauuccuuggaccaccuccaaagaggcaacaauauaauagcuaccucuacuuucaagcuuaguauuuacaagauaggaacugaagguggagaaacaaguuacagcuaggcugugucuuuccagacacaugaaaguucuccagacuuucauaacauaggaagccaacccagaacaaucuccuaagccaaggcuccuacaugcuugucugugccucucaagguuuagcuugagagccaugauuccaguuugggcgagcaugguuccccuuuuagaagccuacuggugccucccugugccucaguucucagugagagagccuggcucucacuguuaagcuagcauuuggauauccagggagaagcauccugcuuggaaaagggcuuucucuuuacaguuaauucuucagucccuaugguaucuugaagguaaaguggaaagaacuguguuccucuagggacugcugggauggcaggccgcagcagggcaaucacugccugggaccugagaauggaagagucccauggaccuucuucaauaccucugccaccaggaccacauccuucgaauaugcaauggcuuaucaaggcccugagauuuuuguauggccuugugcuauuuaaaggcugaaauagcuccuuucgcucaggccaggccuaaggcccagcuuacaugcagcuuccuguaggcugcugccaugagcuucugucugacacaagacacagggagacugcaaggcugucugucaccuucuaccugucuagucugaccagcuacuccauggcuugucucucaccuccaacuccaaaggacaggcccauuguugccuuccaucucuagaagucucgcugaaccacagacaugauguaagaucuuuacuaauuuaugaauugguauaacacccccacuuuccaauucuacguucucccacaggacagaaaucauuuuguguuaauccaugacacuugcuccaagagucaguguacgaauucuaauaaacaagacugcuaaaggcuuuuucuucacagguugaaucauggaaaaccaucauuccccaaagagcuggcacacaccaaguauaaguaagacuaugcaaacauaaccauaaccaaucaaauggcaaaauugccaauaaccgacuuuggaccauccaggagggaagccacuggaguugggguaugaaccaagaaaacacgacugcaauaucccagcugucuuucuuccc

SEQ ID NO: 4748 - RNA, 65567 nt, Mus musculus
aauuuuacaauuaaguuuauuguagcugaugcauaagaacacaaaagcacauguacuaauggaaugacuuguacuguuuuauacauucauaaaaacacuuuuggcucagaccaaguacaguaucaugcauggauguguacaauaacuuuagguaccucacauuucauugugccaggcacucaccugucaccaugggucaucucaaaacaaaggauuuuuuuguuuguuuguuucuugagacaggguuucucucuguaauccuggcugucuuaguacucacucuguacuggccuugaacucagaaaucuaccugccucugccuccugaguccugggauuaaagguguguaucuaccacccggcaaaaguggucguguuuuaagccaggccaucugacccuaaaaccuaugcucugccugccucuaccauccccuaaauuuacuagauggccuauguuguaaagaaagggcacagaaaaauguuuaauaucuguguaugguguaugugcauguguagauguaaguguacaucugugugggagcacauguauacgcagaugugcauagucgaugcugguguucucaaguacucaguuuuauuuauugaggcagggucuguugcugaacuugaagcucacugauucuagcuaguccagccagccagcuugcccuggggaaccccugucucugacucuaaaguguaaggauuauagguggcuccuacgccugccuggaguuuuguaguaguacaggggauccaaacucuuguccucaugcuuguccaggaagcauuuucccuaagccguaucccuagccuccuaaaaacacuaucuuaaagcaaacaauuucacuagugauaccugagaguagacaguagucacucucagguuuaauuacccacacuaacaaaauguaaagugaccucucaacaauugucuggagauuuagaaugugaugacagucccaaggcuucuggagcaagcugucacaugugaaaaagaguggcucccauaggcucauggauuugaauacuugguccccagcugauggaacuguuaggagguguggccuuguuggaggaggcgugucacaggggcgggcucauccucaaugccuugugcuuguggaucugauggaaggucucagcuucugcuccagugccaugcuuguugccgugcuccccgccaugguggaaacccucugggaacaugagccccaaguuaaaauugucguggucaugguguuucguuauagcaauaguaaagugacugaggcaaaagggaugucucuuuucuccuauguacauauugagacgauugacuuacucuguugucucaagccugauuuaaucugcugucuuuugcuuucaaggagucaaucagaacagaagcaguuuucaaaagauuguuccuacacauuaaaaacaauguuuagcugggcagugguggcacacaacuuuaaucccagcacuugggaggcagagacaggcugaucucugaguuaaaguccagccuauucuacagaguguguuccaggacagcuggagcuacacagagaaacccugucucaaaaacaauguuuacucaccaauuaaugccgguuuuuccaagguccaucaucugccaaaccugaggugcauuugugggguugcagcugucagaucauagccucaagcccuggaguuagagauuaaagugacuucagaggcauguuccaggggcacauuuguccaaggaucugagccaggagccugagagaacaggacaaaacggugucaggagaggaacggugccaggccagggacagacacaacccaaggaaagcuggcaaacuggaaaaaggccaggcugggacgagccagguggggacaggcuccuagaaggccacuguggcagacacagaaaagaggucaugugacuguaugcugucuccuacgauuucuuaaauccauauaaauuauauaucauaaaauucacucuuuuaaaugaggaacucaucacuauacuaaagucacaaagcaugcaaccaucaccaccauccagucgcagagcauuuuugccaucacaagauacaaccccucucugggcugggguugcuguguagcugaggagaaccuugaauuucugguccuccugcuuccaccucccaagugcugagggacugcaggcauguauuaccaugcccaucuucauuaauuaauuagguaaucuuccaaacuaggcuaugugaaagugagcaggaugcuaccugugacuauacacaacaccaagucaagauaggcuauccugagaaaaccagagccaugacuccaagauucauccaccuguaggucuuuugugacuguuguucccacguuaguucuuuuuguucuacauaauaccacuuuuaaaaccccuuccugucauuucaagagggacaggugcauuuuacuuucaggagguaugaaaggugggcuuaacucagaauuuguuuggauuaaaauaguagauaccauaggggacuaauauccaauauauauaaagaacucaagaagguggacuccagaaaaucaaauaaccccauuaaaaaauggggcucagagcuaaacaaagaauucucaccugaggaauaccgaauggcugagaagcaccugaaaaaauguucagcauccuuaaucaucagggaaauacaaaucaaaacaacccugagauuccaccucacaccauucagaauggcuaagaucaaaaauucaggugacagcagaugcuggcaaggauguggagaaagaagaacacuccuccauugcuggugggauugcaagcuuguacaaccacucuggaaaucagucuggcaauuccucaaaaaauuggacauaguacuaccagaggaucccacaauaccuguccugggcauauauccagauguuccaaccgguaagaaggacacaugcuccacuauguucauagccgccuuauuuauaauagccaaaagcuggaaagaacccagaugccccucaacagaggaauggauacagaaaaugugguacauuuacacaauggagugcuacucagcuauuaaaaagaaugaacuuaugaaauuccuaggcaaauggauggaccuggagggcaucauccugagugagguaacccaaucacaaaagaacucacaugauaugcacucacugauaaguggauauuagccuagauacuuagaauacccaagauauaagauacaauuugugaaauacaugaaauucaagaagaacgaagaccaaaguguggacacuuugccccuucuuagaauugggaacaaaacacccauagaaggaguuacagagacaaaguuuggagcugagacgaaaggauggaccaucuagagacugccauauccggggauccaccccauaaucagcuuccaaacgcugacaccauugcauacacuagcaagauuuugcugacaggaccccgauauagcugucucuugugagacuaugccagggccuagcaaacacagaaguggaugcucacagucagcuauuggauggaucacagggcccccaauggaggagcuagagaaaguacccaaggaccuggggggaucugcaacccuauaggaggaacaacaauaugaauuaaccaguaacccccagagcuacauauguaucagaagauggccuagucggccaucaguggaaagagaggcccauuggucauacaaacuuuauaugccucaguacaggggaaugccagggccaagaagugggaguggauggggaggggagugggggaggggagaguaugggggauuugaaauguaaaugaagaaaauaccuaauuaaaaaagaauagaaaauaauaauaauaauaauagacaccuaguaugaucuagcuaaaguaaagacgugagcuuuuuuuuuuaaucauuuuaugugugggguguucuaucugaaucuguaucugugcauuuuggugcccacagagaucagaggagaagggaucacaucuccuggaacuagaguagauggucaugagcuaccacguagaugaaguagguacugggaaucgacuuggguccucugcaaguucagcuaguccucuugaccacugagccuccugucuacucuucuugcgugugggcuccaugcccuugcccugcaauccagcucuucugagggagguggcaucacugcugaccgugacucacugugcagcauacaguacucagagcacccaacacucagaguccuguucuggcuccaaaggcaaacaucacaaauaagagacaugacguuccaacuaagauuguagggccauccgcagcuuccaugggcucagugggggaugggauucacagucuguaugaaaguggguucagucucggcguuggucaucugugagaggugagugcuguggacgugagugugugcccuucacuccucaacaaugacagaugcguaugacacugggaagaugaggcuuuggcaccucgcugcggccauuaagccucuucuagugacugacauaggugacagcuuguaagaccuaacacugaaacuucucuguuccugucccccacauccccauuacacagaccugcaugugggaggccuggcuuugacuucuggauaccucagugucuguagaaggccuuuuccucauccuucucauccuugucuaaaaggaccaaaaagauucucuuuuuuuuuuuuuuuuuuaagauuuauuuauuuauuuauuuauuuauuuauuuauuuauuuauuguaaguacacuguagcuguccucagacacuccagaagagggagucagaucucguuacggaugguugugagccaccaugugguugcugggauuugaacuccugaccuucggaagagcagucgggugcucuuacccacugagccaucucaccagccccaagacucucuuacuuauauauauauauacuuuuauuuuuuuuuauuuuuuugguuuuucgagauggguuuacuuauauauuuaaagcuccagaauuuuuggauauaagaaguagaaaagaucuuugagauacuuaauguauauaccacaaagauguccauuggcauaguaacucgugaguuucuccuuuaaaauaaggucaaauaaguuuggaaagcccuagagauucaguucguguuagccaucauaagaauccagacgucucauauuaugaaugaaggaagggcuuguggguuuuccagaguuuuccaaagcuaaugccaggaagcagcaguacugguuuccuggugucucuggcaaccugcauugccaaaugcuagugaaagucagcuucuucccgcucucccuguguuuaauuuacuuguucaucaggaacaagauuugucauguuaucgagggcaccuuagugacaucaucaagaucuguuauguuacccaggguaccuuagguaacauuauuaaggugagucaguauacaaaagaggaccaaggcuugagaccgaggacauggcuuagugggcaagaauccucagacccaagcugggcaggggccauguaugcuuuaaucccagcacucagaaggcggaggcaggcagaucucugugaguuugaggucagcguggucuacagagcaaguuccaggacacccagagagaaacccugccuaggugguggaauacgcagacauguauuuggaaucuccgugcuccacaggcacauaggaggcaaaaguucacggguuagacaccugcauacuuagcagaaaaucaagagacuccuguuucaaacaaacaaaaggcaaggaccuuuaccaagauuguccucugaccucuguaccucuacacuacauuuacacacacacacacacaugaauguacacacaaauacauauccagaaucagguuugcaagaauccauucuaucagccuugucuagaucagaccaaugaguuuuuauuaggacauauauuguuauaaccccuuuuuauaguauugccuacauucugcuaaguagaagggauagcugcuuacacagcagguguguuucuuuucucguuuccuuuuuuuuuuuuuuucgguuuuccgagacaggguuucucuuuguagcccuggcuguccuggaacucacucgguagaccaggcugaccucgaacucagaaacccgccugccucugccucccaagugcugggauuaaaggcgugcgcuaccaucgcccagcaauaaugcaugucuuauucugaguuagcacccuguucuuucuucucuguauugagguugggucauugcaguggcuuagaaacacaccuguugccgggcgugguggcacacaccuuuaaucccagcacuugggaggcagaggcaggcggauuucugaguucgaggccagccuggucuacagagugaguuccaggacagccagggcuacacagaaaaacccugucucgaaaaacaacaaaaaaaagacauucauuauucaguugcucuugcguguagaaucuccaugagugggguagcuacagauacagacagacucagguaagugcuuuugguaaauuccaaacaaaucaaaacacucuuucucgauaugcauaguaguuuccucaaaacaaaacaaaacaaaaacuacauguguaugaaaacuccccaaaagacuuugacugagcacgcacuguugggcauuuauuauguaacagcacugaugucugcgugcucuccaugaauugacccauucugucuuuguaacuauuugguuuagggucuaguuucaugugccuguuguuaagaugaagagacuaaggcaaggaagauagguuaacugucccccaacuguccagugguagcuucagaacacagucucagucuucugugucccugucaucugaaagacccagaaagguaguguccuggauauuuauucuacagaucaugaccagauaaaggcuguuugagaucugugaauccauaauauccaaaaggaauccagaccaggucaccucucccaccacaguuccugucuacccaggagaaggacagaggagcuguuggaggguguuugggcuggcguugggcccaggagcccuccaggaccugucaacaagucuucagagaacacagacaggaaacaggcagguugccuuuguccuuccucaugucccuccaucucuugccaaaaacccagcccuagauuuugcauuuagcaaguucccaucacagagaagaugagaaauaucagggagcagagagaaagcacaggagaccaaaccccuuccagguugccaggcuagggagagucuugggacuuuucucccuccgaaaguaauuacacugcugugacaggugucuggguggcaaacauuccucuguaucccuuccucugaaaagaagaaauccugaguacacuugucuugggguggugugagaugacaccaguuugauacuggguagacugggcaaggugggacaaacguaggaagugggggugggaggcagcccagggacuggcugcaccuacaucuucugugaguguucuggugccgauuuccccaauugugcauaaggacaaaagugaugacucuggcccuggugauugucagugggaaauuaacucacgauguugguugcuuccaaacacgagugaauuagacuucccaguagugccaguugauaaggagguauaugauguuacagguuaagcucuacagaaugaaaaugaaugugaaaaaauuuuaugaaguuaaucaucuguuauaggcucaagacaacccaguaaacucugguaugcaucauucacaaaagguagccuaauagaaauuaagguucauuuucaacaaaaauuaagacaagaaugagaaaugaggaggcuagccaggcuguggcacucaggauacagucagguggaucucggugaguuuagaggccauccuggucuacagagggaguuccauaaaaacugaggcuacacagagaaacccuauauggaaagagagaaaaagagagaaggggcugaugaggggcuggagacggcacagugguuaagaacacugucugcucuuacagaggaucuagguucaguucccagcacccacauggaggcucacagcugucuguuacuccaggccuaugagauccaaccucuccugaccucuaaggucauacauacauacauaauggcauacacacauagcacaguacguuuacucagugcauuuauuggugagauagucauacacauacuacaaauaaaaucuuuuuuggggggggggggaggggaggauuugguuuuucgagacaggguuucucuguguagccuugacuguccuggaacucacuuuguagaccaggcuggccucgaacuuagaaauccgccugccucugccucccaagugcugggauuaaaggcaugugccaccaccacccagcugaaauaaaaucuuuaaguaaguaacaguuuuuaaagagcaggaguugaaggucaucuccagcuacuuaguuugagggcuggggagauagguggcucaguggacaaaacauuugcugcaagacugacagccugcauuugauccaccagaccaaugucugaaggagaggaccagguccuuguuggucguuguucucugaccucaccacaggcacuguggucugagucuccuccacacaaaguaaauaaacgcuguaaguccucuugucgcucacuguucauugcccugugguuugugugcucaggcagugguuccuggggaagcccacacccuccaagcgucugcacugaacauugcuaacacucacuaaugacuaauuauaccucaaaacucuuuagguccuaaauccucauagcaacucugugacaaguaggcucccaaccuauccacagaugggacgcuggggcacagcacgcuuaugucuccauguucaggucacgaagccagcagagguagaaguaaggggccagcucugcucuuccugaaggguuuaccugaccaagccugaggcuguacuggagaaacaugugaacuguuagagauguguucagacacagauggcuucccaggaccccuuugcuucaccacugggcuuucuucuggucuccaguucuccugaguuagcggguauugugucacuggaaugaggaaacggaagccugccaccuuguugaggcagguuuuucuuuuugucucaacugagcuucacacuguaggcuagcuggugggguggggaguucuggggaaggcucucccugugcugagaauguaaugcgugcucccaaguccagcuuuuauguagguucuaggggacccaacucagguuguagagacggcauagccaucucacuugccugggagacacaguacaaauguacauguaagagcuauucucuguucugggaaaacuucuuuguucauaauuaagaaaauuccaagaaauauaguccaagucucuuugccuugucauuggcacuuagcugcaucuugggcagccucuuaacacauugacauugaaguaaugguagaucccuacuaaggcuccugucagcuuuuuuaggucuuuuauuguuuuguuuuucagcuauccugugcugccucauccuuauuuguauuagauuacugauucuggggggcugggagguugcuuggggggugagugcuugcuccaagaucaugggcaucugaauucacacccccagcacccacagaagagccaguggcagagacaagcaggucacaagagcagccagguuugcagaaaugaguggucagugggagacccugccucaacaaacuguaugcuagaggaaggucuccaaaagugaccucugacuuucucucucucucucucucucucucucucucucucucucucucucucucucucucucucucucucucacacacacacacacacacacacacacacacacacacguugaguuucuuguugauacaucauuguuaagucgucagaaucaccuacaaaguauaagaaguguuaaaauuuuuaaagucauaagucccaaacuuuaagaaucugauucuuaggaaucuggcaaguuccagacauuuuaaaaguuuuucauccaggcagugguggcgccuuuaaucccagcacuugggaggcagagacaggcggauuucugcguucgaggccagccugaucuacauagugaguuccaggacagccagggcuacacagagaaacccugucucgaaaaacaaaaaacaaacaaacaaaaaguuuuucauggggguucagggagcaguuggagagaugguucagcaaagagcacuuguuguucuuccagaggaccuggguucaguucccagcgcucaauuggcagcuggcagccaucaguagauccaguuccaggaagucugacacucucuucugaccuccaccagcaccagucauguaugugauacacagacauccaugcagacaaaacaggcacacaugcaaaauaaaauguuucauagaggcaacggcuguggcuugccuaucaugcacaaaguaugucccccuauaccacuaaauaauacugaggcuuuucauuugcaucaguagauuaaguguguguggagaggggggggucacuaacuacuuagacaguaucccuugggggcaauguguccacccucuguggugagggccgggguuauaaucucuagcauguuucacacucccaugugcauuagcaaacaauacagacccuagccucauccguauguccacacgucugguucucuccagccuuuggucaagcucuacagccuuuucuuccugggucauugcagcacugaguuccacuaagcagaugaucuagggucugcaaccagcacuuucucuaccugcaaagaccuggcuaacuccagggacacccaggcuguuugagcaagcuaagauuauaaugauucggggugucccaaagcaaacuggcacuuccuggaaucagacacuagccagucagcucccccuaugcccuacuagccaggcgccauccaaauaaguaaggucggcagugcaggagagggacaaguccuuccugcagaacagauuuccuaguaacgggcaccuuuaaaggcaagguuuguagagucgucaaacuuggcaguuaccuguuugaauaauaaaccucuaaaccccagucccaguuauguaaacugugaucgauaaucccugugucacaggauucagugguaaaaccgguggaaagggcucagccccgugaccaguguagaaccaccaauaaauggcaacagggaucuguuuccugccccuuggcugucuggcagaaugcuuucagggaaggaaggaaacaggaccuccacccuuggcaggugucugcauagagauccggggauuggaagcaauaaagccugucuccagguguggcagcuagugcccuuugaagggugaauuugucauggaucucugagaugcugccagucucgcagcagcagcugcagccaccuuugcacaagcucuggccauucucccugcugucuuuguucuauuucggugccuguggaggugcagggaagcugcugucuuccucggguugcuauuuaaagacauucugaaagaggcugcacuauuccuacugcaguggcggcuguggcuccugcuccugccacagaaggcugcaagcccuguggccgcugaaaccuuggguggagugccucagcaaaagcuagccuggaagcacacacauuagaccuggggacuucugcucucugucuuuuguuuaggacccugagccgucaucucuaccaggagcuuacagccagcagccacuuugaucucugucccugcacugccucaccuaccuauaucccuggaaggauuuuuaaccaguuagcuucucccuuguucuccagggaaagucaugcgcaauacuccccuccucuuccaccccaucgacaguucacacuugggauucuuuccccauuguacagcuaggcacaauccaggaggggucagggugacgcuugucucuagucuaauagaaauauuuugaaaauaaaugcucucugaaaggcucaguaaccuucaguuaauaauaacagcagcuugggcuuuagugagccuguguucucuagccaccaggcguggauagaaucccuuagguggcaggacuccugccccucugcugacuucccugcacucgcgaugcagugucucaaaagccuggccuugcuguugguuggagucagcccuaauuucuuuuuccuagaccucucaaagcgaagcuuuagauuuuaucaguaaaguagcugggccagcagccgccuccauuuggcucccccaacuacccccuuucucauuaugguggagaggcugccugccuuguaggcuuggagcccaggccuguuugcuggccucgcagaauucccccagugcccucagcgcugcacaguagcaccaucagauguuucagugugacacacaugccacuaccaccugacccacacuggccccuacacugcacugaagguuuccuaaggugcacaacucgcuguagcuguuuuauacuacagaaauucugugucugucuguuacacacgaguagaaauugaacauauuaggugaaauggaaagcucucucccaccugaaaccucauuguuccucuuguuccuuguuguucuuuuuacuuacacauuuuagugaugauuuagacagaauuguucuuuaugaguuauaaauaguugugguccuucaaauuuccuaucugccuuuuuguuuuaccuuguuugguuuuuuugagucagggguuuucuguguagucuuggcuguccuggaacucucucugucgacuaggcugguuuaaaaagcacagagauccaccugccucucucucugccucccaagugaguguucagauuauauguuuuauaacauuaacuuuggcugaugggauggcucagaaaguaaggguauuuacuaagcaugaaugguagguacccugaucugguccccagaccccaccuaaagguggagagaaccaauccacaaagguauccucuuaccucuaugcacaugcauacacauuauuuacauacaauaauaaauaaauaaaugagcugggcauggugguacacaccuuuagucccagcacugaugggggggggagaaucugugaauucaaggccagcuuggucuacagagaguuacacgauagccagaguuacauaagagaccugaucucaaaaaaccaaaacaauaauaauaauaauuaauaaauaaauaaaauuuagggucuggagagaugacucaguaguuaagcacauguauuaucucaugcagaggacccagguucaauucccagcacccagauuggacaccuuacagcugcuuguauacccagccacaaaggggucugacacuccucaccuuggcagcaggccuaacucuaauguacagaccaacacacauauaauuaaaaacaaaauaaaucuuuuuuuuuaaucuaagggaguaaggggacauugagauaacucagagggcaaaggcacaaaaaagcacuugccacugugccacccagcauugugagucugagcccuggauccuacgugauagaaaagagagucucuacuguggcauacauauccacauguggacauaaaugccaaauaaauaaauauaaacaacuaacguguguguguguguguguguguguguguguguguguguguaacaguaaccagccaucaagguguggcaagcagugacaccauuuuguuuuuuucuccaaauaaagccuuagugggaaauaaauaaaugaucuuuuauuacgaaaagcaaacuaguggugguggcacacaccuucauucucagcacuuggaagacaaggugggccgccuggucuacagagugaauuccaggauagccaaggcuacacagagaaacuuugucucgaacuacucuguccccacaaaauuacaaaaagcaaauauauacaaaauaaaccauguucccaacuuaccccuuccuuuucugccugcucauauuuggggcuucucucuauucuuugucuugagagccgugucuuugcccuuagccccugauagcaagccagauuucucaaagugucaguaauaauaaggauccuggagauauagauauuugcuuaagaaagcaaaauauucucacaugcguuccaucuguuagagccuacaauagacuuguaaggguggcagcagauuggcuuucuguacacuucuuuguaguaguaagaaggagaugcaguagugagugauauuuaauagagucacaucugcaaaguccaugccauugggucugccccccuucuuuacuagcuguagggcccuagaaaaacuggagaugauguucguggcuuuccuuuuaugaugauguagucuugucuauuuauuuaguguaggaugccauggcucacaugcagaagguagaggacaguauaaauauaugggaaucgucucuccuagauguggaccccaaggggucaaauucagguuuccaggcucggcaguaagugacuuuauuugcugagcuaccucaucgacauuacucuuuaaaagcuuuuuaagggaccagaggcuuaauucaguuguaagagcacuuguuccaucagggucucagaacauacacagcagcuuacaaccaucuguaacuccagccccagggcaucugauacccucuucugaccucuauuggcaccagguacauacaugcaggcaaaaacauucgcacacauaauaaaauaaaaauuuuuuucuccgggcaugguggcgcacaccuugcaggcggauuucugaguucgaggccaacguggucuacaaagugaguaccaggacagccagggcuauacagagaaacccugucucgaaaaaacaaacaaacaaacaaacaaacaauuuccagccuggucuacagagcaaguuccagacagccaaagcuacacagagaaacccugacucaaagcuacucccccugcacccccaaaaagaauuuguauggauuuucacaagaauguuuuguguagaggcuaguaagauggcucaguagucaauagcaguugcuguucuugcagaggaucuagguuugggucuauaacuccaguucuagggaauucaacaccuucuucuggccuccaugggaacagggcacauacuugguacacaugcacauguaggcucuugaaaauacccauauuuacccauaggauaaacauaaauuguuuaaaauauacauuuaugucuagcauguuggcacaugcuugaauccuagcacuugggaggcaaaggcucaucucuaugaauucgaggccaggcugaucuacauagcuaguuccaggacuacagagaggggcagugucucaaaacaaaacaaaccagaccacaguaccuguguggcuuccgaggccaccugcacacacauggagcauauaaacaaacucaugcaggcgcacauacauagacauaaagaguaaagaaagaaacuugguuguuuuguuuuguuuuuuaaauuuuuuucccuugggcuggagcuauagcccaguagguaauaccugaguucagccaccagaaccugcaccagcguuuguccucugaccgccacguguaugugcacacacuggaaacaugcuacacacaaaagaaaaaauucucuuuuuguuuguuuuuuagagagugccuggccuccgacucucuguguaugaccgcuuugcugcauguaugucugugcaccagaggagggaguugcauguucuagaacugauggcgugacaguugguugugaggcaccaggugggugcuaggaaucgaucccaguccucuaccaaagcuguccugcucuuaaucacuuucauggcaauccuccagccuccgugaucuuuccugauucacacuccuacugccaucucuccucugagcuccccacagaguuccucucagacuucacaugauauacacacuacauauguaagaaaaaaauugacaucuuguuuuucugcuucucccuuauguuugaaaucauuuuuuaaaaaauuaaagcaagggcuugagagaugacucggggguuaugagcacugguuggccuuccacaggacccaaguucaauuccuaucacucacauggcagcucacagcucucugucugaagcuucaguuccaggaauucuagcuucuaagggaucuauccacauguggugcacagccacacaugagacaaaauacccauacaaauaaauuguauguacauuaaaauaaaucauauauuuaguguguguguguguguguguguguguguguguguguucaucuugaugggaauuguggcacacacacaccuuuuauccuaacacugggaagucagaguaagcacaucuuaaagaguucaaggccagccuggccuacauagcaagugccaagcuaaccagagcgaacauaucaagacucugucucaaauaacaaaaauaucucuguguguguuagaaagguaggucuggcuagagauuuuuuuuucuuccucccuguaguuuccaaauauucugacuuaugguuauguggcuuuuauaaccaaauaaauaaacauauuuaggaucuaacaagaagaauaccugccauuuauuucuucuuuugaucuuaacucaaagacacagcuuuguaggaauguucugagcguccggaaagaguccucggcuguuuuucugcuuuuccauuugaaagugcaccugugugcccaaggcacuucugcucacauguucuguuuacuaagccuucugugucucagccaugccaaccccaaacauugcccuuguugcugaaacccccaagcuggugaacaggaugggugggaaaauggcugugugugguacacagucgccccugucugcuggugaggcaccucagcuucagcccuuccagggagguuucacacaaggaagcuggugcugcuuuaagcucuccugaccuaggggcuagguggaggugugcacaccucaguauagaggacauguuuagcauuagguccaaugucuaugugagaguccaacuccaaaaaggaaacuccccugaaaccacaaagggcuucuucuguccagugcuuuuggcagccaccugcugcucugagcccuucugaaugagaggaggcaccucccuccccacaagcacacacuacccaugcccuguccucucccugcaguuuuggggcuugauuggggugggguggugugggguguguguguguguguguguguguguguguguguguauagauggcagguauaggguauguguuguauguguguguagauggcagguguuggggguuauagaugggguguaugugugugugugugugugguguauguaugugugugaguaugugugugugguguguauguguguagauggcaggguguugaagucuuaaugagagccccccccccacaggauugcuuguauccugccuaccucagaggguccugugaauaacuuuaccuuugaacuuuucuuguauucagccccugauccuuaggauuuggugacaauccuuggcugacaggaggcuuugauccuuggggaguucagaggaagucccaugauauggaggaggauuggagaucggcacaggagggggggcugcuaagauggacccguuaauuaagaagaaggcuuugcuuaacacucacacagacacacaaaaaaagcccagagccugaugacaggagcucagccaggaugccauguguuagcacgagcaugacuguuauuuaagacacaacagugcccaggagagauuccuacccccaccccaggaagagcagaauaccugagaaccgccccauuuaaagagguaaagcuggcuuucuuugaguggugggugucuccaggagaaagaagucuugcaggucucugaauguagcucagauggcagagcgcuugccuggcccuggguucagucccugcauggcugaaaccugaccaggugacaugcacuguacucucggccucuggaaggaggcagggaagauucacagucauccuuggcugccuagagaguuagaagccagggacagcaagauaguucaguggguaaaggcacuugcugccaaaccugaggaccugaguucaaguccugggacccgcaaggcauaagaagaaaacuuacacaugugugagucauggcacaugugcauucacauacauauagacauacuaaauaaauaaauauaguuuuuauuauaaauauaacauuuuaaaaugcuuuugcuuagggacgacuuuaucucaaguggcuaaagccauucccugguaccacccaaucggugucacagugacacuccuuucaccagcagaacguuguagcuugucucccucccaccuccaaggcagguguucuccuuugauccugauaaucaggcacaccauuuaccucucaguagagaccucacuguguaaccugugccuccugccucucugggcuuuggcugcuagaggcugguucauggaccauccaucucuuuagcccgguacauggccuggguaccacguaggcccuucauaaugaucagagugagugguaacuaugggcaggagcuguacaguuguccucuuucuggcaucaucucauuuucacucugccaaaaaagaugaagaccaguuagcagagugugggcagggcuagucagggugggaugcccgucuuacuccuggugugucuaacagcuccuugagaaaguccaggacagcaucuuagugagcuuggcucacgggcucaggacuuaauggagcaacacuuggaaaaggaacagacauggcagaacuacuguguaagaccuguguucccaugcaaaaccaaaacacaaggcccccacuaauagggagggggugggggcagagagacgguccagcaguugagcauaugcuguccuuguagaggacccaaguucaauuccuagcacucacauagcagcucacaacuguccauaaguccaguacuaggaugcacaugaugcacagauauccaugcaaacaaagcacucauacacauagaauaaaugcauccuuaaaaacauuuuuaaagccagucaugguggcucacgccuuuaaucccagcacucgggaggcagaggcaggcgcauuucugaguucgaggccagucuggucuacaaagugaguuccaggacagccagggcuauacagaggaacccugucuccaaaaacaagaaaauauauuuuuuaaaaagaggggccaggcagugguggcacacgccuuuaaucucagcacuugggagacagaggaggcaaaucucuguaaguucaaggccaaccuggccuauagagcaaguucaaguucagaacagccaaggcuacacagagaaacccugucucaaaaaaaaaaaaaaaaaagaaaagaaaagggguguguguggcauuuauucuaaucagaugcagcuucccucccccccagaauccccguuugcguguccaggugguuacugauugccauugagguugcucugaggagaaacugacgugugaaauaauugcaugcuuuuuacagcucauuuuuacucugugcagugucgaucugaaaugcaaauagaagaguauuuaccucuauauacagaauugccagaauuacaguguguauccccccucaucuugcacgugcacgugccuuuccgugauugaaaacuggaagaacaugcaaaagugagcacaacuguguccuuacucgccugccugcugucagccugcaccuccaucaggcuggccagccagggcagcaaggacgacaggcuggccugcuucauucucugucacugucuuuagguaaauguuucacuaaaacaaagaagugggugggugggagagggugucacauagagcucccugaccguccgucuuucugagacagccauuacucuugugugguagucauagguucuagcacuccuugaccaucuguccuucugagacagccauuacuuucuuguguggugggcacagguucuagcuggaauggaaaacuggaacucuccaggcugucaguaggucuauuuacucaguuguaggaguaacagacaccuggaccugcuucuggcuggaauuauucucccacucgcuguaagucuaccagagucuuguguugauggcguauaauuaacacagucaaaaauaacuugugagagacggcgugcaucuccucugcucacauuccugcuccaucguuucacuagaugucauuuacaagucauaaauccaguaacaauuauuaguaguuuuaauaguucaauuguaggucauuaaagccggcgcaugggcuugggggacuagacuggcugucuggcacuguuugguagauguucuuagagucacgaggcuggucaggaguggcaugugugccuucaucccaucauggauguguuagagcaucugccagaugccaguuuugugaaguccuggcccucuguagaagaagcaaggcacuuggcaucgguaguaccugugaucuaaugaggaaaacauuuuuuuguuuugguuuuuuuuguuuguuuguuuguuuucaagacaggguuucucuguguaguccuggcuguccuggaacucacucuguagaccaggcuggccucgaacucagaaaucgccugccucugccucccaagugcugggauuaaaagugugcgccuucacugcccgacgaggaaaacauuuuaaauuauauaauaucaauucccaaccuaaauaaaaaaacaaaaucacaagaaauauuuaaauuacaauugugauaggggcugcaaacagaauuugaggauggguguuagagagaaaagcccucgcaagugguaucuuggcccuauauauaggauaagcaagcagggcaugaaacagccuugcagcagaaagcaugugcagagguggagcccuggaaaggcgcucugcuuagagaaagauccacagagccagaguucaggcagcacaggaaguccagguauaggcaggaagagcccagggcuuuuaggggaacccuguucccuaccuugcccuacucauccccagugccaugaugaccaaaaaccucacaagcuagagggguucuauuuucucauagcaaguccaggacaccaagcagcacgcuggggguugugugggacugaggugccugcaugagucugggccagaccauguguuugccgcccacuguuucuggucauuucugcaauucacuauacccaaaguauaaucugcccucugucuucugcccuuggggccucaaauguuuucuguuuuguuuuguuuuguuuuuuuuuuuuuuuacuuguuuuauuguuguuuguuuugcucuaguuugagacagggucucauagccuaggcuggcacugucuccucuauuguagcugaggccagcuuugaacugcugacccuucugcugcuaccuuccaggagugggaucagaagcaggugccaccaugcugagucagguucuguuuuacacucucaugggcuugucuacuccauccugcuuuccuguaauucuuuccaggguggguucuaaguguagccuugacuguucugggauuuacaguagagaccaggcuggccucgaacucaaagagaucugucuucugagugcugggauuaaaggucugugccacuauaaccagccuuaacaaaaaucuuaaacuagaaccaaacauaucucucucccuccgaaggaugaggcauggggaccccacguuugaggucagucuguaccccagaagaccaggagacggugagcugggucagugguaaagacugucgccaucaggccuuuggccuuaguucuacaucaggcuccacauugcaaagggagcgcugacuccuauaugugugcuuauauagacacacagagacccugaggaagaugcaggcagccauuugugcccacacacucuuggcugccuuuguccugaggccucugcuaucuuuugacuaaagggggagggucuaggagcuauacuagggucuggaaauaaugaggcacagacuuaaaaaucauagugagguguugcgggcagaaaccacaaaggaaucuuauguggggcacagccagcuccaugcuccagguuggaaggucccugcauuaucuuacaaggacgccagagacugcuucccaguagacaugugcucaugaccccaucucuccauccaggugcugagcgacguccucagggaucucuaucacuugcugaagcacguggugcgcuuggaaccugaugacgucgccaagcugcaugcccagcuggcccuggaggagcucgaugagaucaugaggaacuuccuguucccgccccagaagcuggagaagaagauugugguccugccauagaccugguucacagaacauggaagaaggcaggggaaaccaagcagccaaagcaguggucacacaccucccagcaggugucuccaccgccuccuuggugcagaccugaggucugcuauaaccugaagguagcuauacggugcuggcaccacuuggguguucagggcuaccuuucuagagcguccauuuggucacucugcaucuggcccaaagcuugugcagugagaagggugaaccccaucuaacuacacccuucaucgucccagccuuuagaggaggccuguguauaacuguggagcauuuucuuccggcuggagaagccgccccaccccccuggucccaccuugauauccugucauagggagaugauucugccugugaugagggacaggcagagcuaucaucugggugugcagcuguggggaggggaaggaagcauugcugcuuaaacuacacaauacgagagaauaaaagaauaaaauuaccuuggcuggaaugaucagccaaugugaaugcugucaccgagcugguugacuuuugcagaagaagaguaagcccugucuguccucuggggccuuuuuucuuuuuauugcuccucuguuuuuacuugagcugccauucagucuucugcaccucucagggugaugcugugacaguggaguggucugagaaaggcaggcagggcuuauguggcacaggaguggccugccaccagcucacugaaacaacuucagauuuagcacuguguucauccgcucuuggauuuauguauuuugguauuuucauugcaaaagacaagaaaggguuaaaagaagaagaagaaggaagaggaggaggaggagacuggggagauauggagauaccuuagucccugaaguacuuaugcaaacuugaggaccugcgcuccauccucugcauccagguaaaaacacugcuugagguggcaugugccugcaggccuaaggagcaggggagggugcagggacaggugcauccuggaggcucacaggcuagccagucuaguuaauuagucugugagcucucagccaccaagagaccccacccccaucccuuucucucucucucuaaaaaaaaaaaaaaaaaagggcagcgccuccugggaaacagcacccaacguugaccuuuggccuacacacacacagacacacacacacacacacacuuacaugcucguacagugucuguucaacucaugagcccacaugaacauacgcauacaugaacauauauacacaggcacagugugugugcaacuucguccacauggaacggaaaggaaaaggaagcaacuggcugcuuccgauaagcccgcucuguagccuacgccuuuauaagaugaaugcgguguucaucgauccccagcaucacagagauaaguauaggacucuaucucgggacuuuaucuaucuccacuuucugggguauccugaucuaaaggaagcagaacugugacagugcaggagacuauggagugacauucagguguucucgccuguugggagcaagccagauuacacagccuucucagcuuagccuucccaguaggcaucgccagaaaggugccaaucacugauacaaaccacaggcagugugucaagcaaaggaucaaacaaggcugccguccguggcagcacguaccucugaucccagcacucaugaggcagagacagguggacuucugaguucgaggccagccugaccuacagagugaguuccaggacagccagggcuacacagagcuugaauguuuugaaggaauauuucuauucagcuaggguagcaguauuaguuuauauuuuuuaaaucaagagugccuauaaagucaggguuggagcugcuuaagcgaguguuacuuagccuuuagaauacauccaacccaaggcuggagagauggcucagcaguagaguacacacugaucuugccgaggacccaaacuugguucccagcccacaugagauacucacaauggcccguggcucuggcuccagccgauugacaccucuggcuucuuaagaguaccagcacucaagccgggcgugguggcgcacgccuuuaaucccagcacucgggaggcagaggcagguggaucucugaguuugaggccagccuggucuacaaagugaguuccaggacagccagggcuauacagagaaacccugucucgaaaaaccaaaaaaaaaaaaaaaaaaaaaaaaaaaagaguaccagcacucacauguacauaaacacacacacacacguaauuaaaagucauuuuaaaauuauauauaauauauuuuaaaagauagagccugcuucgcaggccgaguacuguccacggcguuuaggccagugugccugaagguguacacugaugacuuuaagaucuucuccaucugaacacguccaccccucccagccuuagucucuuuaucucucuguauaaguggacucuuaguuugaacugcuaucaaaggacuagaguauuugauuuuauuaauuuuugguguucucaauuugagagaguaauuuuuuucuuccggacuucauuaucaaauucaaagggaagaugauuuagugacacccuuguaagcaugaccaaauuauuaaaaacugucagauaacucuucuaagucaggcaugguaguuaacacuuaugaccauggcgcucacagggcugagacaggaggguuuuagugaguucaaagucaaauaugggcuguauagugaguucuaagacagcuuggaucacaguauggaauucuaucugaaaaaaaaaaugaaauccuagggccugaagaugucacugagcugcacacagcguuggauucaauccccaguaccucaaaaaucggacaccauaguguagaccuguaaucccagcacuuuggauaaaaaggcaaaaggaucauaaauucggagccauccucagcuacauagcuaaccugggcaacaggagacccugucucgguuauaauuuuuacuguaaauuuacucauguguuucugaaugaaaagcucuaaggaacgagaauaaugggauaggaaaagcacaaacguaacuuaaaggguccaucugggccuggugacacagaccuguaaucccagcuccuggggagcugaggcaggagggugucaagcucaaggccugccugggcugcagugaguucauggaaacccugagaggacaggaguccuaccucacaccuaccucuaugggagguagcagcauugcucagccuacaugaggcccuacacgcaauccccagcccugaaaacaaacaaauggcaugaaccccaaagcuggcacgcggccggaagaacccugcuugcuugcaugauggauccugaguggccgagcucucugucccaccucugacuguuuguccuuucucaaggggcaguccucuucugcuuccccuauuaguccuuccaucccacaucugucacuggcaagccugagaacaugaguucaaaucccaggaucuccaugauaggaggaaaggcccgauucccucagguuggccucuggcauccacacacaccauggcaagaacaccccuccccaguaaaugaauguaaugagacguuuucuguugcggggcggugguggcacacgccuuuaaucccagcacuugggaggcagagacaggcggauuucugaguucaaggccagccuggucuacagagugaguuccaggacagccagggcuucacagagaaacccugucucaaaacaccaaaaauaaaaaaaagacauuuucuguuaaaguugcaggaagaaugaguuagaagggaggauggcgaguggugagagcuucugggaguugagacaugguggccuggcugggaagcuggaagcugggcaagcuggagagagggaaggagggcaggagggagggagggaggacugaccacacagacacgggaagaagaucucugggaaagggaagagcaggcacaaagccccagaaggagaggaggcuugaggaagagccgggguccagacagaguaagaggagaguggcggagggggcaggagggggugccagggggguuguucacugaacaaagcaggcagccacagacccauuucucccugaagccacuucuuuccgcuuguuucuggaaagugcuaugaagcuaaugugguauguguuguaaaauugaaaauaaauauaaccacacacagucuuuuuucuauuuucuccucaagcacaagaaagcagcaggcagaucccucucuauccccaccccccaucuccgggcaguguggcuucaguugcuccuccaacaacagaaagaggacaccaagugugugcaucugccaggguccuccuaccaggguccucccaccagggucuucccaccaggguccuuccugucccuuuagcucagaggacaccugagugaagugcugccaucugccuguaacucucaccagggguuuggcgggguggcugugacgugggaaaguugauuaguuugcacaauaagcugggaggaugauccaucugacugaccugcuaaaaccagagcgagucucuguacuuucccacagccaggguuucuagaguagaaaugacaguuguguccugaauaggcguugagagcuggccaccuuucccucacugaguggcugguugcuuucccugagcccugcagcggccaugaccucaagggccuggcuguguccugcugcaggcuggcuugugcugcagucacaugugcagccucacugcagagugcugcaccucugacuucaugcaccacucugcucggagcucaguguccucuuugcuugggggcugggaaugagucuggcugcucuggcugaaucgguacugcagccucuugccugcuggccagcucaggcugugcucugcacacuggcaagggaaagggaagccagacccucacagacccugggagggacugcacccucuuagcaguugagggucaucccuggucccucccacagcuccucuuacugacucaguagcuuggugaucccuaaacuuccuuucugccccuccccgaggugacccucuguggucuccaaggaccacagaguagcguaaucaguuucguuguuuccuucaguuuggacagcuagguugcagaaucccugcucugggaggcagcuagaucugggccuugucuguccuggccaaggcacuguuuacuaccuuggaagaugggucaugacauuccauggccacugcuggauacugcgggagcugcuucuccacugaagugaagaccuuucacacugggaguacagcucaaugguagacagcuugccuggcacacuugaggccuggguuccauccccaguacacacacacacacaacacauacaacacauauagagagacagacauuagugggggagacauggaaauggagggaaaaagacaagagaaagguaucuugaucauaaacuugaacugcaaacucaaauguuacacacucagacccaggggcgguuugaauaagcauggcccuccuaggucaaauguuugacuauuucaucucuacuugggacuauuuaggaaggaccaguagguaaagccuuguuggaggacggccucucuguauacucugagagggcauaugguguauggauuauaaauguaauggggccaggcauggugguacaugccuuuaaucccaggacuccacugaggcagauggauuucucuaaauuugagaccagccuggucuguauaguaagcccuaggcuagucaaggcuacauaggaagacuguccaagaggaggaagaagaggaggaaggaggagaggaggaaaaagaacuuuaauguauauauaacagaaauuuccagucauaccuccacuuacuccaaggcugccacugauagacugguguguagcuccuucagcuuuuacacacacauguacauauaauguauguauguauguauguauguauguauguauguauguauguaugcaggugcacauguuugcgugugcaugugaagaccagagacugauaucaggugccuuccuugauggcuccaccuuguagauugagcugggucucuguugagcccagcacucacgugauaggacuagucuagccagcugaccuucuccaggguucauccugcccugugcucagcuucaccugacgcucaugugaguauugaggagccaaggacuggccauggagcaauaaaggaagacauuaaacaucaaccucugucccccaacacauauguacacacacauacacacacacacacacacacucguguguauauacuguucaauaaacauacaaacacaaagguucauacuccacacauucccagugugggguucagccugcuaccccaguggggauggcagcuguggcucuuaaucuguguagcaaucacaaugaccauagugaucaguauagaguuucuuauggucuugugugcaguugacacacaaucacagcugggcagugguggcgcacuugggaggcagaggcacguggauuucugaguucgagaccagccuggucugcagagugaguuccaagaaagccagggcuacacagagaagcccugucucagaaaacaacaaacaaacagauacaaaaucacucacacugggccugugagguagauauugucauugguuuuguuuguuugagacauggucucuuagaguucagaguggccuggaacucacuauaugggugaagggugaagguggccuuuaauggcugaucccugccucugccuccugaaugcuagauuauaggcaugucccauuauaucuagcugagauaggugcuauuauuauuauuguuuauguuuuucuguuuuacuggugggaaaaugaggguauauaagaggucagucgcuugcuuggauuacagagcuacuaaagaaguaagcaaaccaguauuggagggggcagacuggcuccaaaaguuauacuuuuccaucaggcuuugucacugucccccuuugcucucaguguuggagagauuaaaaaaaaaaaaguuuccugcuuacuuuaguggacagccugugucaggccugcuuuacccacaguuugcuuaaaacagaaccaucuugccaggcgugguggcgcacgccuuuaaucccagcacucgggaggcagaggcagguggauuucugaguucgaggccagccuggucuacaaagugagcuccaggacagccagggcuauacagagaaacccugucuugaaaaccaaaaaccaaaacaaacaaacaaacaaacaaacaaaaaaccuagaaaagaaaaaaaaaacagaaccaucuuaggcuaagaaguggaggcacagugagacgcugucucaaacuauauuagggaacucauguuuuaggugagaacucagccuuagacaucaggacuggccagcacugggcaucuuuacuuuaugaccuuguagguuuuuuugguuuggcuuuaguuuucuugagacaggguuucucugugcaguccuggcuguccuggaacucacucuguagaccaggcuggccucaaacucacagaaauccgccugccucugucacagaggucugccuaccucugcuucccaaguacaaggauuaaaggcguguacccccacaccuggcugcccuuguaguuuuguggaagcuagaggcugggcuuguuaaaguucucagcccccuuccuccacauguugguggcuuuuuuuauggaaugcuuagauaauuagaguguuaauacugccucucugagagucaagcuacaaguauacaaacgaagaaaaaugggacacaccaugcauggugguuuaagcccagcaguugagacauagaggcagguggauccugugauuucagggccacccuaugucaaaaaggggaaagaauuuauagcaaguguuucuuugugaagaucguuuaacucuuccaucuccuguaaggagccuucguucucagaauuuauguuuaaaaugaugguuguuuuguccggggaggagaaggugggaaagagagcaaaagaaagagaaaaggugggggaggaagggagagugugugcauuuuaccugcauucauguugguguaucauaugcauagagacuagaagugggcccacuccuaaacuggacuuauugacaguuaugaacugucugauaugggagcuaaccccagguccucugcaagaacuaggaguguucuuaaacacuaagccaucugucuagcccaagacaaugggucauuuuuaauugcuauuccuuacaagauacucuaaccauauccacauuaguagcuguaaaaggagccauuccuucagagaggaaaauaugguggguggaugguuuucuuuuggagaaggaaaaauaagauccagagaggugaauggcauuccugucuauuuauugguuuuggcuuuguugcuguugcuuugugaaacaaggucccacguagcccaggcuguccucagacuugugauggagcugcggcugaccuugaacucaacuccuccugcuccuccugcuccuccugccuccaccucccaugugcugggauuacagacucucaccacacacccagcuccagagaggcugcacacagaaggcagaggaaagaacugaggggcaaaggugggugucuuagucaggguuucucuuccugcacaaaacaucaugaccaagauucaaguugagaggaaaggguuuuauucaucuuacacuuccaaauugcuggcuguucauuaccaaaggaagucaggacugaaacucaagcaagucaggaagcaggagcugaugcagaggccauggagggauuuuacuuacuggcuugcuuccccuggcuugcucagcuugcuuuuuuauagaacccaagacuaccagcccagggauggucccacccacaaggggccuuuccccccuugaucacuaauagagaaaauaugccuuacagcuggaucucaaggaggcauuuccucaccugaagcuccuuccucugugauaacuccagcugugucaaguugucacacaaaaccagccaguacaauugaucuguugucaacuugacacacaaacacaucacuauuaagucucaacccuuacucuuauucauccccaagaugaacuuucaaagccccacagucuuuacauauuaaaaguucaauccuuuuaaaauauccaauuucuuuuaaaaaucaaagucuuuuaaaaauucaaagucucuuaacagugggcaccaguaaaauaccuucuuacuuuaagagggaaaaauaucaggacacagucacaaucaaaagcaaaaucaaauuccaaccguccaacgucugggauccacucacaaucuucuggguuccuccaagggcuugagucacuucuucagcccugcccuuuguagcacacaccuugucuucuagacuccagaugccuauacgccacugcugcugcuguucuugguggucaucucaugguacuggcuucuccaaaacacugcugucuuucacugcaacuaagcuucaucaauagccucucauaggcucucuucacaguaccaagccucagcuccuuugcaugaccucuucaaguccuuggccaucaauugcaacugaggcugcaccuucaccaauggccuuccauggccucucacagugaccccuucaugccuucaaaaccaguaccaccuuggguaacucuuacacauuaccaaguccagccacagcacaagguacagccuuggcuaucucuggaacacagccucugugcucucagaaacacuuccuagaagauuccaccuuagugaugcugaucucuucuuaaucacagcuaauuucuuagcuccagcuaaccagcaucaauagucccaguaaugcaaagguuucacuuuagugguuuugguaucuuguuaaucacagcugauucuucagccccagcuaaccagaaccacagacucuucacaaucaaaacauggcccuuauaacagucuuuaaucuucccucugaaauuucacaagccaggccuccaucauuugcacuguucucaacauuaucuuucaagcuccuacacaacaucccacagaacucuuaacaccgaauggaucuucuaggccaaaguuccaaaguccuuccacaguccuccccaaaacauggucagauugucacaggaauaccccacuaugcugguacacucaggaggcagagacagacggaucucugugaauuaagccagccugaucuacaaaugaaguugucagccagccaaggcuacauagugagacccugucucaaagaacaaacaaacaagauuaauuuuuuagaaauauguuaagaacucaucagaagccaggcgugguggcacacgccuuuaauccuagcacucaggaggcagaggcaggcggauuucugaguucaaggccagccuggucuacaaagugaguuccaggacagccagggcuacacagagaaacccugucuugaaaaccaaaaaacaaaacaaacaaacaaacaaaaaacaaaaacaaaaacucaucagaaccaaaacaagucaaguauuuuguuuuuuuaauaugaaauaacuuuuaugaaaauuauaaaccuucugguuaaaguauacacaucuugugacaaggccucuaaaauacagaaacauauagcuuacaauguccauucaaugcaaugaaauauucaacagcaaaauaaauauuaccaugaggaaacguggaaauguuuuaaaaaauaaugcuaaggaaagauauauauauauauauauaacacaggguguuaugguaauguuacacauauaugcguauauauuuaccagaaagauggaauggccuuuugaagacacaguuacagcaccaauuagguagcagcagcauggagggcuggggucagggucuacagaaggcagaauaugcuuugaaucagagucugauauaugguacaguuccucccauagccaggauccauggguccaggaaucaagggguggaaagggaauaguuccacucacugucauccuagugacccucuaggaaaguuucugcuuccuguccccacaacucuagguucugcuagccuagaaguuuugguuccagaagggggagugcucguaccaggagccacaacaaacauuccauugaacuggaagcucagacuucccccuggucauuuugggcuucuaacgcucuuaaaccaacaagguaagaaaguucaauaauaacaguguuaggaggggugauagauccagauuaccacggggaaauuggcuugccucuccacaauggagguaagcaggauuaugucuggagugcaggagaucccuuacggcgucucuuaguacuaccauguccugugauuaaagucaaugggaaacuacaacagccuaauccaagcaggaugacaaaggaugaagggaugggucaguccuccaggaaaagagccaagaccugcugaguuguuugccgagggugaaggaaauacagaauggguaguagaggaugguaauuauagauaucagccaaggucacagaaccaauugcagaaaccaggauuguaaagcacuaugaaugcuucugucuuauuuuguuaagaaaacauguaucuuucuuccaguuucuuuaacaacaauugguauuuaaauugagacacuaaaagaauguucccaagggacauugccccacuauaaauuuacaaauguguuugcgauuguacaaggaauaguuauaucauguuaggcauauucaugaccuuguuauuauuucaguggacacgagauauuauuuuuuuuuaaagauuuauuuauuaauauauguaaguacacuguagcugucuucagacacuccagaagagggagucagaucuuguuacagaugguugugagccaccaugugguugcugggauuugaacucuggaccuucggaagagcagucgggugcucuuacccacugagccaucucaccagccccacgagauauuauuuguuucaagcugacaagggguagauuguaguggcuauuccugguugucaacugugacuauaguggaaugaacuauaauccagaauuggaagguuuaccugugaucuuaaucuggaggcugggagauauaaguuucugaccuggaucuuggcauggagaucuugaggcauagugguuaugaaucucagaagauuaagacugggagaucucugaguucaaggucaucugggauuaaaggcgugggggcacauaccuuuaaucugggccacccccuccugcuggagaccuacguaaggacguuggaagaaggaagauuuacucucucuuuuucgccugcuugccuugugggacugagcaacugcuagauccauggauucccauucacagcugcugcagaccauucauuguugggaguuggacuacagacugcaagucgucaacaaauucccuuacgauguagaaacuaaccauaaguucugugacucuagagagcccugacuaauacagugggugagcuagaaaacccuugggggggggggcgaccaucgguccggagauguagaaaacuggaguaucgggagcuauucaagaaaaggcagucagucuacaguauagcugggagccacgggaaccucucccuucuggggaccuggaaaaacuccugggcuuuuaagugguuuaugaaaugacguaaugcuucaucuuuacuguguaccuuaggagcugaagccggcucagaauagugccuuggguggggcuuuucugggugcagcccagucaucacacgcacagguagccaccuggugcuggagaacaaagccauccugcgcuucagagccucuagcaagaauuuccugcauauacacaaugcacagacgguuucuggaccacacaccacucucagaacuucaaaacccacagccacaauaugaaucuuaaagacaggccaaccugagccagauguguuagugcaggccuguaagcccugcucuugggaagaggcaggugggucaggaauccaaagucaucucugcuucagaaugaguucaaggccagugucggcugcaugggacccuguaacagaaugagcgaggggcagaggagugagcugggaaaguagaaaaaguuaaugcugauauucaaagaacugggaugaaaugauuuccccacccccauccaaaagucuuguucagagaguuccaaaacuagagcccucgaaucagucaaguggcuauuuccccauggccaauaccagguccauguaagucucuggacuuucccuccugagccucuggagauccuucacccauacuuuauauauauacacacacacacacauacauauauauauuuggguuuuuuugaggcaggguuucucuguguaacccuggcuguccuggaacucacuuuguaaaccaggcuggccucgaacucagaaaucugccugccucugccucccgagugcugggauuaaaggugugggcaacauuuaauuggggcuggcuuacuuguucugagguucaguccauuaucaucaaagcaggaaacauggcugguaguguccaggcagacuuggugcuggaggagcugagagcucuacaucuucaucugaagggcgggcgcuaggagaagacuggcuuucaggcaacuaggaugagggucuuaaagcucacacccacagugacacacuuccuccaacaaggccaugccuauuccaacaaagucacaccuccuacuagugccacugccuggaccaagcauguucaaaccaccacagucagccaguacucuugaggaucugugucuccagcccccucauuguuggauuuggggauuuugguuuuuuuagguuaguucaaacaggugccuaucauuaaggcaggcaaugccagacgacaaggggucugcacuguucuucuagcucuggaggggccaagcgggcugccucucacuugcuucuuggugcaggaaauggccuugcaaauaaucucagcaaggaguacccuugggaugugcacucaagccuggaugcauaauagagucacuugggaaauguaaaauauucaagccucaggccagccccaguggcuugaagaaaauugaucuaggauggguuccagccauuacuguuuuuaaaaaaguccccugggcuuuagaaaaaucuaaaacagacaggagugagagccauugcauuggugugcgugugcaugugagugcgugugugugcaugcacgugcaagcaagcucuccaagucagcuauaagagggauggauuuuauugaggaguccauucccauacagccacggggauugcaauugcccuuagcucuucgaaugcuuuugaacgguucaguuccccugcgacagcgauaaacacugcucuuaagcaagaaagaggacagacagcagaagugccagcaucguaggaguuauuuauaacugaugaccugaagauauggcuuagugguagagcccuugcccugcauggguucaaucccugguacagcaaaaaccaccaccaacaaaaaacacuuggacauggugguauuccacuaacauaaaccaaaugaucugagaggcugacuacacacagggucguaccaugaaagucuggggaaguguguguauguguguccacuuggugucacaauaaguuauguguauguauagguggggacacaaacuacucaaauagaguagguuuuuaacucccaaaggagagagacaccuucuuuagggaaagcuuccuuccgggagacuucugcagcccguucagcaugcucuguccugaugguugcuguguugucaacuugacacaagcuguuagggaagagccaccccagucaagacggugccucucgguaagccugauggauggcaagugacacugcagcauauaagaaaguaacaugagcaagccgcgaggagcaagccagugaacagcgguccuccaugcuucuucaguccugcauccaaguuccugcucugaguuccugcccugacuuuucucagugacagagugacagaguguguccccgagagugguaagcugaaauaaaccccuuuuccccccaaguugcuuuuguucgugguauuuuaucacagaaauagaaacccuaagacacugcccaucccuuauccaggaucccuauguaacugugcagggaggggcacgggggcucugagcagcugguguguaccaggcagcccuguguccuucugugguucucacaggugccugaagagcuggcacagcucggcacgagccccuccccugccaacucccucaaagaacagugaggagauuuccauauggccaaccacccaggguuucugcugcuauauacgcaacacagggcucccgggcuccgggcucugggcuccgggcuccauugcuuucgcuguagacugagguuuugaaaucuuucucacccaccugguuacagcauagaagggaugucucagaacucagaauucuaaccauuuagaaaugacuuguugggccugugaggcauuucaacagguaaagggugcuuucgauagacccaccagaccucaguuugacucuggggacccacaugguagauggagaaaacugauucucacaagcaguccucugauccccauaugccauagcaugccuucuggaaaaaagacagaagggaaagauggcugcacaaagccuucuguccaucugguaugaccuaauccugaucuucaaggcugcaugaaagagccuggcugccagcagagcaaaggacucuuaguuuaaaacaaaugcaauuccccaucaaaggcaggaguugcaacuuuagccaggcaagguguccccgagaggagcgagcuacaaaacuacagcuuugucaggcaguagcugccuugcuguacucaaggcacacacucuccacucugaauaaugugcuaagucaaauugugaaguguacugucucaagagaaggaaagcacuaucacccaguagagaaaacaaagccacuauuugauugguuggagacagaugggggacuuacuaugucuccaggcuaguccuuuccuuuccuuuccuuuccuuuccuuuccuuuccuuuccuuuccuuucccuuucccuuucccuuucccuuucccuuuccuuuccuuuccuuuccuuuccuuuccuuuccuuuccuuuccuuuccuuuccuucccuuuuuuccccuuucucuuucccuuccuuuccccuuuccuuucuccuuuccuuuccuuuuccuuuuccuuuccuuuucuuuuccuuuucuuuccuugccuauucucuucuuuccuuuuucucuuuucuuuucucucuucuuuuucuucuucuucuucuucuucuucuucuucuucuucuucuucuucuucuucuucuucuucuuccucucucucucucucucucucucucucucucucucucucucucccucucuuucuuugggacaggauaucucuaguaucucuagcucuggcuacccuggaacucucuauguagaccaggaggcaagccucaaacucacacaaaccugccugugucuaccuccugaaugcugagauuaaagguguguaccacuauaccuggcucaggcuagucuugaacucacagggucaaguaauccuucugucucagccugccccagcuugggggaaaucucucucuuuuuaaacacuucauccugccauccucugggcccacagugggugacacugucaccuucugaaagcagcacccacaguucuuauccccacccccucucagcccucugcuggcugauucgccucucagaccucugaguccugauucccauccuuaccgauaaauguugcccgugacccagucuaccuguuagcagugcuuguagccuacuaaacaacuccagaauccuugcuugguauguuaaagucacacacagugugguccuuagccacccucuuuucagagcggccagacuccaucacuagucacagcuggaaggucuaugggguaaaugucuugucucagccaggccucccuuugccacucugcacacaugccauucugcacacauuccugcaguuugucuuccuagcuagaguguucuccauggaccucuguccaauucauucuagcccacagagaccucucuucugauguccucacugcuccagguagaucuccccaucaucacuaaugauaaccagcuguguggcacaugcccgccaucucagcacucuggagguugaggcagaaggaucacuaagaguuugggggaacuugggcuacaccuggccucaaaaguaggcaggaugaggaaagaaggaacugccucuugggacaacuuaauuuugcaaguggauugucuucaauauggauagucgacguguggcaacuagccucaggccgccugcccugagcaguuucccaugugaguuaagugaguguggcaagaaucuucugagcagccgggcaugguggcgcaugccuuuaaucccagcacucgggaggcagaggcaggcggauuucugaguucgaggccagccuggucuacagagugaguuccaggacagccagggcuacacagagaaacccugucucgaaaaaccaaaaaaaaaaaaaaaaaaagaaaaaaaagaaaaaaaagaaaaaaaaaaucuucugagcaagauugaggggcuuagugucugcaaaagucaauucuucaagucugaauagauguuucuaagugacuagauauggaauuaaccccauuucuacaucccuaguacucggagauaaacuccaggcauuaauguagcagccccuggaccacuuuacagugaagggauaaugcaaacagggacccucaaacuggaugcuaauuauugcaaauccucccuggcacaggcagccuuuacaaaaaaaaaugguaaagacaguuuguauuuuccugaucauaccagguccugguccugcacaucagaauggagcaaaguccauugguauaggcaagugcugacuguccuagcugggcccacuguuucuggggaaggucuuaauugacuggcaaugaugugcugaaccagccccacucuagagccagcagagugguaagaagccuagcgggucacaguuggagccucagaaacugacacacacaagcuggcccuggaacaguggcaggagagggaaugugcacccagagaagccauucuggggacagaacuggaccuuuucaagauugcugccccauuccuugagccucuaaacagaucgauucacaagcagccaauuggcagacaaugacugaugcauuuugccugaccuaugggauguuuguguccaacaucugaauuagcugcuaacacuuaaaaaugaagagauuucacgugcaagacuaaauuuuuuugguuucuccaaguggcuaggcuaggcccucccaucacaggggggcgaacuucuguaugggguaucuccucuccauggggccagugcaccuaauuuugccucagcccagcuuguuuuccuugaucuaaaauguugcauauuacaacucugggagagaggagggaagaucaaaaggaucccuaagacccuggcuucuccagacuugaaugccucugggcguggcauggguggccccggccuccuaggaucuguaauaacagauuuaucuaaacaccaauuagaaacugcuuguaacugaacagcuggauuggccggaugaagccaucucaggcugaagugacuguggcuugucauguacucucucgaggacucugcaaaucuuggaacaguccuuccucuaccucauuucuaccauggagacauugagguuuauacugucacagcccguaguaaaacaagcugacagacuccugagcaacccucuuuacccagacacuacuucucugaguaucuauugcaggcuauagcagggccccucugaccauugguagcucagcacacaugacaacaugggucaauaccagccguuauuucuauaucuuaucuauuuaucguggauguguauaucauuguguagaggucagaagaggacuugagcuaguuggccuucuccuuccaacaugucccagagacuggaacucagguuugguccaaagugucaucacucaaagagccaucucaacagccuuuaagagcacacucuuuggagcuggggcuagaacuuugacaaagcaugcacagagcucaggauucaguccccaucagugaauaaacugggugugguggcccucauccuucucuucggaguuaaagaggauaagaaguucagguuuaucuauccuuggcuauaugggaaguucaaaggccuaucccgggcuacagacucugucucaacaaaacaaacucacucacugcccagcccuuuagcccaugcagugguguuucuccugaaugaagcagggugaaagguuuugauuuugucugucagggugggagugggcggagcaggggcccaggguggcuguguuguggauucuguggcuaagugaccuaugggcaugucugagagggauggcuuccugacuggagcagcucacaugccuauuaaauuguuuccgccugcgaaguuaucucugacgguuggaggacccauaaauucauuuuuaaaacuagucuuuaauuacaauuucucuucagguuuuucugagauguaaaaccucgagaucuccagcugguucuagaguuucuaccucuaacaaacacucuucuccccuggacucccucucggcuucaccucaccggaggagucuacaccaacuuccagggaccacggaacugccagcgaggaugucggauggggaccuaagaggucgggacgugggaaagaaagguggggaggaagagccguuugggcuuuaagaccggaaccuccuggauuccugcuagaccaaucugcagcuuuugcaaacagccuuaaagucaucagcgccccgcugcggaauucaaagcucagcuugucauaauaguuaacaccuucuuugaccagccuccuuuuauuugacaauuuuucuuuucugucccucucuguugccaccgggaagguuuuuagggaguccccucacauagcgagccgccccuuggcguucagaagauuuucugggguagcccguuugcagggugaguagguuuccagguuucgggagcggggcgugggggcggggauggacaugaacgauuuuguagguccccacuggucauccggaaaguuaacgaugcuucagguacuaggcuagggacaaugacagccuuuccaaggcugcuggcccggaggucggcguggagcagcugagccuugggcugcacugggggucccuaguuuucuagaggcagagguugcgacucucgauucggaggggcuagguccacgacagaccccgagucuggcgagcgccagccgguggccgggcaccgggcgcucccgcgggcuccgggagcccucccacucuugccaacuuucccugcccuggugccggaggagggcgccuuucccagugggucgcgcgcgauacuuaaggcggcucugcugggcaaggcggucgucagucggagccccagcggcaccguggaggcagugcgcggcggcgggagccggaggaggagcauggagccgccgcgggccugcugagcaccggaacgccggcagccggcggcacggugagcgcacccaaggggccggagccucuuaccgcgaccuggggacccuggggcuccggccgcucaaugcuucccggcggcagucgcuugcaccauguucccuacccccuccucccuuucuuccgacauccugggcucccgcagccucuccucccuuccucccuugcggcucuuguuuugugaaugaauuggggguggagggaggcugugcggggagcgaggcuagagugccccuccccccaacucacgcccgcaggggguucacaccugcggggacaccgagaucuccagcgaucuggucccuacagcacagguuugugagaugaguuccuccuccuugccgguucagagagguccaagggugccuaggagagauuggaggagcuccagccgcuagugcaaguuucuguacugccgugcgugagcccggcugcagggcgcaccugucagugggagaguugcuguuaaucuugcagcccucaaaguucuacugcuggguagggaggugugcguccuugccuggagguuuuuauuucuuuucauuguccuaugggacauggaucccguaaagcgcccccacccucgugcccuugaaucuaagugcgccuuagcuagccugggcgagcuuucuuggaucucuuuugagaggauggaggaagcggcccaggauauaagaucacauucugguuaaccggcuuggggaaauacaguguccucucugggcagaggaccucaacaagagcccgugccagagccugacuguacauagaauauccagcugcagaaccuuccugggucuucuguagggagauggguaccucuuaauuccugagggggagggggucuggcccccggauggagggggcuggcaacugcagggaugcugccuuuguuugcaggcacuccuuugccaagguaccuggggcccugagaagaugaguagggucugggcuggcaguuguuccuuggcuuuuccguuccuucccagcagagucgugggaaaccugcacguggguguggcuguguggcuuuagccagcggggugaagcucaagccgggugaggagcguggcgagagcuuccuuagcugccuuggaccugaccggacagccucuggaacugcaccgaggcggggcgccaggacgcagguugcugggccagccacagcaccucccgucccuucccagaacgaggcgggcaguagggcccgcagcguccccuauguaucagcucuagcuggagacuaggcaggggacguaugccuggggcucccugagcugggugugugcaaggagggcugggaguccuacagaggaagcaugcggcggcucccggggcugguagggcaggccgcccagaggacaugcuucccggagaggccaagcugccaagaguucuuuccaaucuacacugcuggaagaaugcuuuugcggauuuaagcagugacuguuccgcacccauccuaugugauggauaucucuggcagcagagucuauuccuauugggauggugccuggauucagggagaccaggauugaagcagguuuccgaagugaggggucauugucuaaaacaaggauucuccaaucuggacagguagcuaaagagacaggaauggagggcagccgcuccuucccacacugcuuccuaacgcucccaccugggaaagcccuuaggggcuaaugugcauccauugucagggaaauuaccugagaucugagaagcaaggaaccauuagcaucccucuuggggacauggacaguaagucuuugggcaaggucaggaagccaggaggcaguggagcguguccaaaccuuggucuccgaugucaaguccugggcuccucucauuaaugcacaguuguucccaacaggaugggggcuagaaaccccaacuuaguuacaaaugggaaccuacacuguuugaguggcugggccggaaacaugccggcaagccuaccaggacacuaggaccaaguaggcggagcuccccagcagccuucucugcagugcuugcugcaguccccuauagcucaguugcuggucuuacagcagggcuguccacaccccaacuccccucucccaucucuuggccuuuucuccugccucucaaguaaagaaaacagugaaagccaacccugcgcagugucuuacagaaggguggaagagagaaaugauuugugucugucugccucacaccccuuuuacauccccugccccuguuuucuccaugggccuuuugcugugcugggaaugguccccucccaggguacacuuaacacuuagaggugguagcuguaggccuugggcugcccccugacccaucuucucccacacugccuguagagcuguccccucuaugcccaauguccccacagaagcuuauggauuaagagcuuugggucagguagaucacaccuaccauaucccaggggacuaucuggcuugucugugaucaacacuauucuacugcccuuacaugucacguguuugcuccuggaacaugcuaugagguuaguuguauaauacauucuaugggucaaauagcugaaaggggagugggucaguuagaaaugucagaacuaggacuugaaccccagcaacuuaggcucugaauuuccaguggucuuaagucaaguucaguaagaaauaaugguuuuuaauaaugggucauuucuuuugucuugggccuaucuugagaaugcucaagcuuuuuugacaagaaaugcugaacuugcugggcagugguggugcacgccuuuaaucccagcacuugggaggcagaggcaggcggauuucugaguuugaggccagccuggucuacagagugaguuccaggacagccagggcuacacagagaaacccuuacucgaaaaaagaccaaaaggaaaaaagaaaagaaaacaagaaauaaaugcugucccugccugauccacuaucucuuuaucuuguuuuuagaugccggugcagcugacuacagcccugcguguggugggcaccagucuguuugcccugguagugcugggaggcauccuggcggccuaugugacaggcuaccaguuuauccacacagaaaagcacuaccuguccuuuggccucuacggugccauccugggucuacaucugcucauccagagccuguuugccuuccuggagcaccgucgaaugcgcagggcagggcgcccccucaagcugcacugcucccagaggccgcguucaguggcacucugcauugcugccuaccaagaggaccccgaauaccugcgcaagugccuucgcucagcucagcgcauugccuuuccaaaccucaagguggucaugguaguggauggcaaucgccaggaagauaccuacauguuggacaucuuccaugaggugcuggguggcacugagcaagcuggcuucuuuguguggcguagcaauuuccaugaggcgggugaaggagagacagaggccagccugcaggaaggcauggagcgugugcgagcuguggugugggccagcaccuucucaugcaucaugcagaagugggggggcaagcgugaggucauguacacugccuucaaggcccuuggcaacucaguggacuacauccagguaaggcugccucccuuagagugugugcauaugggcacacguaaccagcugggcauucuguccucccgcaacuuuaaaucugauguaggucuugguguuguagcuauccguccucuucccuaaacaagguguaauaaacaguucuaaagcaaccuugggacugaccaaaccugggcugugguucuguugauaacugagcagaccuugaacagguuccccauaacaacagcagcaagagguaggcaacaccaacucuauaccaggcacugcuggugugugcuucaaacauuauuuuaacccuuaauaauagcucugcaggugagcacugcucuagguucacauaaauaagguaaaacagguuuagagaguaacuugccuaaugucaaacagcuggcaacagugcagaccagaaugucagccaggcugcuuauccaaggccuacuguugauucuugugucucacuccuggcgacagggcgacuaaacaccauaaagaaguuugaagagggagcuagagaaauggcuuggcagugaacacuggcuauucuaguggauccaacccaccuuccaacucuagaacccgcaugacagcuaacaaccucuguaaugucagguccagguuaucugacacccucuuuauggccuuuacaagcaaugcacgaauguguugcagacuuacauacagaggaaacacccauacacauucuuuaacaaaucuuuuuuaaaaauuaaguauaacaaguaaaaggauccugcuaacaaaucacuccacuuguuuugaguuaggaccacaaaguccccauccuuccuaguguuaaauucaugucugacauggcagcuggggagacucagguauaugaaugaccaacuuccuuucccaguguuggcacagguggaacucuaaacagacccugcccagauccugaucaaguggucauuggcaccagccuggaaauucuauuaggguggcaagguuuacauagcuuaaaauuucaaagaacaaacuagaaagaacaaaagauuaagaaguauacauuucaguaccaacuagaaacagacaacugggcugcacagguucuguuaguuggggggggggcauuuuguuuguuuugugggguuauuguguuuugguucuuccagacagaguuucuguguacaucccugaccgauguggaacucagcuggccuuuaaacugaggcgggucugugggucuggcuggcggcucccugggaccuuccccagcucggagucugauggagggacagaagacgcagagcuggugcugacaguucccacuuagccuucugcugcugcuuuguaccacccugucuuugaacaugaagagaaccagacugggguuguucuugugggcuaauaggcacuuacccagccaggacccauuuauuuauuuuagguucugggaacuugggugagggccuuaggacagcaaacuuaguaaaagcuucgauggcacaggauugauuuaaaguucaucugcucugagaacacugaccacagagcccagucaugggcuuaguaaaccaauuuccuauugagugguaugccaaagccauauuaguaacuuuaaaaggcacacagaaaaggcuguucaugaugguucacauuuuuaaucacagcacucaggaaacagaggcagacagaucugugaguucaaggucacccugguccuacauaggaucucaccauggccaggacuacauaaagaggcccuguaacaguucccacuggggaggguggggguggggguggggggugggagggaggacuggaagucaguuaccauccuaagaguucccagcgcucaggugcagcuaguagugcuauuuuauaccaugagaggaggggcugcauuuguaggcaaggucugaggcaaggugugcuugcuggcaauggcugccaguuucugggcuuauucagaggucaggcaaguggagcuguuggccugagagacuuggcugagaucccaagcacaggauguuuugucucuuggaggggcuuuugggcagguaggcucgucccuaucacagggcugucgggucaccuggaggccagggguugacaugagaagcugcuagcaaacuaccauuggcucaccuccgcagcaggccgacaacaucugcuggggcucccuccuuagccuuguggucucugaacagucaagaguccuuuucuucuuucccuugucuuucaccuccccuucuaccuggcacugagcaguuugcuggaagugaaugugagcggucaggcuccucgggcagugcacugcuuccucaagugacaguucuuguucaggccugagaugcuaacagugcauccuccugcaggugugugacucugacacugugcuggacccagccugcaccauugagaugcuucgagucuuggaagaagauccccaaguaggagguguuggaggagauguccaaguaagaaguaaccaaggguuccuggggguuggggcugggcuuuucuguuuccaaacgcagugggauaugccugggaaauucaucccuugacuuacuaguaccugggaagcacuuucccugauaguuuaucuggucuucaagagguucacuucacugacugcccaacucaacucaguucucgccccuugugaauguaaggggaggggagaguuaggaaauuugaagagggggcuggagauggcucagcugaucuugcagauggcccagguucaauccccagcauccacaugguaacacuauauaugccauaacugcaauucuaggggaccugacacccucuucugaccuccacuggcauggguaccagaggcacacaaacauacaugccucugcacaauaccaugcaauuccacacauaaaguuaaaaaaaauugcuuuuuugaaaaccaguagauuuggagggauacaggauuuggccacuauaggucucaaaaaguacuuccuuuugaguugacaguguagcagguagcucccaaguuaguuccuugaaaagcccaugcucuagggaauuuaggcuaaugagcuauaggcaguauacuaagcacacagacccaggucuuugucagaggccacugcagacaauaugucaugcccucuuccaggcuuuccuaagacaaggcuccugagaccaguggcucuaagacauggcacccaucacuggaaugcauuaacugggacucagugcaggagccaauauaaagguggagcuggugcuggagacugagguuuuaaauggccacccuaagcuucagauuccugaguuuagagcuaaugaccaggaauuugagcagcagccuauauaacucaggcuggaaaggccucagaugaacacagcaucucuucccuuacagauccucaacaaguaugauucauggaucuccuuccugagcagugugagguacuggauggcuuucaacguggagcgggccugccaguccuacuuuggcugugugcaauguauuagugggccuuugggcauguaccgcaacagccuccuucagcaguuccuggaggauugguaccaucagaaguuccuaggcagcaagugcagcuuuggggaugaucggcaccuuaccaaccgaguccugagucuuggcuaccggacuaaguauacagcacgcucuaagugccucacagagacccccacuagguaccuucgauggcucaaucagcaaacccgcuggagcaagucuuacuuucgggaauggcucuacaauucucugugguuccauaagcaccaccucuggaugaccuaugaaucaguggucacagguuucuucccauucuuccucauugcuacagucauacaacuuuucuaccguggccgcaucuggaacauucuccucuuccugcuaacagugcagcuggugggcauuaucaaggcuaccuaugccugcuuccuucgaggcaaugcagagaugaucuucaugucccucuacucccuucucuauauguccagccucuugccagccaagaucuuugcuauugcuaccaucaacaagucuggcuggggcacuucuggcaggaaaaccauugucgugaacuucauuggccuaauccccguguccaucuggguggcaguucuucuagggggguuagccuacacagcuuauugccaggaccuguucagugagaccgagcuagccuuccuagucucuggggccauccuguauggcugcuacuggguggcccuccucaugcuguaucuggccauuauugcccggaggugugggaagaagccagaacaguauagccuggcuuuugcggaggugugauauaaccuccaaguaaagugggaaaugugcaauggguaagggagggaauggaaaagauggggugggagggaggaggguguguuguguucuaguuucauggcugaaaggaccgaucugaaacgcaaagaauagugacugugguauggccuggguagcucugcucagcagaagcauggcauugggcagaugggcuuguauguuucuaggcugcucaucugccugcccuugcacagguagugaacucuuugaaaugauuuuacuucuuccugggaacuauugagaacccagaagugugcuaaaauaagugcuaaauuccauccuaugucaacuucugguacagaaacaagcaaugacagcucauagaauauauccuccuagcccagcugaacaugacaaggaguuccugucaaguguuacugucccauaccggcuacugucccauuucccuaaccuccgauuagccaucaaugcguuaagacugugccugagauaaugaggcugggaagccugaccuuuggucaaaaaacagggucuaagaaauggugcuuuauguaauuaauauauuccacuccacaccaaaacaucccagggaugagccaagucaccagaaguaaggaaugagucugguggggauuuuaucuguuuugggugcacaguacaaagcaaagucugcaaugcaccaaacaaaagccgcccaguuguucugcugcacauuugucaucccagcacuuagaagcagaaagagaugagagggucaggguuaggcuagacuacaugagauccugacugucucauacaaaaaugguuugacgggaggaucaaagauugcguuggugcuaaaaaccauggaugccuuggagugaauguguuccaacugaaaacugcuuggucuuuuacaaaauuccccaaguugucaagagaacuugcugggcagacuggauguuuuagccaucuaccgggaagacucaaccccaguggauucagauaagaagucuuuaguuauucuagcucauuccuaccugaaugccucucacauauggcucucauccugcuugcuauuucaaucucuucagagccgcgcaugucgcuuaguuguuguuuucugguggggagagcagcaguuaccucuucauuuucauggguaaauucccaugugaccaugguagagaauagacgcuuacaaggcuuucaaggcuguucccuacaugcauggacguaacaacagccucuggccacacuguucaucguccaggacuggucaggacuucggcagcugguuaguuagcaucuguaacuuucucgacaaucauucccaaaggaaagcuuucuggaguugcccaaaugaaccuucagauccauguuggucaucuuugagagcauccauucucaguggcuucuccaaggaauucuacggcuagaauaguagaugcaccuccauuugcugcuucaguccagaaaccaaaguaggagcuggaaccgguccaacagucuucaguccucuuacagcccucacuggcugccgauuuccuuguuucucuugaggaacgaggagaagcuuuuacacucuuuugaagucaagaccagauugcuuuggcauugaagcgugggcucgugacuaagccuuugacuuugugggcuacuuacaauuucccugaacauuuguucucugagggaccagcuaacccucagaagcaacuggguuggagagcaguguacauaggugcuuccuacaaaagaaugaagugcacuccaaaccaccaaugggccaucccuuguauuucccuuccucguaugaacaaaagggguuuuccagguguagcuaacaguugccacagcacacaaaccucaaguugcuaggaaaacugcuggcuggugugaggcccaacucaugguggcugaggagcagcagccguuugugacaggcaguugcucuggggccuucuguuaagaagugaacuauuugagcacuacaguggagacaauccagucaacuucggggcucagacuaagggcuuguuuuucuucagcuuuuacuugaagguuacaggacaauggacucuggaugaaaacugguugucuaccgucagcucucugccuugcacuguggucaacucuccucagauuaaagaugcagguacaguagugagcuuacaacauuugaccucgacuggauuuccuaauuuauuuuauaagcagcaaaacuaaacugggucuacagcuauaucccuguuucuugcaagggaagagccuuuauacaauuagacucauuuugguuuuccucauugacaauuucagccucuuuuguauuauuucuacaauaauuuguauauauuuuuuccugcuuuuuuauuaaauaaggagggaacuuuauuuaacauuaagggugggagggaaucagaaaggaggauaauauucauaucaugcucuuggcacagccacugagcacaaugcacaggccucgugacucuuaagcaaagucacaguguacaggugugcagcuggagcucaucuucuucagcuaagcuuuuauccgcgguucuaccuucaccuugccuaugaccugcaaaguccaggaggugccccuguuccuccagguugccagacaggucauaggaacaccucagaaaguguagaacucuaccaggacccuucucagaaugauccuucucugcuucacaaucucugccaucuuucucaccauuccuacaagcuguagucagugcaggugccacagccaauguccccucaaccauccccccaacccccccagccuuuacagcuuccucucugccuuguccuucuacaacucugggccucuugaaagcaaagcccccccccccccccccguugucauucucuuugcugauguccauguucucacuccagcaucaacuaguggggauucaagcugaggaccacggcucugccuuuuccaggaccaccucugcacucuggguaguggugcugagcuuugcccagcaguaugaaaccuaagucccucucuugaaucuaaugcucaggaggucguaucucaucuucuggcaccaccaccucaagagugagauacuuagaggugagcugaagcccugcugaacuuguaguugcaggaugacccagcucucagccaauucucauucaugaggccacugguggucacccuaguucuauggaaggugucuagccaguuccuccaguucccaucuuauuuagcuuuugcugugccgaggccaccugcacaaggcagcuguuagggcacagcucuuggccagcuucuuaugcaccggguucacauucaccagcagugcauucuccucuucuugcaauacuccuuuuguccuuaaaggugaaggucagucucuccuuuguauuaaugacauacuucucagugaggcccuacaggucucaagcgccaugcaucagugugcugaugccuaacuucuggucuaucuccuccaacagcuuaguccucuucucugccaagaccuucuguagcucuucauuaucccagcugugguguucccagggcuggggucauucuccucuaacuucugagucaggaguacugucccuguggcucuucuugaaaggccaugggagcuaaaguuggauauuacaaacccgucuuucuuaauagugacuuucaagaguuucaacaucaauuuggcuguaacugacuguuucaaagagcaucuccuacuuuguagcugcccagaauacugugcagugccauuagagaccugaguuucugucaccccguagccccaccuguuguccacuguaggugccauuccggugcuguuuuuuguacuccaaauguugcuguggcagcuugaugacuccuuaaaacuaaguuggccucacugggcugccaccaaguccugacacaaaaugcagacaauuuugggugacaaggcagccgcuauccuguugcuggcaaccaugagcagcugcuccuggcuccauuguuuucguugcccuuggagacuggcuuuuuuuguuguuuaucaggucaagaauuuuuuuuuauugcacuuaucaaaauaaaaauucuuacauaacucuggcguguccauugcuaugacaaagaaucaaaguaaacuuuaaggaacuaaaguucaucauggcucccguuucuggucuccaacucugucucugggcacaaggugaggcagaguaucacagaauggacgaaaggacggacagacggagcuugugcugaagcacagcuccucaccuggaagccgcagggaagcagagggcuuagaggaagccagggaggaaauacacucucaaggccauggccacagugacagcuuuccuuggcugugcuuugccucccaaagucuaaagcgcuucuccauuagccucuuaaaccaggauuugaccaagagcuguuucuuccucauguucaaggaccaccuccaggcucuaucagagagcugugcuggggaccaagucuucaacacaugagugcuggagguagaguucaaauguaaaaauacaacugggaucucagagcuauguccucuaagccuagcucuuuaguuuuaaaaggauuagugguagaaauggaaucagugaaauucaaaaguagaaaaagaggccagcaagauggcccaggaguaaaagguaccuacuacuaagccugaugacuggaguucaauccucgagauccauccaguacaaggcgaguccauuccaccccaacugucuggcuuccacacgugcuaucagcagugagugcgcacaaaccaaacaucucuaaugcugacuuuaaaaauuucacaaauaagguaaguugucacgguugcuucacuuuggagaauuaagccauuaggccaccagauacuacacaugcaagauggcuuauuuucuauuguagacgucagaaucucacacuccucaaauuauucuacaaaauagaaucggaagaaugagugaaggcuaaccaaagcuuguauccucaaauacaagcauguuggacggcagguaauaaacaggguuguugucauuuuaaaaaaaacaagcagagaguaaacagaacaaaauggagcgacagcagcagcccucucacccauuuauuaaagaaacaguaagaaaagauacaauggaggaaaaccaaccauccuucacaucaagcugaacacagcacagugauuucccuuucaucccuccaccccccccccagcccccccacuucccauccaucgcaguuuaaguuuugagguucuuugauugggaggaccagugaggagggagcuggcugaucggaggaagcuuaaaucuguccaccucuaagucccagaagaaaggagccgcaggcccagucaagcagaaauguggugggucuguggcguggguguccaccucccauucuguguucaagcccccagggaaaggucuggcaguagaacaugacuagguccagggagccgggucagaguuaccgaagcauggcccgcucaccaaugcagcgucacuagacagcaagcgagccaauucuccagcggugaguggggaacuaggaccugcaggccaauguaucccugaggaaaaguccacgagaacaguucaaggaacuaguaagaaacaaggggcagaaagcugugggacaaaagcacagaggcuuccggaaggccagagagccuuuuccuugaggccaggaucaccccaucugccauaguccauggcucacaaauaacauuuugccuuuagucaagaaaaaagcagaggaaaaagaagguucauuugaacucgagccccagcuauguucuucagacuguacuuccauaucuacucuuuuaucuaagagacagccccagcucagaaccacagugcuuaaauaacaaaaguggcccuggaagaaaaaugguauuuaaggggguaacauuccauuuggguacauugcagccauuggacccccuggccuggggaaagcagcuggauuugagccagggaggcugccuacccuaggaaaugggaccaaagucuuaccuacagggccauucauccuuggaaaggaagcuggguuaaggcccaggguccccguuggucuugcaaaaggagcuggguugauacccacagggccugcuggagaagagcccaggugccccgcagcugaccuggggaaagcaacuugaccugggccuaauggaccagcagaccuugggaaggcagcuggacuuggacccugcaggccaguggcccuuggaaaguuagcuggguuggggccuaguggcccagaggcucuugggaaaacugcuugauuugagcccuggaggccagcagaccucugaaaggugccuggauuugaggccaaugugccagaagacugagagaaggcauuuggguucaguccuccugauccugucccccuuggaaagacuccagcauuuacccccauggggccaccuggucuugagaaaugagcugaauuaggacccauggggccaggagcccuugacaugggagagggauuuggcccuggaaggccaaguccucgagagcuaggaccuguguuuggaccuauggggccagguacucuugucauggugggcggguuugugcccauguuuccagaagccugggaaaaagaaacugaauuugucccuaaaagaccugcugcccucaggaugggggcaagaucuaagccuugagguccagccauucuuaaguuaagaccagauccuguaccuaagaggccaccugcucuguuguccagauuugggccugggccuaggccaccagcucuuggguugggcccaagaccugguccuaagccacaugcucguggguugggacccaggccugggccuggaaacauacccgaccuaggggccggguuuguaccuaaaaagcuugaucucagauuuggacuugguccaggacccaggccaacuggccuaggauugggaggaccagucccagaggacaaaacaccugcccucauguuggguccacauccagggaccauggggccaccacuucuagggucaggacuugcucccagaaguccgccugcccuuggguuggccauaggaccagguccaggaagcccuccuaaucugggguuagacauaggcccugggccuggaagagccccuguucuaggguuuaaaccugguccugguccuggucccaacaggccuccuggccuugggaaggaaacugcaccugugccagugggauucaucccucuugggaaagaagucaugccugggucgcgagcaccagcagcaaagugugcuggguuugacgccaaagagccugauggauucugaaaaggagcugcauuccuuggaaauggagccagguuuccaccaagagaaccugcugccauaaggaaaggaucugaguucacacccauuggguggccugcguucauaacaggcccuccguccagccguccucgagguggcaauggagcacgaguccaaggaguuggucgcucucuagggaaaauccgggguucuuucauacuuucuuggggacguuggugauaauaggcuuggggcgaguuuugaaaaggaucuuguuuuugaugagugcugucaccaaguacugggugccagucccucgaccgggcucaucacaguccugcuucccaggaguguguuugacaaggacugcaaaagguuucuccagguggaugguuuucccauacaggauaugauggcccacgaucagcacagggauucccuuuggcagaacagaaggagaugccuaagguugagggcaaggccguuccuuucaggggccuuuuaaagcugcucuugcagcaaugcuggcaccuccagccccuggucuggcucuaucacuguuaaaaaaccacauuggcaauccacccuugugcccuuucauucuuugcagccccacguaaacagcauuucuacuuuuaggacucuagcagauucccaacggcuccauuccucugcuacuccagaagguggggacagcaagcagcuagcucuacagacuggcuaaccuggagcaacaaacccgaggacaguccucacgcuggguccugggagcaccaccuugguggagcuugcuuuacugaggcauaaggcagggaaagaaaagcccccucaccucagugguguaauguaggucucccaggagguuuccagcuaauccggugcuguagcgagccucgaucucccccuguagcuccaucagcacccauucugccaggccuucagcccccguacugaaaguaaagggcuggcgguuacaauauuuuugagcggugaaggaugaguaguguccuacaccuacaccaccauuagaagcccaaaggaacucuguugaauacaaguucucgggaaacugggcaguacugagaacugaaauauagauuguaaugcaagaauguauagaagauguaccugaggacccuaauuccuucagaagaauguaaaaccaguauagcccuuaacacucaagcuaaguaaaaucuuaaaauguacucaccuggaaauaacaauuugcaccaugagccuuccuucuuuaaaaaugcaacugaaaaacuagagggggggaaaaaaaccuuuuaggauagcaauaauuauaaauaauuauauuuaucacuuaauuguaugauaggcacuuuccccacuuucagacaggucucuagugcacgcuacccuugaacucccuauggcugaggcugaccuuuaacuucggauucuccugccagucucacaaaugcuaggucagcauucugccaacugaguuuuacacuuccagcccaauguguggcaggaacuuagaauucuaagugcuuuuaaacauguuacucuauugcucuagcaaugucaaaaggguuaggcuuucuugcuguuucugaacauauagauuacaguuguuaaugacaaucauuggacuggugauccacucagguguauuacaacaaaugguaaggcaauuuuuuuuuuuuuuuuugagacaggguuucuuucacuauguaacucuggugauccugaaacuguguagaccagacuaaccuugacucauagagauccaucugccuccccaguuguguguuuaaaggauugugccacgugccuaguaguaagcugauuucuaauguaacucagcuacagacuaccuuucacuuagcugagggagggaguuccuguaucuucacauuauacaacagcgccaccagguggcaauuuggagcacccuaaaagccugcugcuagcuggcuucauuuucccuuguaccugccauuaacagagauugaauuggggaaucaaagcuacaguguuugguugucucuugaaugagacaauauauaguguuaccagucaugguacaaaaagccaacagauuuuauaauuguacucaaaacgcagaaaaaauauuaaucaggauuuuuuuucuggccuggggcuugguauagcauauucuuaaccucagcuucuagagagcuaggucgacaaggggcagcugccauuugagggguuucuuuacugguucuugucgcuuuggaccuccaguaggcuuauaucaugacagaaccucuuuccagagcaccaaacacacugggucagcaguuaacauauuuuaaauguuuacuauggacuacaugcuaugcacauguguacaugguaucucaaccaacacagcaacucuaaugauaaccauuuauuccuauuuugcauuugaggcuacugggucauauacaaauaaaaaucauguauucauaugugguacacacucaacuagaguauagagagcaaagacaagaaacuagcccaucuaguuacuuaaaagucacuacuuaauuuucccuuccuaaaggacagaaccagguaucagcaagaaugaagaggaaucaggagagcgugcagccaggaacauguguaagugcuguucacaucagcacaagggcaccaacacuagaucugugagcuagugagucucuguacccaaagaggcuguggcccuaccgagaaaaggcaaagaucuuugugcuuauaagacccuuugcagaacuuaacuuuugagaccagguccaucuuugaauuuccaaucccucuguuuuaaucucauacacuggaucaaaagcacugaguccugcugccagagcaucuccaaagugaaucaauccaaauucaaaaggcugaguuccgguuccagcuuguaagguggaaagcuacuguaugaucacgcucaggucacuaaaugacuaggucgcugacaccuagaugaugacucacuagugugaugacuaaauauaacucaugcaagacuuuagacuccuauugagaauagcuaauauuuuagauugggaaguaagcaauucagcauuugacagucuaacuuugauuauaauucauaaagauuguaaaaggccaaggcugcacagaccaaguucuuucaaauaagcuuuuguugacugauacuguguaugauguguaagcugcaaaaaaaaaguggccuaaaaaaagcaauaaagaauucacaucugugaacaucauauucuaaacauggggaagaagauaauacucuacguccuggauccaggaagauggcucagacaugcgaguaugaacaccugagcuccacucuccagugcccaugaagacacuaaacauacagcacuagcaucugcaaccgcaguggcuuucugagacaggaggcaaaggaaaacuccaaagccugaaggguugcaguggaaccaagacuuugugucucaggcagaagacaagacugauacuuacugaccucuacacaugcacauaugcuacacacacauaccaaaauacgcuuccugaaaauuucaauuuuccugugcuuuuuauccacaggaaauagacaguauggcugccaaauuuucucagugaauucucugcuuccuggacagacuaucagaauaagaauucacaaugaacuaagaaaagcagacaccugaccucugauuugggguagcacuugcaaaccuacccaugcagguucaacugaaaacauacaucuuuauauacagcugcaggaagccuugccugaguuauuucuauugauccuggcaaacaccuagcaaugccuuggaaacaguaacuguguggcuuacagccuggccauucuguugcuguaccccaucaacccuguaaaauguuuuaugcuaaaucaaauuaggugacuuacacggauauaaaaggaaaugugucagucuagcuuagagacaccuguauauccauaugauuauaccuaugugaucucucuguguguguguguguguguguguguguguguguguguguguguguaucucagggcuugagauuuccuguagcaucuauuacuccuguucuugcuccuugaggucaccagaaaacuguccauggggcuagcuuacauauugauuugagagcacaaccgacagagguaacaggaguaugaccacgugucccaauuagcauacauuuuauucaaagggucucaaaagccagguguggugcuaugcaucuguaaucccugcccuucaggcugaggcaggacaacucaggaagacccugucuccaacaacaaaggugggugugagggaaacuuaaaaagaggugaagccucguacaagcagaacaccuacaaucugagaacauguuuccaaguagaaaaaaaauuuaaacauaauauuaggcugcuaguaucaaaugucaagauuucucaguuuucgggcuauucaucugcuaaaucaaugcaaagauuccaauaucugaagcacuugugugaauuuccaaugcuguuuaagaagccaaauucugguaauaguaacaaauaacaaaaauguuacaaugaaaauucuguguggcaucaauuucugagucuucagucucacuucaugcuaacacuaagaaucgaccaguuucuaggacuaagauuugccuugauuagaaagcagcacaguguuaccaauaccaaaagauuucaucuccauacucuuuggacugcuuacuggauuaucucaucccauccugacaaccagcucaaguuaggcaugguuaucaaacucccuuucagguaacaaggcuuagaaaagcugaaggcuaagcaauuggucgcauagcuaauuaauaaccaguaaagcaggaugugacuuuagccauuccacuguguggucugcacaccagcccuccucauacacaacuucugagauccaucuaccuugcaauugcccucauucuccugcaaaucugaaagaagccuugucccuugcaaugaaagcagcuaaaauccaagcugauacaucaaaguagcugauaaacuauuaccuuauccauguuuaggcuuuaaaagucaaauucaaugccaccuucaagauucaaaauuauacccuaaacccucucucuaccccucaucaaggaaaaaaagaagucaugaagacugaggacuuuuuugccguggguucacuuuaaucucugaccaaacccaauucucauccucugcucucuaaaucauuacauauuaaaggauuacuaaugucuuagagaacagccugaucagugacccucauaaugguaacuucccaaaauaaaaugugguguaaguaugguauguacccaaccauacaaacagaaaaacaaaggacugugauucaaugauuuaaaucuaaugacacaaaaucuucuaugacuaaaucauguuuuauaaauguccauuuuauuagccuggucuacagacugaauuccaggacugccagggauauacagagaaaccuggucucaaaggaaaaaaaauccauuacaauguaucuaaacacuuuguguggucugcuaaagauuaaaccagugaacaagauagacacuaucucuaccuguauuuuugaauuuugucuguuuuaaagggaauauguucuaauucuucaaaacuauacuuuaaaauuuuucuuuaaaaaauuaggauaaaguggcuuaaccauuucauaguaaaaaaaguuagcuguuuccuagaauaugucaaguagaacaucacuaccaccaaauugguaacuacugugaauguuuacaauggacaaaauaggcuauaaaaacaguaggucaucaaagucaacuuuauacaacuggagaacaauucaaaggcuuuaggcaggguuuacugagaugcuucagggcuuaaacucuggaaagucauuucucuaaauaugacaacuauuucucuaugugccuuucuagcaaacaaccaaccuugugaguuuuauauaugacugaauacaaaucauuuuuauuaccagugucauggugguugugugacugaaggggauguuugacccaguuuucuaaggagaacuugucucuuaauagaguuguuacuaagucuaaacuacuuuaaaugagacacuugcuccccuccaaaaaggggcuguggagggaagguagaacugaaugcuuccgaacuuuucauuagugaagaauguuuucaaaacguguuuagagacuaugcauccacgugguacguucccaucacguggcaggauuccuccacuggagggaaucaauuacuguuauuuguagacaauggguagaaaagauggcuucgguugauuugaguuacuccgguuuucuccaucuucugcuacucugccaccccaucucaaccuucccuccucuuccugcccucacaaccuccuccucccaacccuuucuggccgcgcggcaguugugggggaggucccccuccuugcuggagucuuccauuucuucuaucuccuccacccuugagcuccccuccccccuccuucaacuagacaagauuuuuucuaacucccucuugcccguuucuccaacuuccuucaaacuaucccaaacuacuauuggaaccguuuuaucaaggucuuuaacccucuaccuaccccccuaagaaacuaucccuccccaccucacucuuaaacugcuuuucuccacggcccccauccgucuucauagccccagccuucucccgaagaguccucuuucaacuaccuuccucuaccacucaaauacgagccaaaaccguucccagucccgcuacucuaggacaccacccuucucaacuuuaggauucauucacuccucccacaaagcgcccgagaccacuuugcaagaauccuccaaauaaugcccccccuagcagcuuccuccuccccacuaccaugauuuaauaaaauaaagguccccugaaacaagccucacauuucuguccguuccgccccaaaccccuuuugagucucgggcugccauucccgcuacuuucugaguuccaaguccacucgacuccagcaagccucccgaccggggacugagccccuuucccccccgcaccuaccucguggauccggcccgcgccgcccccugcuccguccuccgcccgcgcuccgucagccuuuccgcccuucucccacuccacccgacucccucgcucccuuccuuccguccuugcccaguucccgguccccaagcgccccuggcuggcggcgggcuagccucggcccgcgcggcccucacucucccgggcccagcacgcgccccucccccgcccgcuccccgccccuccgcucgccauucuucucgccgagccgcgcgccccgcccggccccggcugccuagcuggcccauccuccgcgcucucgccgcgguccccgccuccggccucguuccccgcggccucccgcgccccuccgcccgcggccugaccugcaauggcggccgccgagcgcggcgccgcgcggccaacgggcgacaaccgaaccucccgccgccgucgccgccgccgcgagcauugccugcgcacuuccggccucgcgccgcggaguacuucc

SEQ ID NO: 4749 - RNA, 29827 nt, Mus musculus
gcggccgccgagcgcggcgccgcgcggccaacgggcgacaaccgaaccucccgccgccgucgccgccgccgcgagcauugccugcgcacuuccggccucgcgccgcggaguacuuccgggacggcgcugucgagugcgcaagcgcgcacguggggccggggcggagagaagcgagguccgggguuggcgaguucccggcgguaggugaguucggggagaacuccgggggcagcuaaaacccacuguucggaaggggugugguucaccuggggucggaggcccgcggaccuuguuggaugcucaguucuugaggccgaggggaagcuacuccgcuccguggaccugggagagcagggcuggcggacaccccgcgcgcuuuaguggcucaucagaacgugcccgcucugccuguggcucccuugaggauagaagaguaagggacguacaaguuccacucccaguaggugugugucagguagcugcuagaucaggcaggcuggaagagaccaccaaguucugucgcugccuacucgugcucugggauuccccucccccaucuacccuaugucacugucuuacuagagugggucuguaauuugcagacucaguaaauuuuuguuuguuuguuuuuguuuuuuuucgagacaggguuucucuguauagcccuggcuguccugaaacucacuuuguagaccaggcuggccucgaacuuagaaauccgccugucucagccuccggagugcugggauuaaaggcgugcaccaccacgcccgaccagacucaguaauguugaggagaaaaguauugguaaaaugccggucucaaacccucuuccuccaaaaagauggaggaauagaguuagccuuuggggggaggcgggggguggguggggauuaaguuguugaaacuucccuacugaauuucuggagaccgaagagucuugcuggggcacaccagcauuauuaaaaaugaacuuaagugagagaucaugggaccuccuauccaacagugaugaugguaaauugaaugcauaggagauucuccggguuaaugcuuaacagugauucuuuuugucccuccaggaaugggugaauuuaagguccaucgaguacguuucuuuaauuacguuccaucagguauccgguguguggcuuacaauaaucagucaaacagauuggcuguuucacgaacagauggcacgguggaaauuuauaacuugucagcaaacuauuuucaggagaaaguaagucuuugggggagccuggugugguagcccugauguuaauuuucuuaacuucaauucuacaacuuaugagcccuaucuucagauagaucaauugacucuuccugcuguggaauugcuuagaacuucuguagcauaucuggggucccuugaugcacccaucaagggaaaagcagcccagggguuugagcuaucucaagcuguuuagaaagcuccugccugggaauugugugccguuugaggccugaagcuugcuggaucuuuuggccacuacaagaaagaaagaaaaaaauuguugagaucauugugauucugguauaauggcauuucuugcugaaggucuuacuaugccuuccauggacaguggaaaggucacaaacauuguaauaucagaaaauuuuacuaacacggcagcaagcagacucccaguucaccugucuccaaggauguaggcuuguuugucuauuugggaacagaggagacuuuucauuagaugaaauguuucuuuugugugugccagaauuuugccuacaugcauguauguacacuugagguguaccuaauacccaugguggucaggagagggcauucgauccccuagaauuggauuuagaagugguuaugaacuaccauuuagugcugggaacccuucacaagaacaggugcucugagccaucucaacaacuguugagccaucucuccaacgccaaagacuuucuccucaugaacacugguuacuaauguucuugaggugcaacaugcaacucaguucaaaagagaagcgaugggugguugaguugucaguacccagcaggcuagggcuugagauguaggcauucuguaaacguugccaagaaugagugucaggaacugguaaggaaacaugucagagcuuuuacauucguggagaaaggucuguaaacagacaguuucuccccuguauaauaaagcugacagcuagcuuaagggauccugcauagcucuggcuuacugaagaacuauuguguguagaagaguggcaaguccuugcccacagcaaguuggucacugcuagaaacacgacaaacaugcuuggguggacaccuguugcauagugugacuuuccugugugucguuuauaacuacuauacuugcauaacuuguauuuuugcuuagugccucuuuucacugcuaaccuuaaauucuguaagaugggggacuacaucagcaauguuugugacuguacuccggugcuaugucugguacaaagccacugcuaaguuaauguugggggauucaguccuccauuuuuuuccccuacccuucuuauuuuaagcagcuaccuaauucagucuccuauuuucuccaugucuccuuuccuauucauuaaauugcuagccucuggccaagugagauggcucagugagaaaagguccuugcuucugagacugaaguccuggguuugaucucuguagcccacaugguggaaggagagaccaacuccugcaguugccgucugaccuucauaugcccauacacaacauguacauacacucaguaaauaaguuuaauaaaaaucuuaagggcugcuggccucagucacaucacucucagagcaaggcaaauagucagaauaaaaugguuaggagcaaagagagcuguguucccgucauucuauugacuuaggcuuuucaggcaagccacuuuacccauuugucucuuggccuugcaaguucagauaggaaacauuguuugugucaagcagacauaaaauuaaaaugccaugauauauaugaaaauauugaaugcccagaaaguacuuguaaucugagacugugugguagcaguacaugccuuuaauuccagaagacaaaaccaagcuuaucuuuaugaguucugggccagccugaucuacauaaagaguucuaucuuggacagugagggcuacauagugugaggcccugccucaaaagaaaagaaaaaagggaccugaguccugaguagaaagcuggaguggacugaauuauuucuuaagcgccccuuccaggugaaauggacacaaaauugaggcagauauaaagugugcaugcuggcauuuagcauauaugcagugaugcaucucuugauggaggucuguuuugagaaauguauugauaguugauugcuagagaguuggcuuaugaaaccuaccaccguguagccuuauuccuaaacuauagacaccuaaaacauguaacugcuuuggaaucucaugggcaguuguaacacaauaggaaauauuugugugaaaaacaaaccagccccaggugguuugucuuuggcuuauuuaagagcggcacgauuugguggaaacguauuccggcaauaauucgaucccaauuuuagcaaagcaugcauaaaucuccuugagggacaaaguaagcuaaaugcagagcagacacugaaacucuuuguaaaguucauaaagauagauucuguacguggacugggagaacaagcugaaggcaagagucugcgagaggaucggaugcugaagaagucuggccacucagauauuacagaacucaccaggcuagugaguucccagccuucugggaggguaacagguucugcacuccuccccuugauggaacaacccugugugcuaacauuccagguuccccuagcacuuaccugugagcacagagaacuccaaguuuguaauaauaguuuuuagaaaauugauacuucagguaauaguggcacaagccuugaaucccagcacuugggaggcagaagcaggugggucuuucugaauuugagaccagagcaaauuacaggacauccagagcuauuacucuguuuuaagacagagaaacugucucaaaaaacaagcaauaaaaaauaaauauuagauacuuuguauccaacuggacacuagcccaacuuuuuuaugcauggggacugccacagccugcucccaccucccacccucuucagguguccuaccucugcuuccugaggacugagauuagaguuauauaagccaccacaccugcugagucaaucuugaaucuccucauucucaaauauuauuugaucgucugcuacauuaguucuagucuaaaagagagaaauguauaacauguaauguuaaguaacuaauauuugaagcugaaagaaagaaagugucuaauagacacagccguuugauagugacaagcuacuaguuauuuguggggaaauacuuuugagugccagugacugaggcauucauagcaaguugggaagauaugcugcuuugugguuuugaacucacggcagguugugaaaugaugguacuucuguaguuuuucccaggucaugagucucgggguaccgaagcccuguguugggcaggaggacagcggcucuuuagugcuggacugaacggagaaauccuugaguaugaccuacaggcacuaaacaucaaguacacuuuggaugccuuuggaggacccaucuggaguaugaccgccagccccaguggcucucaacuuuuggucaguaagcuaguauugauaauacaaaauacaguagucuugauggucagucccuuccccgucucacaagcuguuuugguuuguuuugauuuuaggcaagugauagcuuuagagaagaaacgcuugugcauggggguauuaguucuguauaaaggcucauuuagucuguuuucuacucgucucuaaucagguugguugugaagauggcuccgugaaacuauuugaagucaccccagaaaaaauccaguuugcaagaaauuuugaucggcaaaaaaguaaggcuuguuuuggguucgggcaaugaacagcuucaacaagagguugucuguuugugucaccaaagggacaggauauuuuccuguggcuauaggauaugcuguguagauuuucucugagcacaaggggaguucuagaaggcaucccauuagguaucccauuagguagcauaguugugaaauucaaaguagaaagcuaguguuccugugaaaaugaguguauuguuuaucaccugcauuuuaguccagguuuauguugugauaaacucccaugcccagaagcaacuuggagaagaacagguuuauuucagcuuccacagcacaguccaucaaaaguuguagcuggggcagaaacucaaacagggcaggacccuggaggcaggagcugaugcagaggccauggaggggugcuacuugcuuagccugcuuucuuuguuugcuuguuuuuuuuguuuguuuguuuuuuguuuuucgagacaggguuucuuuguauagcccuggcuguccuggaacucacuuuguagaccaggcuggccucgaacucagaaauccagcugccucugccucccgagugcugggaucaaaggcgugcaccaccacgcccggcuuagccugcuuucuuauagcacccaggagcaccaguccuggggugucaccaccaacccugggcugggccccucccacguuaauuaacaaucaagaaaguguaccucaaguucacccacaggccagucuaguugggacauuuucucaauugagggucucuccaaaaugacucuggcuuugucaaguugacauagaaucaguagugugcuccuacagaaacuccugcuuugugaaauguaaacagcugugccuagggucuuaacuacccuacuaaaugaugugcuuuuugaggcugauuccucugugggacuaggcaaccuuuaacucccguccuccggccuccugaaugcugagauuagagauuuauaccacagcaaagcugccacgccuuuguuccccccuucuccugcuuuuuaugacagggguucucacacuggagccugcacucgccuggcacaccguguagcccuggcuggcagaagaaaaggggaguguauuucuuaacccuacuagccaaucuaaaugccauggggagugucgugagcagcuguugggguuggggcucuggcacgucccagcacuggggugcagagcaggguuucauaagcacuuugugaaauacugagcacaacaguacugaggcuuuggagcacuacagccucugcuaacucuggguguagcagggaaacagccagacagucuggaaauagacugugugcugcuagaacuugauuuaagaaaaccaacaguuagccaggcgugguggcgcacgccuuuagucccagcacuugggaggcagaggcagguggauuucugaguuccaggacagccagggcuacacagagaaacccugacuugaaaaacaaacaaacaacaaacaaacccaacagugaguuguaguuuguuggugccuguuuuggagaguagugaccuugauguguauucucuauguccuuugguaauuuugucaaguugacaaaaaaacuugccgggcgugguggcgcaugccuuuaaucccagcacucggaaggcaggggcaggcagauuucugaguucgaggccagccuggucuacagagugaguuccaggacagccagggcuacacagagaaacccugucuugaaaaaacaaaaacaaaaaaaaacaaaaacaaaaaccuuaccagcucaaccaccaaaaaagaaagaaaauuaaaaacauaauuaugacagguuaacagcaguugguucugagaaauguaauguuaaaugaucucacugugugaccaucagcaggcaggcaggcaggcaggccugcacaaaccaagguggccaaugucacugggcaguacaauccugugagcgugcccuccuauauucagugcauccuuguuuguaaugucaauauuuguucaugaccauacauguuugggcacucgugcaaguaugucuuuuuaaucugugagaagucagugucugugcacacggaaauuuccuuagguuaucaccacaccauugucaaaagaaaacauauuuacacauuuuccucaacuguuuauacaaagugaguugccggaugcuuuauugugggucccaggacagcuuaucaaccaugguggcugaggaaacuuaagcugagcugugccagcccugcgggugacuguggaaggagagccccguuagguuugguuguuuauuuggaugucaccuuuuuugcuguuuucuuacuccuaaggucggauucucagucucugcuggcacccugcggguacccacgucgcagcugguuccuuagacuacauuagcguguuugaugucaaaucaggugauugucucucuauuuaguacauuugggguguggguuuugucaggguuacuuuucucaguuucugaaucuugacuuagccuaacucuucacuaaucuccaccaguccaucacaaaucucaccccuuguuuucugugcguuuguucuguguguguguuugugugucugucucugcauuuccguuaugugugcauguaugccucuguaagugcugaccagaggggaugugagaccuucuccuuauugcuuguguucccugauuuuuuugcugcacagucuuuugcugaaccuggagauagaguucacuuuuuguuuuuaauauaaucuggggcaagaaacuaguccugaugauccucccgucuccagucccucugugcugagguuauagguguccaggggaccgugccuggcuuuuacacauguccuagaauccaggcuuccuucucugucucugucugucugucucucugucucucucucucucuuuccuugcauagaaagcccucauaacuacugagccaucucuagccuccuauugguggguuugauuaccacugcugcuuuugggggaaccuccacucuucaguggggacuggccacauucuuuauaaggagauaagaaaguagcuuuuuuuacucuaaugacuuuuuuucuguucuuggccuggaaaauugggcuauuagacaccuuuagugugagcuugccucuaacuuguuagauuagcauauuuauacaugcaagauacagagacaaaaugggucagacaugucuuguuguuuuuucuuucuccucagugccugacuugugugauucuuuguccuuauuacacaugcccacaaccuaagaacuccuucaggcuuuuuucaaaaaguaggaaucccccugucccuucucccacuccucaaagugggccacugcagcugugagcugacuguuuugggcucugcuauacaugacauguucaugauucuggauugugguuuuuaaucucuguacguuauugacuucaacaccugagucuucccuuuguaccuugugucauaaguguccgagcacacggucuccugcuccuucccacaugcuccuuugugacuggguuccgguaagcagucagcuguuuccaucauggccccacguucaccacucacaaaggaaguuacuuuccuuccuucccgucugcuuccuguuuaguuuucuuccucucccugcguucuucuacuugacucuugaaaucuuucagcuguguaagcugacuaaaaacacaucugaguauuuuggugguuuuguuuguuuuuccugccauuucuauguccuuaaaaauaaguuucuuuguuuugacuucuggucuugcuuagccgcuugggacaugcugcacacacaagggugggguuggaagacggguguuucggucuuuccagggucccuuuugcuucuguguuuaggauucccucuuugccuguuaggaagucuaaugccuuucuaauuauuguguggacagagaguuaagcuucugguuggucccuagggcuuuugagcaugccuuucccgcuuuccuuuccuguguggacaguuucgugguuggaaagccagcccaggcccccgagugcccccagccccuguuuuacccugaagucaucacacuugcugaugucugaguguguuguggguuuggcuuugguuaguuggcuuuugucuugugccagucaguugugcucugaagaugaguucccccuugccuugcugguguuuuguuacuucagugcugacuuucugucuucugacuuuuucggccuuucuuacucuuugaucuuuccugacuucacugcuugcuaagguaaguuuguuguuuuucuaucuuagucuuuguagugggauuuuucacuuagccaccuccaaaggucuuucagcugcuggagacuaaaccugggccuucgcuaagcuguguucuggaacuaagccugcggccucugaggcugaucuuucuuuuuuaagagcuguaguuugguuuuugauuaugugugcucaugaagcaaucugcuaggacuguaguuauggguggugcugggaaccaaacuccaggcuucugcaagaacagcaaacacugaacaacucgcugucucuccagcccuaccauuagugacauccggcaaguguucugucucuccagccccacuguuagugacauccggcaaguguucugcgcccuuccuguccuucuguuuauuuucuuguuguuucuauuagucuccuuggcuuuucucaguagaggagacuuucuucccaugccaugugugcuguuugcgccugucaccauaguggggcucuugaguauggccuucccugcagagagguaucuugguggccuaucuggggacuugugaagucauaagcuuauacuuuuuuuuuucuugagugacuugaaaucaaucaguuggguuuuugggggggggucgguggggggguccuagagaucaaccaacccugagcguuccauguucugccacugagcugcacucucagacucccccauucuguccccgugaguccuguaaguacaggcccagcugucaguguucugaggaggagaaaucugguguugucggcauucaaguuagcaguuucacuggaccguuuuccuuccagacaccucugucccagccucaguucccaacgcuuuuuauguaagaaagucuucucuggagauagaguuuaguuaauauccggcagcuuacucaggagauugcuaccucgagguccagcagccucuagaugaccuuuugaccagucccuccugugggugucaagaauaagucaaguggcuucuuggcuuuccuuaaggcuaaccugcaucuugguuucaagguccugcuugguugccacccugagucuuugacacugucuucuuuucucccuguccuauaaacagaguguggggagaguucagggugugauguguacaugcaguacaugauguguacaugcagggugugauguguacaugcagggugugauguguacaugcagugugccagcuuuuaagugaacagggauccuuccaugccagugccccagaaggaaugccaguccuuuugcucucucuuucucccucccuuuuuuccucccuccugcgaacuucaccccuuccuuuucaggaucccauuuuggaauuuuaaaacaguucgacccagcuaccauuuuacucccuaacuauauguucaggcaucuaacuccauguaugcuugccugugcaguuuugaaaaacuaaaacuaaacgugugccuuucuuacuuuucagggagcauaauucguaagaugguuuuagauaggcaacaccugggagugacuaaguccaggugcauagugugggguguugccuucuuguccgacggcacugucauaaguguggacucuguuggaaaggugcaguugugggacucugcuacugggacacucguuaagagucaucucgucgcaaaugcugaugugcagucuauugcuguugcugaugugaguauggucgcagcccaggucuucccugaacuuacgguccuccugccucagccucugaguagcuaggauuuaggcuugugugacaagccuaucuuccaagucagucguaggucuuuccuuucccauacaaugcuuaugugacuuagaaggauucaguuuuuuaucacaacuaacuuucuuguuauuguuaauuuaaagcuauuuuuacauguuucugcucauacuaagcguaguuuguauauaguuacaugucaccuaauggcgggaaggaucacauucugagaagcccaucgggugauuucaacauuguaugagcgucauagaguguauuuaggcagacagauaguaggggaagcuacuguguugcgcaccuaauguaccaauuguguguacucuuuuuuuacacaacuaacaacagagaaauuuaaauccuucuaaaccguguaagcagugacaucauagaaauccauaccguguugaaauccauacaaguguugaacuucauaaagauguuuuacuaagcugacaagauggcucaguggguaaugacacuuggcgccaaguaaagagagaagagaugcaguagauuucauuuaagaagaugcuaccucuaaggaaguacaaauacuaagugccuuguuugaaaguggaagaggguuagguuaucuuucaagauuuguagcagagagaaaucuugucucaaaaagcaaaauaaaauuuuuuuaaauuauauguacuuuuuuauuuuauguacauugguguuuuaccugcaugucugucugugugaggguguugaauccucugcaaugggaguuagagacaguugugagcugccauguaguugcugggaauugagcccugguccucuugaaagagcagccagugcucuuaaccacugagccgugucucucuaaccuccacuuuuuaauaugcaugaguguuuuaccugugugucucuggaucccuuggaucugggguugcagacagcugugagcuggcauaugggugcugagaauugaacccaggucuccaccaccccacccccuuuuaaaauaaauauuugauuauguguggguguggauaugcguacaagcguguagaagucagaggcuucaauacguuuggagcaggaguucuguagaagguugcaagcugcauuaugugagugcugggaacugaacucggguccacugacagcaguagugcccucaaccucagaaccagcucuccagcccgaagguuuuaaaaucuuacagcaagauaaaaaucucccaccuaaaccaaccuaaaguacagucuaacgguaugcuuacaccagcuucauugugaguuuugaguaauguuuuauguacagcuaugaugucacugggaauugggaacuuuuuuggaugauauuuuggcuugucauuaaauguguagcuugugacuggccauacugauugacacaauuggccauacuaauugguaauguugucagcagggggcgcauggcuacccauguuugagcuugcuucucugauggaacugcuacugggagccucccugcuaauucagggcaagagggguuuuuugacuuuuuuuuugucuccugagcugcccagauagaaaaccugaaggaauauuuuccugucugguauguuuuguugacaucuauccccucaugauuuaauuucucagcaagaagacaguuuuguggugggcaccgccgagggcacgguauuccauuuccagcugguguccaugacuuccaacagcagugagaagcagugggugcggacgaaaccguuccagcaucacacucaugacgugcgugcuguggcccacagcccaacagcccugaucucaggagguagguccucccccagccagcugcuccuggcugccgguucuggcucaggcuguucucuucaugaaagccaucucuuaccgcauguucccacaggcaccgacacccaccugguuauucggccucucauggagagaguggagguaaagaauuacgaugcugcucuccgaaagaucacguucccccaugugaguagcccccuggcacccucaguaucucucccucugcccaguaagacagcucgcacuuccuaugcucucuucauuguauucugaggcaagccuccuugaagacauccacuauguguacauguacgugaauauugugauaaugaggagguguagguguugggaaggucuucucaauuuguaggauggugccaucuaccuugaaaggaccacuacuagccugguucuccaccuaaggguagagccacccacccuuacaaacaagcuaaccagacucccaugaagcacgguuacugagggcgggguguuucuccagaaaggaagcucaggacgauguuugcacuuuacacacacaguuuaggccuggacaugugcgccccguggucccugcaaacaaagcagcucaucuugcagcucguaacugucuguaccuccaggucaagagcucuguuuuuaucucuucagguacugcaugaauguggugcacagacauauaugcaggccaaacacccacacaccuacaguaaaaaauccacauuuuucauguaugugguuugauagucagacauaguccucauucccccgccccaccuuugacuuuaaagacaggauuggauuauguaguccugucuggcuuuguuaucccuacauagaguacacuaaccuugaacucauggagcuccauuugguaccaggaacucagugucucuuggcugaauccuucucuguccuucucuaucccagucugagucaccauucguggauuccuuuucagggacuuccuuaagaauuuccuuuuuuguuuguuuuguuuuuagacaggauuucucuguguagcacuagcuguccuagaacucuuuguagaccaggguggucuagaacucagagaucucuugcuucugccucccgagugcugggauuaaagacaugcacacgugaccagcuucguagucuccuuuuaucaacgucugugucgugcuacccuaugcuccuuggguuguucuaaaagcaccguguucauuucucuguguuuaaaaaaccuuugguugcuauugucuucagcauagagcccuaaaugucugguguguuuguggaaaccuguguugaucuuggacuguccugucucauucagcuuuuccguucccaaaagucuuuuccaugcugcuuugcaucugaccuugaggcacaaugagaggucacacgcccuuuccucccugggacuuguuaccuugccuucucugcuugacuaaucuuuaccagugaacuacuucuguucuguauauauuccacgaggcuaaguuagaugugcuuucugcucauccuagguuuguccguguuaaaucuugcaccauacccuauauauagcaugacugccuagucuaugucauuucuuuagacgagucuuuaggucaguggcuauuucaucaccauuguggucuugauuccuaggacaguggcuagacuguaguaggauuuaggauauguuuaucaaauaaaugaagaucuaggguguuucgagacugugucucaguaaguagacuagauuggcuuugaacucacagagguccacauauuucugccuuccaagugggggccacuguacccagcuaaauaaauggguuucaacaguagaggagcugguaugcuaagauguugaaucggggaaacaaagcaguggaugaccagguuggccuacuuacaacguuucaauuguuggcugcagcggcgucucauuuccuguucaaaaagaaggcagcuucuccuuuuccaguucgcgcaucacuuggaacuguggagacuaggauccacaucugcaacagguaugucuggagaagaggcuuuuguuuuugcuuuuguuuuuuuaaaacugggaaguauuuuaaaaagagggggggaaaggugggaggguguggcaagaagggcuuuugcaucccucacaagugccggccugggagcacaggucccuggaugugaaccacaguaucggccgguacacgcacacaaaaggaaacuggagaccagccauaauugugcaugccauuaaucccggcacaugggaggcagaggccugugccaagucaagaaagaaaacaaauaaacuggaaagagaaugcgaaguagcaaaauugcaguugaaauucugccuguagaaaauaagcugcaugguggcaauucucuggcaguggaaacagaagaaucgagcucaggaccaaggcaggagcagcccugagcuugcuggacauggcuguggcugagaaugugugcugccuuuauaggauucaguucacagcaccuacgcuggaugguucacgaccccacggaacucuggcucgaggggaccugacacccuuuucugcccuccaagugauacccacacacagaggcagcuaacuaaaaacacacaaaaaucuuacaaaugcgggagggcuuaggcuucuguaagaugcaugcaagaggugauugagcugacagcuacggagucaggcuuugcccuggccugcuggauauagaagcaggcuguugagaacugagaagguagaaggcugugcagaggcaguccugcgugcagacaggccacggacucugagucuaguuuaagagugaauucucuuccuuagaauguauugaaaucugcuccuccaucccugcaugucuguggaguggggcuucagccaugucagacacggucuucgagcucguuugcugcucuuucggggccagccugucagagagugcuguguacguggagaaccagugccagccugucagcgcuguguacguggagaaccagugccagccugucagagugcuguguacguggagaaccagugccagccugucagagcgcuguguacguggagaaccagugccagccugucagcacuguguacguggagaaccagugccagccugucagagugcuguguacguggagaaccagugccagccugucagcgcuguguacguggagaaccagugccagccugucagagugcuguguacgaggagaaccagugccagccugucagagugugcuguguacguggagaaccagugccagccugucagagugugcuguguauguggagaaccagugccagccugucagagugugcuguguacauggagaaccagugccagccugucagagugcuguguacguggagaaccagugccagccugucagagugugcuguguauguggagaaccagugccagccugucagagugcuguguacguggagaaccagugccagccuaucagagugcuguguacguggagaaccagugccagccugucagagugugcuguguauguggagaaccagugccagccugucagagugcuguguacguggagaaccagugccagccugucagagugugcuguguauguggagaaccagugccagccugucagagugcuguguacguggagaaccagugccagccuaucagacugugcuguguacguggagaaccagugccagccugucagagugugcuguguauguggagaaccagugccagccugucagagugugcuguguauguggagaaccagugccagccugucagagugugcuguguacguggagaaccagugccagccugucagagugcuguguacguggagaaccagugccagccugucagagugugcuguguauguggagaaccagugccagccugucagagugugcuguguacguggagaaccagugccagccugucagagugugccguguacguggagaaccagugccagccugucagagugugcuguguauguggagaaccagugccagccugucagagugugcuguguauguggagaaccagugccagccugucagagagugcuguguacguggagaaccagugccagccugucagagugugcuguguauguggagaaccagugccagccuguaagagugcuguguacguggagaaccagugccagccuaucagagugcuguguacguggagaaccagugccagccugucagagugugcuguguauguggagaaccagugccagccugucagagugugcuguguauguggagaaccagugccagccugucagagugugcuguguauguggagaaccagugccagccugucagagugcuguguacguggagaaccagugccagccugucagagugugcuguguauguggagaaccagugccagccugucagagugugcuguguauguggagaaccagugccagccugucagagugcuguguacguggagaaccagugccagccugucagagugcuguguacguggagaaccagugccagccugucagagcgcuguguacaaggagaaccagguugcccacgggaaggagcucuguggugcugagaguuggcuucacaguggaaaaaugcagaauuugucuuuuuggugagaaaaaaacucaaggaauuuucugucuuuaggcaagaacggagauacucuuccacucucuaaaaacgcagaucaucuccugcaccucaagacaaaggugaggucuguuuguacuccccauccaagguccagagcgcuucuauucugagucugagugccacucagucuguagcccaggcugugucaucaguuggauguugagaauguguccuuauuaaggugguacaaauauaaaacuuaaauaaguaaagauaucggucauuuaugguggcacaugccaccuguaaauuccaacauucaggaggcuccgggauaagggccgcccugagucuggaguuagccauggacagagauugaguccagguuuacugucaucaggauuagccuuaaaguuagaaucccucgucucccuggugcugggauuacagauaugcaccuccacaccagcuuuaguuuuaacucuacauaaacuuuacauuccauauuucuucuccuuugaauaucuuucuuuuuuucuuuucuuuuuuuuuuuuuuuuuuuuuuuuuuuuuucauuucuuagagguauuuuggggggaugagguuuuaggacaggguguaaucucuguguaguccuagcuguccuggaccuuguuccauagaccagacuggccuggaacucaaggacugccugccuuugccuccugagagcugggaugaaaggcaugcaccaccauaucacagacagaagaggaaaugagcacucaauccuuuguccucagcuguugcauuaauguccuguuucccagauuaagacuuuccaagguacucaaaagaccuaacguaauacacaguuagcugcagacacguguuagauuuggaaaucaaagcuguaccagugauguguucugucugggauuuaaugauaguacacacagcacaugaguguucaagacuacauacauacaggcaaggcgggcaauggucgugcacaccuuuaaucccaacauucaggaggcagaggcaggcggauuucugaguuugaggccagccuggucuacaaagugaguuccaggacagccagggcuauacagagaaacccugucucaaaaaaaaaaaaaaaagaaaaaagaaaaaggccuauauaggcauuuguggaaauguccagagcacugagauuccugucauaggaaccuuguuauaagguuugccagccuugguggcggacuccccugagcuggcaucgggugucuaauuggaggagguuguagugaaacgacgagauguugucuggaaugcauugguuuucucacucgaguugcucccucgguuugccagggcccugagaacauuaucugcagcugugucuccccguguggaagcuggauagccuauucuacagcgucucgcuuuuuucucuaucgauugaaauaugaacgcgauaacauaagccuccaaagaguaagugaggggggcgcaguguguuccuggacaagaagaaacuucuguaugugucauuuuuguuugacguggcaaugaauugggaagaauccuuagugaaaaguuagccagucauagcuguuacagaaucuaugggaccugcaugguggaaggaggaacucgcacaacuuaaccucugcccuccacauacaugcacacagcacauuuuuuaaacguuuuauuugcuuacuuguaucgaugucuugcaugcaugcaaguauguuuguucaccauguguaugcugaugcuugcagacagaaaggggggcccccgggcacugaaguuauagaugguugugagccauacaugggugcugggacucggaguccuguccucuggggaaguggccagugcuuguaaccccggaagcaacucuccaaccuacacacaaguuuuuuguuuguuuuaaaucuuauagaagguucuagguucgaucuucagcauuaccccugcaaugcuaaauauauauuuacuacuauuaauuuguuuaauuuuuauacauuuuuagaacagaagagaauuacauuucuuuccucuuuccauucccucuaagaccucugaccccauguaugcucuccauuaaagagccuuuuuuuuuuuuuuaacuauuauugguguguguguguuugcacgaauaaauguauaaauauagccugcugagucuauuuuuguuagugugaaugauuuuuagggcuauguauuuauuguguacauaaaaaagaaauagagaaagguuccuagcaaaaauguucuuuuauucccauagcaugcccagguagagaacugacgcguuaccaucuggauggagagaaggcuagacaggcucugggaaacaugccaggguucaggcccuugugggucucugcuuggaaaucccaagguuaauggaacugaagccuggcugugucggguuugggugcuacuuucucucaccagcuuucaccauugauuuauccaaagguuuccaaauugccaucauuccugcgcucugcccuucauauucuguuuucugaagauucaacaaagcuccuuguggcauccaaucaagggucucugcauauuguucaucugucggaaggaagcuucaagcacuugcauacuuuccagccgcagucagguggggauucuuuuuuguuguuuuguuuuuguuuuuguuuuugagacaggguuucucuguguagcccuggcuguccuggaacucacuuuguagaccaggcuggccuugaacucagaaauccgccugccucugccucccgagugcugggauuaaaggugugugccaccacgcccggccagguggggauuucuaacuggacagagagacuucuuagugucuccaggguggugcccugcuuuuuagacccagcguggggugcuggugcucuucgcacccugcagauacacucacuccuauguuugcagguuaaguaggaggggauaucuggcagaugaacacgcgcgacgagaucugaacuguuccucacaccuacucuuuucucacuggguucuuguuuccuuauuugggaccagagaaguuucaucaugcuugcuuuuguuagcagaguuagaaagcaguaaaagucaucuguaucugcgguccuggugcugguaacccccaguacuuuaccuaguaaccccaguacuuuaccuaguaaccccaguacuuuaccuaguaaucccaguacuuuaccuaguaacccccaguacuuuaccuaguaaccccaguacuuuaccuaguaaucccaguacuuuaccuaguaaucccaguacuuuaccuaguaaucccaguacuuuaccuaguaaucccaguacuuuaccuaguaaucccaguacuuuaccuaguaaucccaguacuuuaccuaguaaucccaguacuuuaccuaguaacccccaguacuuuaccuaguaacccccaguacuuuaccuaguaaccccaguacuuugccuaguaacccccaguacuuugccuaguaacccccaguacuuugccuaguaaccgccccguacuuuaccuaguaacccccaguacuuugccuaguaaccccuucguacuuugccuagaaacccccuaguaugccuaguaacccccucguacuuugcucaguacagauguuuauauaagaugaaaauauuguugugcguauaguuuuauuuggggucauuuguccuugugacugucuuuuguguucugugagaacauggauugcaucaccggaugcauugcuauacacaccagcuaaugcugaauuaacagcacuggggaggugcaauguugacuuaaguuucucaucugcuuuacguugauaguuggauuuauuccaugaucugucccuugucccuagccuggcauuuagcugcuucauuaccauuuagacucuuaucagccuggauugucaacauuuaauauuaacucauggaaagcugcuucaggccagguguuggggugcacaccucuagucccagcacucgggaagcaggggcagauggaucuccaugaguuugaggaacucacuauaaguuccaugguagccagggcuacacagagacccugucucagcucccuauauccuccaacccccaaaaagaaaaagaaaaaagaaaaccugcuucagaggaaaccuaccguuuaggagucagaugaauuaagccaacaauucuuuuaauuauaaaucuuagacuaccuuguccuuacauuguuuugguuucucuguguagcucugguuguuuuggaauucccucuguagaccaggcuggccucaaacgcagagguccgccuggcuuugccucugccucucaaaugugcguaguaacagucagugccaccaccauccagugccuaacuuaccaucuuuaccacccucagcacuuggucugugacuuguuauaaagcuuuucucauuauuagggauacuuagaugcagcauauaucuuagcauauaaaacugaugucugauuuuuaccucaugucuucacguugcuaauugaaucaaaaccuauugacaaaggugcucgguaguguuaaacauacagaggccauucaauaaauaugugcuucaaacagugagugggaaaagguaguuugaaauaauuagcauaggauacaguuucaguuucccucacaccgcagacgccuccaguuguagcuuuccagccucuucacaugagcggccacugggucaauaguuuuuauguuuguuuuauauuuauuguuuguuuguaccacaucucacgauguagaccuagcugaccugaaaaaugcuguguagaccaggcuggccucaaucucagauucucugccuccugaguccuaggauuaaaauuuaauaccacgguacaauagcuaauucaguuuuaaaaguggggacgguguagcugccugacauuugggaagcagaggcacacacauccuaaauuuaaggcugucuugagcuacaaaaguauuuuccuaagcugggcgugguggcgcacgccuuuaaucccagcgcucaggaggcagaggcagaggcaggcagauuucgagucugaggccagccuggucuacaaagugaguuccaggacagccaaggcuacacagaaacccugccucaaaaaauuuuuuuuuaauuuagaaauaaacagguuaaccuuuagaacuaauuugcaaaacuccaguaaauucuccugugauugauuuauagccacgugggccuugcuggucuuuccaucaucuccagggcugggcaggcugugaguggcuaauucaagaccuuguuucuucuguccucacagguacaguggaggccaugugucuuuuggcagucaguccagaugggaacuggcuagcugcaucggguaccagugcuggaguccacguauaugaucugcaucaucuaaaggugagccucagaucucauagcagcaguuugagucauaugggaggcugcuugucauguuaagauuugaggcagauuggaguuaccuggaaauuuacuagacuuuuguuuuccuccuuugcauuccuguuuuagaguucuuuagagccucaaagcuguacucacauaauauuaaaaucagaaccauguaauuagggguucgagagugauacauccauuuccuggcuagggauauaggucagugguagaguacuugccuuguguucaagguccguccucaguaccacaaaacaagcaagcaaagacaacagaaugauuaaaaagacaaaaacacccagguaucucugcuuugaggaaggaggggaaguucugauacauagauucagagcuagagauccuggcaggcuuccuuuuauacuugcugccuuguauauucggugugacuuuaaguaagauagaaccagaggggaagcauagcugggaauccuucugacaacuacuaacagguaacaauacuaccagcugugcauugaaucauauaccacaguucugucccuggcaccgccaaaacgaauguuucugugaagugcccacauaccuuguaguugaacccaaaugucuguccauaggcgauaauuuuuaacaggguuucccuguauaccccuggcugucuagaacucacucugcaggccaagcuggccucaaacucagagauccaucugccugccucuggcucccaagugcuggauugaggcaugugccaccacggccuagcaguaauguuuuucagacccagaguagagcuauguguucucagugcagaggcguauuugagugauugagcaguuuauucagauaaagcugcucuuaggcucucuggaaaggcuuuauuuuguaaacaguugauaagcaugcuuuguuuguuugagaaaggguuuuacuguccuagaacucacgagaccuggcugacuacaaacucagucgacagauuaaaaaugugugucaccacaccuaacaaaagaaaaauuuaaaugaaguuaaaguuguuuguaguugaaaugccugaacuuccacggaauacuuuugaguucgcuuguguguuccaaacagcugccuuaggggcucaggcuuuagugcaauaauaagcugcuguguagcguguaugaggcccugacaacaacaaaagcaauaacaaugacagucaacuaccagaaaucacuggcagcuagcuuacuuugggggugggugaugugccgccuugcacagcucgcguaaccuuucuugaaggacgguguccuauagucuucccugucuuuucccagcuucacugcacagugccugcuuacaacuucccagugaccgcucuggccaucgcccccaauaccaacaaccuggucauugcucauucugaccagcagguaagugacuccagugcuuuccaguucccucugcuacacucacuggaacagcuaggaggagcuuccccugagacgguggaggaugcauaggcagguuccuuuguguaagugaggcuucccuggguggcccauuggcaagcaguacccacuggcuuacagugcaguucuagagaagaacacagagugauacaagaguucugaagcaaucugcugauguaaaccagagaugacauggacccagguaccaaauuaguuacagauguaauaaaaucuugaaaauaaacuaaaaaauggauggcuuaccuucauaaggaaaacagaccuuacuaaaauaggggugucuaaaucucagccagagugagaacuguaagucuacaggaguuuuuuuaugccaaguuaggaagaagcacuguuuaaaauacuugggcuauagaacacauuaacucaucaaugcugguguauccucaucuguaaacuggagaugagagcaucagccagacucaccaugucugggaagcacuugguuagccugcuaggcaaacgaugcuuccuaaacaguuuuacacucucccacacacacaauauccaaaaaugcucucucauguucacgggcuuucauccuuuaccuagacuacugaaagaugcugccguaagugccuuugucauuuaaacugauacccugaguuuagugacaaugcccaagauccuaucaugugggauauugaggcaggaggaucacaaguuccaggccaaccagagcuuaaacaaaaaacuccgacuggaaaauucacggugagacuuauuaaguaaaauguaaggcugaauacggugcuuaguguucacuacuuacucgugguuaggaaaggauaaaacccagaagggaccagagccucugaacaucaugagugcacauuugcacuuguuuggugguguguucuccagguauuugaauucagcaucccagaaaagcaguauacagaguggagccgcucucuccagaagcaaggauuucaccagcuguggcuccaaagggauacucccaucacacacaucagcuuucaucccaagagaccaaugcacauccuccuccaugaugccuacauguucugcaucauugacaagucauugguaaguuuggagacuucuuacuuaggguaucuuuaauuuuguguguguguguguguguguguguguguguguguguguguguguguguguguuuugcucacagaagccagaagaguguuuaagauuuucagacccaccuuugccugaguuccagcuguccaugagccaugaaccuccuauugggaaccaaacacagauccucugcaagagcagccagugcucuuaauugcugggcugcccuuccagcaccccgguuuguuuuaggcuuuuugagacaugcuguugcuauguagccugacuggccucacguuaaauuuacagcaauccugccucugcuucuaagugcuggggaagugacgugugaguuaccacacccuaucuuuacuuaugaauuuuuaaguauaaauaaugauugauagcuaagggagccucaggauacaaacuucuaccuccguggucaguggaggauggguacaaacugccagcguguugauuggaggacagguucuguuuggcacacucccugauuugcauuccuacuguuggguaagggguuagccuuucuggacuaguuuuucaacacauaauccuaaguagaaaaaugauuggguuggcauucagagggugacccucgggagggaauacguuugagcugacgacccacuuuuaacuuucacucuugaaugacugagugaagcaauuucauucauggagacgccugcugauguuuugaccaccgugcuccuuacugaacacauuucaaaaguuggucuuugugucuugugaaaagcccagcugggauccagugucugugaccacaauuuggguaggauacaagugcuuccuuuaguuugagaugcuagcugcuguuuugauuucuuuuuucccccugaguauaccugucuuuucuggguaggagcuuuucuuccucggaggccuguggaccacagccauggcuguacugcacuuuggguuucaguuauacccaacaccagcuguucugccggucugugaaggugggggugggacuugcguggguaaggcagcagauggcucuaaaggaggugugcacagggaagugucacugaauuucaucucuugggccuuguguccugggaugugggaagcagagcuagcuggcaagugccuccugugagagaguggagcaggaaaagccccucccacucacucagccuucucucuguaacucagcccagaaggcuuucacccuggucauggugauagguccuucauguccuuguccuaaguagagcuaguucccaggaagucagagaugaagugaaucauuuauuuggccgucucuugaagugucagugacacaucaguggguaguuuauguuauuuuccuucgggggggaggggaccuuagccacuuggccaguguauuagauaugguuggggggggggggcuguggaaagcacagggacugugugggcugagauccugcacgugcccguuuguuccugacaguguugcugacaagccuggccuacagcgugccugucuuuagucuugcuguagaguaugaaacccuuucuugcuucauccugcccaucauaaccccuuuuugccugaagcauuuuuacacgaccuaggguguaucgauagguauacagaugaagaaugugugugcacgugugcguauuuguguguauguuuguuugcaugaguuuguauucaccauguaaguguagugcccacagagaccagaagaggguguuagauuuccugggacuggaguuacaggcaguugugagccaccuaauauggguacuaagaacugaaucuugauccugugcaagagcaauaagcauucuuaaccacugagcuaucuuuccaacucccacauguauuuaagacaguucuugagggcuggggauacggcuuaguuguagaaugcuugcccaccacacaugcaacucugguuuagagucccagaacauguaguagaauacacuuuggaaguagagauaugaucagaaguucaaaguuauuccuaccuuuggcaucaauuugaauucagauugaggcuagggagccucucucaaaaaaagauuuucugggagugccugggguguuggcuuagugguuaagagcauauauagaaaguaauaauuuaaaauuuuuaaagauuuuuuaaguuuuuauauauuauacacacagugcucugccugcaauccggaagagggugccagaucccauuacagaugguuaugacccaccgugugguugugggaauugaacucaggaccucugaaggagcagcuagugcuuguaaccucugagccaucucuccagcccaaagauuuucuuuauacauauacuuuuccauuuauucaagacuaaagaggaagggcuagggcuggagagauggcucagcaguuaagagcacugacuguagcugggcagugguuggcgcaugucuuuaaucccagcacucgggaggcagaggcagacggauuucugaguuugaggccagccuagucuauagagugaguuccaggacagucagggcuacacagagaaacccugucucggaaaaccaaaaaauagaaaaagaaaaaagaaaaagaagccaaugaacuuuuugcuguuuuauuuuuguggugcuagggaucaaagccagggucuuacaaaugcuagauaauacaaauccaaauaguauaucuuguucaggccuguaauaccaguuccauaggaggcuggggcaggagcaucucaaauucagggacuaagaccaaaguuauggcuagccugggcaacuuagugaaacucucucaagaaauacugaauaacauggugauaauggugcaugccuuuauccuagcgcucaggagguagaagcaggcgaaucucugugaguucuaggucagccuggucuacacagugaguucgagaauggccagggcuacauagugauaccaucucaaaaauaacaacaacaaaagggggcugggagccgggcaugguggcgcacaacuuugaucccagcacucgggaggcagaggcagacggauuucugaguucaaggccagccuggucuacaaagucaguuccaggacagccagggcuauacagagaaacccugucuugaaaaacaaaaaaaaaaaaaagaagaagaagaagaaggggggggggggcgccuggggaugaggaguacuaaaaaauuaaaagguuagggauauuguucagagugcuugcucuugugugugugugugugugugugugugugugugugugugugugugugugugugugugugugugugugucugucugucugucugucugucugucugucuguauuuauguugcucuaauaaauaauuauccuugucuuuucagccacuuccaaaugagaaaacugugcuuuauaauccacuuccuccgaaaaaugaaucagaugucuucuugaggcggacaacccauggguuuaaaaugucaaagauauauaagguaaaaccccguacuguacccugguugguugcuuccuggcgauguuagcaaaauguaacaacuaacaguuagaagacaagccugucuucuuccauuagcagguagagacccugacuugggagaggaacaaccuugaaguugucuguugcuguagcugugguucacuguucuuaguagguuagagcagggaagucguacuucccugugugagagacauuuguagugagcagugaucuugguacucauguggcaucuuuguuagaaugaauguucuucucugaagcacuucuaauuugagaauauuucaaggaauaaaaguaaugggagccauugaacuuaaacgauuuucuuuuugcuaauuucaccauauauaaaacgauguccuuugaccuuaugguaccacggcugucuggcccagcucaaguuccccagucauacuccuuaugagccaacuccacuacagggcuggcccuguccgcccauguugaguccaagggcaggaaagauugucaggaauuucuguccuuugagucuugaccagagcugguggagaaugacucucuuacugucgucucucugcagcccuugcucuuuauggaucuuuuggaugaaaggacacuuguggcaguagagcgaccccuggacgacaucauugcucaacucccaccacccaucaaaaagaagaaauuuggaacuuaaaacagggcacugucuguguccuuucuugaacugucuauccuguuguuuuguuuguuuguuuguuuguuuuuucccaaaucaugauaauaaaacaaaguuauucuuuaggacuagacauuuuaaauuauuuucuaaaagaaugagcacagauuuccuuuuuuugagugcaguggcaugaaggucauuauaaaucccaguaucaggauggcucuggggacacacacuggacccucaagccuuacaacuccucuugaucacuacaaacugucgcggaaggagagaaccaucucuggaauguuauccucugacuuucuguguaugcauacaguaaaggcgaaccaaacuucaaggcau

SEQ ID NO: 4750 - RNA, 4879 nt, Mus musculus
gaaggaaggaaggaaggaaggaaggaaggaaggaaggaaggaaggaaggaaggaaggaaggaaacuaacuccuaaucucuaaugagaagaucaaauacaagguuacuuagaucuuaaaagcacauugcucuggacaaauuuuaauguguacuacuacagugguagucugaguuuacuuuggaagcuauuccagguuugucaggcaccaggacuacacaguaagauucugucucagaacaacaaaauccuaguacuugggagcuacaggcaaagaauccaagauuagcuguacucaauccaaggccagcuggacuacaucugauccugccucaguacaauagaaaaaaauugaggucauauacacuuuaguugaauccaugcccuuguuuuaauuacuuaguaaucuagaaugauuuugacucuacacacaauucuuacaagucgauacaguccacacugaagcaucuuuaagcuccuucuuucacugucuaaauauucacuaagcguguaguuguugguagaaaucaugcuacacgucgggauuguguacauucaagcagcagaguuuucccacaucauagugauguaagaggaauuugguauugacugccuaaggagcugcucugacacccguucuccuuuuuuuuaaaugagauagccuggagguuagcucagugcagagcagugcaaggcccuggcauccucuggaacaccacuaaaaagaggcagaaaccacauccagcugaucagugacaaguuuucagaggugagaauuucaguucaguguucagaaacaacaaguagccacagggaguacauuaacuauuuuccugacuuuucagcaguggccagaccaacuagggaaaaaugguuguuauauuaacucgcaggaagagagguucuuucuuccuuuucagucuuaggcauugaaauugaccucgggccuugggcauacuaagcauacaguaccacugagcuacauauucauaaaguccuagccccuuugauuucagaauaaaacguuuugguuuucuucucaguuuuuaaacauacucuuauauaaaauaaccuugaccagccucaaauugcugguccuccugccucuacuaagcacuggggaucacagcugugcaccagcuuugaaauaacuuaaacuuaacuucuugccaccuuuauuguuccaucccacugugugugacuggaucaaaguguuuucuaagacuuauuucuuauuuuaugcauaugaccguuugccugcacgugcaccauaugcacgcguggcgucugaggaagccagaggaagcuucagagccccugggacugacgucagagaggguuacaagacacuaugcuggggccaggaacuaaaacccagguccucugcaggcgcagccagugcuccuaagcacugcacaucuucccagccacggcacgugacguacaguccagcucuugagaggucugggaggcaagggagauggggaguugaaagucauccucagcuauguagaguuugagaucagccuggggucaugcaggaaacucagcucaaaaaaaguuugugugaauuuaauauaauacauaaauaugacuguugcaaauuacucuuugcccaauuaguuagauacauauguuuaaaucuaccauauugugagacacauuggcuuaagugcuuagucuuaucagggaggcagaggcagaucucaaggccagccagguuuacagugaguucuaggcuagccaaggcuacacagugagacccugucuuuuuuuuuuucuaaagcaagcacaaacaaaagcuaugcaguuaaacccuauaauagauguucccuuacuccaugauaggacugggaucccggguuagacuucucaccucagccuugcgcugacuuugccuccauauccuugugacagugcucaucccaguuaaugcucuacccucagggccucguggcucugucacccuuccgaagccacagaggacuguagauacccaaaagauucucugggaauguaaacauuugaaacuuucgggcuaguucaugguguaucccuacauuucacccaacaggcauuuugugguagaagcuucugcaucaagccgacugagugaucaggggccuacaagaugucucagcaggcagaggcacucacagccaggguuacaaccugaacucaguguuggaagcagagaacugucucccaacaguuacccucugaccagccucaggccagagcccccccccacacacacacacacacacguguguggcagggagucacuugguaguggauccaauuaacuuagaaucuuuuauugcccaggcacaccacguccucucuuuauuaacuagucuguuucucuuuucuuuuauguauguaguuguuuuaccugcauggaugugugcuacaucuguucagugcuuguagaggucagaagaaggguccagauaccuggaacaggaguuacaggugguucugggcugccgugugggugcuggcagagcagccuguguucuugcuuguuacgccaucuuuccagccaccacuuagcauuugucccagagugucauuggauuuagcuugcuccaguaaacgauugugugaaggcauauucaggcucugcccguggcaacaugagaagaucaccuaaacauguuaaggaaguuggaguuuucauuauauaucauuuuuuaaugaaaacuuagacuuuaguuugugaagggaaauauuauaggucccucaauaagauaaaucacaaagugaaaauuuaaucuuuaucgccaacaguagauuaauaggggaaaaagccuuuuucuuuuuucuuuuucauuuuuauaugugugaauacacugucacugucuucagacacaccagaagagugcaucaggucauguuauagauguuugugagccaccaugugguugcugggaauugaacucaggaccucuggaagaacagucagugcucuuaaccacugagccauuucuccagcccuuuuauucuuuuaaauagacagcaaaguuuauuuuugaacauugcugaccuauucauuuccagacuggaggguaguuuuguguuuuuauuuuucuguuuuuugaaacagagugucugugcuauccuggaauagcuuuauagaccaggcuggccucaaacucucuagagaucuaucugccucugccugggaucaaagaugugugucaccaccacugguugcaucuuauuuucuuaagguccuuauacacaucauagcuggaccguuucuccauuaacaagcaaccacauugcauuaaaaauuagcaagaguccagguguggcaaggucacucagugguuggagcucuuggcugcucuuuuagaggcucgauuuuaauuuccaacacccacaugucggcucacaguccucuauaauuguccuaugggauucaauguccuuuucuggugugcagcuauacaugcagacaaagcacucauauacacacacuacauaaauaaguccugaaaauuagcauuuuucugcuuacucaagaacccguuggcguucaaacucaguggaaagagaccuagagaaagugagccaggguuggcugaauuuuccaguagugacgccucuuucaauccuucuugcuuuuuauuaccugugaggucagcuuuucaaacuuguuuaaucccucccugaaaguacucucugagcuggggauggcgggaagaggaguugcauggcucucuccccuuguuggcaaauguauuggagucacugggucacgccuugcgugucuuguucucuaaaccugcccuuugcagucaggugcuaauaacugcguuuuuaucaaaaccagcagauauuauugcugcacaccuaguccuauaggaccaaagaagggcuuuccuucuguggaguccucgguuaacaguggguauuuucacaucuuuuugcugguguuuucugaaucagugggauuggggagagagaaaagcugaggucugcggaaucacggccucccaaauccucacuuagcaccccaggcacuggguucagcucuccucccucgguugggaugccacccguauugucagucgccuggugagguaaguugcaguccccggagccccaauaaucccucuuccuagugccagaucugaagucuuacaaagcauaaccuauuuuuuuucuucuguguacccucugcuaauccccacguguauguauucuuucuugcacuacucauuuuuguuaaguguaaagacuuagaaagcuagcucaaguaaggcuggugauuagcucauuuggaaggacacuugccucaggaagcccugaguucuauccacagcaccauagaaaaccagauguggcuggccacaucuguaaacccagcauucauuuggaaggugggaggcaggaagaagucauccauaguuacauaguaaauaacaagccagcucaggucuguggaccugccccucaaaacaggcaaacccaaaaaccucaacaacagaaagccuguuuguaccaauugauuguuuugguauugguguugguuuuuuuuuuuuuucuuuuuagaauccuuuauuuaaauaagaccucuauucaagucuuauuuaaaauuucucaaaucuucuggcuaccaaaucaaagacccaugauauaaaacagagcaguauguguucuuauuuuuuacaaagcuuuauguauauucucucaauauagaugcuuagacaacacuucccuugaguugcacaucgacauauagcauuguauauuacaaugaaaauuuguaacuuaaggguauuuuauauauauauauauauauacauauacauauauauaaguauauauuccuuuguaaccuuuuuauuguaaauaaaaaguugcuuuuaga

SEQ ID NO: 4751 - RNA, 4879 nt, Mus musculus
ucuaaaagcaacuuuuuauuuacaauaaaaagguuacaaaggaauauauacuuauauauauguauauguauauauauauauauauauaaaauacccuuaaguuacaaauuuucauuguaauauacaaugcuauaugucgaugugcaacucaagggaaguguugucuaagcaucuauauugagagaauauacauaaagcuuuguaaaaaauaagaacacauacugcucuguuuuauaucaugggucuuugauuugguagccagaagauuugagaaauuuuaaauaagacuugaauagaggucuuauuuaaauaaaggauucuaaaaagaaaaaaaaaaaaaaccaacaccaauaccaaaacaaucaauugguacaaacaggcuuucuguuguugagguuuuuggguuugccuguuuugaggggcagguccacagaccugagcuggcuuguuauuuacuauguaacuauggaugacuucuuccugccucccaccuuccaaaugaaugcuggguuuacagauguggccagccacaucugguuuucuauggugcuguggauagaacucagggcuuccugaggcaaguguccuuccaaaugagcuaaucaccagccuuacuugagcuagcuuucuaagucuuuacacuuaacaaaaaugaguagugcaagaaagaauacauacacguggggauuagcagaggguacacagaagaaaaaaaauagguuaugcuuuguaagacuucagaucuggcacuaggaagagggauuauuggggcuccggggacugcaacuuaccucaccaggcgacugacaauacggguggcaucccaaccgagggaggagagcugaacccagugccuggggugcuaagugaggauuugggaggccgugauuccgcagaccucagcuuuucucucuccccaaucccacugauucagaaaacaccagcaaaaagaugugaaaauacccacuguuaaccgaggacuccacagaaggaaagcccuucuuugguccuauaggacuaggugugcagcaauaauaucugcugguuuugauaaaaacgcaguuauuagcaccugacugcaaagggcagguuuagagaacaagacacgcaaggcgugacccagugacuccaauacauuugccaacaaggggagagagccaugcaacuccucuucccgccauccccagcucagagaguacuuucagggagggauuaaacaaguuugaaaagcugaccucacagguaauaaaaagcaagaaggauugaaagaggcgucacuacuggaaaauucagccaacccuggcucacuuucucuaggucucuuuccacugaguuugaacgccaacggguucuugaguaagcagaaaaaugcuaauuuucaggacuuauuuauguaguguguguauaugagugcuuugucugcauguauagcugcacaccagaaaaggacauugaaucccauaggacaauuauagaggacugugagccgacauguggguguuggaaauuaaaaucgagccucuaaaagagcagccaagagcuccaaccacugagugaccuugccacaccuggacucuugcuaauuuuuaaugcaaugugguugcuuguuaauggagaaacgguccagcuaugauguguauaaggaccuuaagaaaauaagaugcaaccagugguggugacacacaucuuugaucccaggcagaggcagauagaucucuagagaguuugaggccagccuggucuauaaagcuauuccaggauagcacagacacucuguuucaaaaaacagaaaaauaaaaacacaaaacuacccuccagucuggaaaugaauaggucagcaauguucaaaaauaaacuuugcugucuauuuaaaagaauaaaagggcuggagaaauggcucagugguuaagagcacugacuguucuuccagagguccugaguucaauucccagcaaccacaugguggcucacaaacaucuauaacaugaccugaugcacucuucuggugugucugaagacagugacaguguauucacacauauaaaaaugaaaaagaaaaaagaaaaaggcuuuuuccccuauuaaucuacuguuggcgauaaagauuaaauuuucacuuugugauuuaucuuauugagggaccuauaauauuucccuucacaaacuaaagucuaaguuuucauuaaaaaaugauauauaaugaaaacuccaacuuccuuaacauguuuaggugaucuucucauguugccacgggcagagccugaauaugccuucacacaaucguuuacuggagcaagcuaaauccaaugacacucugggacaaaugcuaagugguggcuggaaagauggcguaacaagcaagaacacaggcugcucugccagcacccacacggcagcccagaaccaccuguaacuccuguuccagguaucuggacccuucuucugaccucuacaagcacugaacagauguagcacacauccaugcagguaaaacaacuacauacauaaaagaaaagagaaacagacuaguuaauaaagagaggacguggugugccugggcaauaaaagauucuaaguuaauuggauccacuaccaagugacucccugccacacacgugugugugugugugugugggggggggcucuggccugaggcuggucagaggguaacuguugggagacaguucucugcuuccaacacugaguucagguuguaacccuggcugugagugccucugccugcugagacaucuuguaggccccugaucacucagucggcuugaugcagaagcuucuaccacaaaaugccuguugggugaaauguagggauacaccaugaacuagcccgaaaguuucaaauguuuacauucccagagaaucuuuuggguaucuacaguccucuguggcuucggaagggugacagagccacgaggcccugaggguagagcauuaacugggaugagcacugucacaaggauauggaggcaaagucagcgcaaggcugaggugagaagucuaacccgggaucccaguccuaucauggaguaagggaacaucuauuauaggguuuaacugcauagcuuuuguuugugcuugcuuuagaaaaaaaaaaagacagggucucacuguguagccuuggcuagccuagaacucacuguaaaccuggcuggccuugagaucugccucugccucccugauaagacuaagcacuuaagccaaugugucucacaauaugguagauuuaaacauauguaucuaacuaauugggcaaagaguaauuugcaacagucauauuuauguauuauauuaaauucacacaaacuuuuuuugagcugaguuuccugcaugaccccaggcugaucucaaacucuacauagcugaggaugacuuucaacuccccaucucccuugccucccagaccucucaagagcuggacuguacgucacgugccguggcugggaagaugugcagugcuuaggagcacuggcugcgccugcagaggaccuggguuuuaguuccuggccccagcauagugucuuguaacccucucugacgucagucccaggggcucugaagcuuccucuggcuuccucagacgccacgcgugcauauggugcacgugcaggcaaacggucauaugcauaaaauaagaaauaagucuuagaaaacacuuugauccagucacacacagugggauggaacaauaaagguggcaagaaguuaaguuuaaguuauuucaaagcuggugcacagcugugauccccagugcuuaguagaggcaggaggaccagcaauuugaggcuggucaagguuauuuuauauaagaguauguuuaaaaacugagaagaaaaccaaaacguuuuauucugaaaucaaaggggcuaggacuuuaugaauauguagcucagugguacuguaugcuuaguaugcccaaggcccgaggucaauuucaaugccuaagacugaaaaggaagaaagaaccucucuuccugcgaguuaauauaacaaccauuuuucccuaguuggucuggccacugcugaaaagucaggaaaauaguuaauguacucccuguggcuacuuguuguuucugaacacugaacugaaauucucaccucugaaaacuugucacugaucagcuggaugugguuucugccucuuuuuagugguguuccagaggaugccagggccuugcacugcucugcacugagcuaaccuccaggcuaucucauuuaaaaaaaaggagaacgggugucagagcagcuccuuaggcagucaauaccaaauuccucuuacaucacuaugaugugggaaaacucugcugcuugaauguacacaaucccgacguguagcaugauuucuaccaacaacuacacgcuuagugaauauuuagacagugaaagaaggagcuuaaagaugcuucaguguggacuguaucgacuuguaagaauuguguguagagucaaaaucauucuagauuacuaaguaauuaaaacaagggcauggauucaacuaaaguguauaugaccucaauuuuuuucuauuguacugaggcaggaucagauguaguccagcuggccuuggauugaguacagcuaaucuuggauucuuugccuguagcucccaaguacuaggauuuuguuguucugagacagaaucuuacuguguaguccuggugccugacaaaccuggaauagcuuccaaaguaaacucagacuaccacuguaguaguacacauuaaaauuuguccagagcaaugugcuuuuaagaucuaaguaaccuuguauuugaucuucucauuagagauuaggaguuaguuuccuuccuuccuuccuuccuuccuuccuuccuuccuuccuuccuuccuuccuuccuuccuuc

SEQ ID NO: 4752 - RNA, 1531 nt, Mus musculus
cuuuuuuuuucuuuuuggcauaauuuuuuucuuccugugaacucagaaccucuggaagagcagccagugcucuuaacugcugugccaucucuccagcaucucuccagccccgacugguuuuuugaaacggggucucuuuaugcuguccuguuggucuuggagcuugcuguauaguucaggcuguccucaaacucacaagagauccucuugccucuggcuccugagcgcagguuauuaaaagcaugugccaccaugaucuuuauuguagcuaugagggagggaacagucagaggcauccggaagagcccagagcugagaaagaacagaguggacugaauagggucagcugacuggaccugacugugaggggagcaggagcugugcagagagggagagacaagacaagaccaagagggcacagagcugaaaucgcaggguuaugaggagaaaugaguagcuggggaagggaagcccaugagugacguuuaggggagggagcaaagcgcacauuagcccacagaccuggaggcuagugugcgcuucccuaugcugacaggcaccucagacagccauguuccuucugccagugguaagggaaaugacguggcuccuuugauaaaggggaagcagcuccagaaucucaggaaaugcaguuuccuuugcaccugacacagagagagagacccugccugaaaaaaagaaguaucugggcauggcaacccaaaacuuuaaucccagcaaaggcaggcagaucucugagaguuugggugggcaggaguguggcaaucagaggacaacuauaagaagucugcucucuucuuccacccagcaggaacuggggauauuagcucauuugucuugugcacaagugcuuuuaccugcugagccaucucgcuggcccagaaaaguuaacaguuaaaaacuagcacaaacuugguggugguacaagccuuuaaucucagaacucagacggcagaggcagguggaucucuguucgagguuacgccuggucgacagccugaguuccaagacagccaaggcaacacagugaaacccugucuugaaaaaaaaauaaaaauaaaaaccaucacaaaacaggcuuuagaaucauucucucauaacaguuaccugggauugaacccacagugugacauucacuauguauacauuaguucauucauuguccccuaagacaggcaagguaaauacuaauuaacauaaccuauuaaauagcgggaaaacacagcuccagggaguuuacuuuuuaugguuagguuuacucaagugggguacagauucuacuuguucccuccgccccgccccucacucucucacaaggcacgcccuuggucggccccgcccaccugggcucccaacuccgcccagaacuccccaucuuuguccacguccagccccgcuccucucccggaucuaccaggccccgcccccgucggccccaccccucacucggcggcuccgccccucacuccgguuuuaccggccuucgggcuggcccuuuaccgguauccca

SEQ ID NO: 4753 - RNA, 14551 nt, Mus musculus
cuuagaggagcggugucugcaguugcaggccauggccacagggcggcagccgcgugacucgggcugggccgcucugggccgcgcuccucguucacccucggacucggcucccacugcuaguggcagcucugcccgcgccgagagccgaccugccgggcuccuaagcggcggacccaccaccucggcuccuccgagccggaccgaggccgcaagcagcaccgcgggguguggggcggacccaggauaugaaaugacaacgucaacccuccagguacuugggugcggcgcgcccgcggaggcccaaggcggcagggccugcgggccgcggagcggacgggcgguggccuccucggagcccggccuggcggucccugucaggcugccucgucccacccgcgcugcagccucucccgcgcucggagcccgaaggacgucuccacugagccccggcccaagccgaaccggcgggccggagcccaggacgcgcagccggggcugaacugccgccuugcagcggcgccgccucccccugagcgcgcccgggucccgcaggucgcuccgggagcggcguucacccgcuccugccaggcgcccuggcagcccccugagcugcuuccaacgagccccggguuucucggccagccacccuucauucauucccuacguccugcagggugaugcugggguggcgccgcccggaugaaggaagggcucguucuagagcugucagaaagcauaaacacugucaggccucaggcuuguguuuaaaucccagcccugccacucaccagugugucuagguuuuggauguuggaauguuggauuuccucaucacuaaaauaggcagugcccuuguagggugguugucagacgacuugagacaauaauucagggaaagcaauuauaacauagguucagcauaucauguacucgguaagccuuugcuaauaaaguaagcguuuggguggaaccaaguaagacuuuaugaaggaagggacuuuagccagagcaucaaagagugagugauauuugcauaucuggugguggugguggcugcuccaaguagaaauacaggaguaaauuucuguucuaggcuugaaauuagauggaauucagaacuagaacccaccauucacugcagaaacuguucuguuuguucuuaggguuaaaccaacuucggccugaucccaccugccuggccagaguuagcacuacaugugaaccaagaauauuauccaacuuuuaggaaacaguuuuaugaagagcuagcacucaugcuauaacggucacauauuuaaacuguaccauccagggcuuuuagagguuugaaucaucaccaaagaaacucuacgccuuuaaccacugcuccucagcccuacugucccauguagcauacucuguggcauuguacguuguuguguuugcgugcauauguauguauggugugcauguguugucuggguaugacagugcccgcacacgcauucccaugaccugcccguguggggagguccgaggauaacaugcacgcaucgguucucuucuggauguucaauucaggcugucagacuccgguaggaagcggauuucuuuuuuccugggauuuccuuuauucuuugacguuucauacaugucaaccaugagucugggucuuguguacuuccagcuccacccccuacuccugugcccccccucucaguaacccgcugugcccaguuagugcuucuuaaauuuugauuggucuuagugagcucaucuggugcagguaagcugcauuucacagcaccccuccagccucuggcucuuuccuccccucuuccaguuuuuuucuugugccuuggggacaugggugauaacucucagggcugagcccucccucaauagacacuaaucucaguuaggagucugcauugacugcuaaucaucuaaccaacucaccaccacugagaggagcaacuucucuggccuagauuauaucuguggagauaaguauaaauacuuagaggacagaucagcauuaugucaucuaauaaaacaacaguguagauucuucucuaggccuguggucccuaagccaugggcuucugaccagcuuuacagcgccagaucugaauucuucccuguacagcaggccucagauccaagccaaauauaguugagcgcccccauaacuuuugugccacuauuggaccaauggcagaucaguacuguaacaugcaugguuggcuucagggauacuauugaugucuuuucuccccccagagacuaacacuaugacaggcaggcagcaggucaguuuccgcuugcuuucuuuuugguuuuggugguggugguggugguguuuuggggacaggguuucucuguauaguccuggccauccuggcuagccaggcuggccucaaacucagagauccacccaccucugccuccugaguguugggauuaaagucauguguccccaucaccuggcugaaguuuuuuauugaauggagucauacacuguguaguucugucugauuuggcuuaaccugauauuacagucauuuacauuguuuaaaugacuugggaaaggggcuuucaggcuuucaugacauaauuuaaaauucagauuuugggcuggugagauggcucaguggguaagagcacccgacugcucuuccgaagguccagaguucaaaucccagcaaccacauggugacucacaaccaucccuaaugaaaucugaugcccucuucuggaguaucugaagacagcuacaguguacuuacauauaaucaauaaauaaaucuuaaaaaaaaauaagauaaaauaaaauucagauuuugaugccuauaaauaaaguuuuauuggauaauauucuagcucaugucuguaacugcauuugugcugcagagauuauaaacucacaaaaaucuaacagacuugcugauuggguuuuuacggaaauucugucaggucccugugagcacauguuugucacacuuuuucuucaucucagccuuugccaugggugucacuagagauguggcagggcugucaguuuaauuugucaccuuaccuccuguuauacaaagcuguuucucuccuuugaaacuaagaccuccuuagcaagugaaagacaguauugguugccagaaaaauguagugcaccaguaggaguucuaauaguguucagcagagaugagacaggccugcggugcuuuguggggguagaggaaccucagguauuguucugagccuacuuuuguucuuuuauuuuuaugcauguauuuugccuguuuguguauaugccccuugcugcaugccugaugcucuguguccagaaggaggugucggauacccuagagcuggagucacagacaguucugagccaccacauagguccugggaaucaaacaagggccauuacaagagcaagugcagccaggcuugcuggcauacgccuuugcaccucucuggaggcugaggccagccucauuuacauuuggaguuccaggacaaucagagccacugagugagacccugucucaaaacaaaacaaaaaagagcagcaaguaccaugagcugcagagucaucuucccagauucauauuucuuuuauuuuguugggguuguuuugccugccuauaugucugugcaccaggguuuuuuguuuuguuuuguuuuuuguuuuuugggaauggggaugcuuuuucgagacagggguucucuguguggccuuggcugucauggaacuagcuccauagaccaggcuggucucugaccugacucugccacccaagugcugggauuaagguaugugucaugucaccaccaggcuaucuauguaucuaucuaucuguuuucuguuccuacuuauuugcucagugucugggaagaguugaaggggcaucugauccccuagcugggauucaaaccagauuucucuacaagagcaacaaaugcuuguaacugcugaacuaucuuuuuuuuuuccuauuuuuuuacaucuuauaaucauuuauuuauguguguugaggucagaggacaacuuucaggagcaguagguuuuccuuaagugugggaccuccucaggaauuaggugucuccuuccucuguguguucuaggaauuuaacucgaagcuccagguuugcagucagugauuuuaccacugagccaucucagcagcccucugacccuuuccacuauacuccauuuuaaaggggcagaccuagaguucaaagaacugaggguguuaacuguagagaaaagaggccacaccaggaccagguccugucuccaugguuuauaaaaacccaggggggaggacggauggacagauggauggacaggcggacggauagacagacacaagugcgcucaccugcaggaugggucagguggccaugcugcauguguguaagcagcaggggucaaaucaugacagucgucacauucucacuuuuccugucuccucacuguagugaguuccucucauguauccugccucuucacccagacuggcagucuuaacagagcugucuauguaccuuucuuacagaugagauggcuaaacaaauggccuggcccugccaagagcuggucaggagguuguugucugcaguggcuagagcggggucugcagugggaucugccugccaggcggcuagugccacaccagauggaagagaauucuagccaggcuuugugaauuuaagaagcuguaguuuuugaagcuggcuuguauggggccuccaguucagcucagaguguggaccugcagagacuuuggagucucucaaaggcaucacucaagaguucuuagagagccagcaggcaguucccuccacgggcaccuauguuccuggagcuacugguuuauaauaugguugagccucccuucccagauaucagcuuuaggcaguucaagaaaacucuucucuucugccccuagagugaccuaggcaguagagaggacuagaggugucuuugaaucuuccuguuggauugaaacuaucaggcccaugaagggcuuuaacuggcuacuuuggggaggggggagucuagaccaaguaugguuucuggcuuugcugagcaaguccaucuuucccuuggagcauugaaauagauucagacuuguuccgugggccugccuuuggagccccagccccagacauuaaugucaguuuccauuagccaagcuccagaacaggauagaggaagggguggccucugaccacugagcucccuaagagggccgcugucuuuucaagcccuucuuggugguggcaggaaaguagggcaacguaauggccugcaaccaauaaacccacaggccuggcacuaacucccaucuuaucucacccugcugcuugugacuccaaaggcuuuuuggaucccuuggggagcuuugagauauaugccuugccuuuucagaaagccaucgaucuggugacaaaagccacagaagaggauaaagccaagaacuacgaggaggcacuccgucucuaccagcaugcuguggaguauuuccuccacgccaucaaaugugagucacucuuggggucacuuggcugcaguguccggaaggggagggcaggcacaugaggcucagggaggccacuggguuucuccuucugcagaugaagcacacagugacaaggccaaggagagcauucgagcaaagugcaugcaguaccuagacagagcggagaagcugaaggauuauuuacgaaacaaagagaaacauggcaagaagccagucaaagagaaccagagugaaggcaaggggugagugaguaugcugggguaugcagccaugggccagaguucccaggcacauguuccugugucaccggguugccaucauucuuuuuuuuuuuuuuuuauguuggaauuaugacuuugguucuauuuucacccuuuauuuggaaaacagggcaacauuuaaguuuuagauuuuuuaaaugaauuaacaugguaauaaaaaguauggccugaauuuggagaguaagugguuuuccaguuuggggugcaagaucaucuccaaaggagaagagaacacauacucagugagccaccaagggguuggcuuccacucacugagggcaagcagugcaguccaggcuaaccauccaugaucuuugucacagcaaaucagagucuccaauuguucaaaguaacuguagguacaagacagaaagcaacuccagacuggcuuauuaauugaucuggaugacuaugaagugucccccauuccugaggugccaaaaaucuucagagugacuguuggagcagggaaccuuucaugugcucccaguuguuauauagugcauagagacuggugagugucaguccugccaggccaccgcgugcuauuccucagagaccaccuguacauuuauacaacauuccugucauggguccagcugcuacuguguugaggucaucuucugcaccccguguuuucucaaugauaacaccaaaagcacuauagagcaaagccagggagccuagaguauuagcccaaagugccccuugccuagucaccauauucaaaaucuguacauuucuugguuuggaccaggccaugcucuggguuuccuucaauccuaaacgaagaccguucauugcccugaaugcggccccugucaugcaucauccuccaaugguaaagaaagcuaguucaaaucugccucggguuuuauuagcuccaguuggcaaaauaaauuaaucaguauccugaacgagauagcguggauccacauuuaaauaaggagacaggggguucauaccagucagcgggacgccggccaaaucagcguucgaguaacccgcuccuccggcuccgaagaagccagcuaacccgcugguggauuuguugcuacuuccuccgccacccuccaugaggucacagcaaacggcggugggcucgccaccaccaccucaggccggggacgugugcucagccauggccgcgacaagcaacagcgggaagacccgcguugcuccugccaccuucaccaugcucgccaucauucuugaugcgaaagcugccuugaauuucuguugcacccuucuuaugggguaucuaucuccucuggauaaaaacaccagcagcugcuuucaguaagcagaaaacagggucugacuucccagaaugaagacagauugagaaagggacaggaaacgggaagcgggaggguuugaggaugggaaagcaaaggcugggcagcagcuggcuguuggcaugagagcgucccccuuuagcaguuuuguuuguguuguuuuaagacaaaguuugauuauguaguuuuauauuuauuaacugugacuuuauuuaauuuuaaacuucaugucuuuuuugcccuuugaauucucuggaguggcaacuccaccuuguuugucuguuuuugaguucaucugaaaaaucucugacaauuauacuggcuugacuugguguuaaguucagcugaagcacauugcccucauuagcccguaggaaaaagcagcugccagccuccuuauuccuauaaugaagaaucgagauaggucacgaauguuuccucugagggauuguggcagucacauuuagguaucuuuuuguuugucccucaccagcaacacacgcacauggauaagcaugugugcuacuagagcuggcuucacucacagagccuccuugcucccagaauggagggccaacuugaucuuguuuccuuucuuaguagugacagugacagugaaggggauaauccagagaaaaagaaguuacaagaacaauugauggguaagaggccugaggccauggugguagaaggggugugccauggguucuuuuucuggucuacuugugcucauuggucagucugggguccuccuuuuugcaggugcuguugugauggagaagccgaacauacgguggaaugauguagcuggacuggagggggcuaaagaggcucucaaagaagcugugauuuugccaauuaaauucccacacuuauucacagguaagaauguaacauaaugcauaucuuugaucccaacauuuaaaaggcagaggcagauggaccucagaguuaaagaccagccuggucuacagaguaagcucuacaauagucagugcuauccagagaaacccugacuuaaaaaaaauaaaaguaagcugggugugguggcacacgccuuuaaucccagcacucgggaggcagagacaggcggauuuccagucuggucuacagagugaguuccaggacagccagggcuacacagagaaacccugucucaaaaaaccaaaaaauaauaauaauaauaauaaaauaaauuuaaaauaaauuuuaaaaaguaaauagaauguagucacuagcuuagguauaaaacuaccaucaugaggaaucuagcuugggguucugcccucagaacagaugguagguagccuuaugcccucaggacauagcucacagaggguagauucuggucuugcugccuguugugucugcccugcucaccacagccaucuacuaugugacuuguugguuuguuuguuuccuuuugcugggauggaaauugggaccuaggcaagcacuauagcccugaaccugacccugauguuuuugugagcugggaauacuugaauggcaguucuucuaccauguguaaaguccuggguuugguucucagcaucacaaaaauuggaugugguguaucucacugucacuccuguggucucagcacuugggaggcaggaugauugcaggacuagggccauucuuggcuaaauugugagccuguaggccaguggcucagcuguuaagagcacugacugcucuucuagagguccugaguucaaaucccagcaaccacaugguggcucacaaccaucuguaauuagcuguaggccagccugagaugcuuaagacuugaacuuggaguagaccaucucaaugaggaaguagagucaggaaccagagcuggccaauucccuugucaaggacauggggccauuaguaaggugagguaacuuuguuuugagauuuguuuuuaacuauauugguguuuugccugcaugauaugucuguguaccauauuugugcaguuguuugaaggccagaagagggcuggauccccugaaacuagaauuacagucaugaccugccuugugggugcugggaucaaacccaggucuacuggaagcguauucaguacuauuaaccaagccauuucuccaaccccacaacuugauuguguaugugugguauauucaugcauaauuauauauguguucccauguguggggaugcauguauguguacauguaucuggaggucagaggagggugucaggugucuuuugcaguugcuguuuaccauaugacagaugaggguuacggggggcggcagggccaauacuuaaccccagaacucgauggaugauucagcucguccagccagcauacucuagggauccccuagcucugcuuuccaaacccugggcuuacaggccagccaucacucuugcaugguauucucccaggugccggggagcuguacuuuagugcucaagcuuguaggacaagcauucugccuccugagcaggcuccucccugccuucaacuuuccuuuguuccucuuuugccaucaggaaacagcugaguccuguucauucuuuauuacaggcaaacgcacuccuuggcgaggcauacuccucuuugggcccccaggcacaggcaaguccuaccuggccaaagccguggcaacagaagccaacaacucuaccuucuucucuguguccuccucggaucugaugucuaagugguugggggaaagcgagaaguaaguuggccauccgcuaugcuacagcagccuuggcagcugcggguucagcuuccuggccccuuggaaaucacuucccagaggagcugcugugggauaaucugggauaguagucagaacaagcucucacuucuuuuuuuuuuuuuuuuucgaaacaggguuucucuguguagcccugacuguccuggaacucacuuuguagaucaggcuagcccggaacucagaaauccgccugccuuugccucccgagugcugggauuaaaggugugcgccaccacgcccggcucaagcucuuacuucuugagacacuguccugauacgcagauguaugcaaacuuggaaaagacgaggcaccccuguaauccuagcacucaggauacagaggcagaaggauuacaaguucaaggucagccugcucuguguaauuagaccuuguuucaaagcaaauuaaaaaaggagcuagagagauggcucagggguucaaaggaccuggauuuaacucucagcacccacaacagccaguucacaauuguaauuccaauuccaggggaucugacaccccaacacagauauacauacaggcagaacaccaauguaaguaaaauaaaaacagggaaauaaaccaauuguaaauacguaucaucugcuuguuuucucuuugguuuuaugagacagaaucucauaaaacugguuacaaucucaucaguagcagaggcugaccuuggacuucugauugucuuagcacuaccuccucaguguugggguaauacacgugucacaucuguagucagguauauauccucuuugggggcauuucaugggguuuagcuuauuucucaagaugaccuccauucuuugauacgaaucugaggcucagagaaagggaaaggauucuccccaagcccagagcuaaugaauggggcuccccucccaaaaucugaggcugauaccacagcaaguucuugauucauuaguguuugaggacuugucugcccuguuuuuccugcugcuauuuuguuuguuuguuuguuuuguguguguguuuuguuuuguuuuuuuccuuccugugggagaggcaccaggucuaacuaacaacugugucucagggugggcauguuuggguggagugucccagucuugaccccuuucucacucucacaggcuagucaagaaccuguuugagcuggcccggcagcauaagccuuccaucaucuucauugaugagguagauucccucugugggucacggaaugaaaaugagagugaagccgcucguaggaucaaaacagaguucuugguccagaugcaaggugugugcuugugccuugucacucuuuggcugucuucuaccuaaaggcaacccaggacuccauuauggagcugcacugggcacaauggaggagagucacuucugaugccucaggcuggcagcaaacagagggcucugaggccucuguugugucacuuucccaucccucagaacaaguggugcuauagggaagccccaaaccaugguuuaguuuuccauggggccuggcugcuccugcaggcaucuucagucacuugucucccauucuucacaggaguggggaauaauaaugauggaacucuuguucuuggugccacaaacauccccuggguguuggauucagccaucaggaggaggugagucuucccuaggagucuguuaucuuugucuagcuauggucaguuugugacuagccaucugcccccauuucucuauacuccucccaagucugcauguggagcagagccggguguaaagcugggcccuggaucacucauuucaacaugcaggcugcccuugcccuuccuaccauccugcgaucagcuuucauuucaugucaugcaucuuuccagguuugaaaagcgaauuuauaucccauugccagaggaagcggcccgugcccaaauguuucgguuacaucugggaagcacaccucacaaccucacagaugcuaacauucacgagcuggcccgcaagacagaaggcuacucaggagcagauaucagcaucauugugcgggacucccucaugcagccagucagaaaaguacagucagcaacacacuucaagaagguaaguggcggcaguggcuuaggcaguguugcuagugagguguugguagccucuucaacaacuuucuggcugcucaagggaccuucucugugggggaaccaaggguagguauuaagugcccuuugcucuagaacuggggcagugccaugcauccugcugcaguuccugcuggaguaaaaugcucuucaacuauaggaaacagaagauaggcaggcagcaucaugcgggagggcagggugccugacacugucaguggaagggggacuugcccacucauucaggcacaucuuugcugagugucugcuguagguugugauaugugccagcccuguccuggguguaugaaaggcaguaauggagacaaccagugagagaaaugcuaguuccccuuaaacagugaguaccugucagagcaaaguggagucaucaggaguuucagaaguuuggagaggugagcaguuuucucuauuagaagacaaaccacacuggagugaccugagccaauuccugaggauuugguuugcuuaggguuuccccauugcaggagacuucagugagaggaacuuuuuugcugcaaguacauuuaugggaugagucuuuguagcauuauaggggaagauggaacauuuggggcuacaggaaaaucuggaggccagcagcuggaagaucauacuguccaugcaccucugaaaccaaaucaacccuccuggaccuuucagccuuuguuuauugguuguuuuguuguugcguguguacacgugcacacauagaggucauaaguucucugcuacuauguggaucugggagaugcaacucaagucaucaggcuugguuacaguugccuuuaccugcuaagccaucucacuagcccauguacauuuguuuuuuaaggugguucaauuaguccaggacaaucucaaacucauccuauaguugaagaugaccuugaacucauauauccuguacuuccuaagugcugagauuacagguguuugccaccagguuucuuguuugacuuguuuuaaaugcugugggggcagggaaggcaguauacgaagaugccaccguguguuuuggaggucaaaggacaacuuugugguguuggcucucuuuuacagauggaacucaggucaccagguuugcaugccaggugccuuuaagcacugccugagucaucuuucagacccucagacuauuuuaaaaggcgccuuuucuuccuccaacuuugaugacuagaaccucaguacucccuucagccagccuuagguccugauguacacacugcuaacaacagccagccucacagucucugcuugguuucagguguguggcccuucucgaaccaacccuagcguuaugauugaugaucuucugaccccauguucuccgggagauccaggggccauagagaugacuuggauggaugucccuggugauaaacucuuagagccugugguuugcauggugagugacccauugggagaaaaccauaaaguccaaaauaaaaaguaccuuccuacuguccuggcucacaggccuuccagagccuuuagcguggaaggaccuuuugagguccuugcugagguccuaagggucuuuaagaagaaaagccaagacacuaucauuccaaggccuggcuuuuugguccagaaggaaaccagugaaaaucuuuuucacauggcucuuaccugaacaguauagaccucuccuaauuuugucagcugucugcacuguggggugaauucaguaauggaacuacugcugggaugggaugagagcugcggggugaagggugaaguaaucuuucagaaggcaggcaggccucuugucagucuagacagcaugacaaaaggagaguacugaggaccuggggucagccuuuuucagcuacaugcuugucucugcagucugacaugcuccggucuuuggccacuacccggcccacagugaaugcagacgaccuccugaaaguaaagaaauucucugaggacuuuggacaggagaguuaaagcuucaugugauaaugaaauugagagucugacuggagaaaauucaugggacuucguacaccaguggccaggcagggccugaagucgugaagucaauaguauuuccucuacugccuggcugucaaccuaguaggaugaagaaggggccuccccagcugcagagaugcuucaccauguaggacacuugagacuggcucugcauacuucacuacuggaugcucacacuccuugcccugaucuguuuuugucuaacuuuuguuccccuaaauuaaugccgcuuugauuucugucuuguuuauaaauaaagagaaaagucaucuggaaauguuaaggagugggagcugccaggccccugcuuucacuccuugccucuuaacuuuggcuacuugugagcugacugugguaaaguaggaaaagccaucccacucuccuaagcuugcaucuggagcuucagguccuccuugcaggagcugacagcuucugugaacacgaugccguuuccaucaggagagacggcaaacaggcaggucuuuaucgcugccuucaccugagaacugagcccagccucugcugguccuguccuggagaugucuaauaaacccuuuucccuuauugagcuacuggagucguc

SEQ ID NO: 4754 - RNA, 4185 nt, Mus musculus
cuuuuuguuaaacauuugccuuuauugguggacacaagagaaaggggacauaaguugaccccccccccaauaacuuuccaaagcccauuugaucaaagcuuugacaaauaggcuauauguuagcaucuuggcuucuuugugucaguaguugaagcaguaaaaagucuuuucaagaaauagagcuggagggccccggaaagaacaauagcaaggcucugagcuguggaccaccaguucacauagguguaguuagacugcaggaggaagaagucagccacuuuucucauccuggcauaguuguagaagcgccacauguggaaaacuugguucuccacccuuugugugcuguccugugggaagaaggaaagccacucuggcugcuguugggucuuaccugcccugaucuaagugaccugugacucaggagucugagaaacagugcuacagcaguugguaauacaugguacuuugacuuuguuugagaaaaauugguggaguaguuuuaaaguuaggaggcauaguuagggcuugggauguacccagugguaaggaggauugccuaguacccacaaaacuccccacauccuaaacucagcagccuugaacauucaagguaagcacuugggcuacuucucacauagcccaagcuggccucaaacucaguguguagcuaagggugacuuugaauccugaucuacucuguugagguuacuuguauaagccacuaucaauugagaugcguguuccacaugccgucaccuuccuaaccaauaccuugucccugcagacuguuagguuuaugagaccaccaggacagcuaucaccaauacuuuaggauggauagaaaucagaaucuugcugggcgugguggcgcacgccuuuaaucccagcacucgggaggcaggggcaggcagauuucugaguucgaggccagccuggucuacagagugaguuccaggacagccagggcuacacagagaaacccugucucgaaagaaagaaagaaagaaagaaagagagagagagagagagagagagagagagagagagagagagagagaaagaaagaaagaaagaaagaaagaaagaaagaaagaaagaaagaaagaaagagaaagaaagaaaucagaaucuucauaguugucggguaguucauacaaaacuaagcaguuuaaaucaugcccagaaaguccacuuguagcuacaugaaaagaaaacacaaaagcuuguuugcacacauuaucaccagcacugugagagccaaaagguagaaacucacauguagucagcuggugaguggauagucaggaacaaagcuguacuuacacagcaggauguucagagcuaagaaaggggccaaggacuagccaagcauacuauauguaaauuaggugugacagcuugggucuauaaucuuagcacucaaggugaggcagguggauugcugcaaauugaaggccagucugagcuacagagugugagacccuguuauuuauaauaauaauaauaauaauaauaauaauaauaauaauuccaggcggugguggugcauacuuuuaauuccagcauucagggagcuaaguuugaggccaaccuggucuacagagcuccaggacagccauagcuacacagagaaacugucucaaaaaaaaaaaaaaaaaaaaaagaaucagacugggcaugguggugaaugccuuuaaucuuagcacucaagaggaaaguggaucucugugaguucaaggccagccuggucuacaaaaugaauucaauucaggucagccaagacuacauaguaagaccuuaucucaaacaaacgaaagccgugcuuugugaaagaagggaccauaaaaauccacuugccugcuucuguuuacagaaaaccuacaggaacagugcaacagcgcuucuaggguuaggagauucuagaggggauggggcagugaggaccguguagaguuucucgcagggacgggagauuguucugcuguaaguacuaggguagcugcacaaguuugugaaugaguauuacaaacaggcaguggacuagacaggucuguuagccacuguuugcccaagccuugguaccagaggagcgccgugccgcauaaugagcugaaggguucagcucuuuuugcccauuugguuuuuauuaugaguccucccuuguucaggccacacccccaagaaugcccaucccauuaccuuaaucgcauccagagugucguucaguugcuuccuuugacucugcuugugauccaccucgggccccucauagaagacuccgaaguugagauacacuuguauagaacugaagcgauucugcucauuuuuuagacaaagcugauagaagccugugggaauuccuagaucucauuaccaggucuuuagugccccauccugucuuacauucucuguuuaagaguccugucuguccuggaagcacucuguagaccaggcuggccuugaacugaccaagauaugccugccacucccucccgagugcugggauuaaagguaugugccaccacugcccagcccuuauuucucaauuucauagaaauguuugacuauuauuguagcuuuggagaugaauacauaccuguuucuuguguagcaaaguuaaucuggccccuuacauccugggaagugucaauaaggaaacccugcgggguaugugccguggcaacaauguggcggucaugugacaucccgagaaugcgcugaaccugccaucaccgguaaaagagagagagagagagagagagagagagagagagagauccuuacuacaucacucaaaaaccagcaaggugccaggcagugguagcgcacgccuuuaaucccauaauuccagcccuugggaggcagaggcaggaggauuucugaguuugagaccagccuggucuacagaaagaacaaacaaacaaacaaacaaaacaaaccagcaaggacugaugcuguaucuuguuugaggccagugccugggcuacaugagauccugucuccccaagagcccccacaaccuaaaaacaaaaaaccaacaaaaaaaccaaaguuaccucuaacuuuaauauuaagguccuugguggccuaagccccuuuggguguacuugcccaagggauaggcaccuuccaaagaggaacagaauugucugggugcauagacaaagcuuugagccgguuauucuacagguuguuaggauuagcacaugcaggaggucugaccuuaucucaccccaugaacucaagugauuucacuuaaaaucuauuaugggacccuuuucugucucucucuuguuucuucuuucuuuuucuuuuuuucuguuuuuuuuuucuuuuuuuuuuuuuuuucuuucaagacaggguuuuucuguauagcccuggcuguccuggaacucacuuuguagaccagacuggccucgaacucagaaaucugccugccucugccucccaagggcugggacuaaaggugugugccaccacugccaggcucguuucuucuuuauugacaaguuucucuguguagcccugacuguccuggaacucacucuguagaccaagcugaccuugaauuuagagaucccccugccucugcuuccugaguucugggauuaaaggugugugccccacaauuaugugacuauuuuagcacguguugucuuuccucauauccgaggaaagcuaaagguugccucucuuguccauuggauuggaacacacuucuguagcuuccaguucuagaccaagccauaugcuuuagcucccguugcuggcuguucauccaagucucacccagaguugcucucuaacugaagguccacuugauucacaaguggcagccacagccucauagagaaccagaccuuggcuucaucaaaagccuggcucacuuuauaaaagguauggccagaggccuccacgcaccucguagcugaaguagagguaucccaucuggucagcaaauugccagaaacauucgauggcuccuggagagaccacgauggcaaagucauuccgaucagcuccacggaagaguggcugguccuuggagccguguaggggaucugucuccuggcucuuaacagaagucacgaggcucagaacuaccagcucagccacgaggagcaaagggaacaugcugccuucuguggguucuucugcaggugagcugcucacaaucccgug

SEQ ID NO: 4755 - RNA, 36896 nt, Mus musculus
gucaggacaagaaaaggaaaacaguaucuuuauuguguaguucuaacaaacauucacugugugcacauuccaguagaaagagacaaagaucuuuguucaaaauaagcugaaaccaaauagguaaacaaaccccaucguugaauucacaaaaggaauguaguauuagccacucaguugagggugcaggaaaagacaagccaaauaaccgaaaggagcgucugcccaagcagcugauuagacgaggcaggcgugggcaaggaguggccccugccauucaugaguaggacacuggguguaaggcaggugacuggcacaccccugcuucuucagccucccuccuagaccacucccacaaaucccaaagcuggccaaaugugacggagcuccccguuacuuuugggauauuuggcaacugaaucucacagcuucaacccuucgguuucucguugagacaagacaugucugaguccacuucccuugggguaggaggcaaugaacauuuacgauccuugcuucagucaucucaggucgacuucagccggacgggcaucacuggagacagaagcaugagugcugcaugugaugacacaccuugcuuguaaaucacuuuccacugcuugccaucagcacuuaaugagcacaaacccuacaccgugagccccgauggcaacugcuggaagagccagccagcucaagugacagcucuggacagacuugucucugcuuaaguaaguccauacacugugugcuauugcuuucuguacaucacucagugaugaaaaccagcucccagggcuggguagaaacuuuuagagaauggguguuaacacauuuuaucuggguagcacaaaucucucauguucaccugccauuaccuguauauguggcagcagcuggucaccucaagaauaaacaaucaaaccugcccacgcccacaggucaggaggugcugucaguggauaggaacugccuccucuuggucuuaauguuuuuucaugacccucaaauguccaggcuucuuugacaaguuuagacuuuuaaaaguacaccugugcacauguuguguugcuuugccguuuacggaaagccuugacaaacgaucaccuaaaaccuaccuuuccccuagcuguuuauguaggcaacaggauuacaacaaguagaccugaacagaaucucauuauguagcuuuggcuggcuuggagcuugcucuguagaccaggcugaccuacaacccaagagaacugucugcuucugccucccaagugcugggauuaaagauuuaaaaaaaaaaaagcauccuuuuuauauaauauaaaaugacauuacauuaucaguaguucaaaagaagcccuggguauugacggauuucauggaucgcaaagacaaaaguaugaaaaucuuuuccuucuggcucucgggagaaaaagcucagcuauaagaagcugggaaagacacaaaugugaaauagaaaaaacggcuuuugguauugauguuuacuguagaaauaucaaaacaccgauucuacuuaagaauacaguucuuuuauuugguggagugguugugacauggucucucuauguagccugacuguccuggaacuuacuauguggaccagacuggccucaacucagagauucugcagccucugucucuccuacaucgggauuaauggugugcaccaccaugcccagccgaaaaugcaguucuuuaacauuuccuacaagccagauguuuuucacuaggugucccaucaaguuuggaguuagcugggacgcuccuguccugcacucaauguuccuuuguucuucccuucuacccagcauacuccaugugacuucgcuaucccagcaugcaggucccgggcucccugcacacaaccuucccugccuuuaccuggagaugcgcgccgcaugccgcuuuuguuacagacuaauuacgcugucaaucuaugacacaauauuacagacguuucuaaagacgaaugguugauuaagucuucaucucugacauaaaagucaccuagaaaucacucuaaaauaucauauucaaguguguaaggaaaagguuaauguuauuuugaugaauucugaauucauucaacugcuaaaucacaggauacgaguccuggacugaacuuuuuaaaaaauaguuuacacgggcagacugguuuacugugcaguuuccuguccugucaagccccuggcaagcuggaagggaggcaggaggacacuucccaacaucucugguccugcuggaaucccaugguuuccugcuggaugugacaccagcccagaagcugacugguaaugaacaaagaugugaagaaagaucauagaaacuaagaaacagcuggguacugucaggcacugccacagggagagagaauacagucagaggugccaggaaaaugccuggaccaacgagagaaggaauuuuaaaugacugccuacuuuccagugaaauucauauccaagaggaaagaaagcuuccagauuuaucauuacccucaauagaaaguaggacaaaaccaaaaguuggcgccauggagguaaaacccagaugaaaaccgaagucucuuggcauggucucccaaucugaaggggcaugccggacaaugacauuuacaucuaaguuauuuuacugagauaaacauaaguucaaacuugagucuuguacuuuaagacaaggaaucagaaauuugcuaaucgguaaagaaaaacagcagaaaggccuuugugaagccccacggaccggagagaaguguauagaagguaagcacacacacacaucuuucacugguaaagacagccaggguggaagaugguuagaaaccagugucagaccagagagcgcauguuggucccuuuuuaaacugcucuccuguaaguaguguuugguucucuuuguaaaagagauuacucugaagucaguccuucuucagcucuuagauuccuaagaaaucaaagggaugcacacuuugugaaguauuuugggaaaagaggcgggacuuagagacaggaggagccaucagcuacacugucuggagggggcagggguagauagccacuguugcuguacuucauuuuuaaaaauaacaucuggggugugugugugugcgugugugugcaaagaccauagcacacauguggaagucagaggacaacuuuugggaaucgguucuuucuauccugugagugcagugacucagacacaggucaucaggcuucgcggcaauugcuuuuauccacugagccaucuugcuggccccuuacuucuaacaaucauaaauaagaucaucuggcagcuguguuugaaauaagauacacacaacuucaugaauuaaaucccuuaugaugaaugacaaaauuaaaucagaauuaaaaaaauaaauuuacuuaaaaagaaaaaugggaaaagauucauaaccugacugcuguucccuuaacuauaucuacuaugaauucaaauuaugagaaaucauguacuguccccaaaggccaugucacuacaacauaggaacucuaagucauuggcaucaacuuuugaaaugaaaggaaggagugggaaccaaugagagaaacccuggcaaggacacagagugagcaggugcuuugggcgucaggcucuggcggaugaaagacucuggucguacacugaaggaggauagauaucuggucaaccaucuuggcuccaaggggaaagaaaacaacuggcagguuccaaggagggaacacccugcagccuccacacaagucuccuccucucaucgcaggagcacgugcuccgcacuucaacgaggucuccucaggaggauuugcugucagcccagaagugacgauacaagaaaccuauaagaauagcgcccacgauggggacaaaccaauacgcccaggaacuggaaaagaaggaagaaaaagcaguauguuaagaauauucuaagcaaauaauugaauguuuuucagcgcuuauguuuaauauacaugagacaggggucuugauuuaucuugauuuuucucuuaauuuaauugcuuuuaccauagaguauuugaaaggaaaaacaaagccaagucuacauuuauuuguguaugugcaaacaagugcccaggcaugauguauuuguggaggucagaggacaacguguaggaguugguucucucuuucuagcacaugagaacuuaaaccagcagacuuggcaggggucuucuuguuaagcuaaccugcagggcccuaaagagccccuuuaaaaaaagaugcuaaaaauaaaaagaaucugauaugcaagacaugguugugugcuuuuaaucccaguacucuggggggcaaaagcacguaaaucuauugagaguucaaggccacacaguugacacuucucaaaaaaaaaaaaaaauucaaaaaaaaaaaaggauguagcuuagugguagaggacuuucuaucuaucuaucuuaucuuaucaugcauaaagcucugacuuugaacccuagcaccacaacacaucaaaaacagaaugugggacuggagagguggcucagcgguuaagagcagggacugcucuucuagagguccugaguucaauucccagccaccacaugguggcucccaaccaucugaaaugggaucugaugcccucuucugguaugucugaagacagcuacaauauacucauauaaauaauaaauaaauaaaacuuaaaaaagaaaaaaaaauccacuggccaaaaacagaaugcacaauaagcugucaaaacauauauacaagcuggacacggugguacaugccuacacgguacagccucuggaggcugaggcagaauugcagccaccuaaagacuauccugggcuacucuguaagugccagcccagccccagcuauguaugcaucaagaugcugucaagcaagcaaacaagaacagcaaaaaaggaaacagauacauacguacacacagcccacaaucacggaauuuggauacggaggcaggaggauccagaguuuaaggacuaggaaauaguuauuuaaaguacuuguucaggaaauuaauugugaucccaggacucaaguaaaaauucagggugcaguggcuaugcuugaaacgucagugccggggaauaaagaugggaagaucccaugcauuugccagccuggcugagcuaguauaccacaggacagcgaaaggccaugucucaaaggagacaguguuccugagaaugcaggcaaagacacaugcacuuaaaaaaaaguuuauagucacucugguguuucaaaagauaaauaagacauacauacauacauaccauucuagguguuuuuauauagacauuguuauuucuggguuaugggguuauagcuauuaaauuuugccuuucugauuuucuaaaauaaauuauuauacuacaauaucaauuuuuauguguauggugcuagcagcaggaucccuugaggaaaauaauaauuccauauagauuuuuguauuaucuauccuauuacaaguuuagaagcaauacuauccauccauaaccaauauuucucuuuccuaccaaggaaaccacauagcccuugcauccgaguaagaagcuggugauggagucagguggccagacucucaaugugcaguuuuguuuuguuuaggguuuauuauuuauuuaaagucuaugagaguuuugccuguauguauguguaccauguggguuugugguacccucagagaucaaaagaaggcaucacauaccccuggaacugaaguuauggauggcuggcugugagcuaccgugugggugcugggaauugaacucaggaccucuggaagagcagucagugcucuuaaccacugagccaccucuccagccccuuaaaccacuucuuuacagaguuuacuagcucugccuggcuuggacuaugaggcuuuuuaugacucaaauguccugguugccccucaacuuaagacauauucaguuuuaguaugaaaaaguuccaagccaauaaaacaagcugagauuguuaacaaaaauccucucuuugccuaaccauauuuaccauaauguacaaggaaggacgguggcaagcuacucucaacaagugagauggcaagcaggcagcucugcuuaaaacgcaaauacgcaugcacagcagaaacuauggcacacggaaacuucuacguaauugaggcuuccugaagaggaaccaugaaagaguuggguccaaagauaggacccucaaggaaacacugaagaaaaauucuuccaaccaagagagaaugguugccaccaacuuuccuuuugcaguguuugucacugugaagaccaacaggaacugcacuuccagugcacucaaggagacggagcaccagugacuaacucugugucagacaacauucucuucucggagacauauccagguuauugcagauaacugugauuuguuaaauuuuuuuugcuuaguaauauuuuaucauaugacuuuacuagaacucauuauugaauauaugaauuucccuaauguuugaaugucuugaaaaauguugcuauaagcauucuuuuugucguugauuugagaggaccugguaacuucagcguguaucagcugaacugauacacauccaccugccugucucccacguucugagauuaaaggugugugucacugcacuugaggaaaacuuaaaacuuuauaauuuauuuaguuuauguguauggguguuuugccugaaugcaugugugugcaccacaugagcuccuggugcccucaaaggucagaagguguuggauccccuagaacugcaauuacagcugguugggagcugucaaguagaugccagaacuaagccuggguccucuacaagaacagcccacgucccuuaccacugagccuucucuccagccccagcuauaaacauucauguaucuauuuccuugugcuuuucuuuugagcaauagucuuacuauguugccaaggguggucucaaaacuccugggucaaacaauccuuuacagcaacuggaaccacaaggcgggcacacuaugcccaguuugugauauguuucuauuacaagucccauagaaguggaauugguaggucaaaaguuauucauagugucaguuuuacuagacacugccaaaguguucucaaaggaaaugugccuauuaacagcccugagguaggauuuagagucuugguaacucacuucuuaguaagcaagucucagguguagaaauaguaguuuuguccacccgggugugaaauagacccaugauuuuaaugauaaagacauuaaaucuuuuccauaugcuuguauuuguguaaagcauuuaaaugcaaaucuuugugcauauccuauugagauauuuuaauucuuuauguacuuuggauacuaguucuuugaaaaacaacacugauucuuugaaaauuucauacacucauauaauuuauuuggugauacccuuccaccacugcccuccucugucuccgucgagggcuucaacccugucucccucucagcuuuacauccucuguuuaaaaauaauuaauacccucccuccccaaaaccaauuagugcugcccguaacugcauaaaauucuuugcuuugguuuuccuucuuaaaacuuuaguuauauggcacacaccuuuaaucccagcacucuggagguagaggcaggaggagcucugaguuugaggucagccuggucuacagaacuccagggcagccagggcuacacagagaaacuuugucucaaaacaaaacauuuauguauauguauauuuugccugcaugucuguuggucuaccaugcauaccuagugcccacagagacuagaagagggcauaagacacucccuccgccacccacccacguaccccaugcugaaguuacuagguccucuagaaaaacagccugugcucuucuucgucgcugagccaucucuccagccccgagacaaguguuuuuagaaagaaccucuugccaaauauuauguagaguaugaggaagaccauuaaauauuauauagaguaugaggaagaccauuaagagauaacugaccuuuggcaugaauuguucuuggaaggauccugaagaagucacauguucaaaaaugauaaaaagaaagcauuaguacaguaaacacacgccuucuuggcucucuagagaaacuguagcuaguaacaaaauuuccuucaugcgcuuugacgccucccuacuaccucuagacaauggguagaggcuuggaaucuuuuacuucuuuuaacacuuugguauuucuuaguggagagucauuacugagaacauagaaaugauguacauguaaaaauaucaauaauaaaacucuauugaaauggacuaauauuuugagucacaaugacaggccuauuaaccagguuuaccaccagcauggcuaugaucacauuuucugaaaacauuuuuuaaaagauguauuuauuuuauguaugaguacacuguugcugucuucagacauaccagaagagggcaucagaucccauuacagaugguugagagccaccaugugguugcugggaauugaacucaggaccucggagccaucuccccagcccuucugaaaacauuuuaaaaggcucucaaaagucuucucuugcaaaacuaucagcugucaaaugcuccuagacaugcagauaguggcuuccuggcuuacagaaaugacccagcuuacucuuugacacugaaacuagggacuuuggggauuauuuaacacuucuuuuuucuuuuuaaguuuuacuuaauguuguauguauaagugcuugccugaaugucugcauguacagcaggagacgguguuggacacccaggaaauggauguaaauacuuguaaaccucuuuaucuaugggugcugggaaucaagccuggguccucugcagagcaggcaaugagccaccucuccgaccugggguuauuaacaaugagaggggaagaggagguaaaggaaaaagauuaccaaacgguccaggguagccuuaaccucaagauccuacugcuuuaaccuucucagugcugagaguccauguauauuaucaccauaacugccuccaaaaugaucuuuaaaaucagauuugagggauggggagcugacuuagcagguaagagcacuggcugcucuuccagaggaucuggguucaauuccuagcacccagauaguagcuccaacucuguaagugcagucccacaggaaccugacgcccucuucuggucuccacaagcaccaucguggacaugaugcacagauaagaaagcaaacaaaacacugaaacacauaaacacaaguaaaacauugggaauaagaagcaacgaauuacucaucucugugacaagauggaugaaccuucaaaacauuaccuaggcuaucgagaagggacagacacaaaagaccaccuguucuauaagucccucccugaggacagaggaguggcacagaaagcugggcaacaagaauauggcuacuaagaggccuguggcuucuucguggagugaucaaguuguccuaaaauugauuaugcuuauuaucuuacagugccaucaauugaaaacacugcuaagcagaugaauacauacuucaagccugaaaacacacagcugguacaguucaaaucuuuucuacuguuuuaacaacugaaaguucuaaacgugugcuaacuacagugagccuuguacugcaucaucagaagagaaagcagagagcuaagccugcaauaugugggugguaaucaauucuaacaaauaagaaaucauggaaaaucaugguugguugguuguuuuuuaacuaaguaccuuaaaguaccccuguuuuacaagcaauucauuucggggccggggcaagaagaacuuucauagcacacuggaggaaggagaagagaggugugcacugcccucgggacacugacaguacgaacaugcuuagcugcagaccccuuuugagucagacauaauaagcgauacauaauaagggcacagccccugacagucaaguccuucagucaguuuagaaagaagccaccuaaguuaaguuuaauuuuguuuuucaauucuuucuuaauuuuauaaaacuaaaaagaaaaguaauaauuuucugccaguuuacacacuucccaccguccucauuuccaugucagaacgcugacgaaucuacuggguaccuaagugacaaucugacaagcuacggaugggcacgucuggcugagccauaccagauguuacugcucuucacuaaggcuuuaguagugagaggucagaucagauccuacacucuuccugcagagacccuaccacacaaccagugugcaugcgucuguauuucccaaggaguacacuugcaaacacaauuucucaguuagcuaugauuuuaguccaauauugucaauaauuaaaaucaacugcuuagcugagcauggcgacccagguccucugaaagaacagccaaugcucuuaaccacuauggcguuucuccaaucccgucaacuuuuucuaaagcugcccauaagugaaaguauguguaucuuccagcucaaggcuaagucagcuuccuugucuguagaaugaagauucagaugaacugaauucuaacaucacuauuccagcacagcuuucugagucaaggcaucuuagcaagaccuuuaagaugagcauuccaaagggcaggagaggaaucucucacucgugggggagacuguaggagcucacuaccccaugucaucucuuucucuuucacuagcuccacaagagacuauuuucccagacauuuccucuagaagcacuguacacugaauacugacuuaaucuaaaaauaauaagaaagaaacguuagucuggcagucauaggcagggcugcuggggucagugagggaggacugcacgaugaacuucuguuuauaagaaaaugugaaagagagcacacacuuaagggaggugcacuucaucaccagagcacaaagguaggaaagagaaagucagauuuaugauuauaagguaugacaguagacacagggucuuuggcuaauuagagauuauaauuaggcuuucaaaagcauaaauaacugauaaacaaaauauagaaggagcuugcauucaauuccuaagcugggcauuugcuauuccaagaggauucuaaauauuuaaaauuuaagccuuaagacauucaacagggcuggugagaugguucaguugguaagagcacccgacugcucucccaaagguccugaguucaaaucccagcaaccacaugguggcucacaaccauccguaaugaaaucugacucccucuucuggaguguuugacaacagcuacaguauacuuacauauaauaaaaauaaauacaucuuuaaaaaaaaaaagacaucuucaacaaauccaacaguaugguuuccucagcguuuuacucgaugguguucuguggccacuaucuuaagaaaaacaaguugguaacuucugauuuaaaauacuuauggagccaggcaugguggcacacgccuuuaaucccagcauuugggaagcagaggcaggcagauuucugaguuugaggccagccuggucuacagagugaauuccaggacaaccagggcuauacagagaaacccugucucgaaaaacaaaaaauaaauaaauaaaauaaaauacuuauggaaaggauuuucuuucccccaucauaucauggcccuuauaucacaagguaccacuguaugaauuuuauuaggugcauauuacuuaaaaaguuagaagacagaagacuuaagauguaaacauuuuauaaauccaguuacauaauaucauguaguauauaauccuuggaacaggcuucucaugaaauuccagcauacuaaaauauaucaguuacugcaauuuuuuucaauaaaaacuucauguuuuacuguugauuuugaguacgcuaugucuauaugaguguguauguauauguaugcauauguauguaugaguauguauguauguauauguauguaugaguauguauguauauguauuaugaguauguauguaugaguauguauguauauguauguaugaguauguauguauauguauguaugugugaguacagagcccugggaagcugaaagagggugugggucccugggagccacauaugggugcuggaaaucaaacuucaguccucugaaagaacagcacacacucuuaacugcugaaccaucuuucugguuccaaauaauuuuuccagaugaaaauacaguucaauaauuacugccucauaaaguauaugacccuauaguuaguguaguuguauauaaaaauguuuuccugaugagagaaaaaaauacaaaacaagaaaaacucccuaaugugauuuucuaaauucucuuaagaacaacuaucagauucauauugagaaacuguaucaaaauaagaacaaaaagaacccccugugauaauacauauaauacaucacuggggaaaaagccuggggguguaguucaguugguaggauggcugccuagcacauaugaaggccuggguuugaucaccacauuaaccagguauggcugcccacacaagugaccccagagcuucggagguggugaaaggagaaccaaaaggucagcauucaugaaguggugagcuugaggccagccuggcugcaugagauugugucucgaggaaaagcccucccucccgaggugagcaucccuauuuggaccgaaacaugugagcgagcaauuccagcugggaagugugggagagcacugcccggcuucucacgcucacuuuguuucuagaacuuggugagacauuaaugccugacacugcucagagaacagcauuuuguuuuucaagagagacuggccaggacauuuuaugcuuaauucccaaagaccauagcugucuggaaaaucacauuaccagagagaagucuugaucagcggcaguuacuauugaccauugcaaacuccaggaaguuagguaguuaagacagguacagcaaagaacuguuuuuuauuuuucugaagcagguucucauguagaccaugguauagcuaagguggucuucaaguacugacucucuuaccccaccuaccaagucucuuuuuauuauuuuuuuauuuuugaagacaacagucugaccauauggcaucagcauaucccaaagaguagaauuauuuuuaauucuaauuaguuauuaccgacuaaagcaggugucauggcacaccuucuaccucagcacuugggaggcagaggcuggcugaucuuaguucuaagccagccaaagcuacagagaaaaauaaacuugucagaucgacaaauuaaaaaucuucaaaaauuuuauauuguacuaugugcugccaucaacugggauauuaucagucuacugugaaacaauggugaccauuaccacuuauuagcuggaacaugaaaagcuguuucuaaaagaagagggaaaugaagacugggcacgguggccuaugccuauaacccagagcuccagaagggaaggcaggagggcugaaguucgaggucauccucagcagacacagcagacccaggucuggaacacugacuuucucugggaagaaggcagaggcugccugagggggagaaguggugcagagaagggaagggaaggagaagaugagaacucuaucccacaaaaaugaaggcugugcuucagaaaucauauuuuuacagauucagaaacccugaaccacagaaaggaaacuaauuaauaaaugagcuucccucccauucgggaaggaaagccaucucugcauccuaggauaggaagugucugccucauccucugugagaagccggaucacuucucagccuuuugcuaacaucaagcacggagauaaagcugagggaucaagacuuucuuccuggaaaagaaaucaguuuggaauauaauucuaugaagaccugguagguagccuugaaauuuuuccaaaaggcugccuuugccuaaugugccuggaggguaagagacgaccugcuggaaacaaacaacagccagaaggauccuaauggagacgggucccuggggaacaaguaacuggagaaaaacaggcuugaaagcacagcucuccgucccucccuaaccuggauggggcuauacuacauuuccacaucuaagucaccaugcuacuuggugcuccgaggaggcuuuucuauacuucuugcagggggggaaaauccagggccaaucauuuuauuucagcugaucagucucuaauugcuuggcuuacagaaggcagcaaugcuugcacaggagcaaauucaguguccccggguuuuaucugcaguggcaggcagacaggcacgucggucagcacagggugugcugccugccuuccuuccuaucaccugugcucuuuaaagugcaaacccaggaggcugaacaaguggcucacugguuaagagcacuggcuacucuuccagaggaccaggguuccuuucucugcaccuucauggcagcccucaacugucuguagcucccguucacaccaauguacagaaaauaaaauuaaauaaauuaucuaaaaaaaaaaacaaacaaacugcaaagcuagcucgacuccagagauucuaaacagaauuagugcaagcccaggaaaagaacacuggugcaaggaacagaauuucugaaacacugcaguggauuccgcacaaacguugugccuccuguaucaacaauaagaaaaccaacaagaaacaacugauagaguucuagagaccguaacugaccagugucuuucucuugcuuuaacauaugagugcguucaugaucgccuugggaaacuggugagggccacuagguucaaggucgccugugaaagcuuggacucaggguggcguucucuagaaauguucaauuaagaucauauuagcucaaauuuuaccuuaaugucacaagaggauucaagacugagugagguaagaggagggagagggaaaaccaaccgucaguggucacaaacguuuaaagagucauuccaucuccuuaguaacuuaacagagcgagcgagcaguauagaagaguuaauuauauacacacccuggauuucagggcaacagaaggcacacgcugccaagcaagcagccucuugaauugaaagaauucuugugcccaggccaaucugaauugcugugucaaacccgcucauuauuuccuggcucaaugaagaaugagaaucuagaaggaagagggggagacuauuguguccaggaugagcuaggagacacccagacugcuaucccuuuacuaaagggcacggaacaaccucuaaaugacagaagucaagggaagcagccgagaacaugggaggugccacugccugcuuauaggaaguagaaaagacuuccacgcuuuccucuugguccguaagugaggcaaagcacaccggggguuuccaacacccaagugcuacacuugcuguucuagcugagccggugagagaacugggaagguguggacaaucugagcacagaggaguuuaaauuucugaggaaaugaggacagaaagaaagaaagaccuuuuuuuucuuuucuuuucuuuucuuuuuuugguuuuucgagacaggguuucucuguguagcccuggcuguccuggaacucacucuguagaccaggcuggccucgaacucagaaauucgccugccucugccucccaagugcuaggauuaaaggcgugcgccaccaccgccuggcuaagaaagaccuuuauauuauaaagaagauaucuuguagaaaaaaaauuuaucacaguauccaucacauguuuuaaguaaaaauaagaggucuucccaaacugaacccauaaacuaauuucuuucaaagccacaguaaacacacuuuggagucucaauaaagaaagcucgcagagcauuaauaagguguuuccuacugggcugaagagcugucucagccauucaaggcugggcucacaacagaaauguuaaaaugauuccuucugucuaagauuuagcuuuuccuuuuuuccugacagguguaaaguccaaauuccuuaaaaauagaauucuggggcuggugagauggcucaguggguaagagcacccuacuguucucccgaagguccggaguucaaaucccagcaaccacaugguggcucacaaccaucuguaacaagaucugacucccucuucuggacagcuacaguguacuuacauauaauaaauaaauaaaucuuuaaaaaaaaaaaaaaaauagaauucugggagccaagcagggugacacaaaccuuaaaucccagcacucaggagccagaggcaggggaaucucggggaauuuaaggcuagccuggucuacaaggcacagucagggcuguuccacagagaaacucuaucaugaaaaacaaaaacaacaacaaaaacccagaauuguuguuuggauaaaagugaagaugaacuugcagagauccgucugucuucccucccaagcacugggacugaaagcauagaucacauucucuggcucuuuuuauuucauuuauaugcaugacuguucugccuauaggaaugccacugugcacaguguguaugcagggucagcagacgccagaagaggaggcuggaccccugggacugggauuauaaacaauucggagcuaccagaagggugcuagggaucaacccucaucuccuggagagcaacugcauucuuagccacugagcaaucuccccagggaauuuuuuguuguuaucauuuugguuuuuugcuuguuuguucuuguuuuguuuguuuuuguuguauguguguguaaccgguucgguuugguuugguuuuguguuuuguuuuguuuuguuuugugagaagguuucucuguauaacucuagcuauccuggaacuuacccuguagaccaggcuggccucaaacucagagaucugccugccucugccucccugagugcuggaauuaaaggcgugcgccaccaccaccugguuuuuccagccaauuuuaacuucuccuauuaaaauuauuuuuaaaagcaauuuuacucaaguuaauagaaauacuugaaacacacaagacaaaguagugacuucuuaccuugucaucgccuuuagguuuaaggucacucuguuuaaaaagagagagaaaaacaauauucaagaugcaucuaaaugagggcgagcaaucuguuagcuccuucagagaugucagagucugaagaaggugccagguccaccuguuagcacaucaggauccccuauuagaaugcuaagcccaaaggacuuauagauacauaauaaauaauguuagcaagaaacuugcaagaauaaccaaaccacuauuuggggaacagguguuauuaauuacaagaaucaaucaauaaaagacgaaaaccaguucccuuggcuuuucagauacuguauguacaacacaggauggcucgaugauucuggggcaaaccuggccugagagccaggcugaaugaauuuuuacucuaaauaauucaaucuuucauccugcugguggcugucaaguaguuuucucugcauaagcaucugagcgcuacaacaguucuuaccggauggacaucuccaauguaguacugcuuuagcaucucccuggcaucaggggaguggccgacaucuucaaagcuuucaguugcaucagcacccgcuuguuccagcagaaccucuuccccgccaggaugcuaggaagaaauagcauuugcugaauagagggcucucugaaaaagcaaacuaaaguuuuuucuuuccauccccuuucuuccuuuaguggaacaaauugugugccacuuuugaggguguaucaggaaggauacagcaucauuuucuacaauauucuggcacagacugcauaauaugcauauuaauugauuuccuuuguugacauuaaaacugcaacaaaacucacaagugagaacgccagaauuucuggaacuuuuuuuuuuuuuuuuuuuuuugagacaguguuucucuguauagcccuggcuguccuggagcucacuuuguagaccaggcuggccucaaacucagaaaucugccugccucugccucccaagugcugggauuaaaggcgugcgccaccacgcucagcucuggaacucucuuuauucuacucuugaauuuuuuucuuucuuccuccuccuucccuccacuuacuccuuuuuggagauggggucucaugugguacagcuggucugaaauguauagcccaagagagcuuaaacgccagaucuuccuguccccuuggacugcagguguggaccaccauguccacauuacugaggugcuggggaccgaacccagggccucaugcauggcagacagggacucucccagcugagcuauucuuuugcccaugcccuuucucucuuucuuuugaaaacacuuaccuacucgcuuguguacaugugugcauguguguacaugugugcacgugcauuaauccuuccugccucagcuucuggaugguuagucucgaaacuuuuuguaaauuuaaaacucuuuuccuucucuucucuucuuuucuuuuuuuuugguuuugagacaagguuuuuuucucuguguauccuugacuguccuggaaguggcucuguagaccaggcugaacucaaauucucggagaucuaccugcucugccuucucuagugcugggaucacaggcaucugccaccuucacccagcuuaaaauuguuuuuaaauuaaaaaaaaaaaaaaugagagagcccaacaaccugauuuugaucccugaaaccuaugaauagaaccaacuuccaaaaguuguccugacuucccuccacucucuggagcaguuucacacacaugugcacacagagaaacaaauaaauaaaguuaauuuuuaaaaaguuggcaccugcuaggcaugacagauaccuuuuagcccagcacacggaaggcagaagcaaacagaucucugaguuccaggccagccuggcaauuagagagaguucuaaggccauccagggcugcaagaagggcucugucuacaaacagacagacagacagacaaaaaguagauacaugaaaaugccaaaggggacugcagaggcugcaccaagugaacacuguaucuucugaaacuguauucaccaaguauucccuauuuaaaaacuuuauuuucuaaacuaacacacagcagucccugacuucaauacucagcaaacauuugcuuauuagcaaauuuagaauuuucauuagcacacccaagccuauguuucugaaauacucaugucuuuuuaguuacuuuuuauaacaaccacuuuaaaaacauuauuauuuuaaagauuaauucaagagaaaugcaaaccuuuccaagucaccuacccaucacagucacucacucaucagcucccugaggaucagagcagcugcuauuuuagucuccuaaaaggucuccacccaggagagcccagcgucuaaccaugcuauuuuagugcaggagugagacugucaccacucagcuguuccgucuugagagaaagugaagucaccgcauggggaaccacaucccaauuugcgcuaugucuaaacuauggaaauauuuccccuuuauccuauucccaacaaacaggcuuuccuagucaggauaagccaagccugguggcacaggccccauaaucccagcgucacaagagacugaggcagggcaucccaaacucaagccggugggggcaacuuugucagcuccugcaucaaaaugaaaagcaagcuggacgugguggcgcuggacguagugacgcacaccuuuaguucccagcacucaggagacagaggcagaggcuguggacgucugugaagacuuaagagcugcccuuaccacugagaagaacugggaggagagaggugguccucccaagggaagaacacacuaguuggcuaucuucugccaaauggucagccuuaaaaacauacauacauacauacauacauacauaaacacauacauacacacauacacacauacacacacacauacacacacacauacacacaagcagacaggaaacaccacacagauuugacaggucauuuuaaagaauauauauguauauacaaguacauaugugccuauaauaacgauugauuuaaaacaaaaaaggccaaaaauaugaaggagagcaggaacggguauuugagaggauuuggauagagaacuauuguacuuaaaauacaaucucaaaaauuaacaaccauguauuuuuuaaaaauaaauaaaauaugauuuuuuuuaaaaaguugccaggcuggagagauggcucagcgguuaagagcgcugaccgcucucacagagguccugaguucgauucccaccaaguacaugguggcucacaaccaucuguaaugggauccgaugcacucuucuguguaugucugaagacagcuacaguauacucauauaaauaaaaaaauaaaucuuaaaaaaaaagagagagagagagcauuaaaaaaaaaaaguugcccuuaaccugguaacuacugagcagggcgugguggcacacgucuuuaaucccagcacuuggaaggaagaggcagauggauuccugaguucgaggacagccuggucuacaaagugaguuccaggacagucagggcuacacagagaaacccugucucgaagaaaaaaaaaaaaagaaaaaaacaaccugguaacuacuguucaaaagagucucucuaaauaaaagggaagcuguauaauaaauacauggacaugcaacaggaccauucuuuccugagccuaaaaccuagaaaguagaggaaauaauaaauguguggcugguaauucacaaggaaaaagccaaccuagaaauguuuuagggggcucagcaguuuagugggcucuuacagaggacccagguucaguucccagcccccacauggugauucacaaccaucuguaacuccaauuccagggaacccaaucccuuccgcaagcaccaaagcacacauacgugaaggcaaaacacugacauuucaucuauauaaaauaaaugaauaaauaacaauaaaaaaaugauaucauguaaaaaaaaucuuuuuuuagggggugggaauugagacagaaucucacuauguagccugacugucuaggaacucacuauuuaguccuugaauucacagagauccaccugccucugacucccaagugcugcaguuaaaaaaaaaaucuuuaaaaaguuaaaaaugaaauauuuuaggacagagagauggcucagugaauacaugcaugaaaaccagaagucauauaaaugccagguggccacggcagcucccuguaauuccagagcucagaagguagagauaagggaucauuggagcaagguggcuagcuagaccagccauaucggugagcuccgaauucagcugagagauccugccucaaacuaaagaagacuggcaaggucaacuucagccuccacauacaugucuacacucacacagagagcacacgcaaacauauccaccuacaucacacacauaaauuuuaaaacaugacacugaacauaccaaauccccagagagaucacugcugccacaagugagcuaucacucggcugaacuaaaggccgacuuccucugccgaagcugguuuacgcaacgguguagaugaagggcaauggcugcagacacagauaugagugagcugcccugggauacucuaccuguauuaaaugucccagagaagugacagagugacauuucugucaagaaguagauguagggccggugagaugguuuauccaggacagcacuugaugugcaaaccugacaaacugaguuuaauccccagaacucagggugaaaagaguaagccaaccagaaauguguaugcauaaauaucuuaaaauacaugcagauguguuacagaucaaacuagaaaagcagugcaaauuaugaaauagaauuaauugaggcaagggaaagauaagaggaaaaaaaugggugacagcuuauuuguuuuuuuuuuuguuguuguuguuuugagaucgggucucacuauguagcucucuccggcuguccuggaauucacaauagacuaacuaggcuggccucaaacucacaagagaugcauccaccacugccucuccagggccgagauuagcauggggcaccauccucacuuguaaaagcuuacuggauugaugguuaagguucuaacucuugcuuuugacaguaaccacauuagcuacuuuuguaucacuggaucaaaaaaaguaacagaauaucagggcggaggagacuucuauuguguggauuucaaaggauuucugcuccauguagaaaggcaugguggcaggaacaggagacauugagaguaggacuagaaccugcaguuggugcuguuuucaaaagaccggcucccaaugaccuauuuuugucaacuuaggccccaccuccuaaaagauccacagccucccaaaauauugucagccuuuggcagacaagugguaguaagucugaagggggcauuucuaagucaaugcauaauaacuaagauguauauaagagugcauaaaaggagugcuuuauaauaguguauuaugcaaaagcuagacaucagcacagcagucacuuuggggagcgggaggcgaacuaauuaggaagaaacuccagaacuuggaacacaauuucacagauguacaaacuuaggaaaaacucacuaagcaugcuuucaggcuuugugcauucuuguguuacaguuuuuuaaaauaugucuucagaacuaugcagcugacaucagagaagaggaaacaccugggcauguuuacugacuagacacaggcagaaaguuuugaauguuuugcacugcacagcacuuucuucaagcagcauuuuagauggaagcccaauauauacacucacguacaagugaagaguguucagcaaccuucaagagucaaucuaaaaaccauccacacguauaaauggacaaaugacaaaucaacaccaccaguagcaggcacaaggcgguuccuagcgucagcgucacaggacuuugagagcugcuuguagccugccaggacuuaaaaaugcccugcugugcuaucuucagaggucagauaaggaaaggagacuugagaacaguucacaaggugcgccacuccaccccgcucaaaggcugcaaguccuaugguagcagagaguacauucuagaccuagcccaaaguuaggagagaugggaccaaguucaauuguagcccaaacagcuccugucugccaguuuuugugcugguuaauguucagugucaauuuaccaggauuuagacucaccuagaaaacacagcucuagaugugucugugaggauguuucuagaauguuccuaagaaaggccuugaauguaggagacugcacgugaccagccaccucucacaucacucgucacacuuucccugccaugguggcagguucccucaaacugugagucaagauaaaucucuccauaaugccaacuauuugucacagcaagaaaaaagucacuaauacagaaauaauaaacacugucuuggcuacaauaguaagaaauugaaagcuagccgggcgugauggugcacgccuuuaaucccagcacuugggaggcagaggcaggcagaucuccgaguucgaggccagccuggucuacagagugaguuccaggacagccaaggcuauacagagaaacccugucucggaaaaaaaaaauaaagaaagaaaucgaaagcuaggcauaguggcacgugacugcaaacccagcacucggaggcagagauaaaaucaucagaaauaagacugagcucagggcuggaaagauggcucagcaauuaagacaaugugcuguucuugaaagggccagagcucaguucccagcaccuuauugugcggcucacaaccuccuguaacuccaucuccagggggaucuggaaucugcagacaccguaaacaagcacauaucuacacacagacacauacaugcacucacaugcacauaucuacacacagacacauacaugcacucacaugcacauaucuacacacagacacauacauauacacauaguaaaaagauaaaaguucuuaaagauacuacaagacaaguucagaugaagcaacacacacagugacaugcagauucuuucgguuuuuccuuggagugugugcaugggauggcauuugucguguccuuaccacauaggccucugccucugaacuccucuaacuguaaccucucacuaggagcagucgucccuaguccucuuuuucccucuuuccuacuccccaacuaagggcagaaaggaaauaaauuuaaaaugcugccauauaaaggcaugggaggcagucacugagcugauacugaaggagggacccagcauaaggcaagacauuugcauuaugugguggggcuugguuuccacagccucuucuaacgcuucuacaaccacagaggccaaaaccaggaguggagccaaugacgcuguuaguguaggaaucuucaggaggccgccacaucuaugcagcgcccugccugcuguacuuucuuuucuuuaauguauaugggugcugugccugcauacgucuaugcaucauaacgcgugugcuucaugccugcggggucuagaggaagguaucagacccuggaguagaguuacaauggcuguaagcugccaucuaggaaccaaacuuggguuuucuuaaagaauagcagaugcugcugagccaucucuccagccuacugcuguauuucuuuucucauagaaacuuucauuuuugaacauuuuugcaaggacaacuugcaagagucaguucucuccuaccacauggacucuggaaacugaacgcaagcuuugcagcaagcacacucacccagcguucacuguucuuguacuucggaagagaaggaaaggcaggcgaguugggaagagggaaaaagaggacuagggacgacuguuccuagugagagguuacaguuagaggaguucagaggcagaggccuaugugguaaggacacgacccuacauuuaaucccaacaccacacgcaugccaccccaugcacacacuccaaggaaaaaccgaaagaaucugcaugucacuaacuguguaaaaugcaucaaauuuacaaaaauaauuuaauuuaaaagaaaacuuuaacaaucuaacuauaacaacauuuuacucugcuugcuucuaaaacaguuccaccauggcaaagcaugggacuuuuuuaaaaaacaaaccacuacauuaacuaaaaauacaaaauaagccaaguuucuaugcucccaaaucaggaagaaauuuguuuguuuuguuuauuuuaagauggcgucuauuuuguagcccuggcuguccuagaacucacuauguaguccaggcuguccuugaacucacagaaacacaccuguuucugccucccaaguacuggaaaugaaacaugaaugggggaaauuuccuaagacccccacuccuggaugaagagcuacaggugaucaauggcugcugaaaggaguuggucuucuccagggggaagcuuccugauagcuuacucaaucccaaguggucaguccuaaacacguguauaugcauauguauauaucuaacauuaaaggggacuaugggagaauuagagggaaaagagugggggauagaaaugaccuagcauacuuauaucuauuaaaaaucuuuuuuaaaaaaaggaacaaaaggaaccuuuuuuuuugagagagagagagguuuguaucuuuaaauauauauauauauuuauuuauucuaucugcauguauaccugcauguuagaagaaggcaucagaccccauuacagaugguuguaagccaacaagugguugcugggaauugaacucaggaccucuggaagagcagucagugcucuuaaccacugagccaucucuccagcccauuguuguuuuguuuuauuuuguuuugagacacggcuucucuguguagcaacagcuguccuuaaacucagagauccgccugccucugccuccugggugaugccagcaagaggacucuauaaauggauggguggguggguggaugauggagagauggguggguggauggauagguggguggguggauagauuuguuuuguuuuugaggcaaaguaucucuacauagcccuggcuguccuggaacucacuacauagaccaggcuggccuagacucacagagauauaccugucuuuaucucccaaauacugggauuaaaggugugugucaccaugcccuauuuucuguuuuuguuuguuuauuuguuuguuuuuuuuuuaaugaucagugaggaugagaaaauucucaguuaguaaagugcuuuucucacaguagaaagaccugagucuuuacguacucagacuaaugaccugaguucacuccccaugagccacaugauagagggagagaacaagaucagauuccuaaaaguugucuaccgacuuccacaccuguuaugacauacacauguguacacacucacacuuugaaugaauguuuaaucauaaaaaaaauuuuuuuaaauaaaauguaucaauguaucagaucacauuaauuaaaagaagggacaaacaacucagucaucucagugacagaggaaagcauuugaccaaguucagcacccugauacucucaaaaaacuagagacagggaaauuucagcaauaaagagcacuuaugaaaaacauacaagaauugaaaagauggcucagagguuaagagcacagacuguucuuaugaagguugaguucaaaucccagcaaccacaugguggcucacaaacaucugaugagaucugaugcccucuucugggaugucugaagacagcuacaguguacuuacauauaauaaguaaauaaaucuuuuaaaaaggaaaaaaaaaagaaaacauacacuagaaggcucaaaagugaaagacuguuccuuagaucagugacaaaaccagacaccaguccuagggacugcuguucaguacugcacucaaaguccuagccaagacacucacacacacacacaaauggaaggaaggaaggaaggaaggaaggaaggaaggaaggaaggaaggaaggaaauaagguagaaaggaaagaggaagggaggggcagaaugggggaagaagggaggaagggagggagggaaggagggaaggagacggggagggaaggagacagggaaaagcagaagaaaaucuuccaagauuuguaagaaacauauuagcagcucacaaacuaagucaacaaaguuuuagggaacaagcuaaaaaaaaaaauguuagcauaaaccagcaaugaaugauccaaaagagaggaggaagaagaaaaaagaagaggaggaagaaaaaggaggaagacaaggaaaaauaaggaaagcaauucuucucaaaauagcaucuggaagaauuacuaccugaguucaaccauagccaaggaagucaggcuggccucaaacuuuuaucaguccuccugccucagcauccggaggacuaggaucacaggcauucugagccacaacugacuuauaugauuccauuucaugggugccuacuguaauuaaauucagagagacagaagucagaacagugaucuccgagacugggagcugaggaacugggaucugauccguaaugaugagcauuucaguuagaaggagaaagcucugaagauggacaguggugacaguucucaaaaaauguggaugcacuuaaugccaaacuauaugccuaaaaguggugaaaauggugacaguuacauuuaaaaaccaugauacuaaaaauguuuuucauuuaaagaguauagcgaagggcugauuagauagcucaguaggucauggucccugcuggcaaacugaguuugaucaccagaaccuacaagggggaagaaaggaagggacuccagaaaguuuuccuacacaacacuguaagugaagcgagugccacugaauugcacaggucaaaaugguuacaauggagacgagcuaagggugcacagcugggucaauccuaaacccugaaaaagcaaaaggucgaaauagcuuuacacacacuauaaauacacacacacacacacacauauauauauuauuuacuuacuauuauaaaagagacuuacuauuauaaaagagaugcuaaauauacauaccaauaguuaacauaagccaaaauuugcuuuuaaaucacaaucaaacaagagugugggacuauucucaguaaccuagaucaguugucuauacuaauuaaaaauacuagacaacaaaaaaguuucuucuuuggccuagggugcagcacaguggcaguggucccucaaacaugcagaagcccagaguuugacucuuagcauaacaagacccaacacagcaacacucaccagaacucaccagaacuuacaggaagcuggagagcugccucugcaguugagagcacuuacugaucuugaggagcacucaguuugcuucccagaaccacacugggccagccuccacaggcuucuguacucaggcccagauacacagacauacauaaaaauaaaucugaacaaaacccaucacacaaucaggagcuagagauacaguucauucauacauagaguguuugccuagaaagucaaaggucccgguccaaccucuucaccacaauaaacaaaauccucaccuagcuuaaguaaaacacagagcccacgagccuuagcgccugcuuugcauacaaacuucuuguguguuuguuuuugggguuuuauuguagcucaggcaguucccaauucaagaucuccccaacucagcuuaauagguacagggauuacagauaagagacacgcagccggcaugcauuuaaaccucauguaagcuaccacacaagcuaguaagagagaagacacaacugugggucuauuuauuucugacucacucaagcaaaaguaaccaagucaaacacuccggcuauuagaaaacuguccccuagugaaggagcucaggcaaucaacccccccaagaauucagaauagggacagaaacggucuuaaauucaauuacuguacuaaauacuacugacagaggacacaaaaaaucuaugcuuuaguaaagaaacgaaaggacaaacuacuuaugggaaucauuccugauuacuaagucuaaggaaagaacagaggacugggggcugacaggagaaugugaggacaauuacaguuuaacauccuagcugggaaaaaaugauucaaguucucuguggauggaaauuccauaccgaugcaguaaaaaugugacaauggagcucuccugaagcccaccugacuuggaaaauggaaugagagucauuagcuugaggaagcugcagaacuaggcuggacgauaaagagcaaucucuagccaaacacagacuaucacuaaagccaaauacaaagaucaaaguauggcaaggcagagaaagauaacagaacuagugggucacaggaggaaaugaugccuuuggcuuggggauaagagugaaccugggaagacagggguguugccuaggaaacuagccugaugccaaaggguguaagcuggcaaggucaccagaccucacacaugccaaagcacaugccaagaacaacacuguggaggagguucaccuucccccuuaugcaggucccagggagucagacuugaacaaaugcucuaccagcugagccaucuagaaccuacaauugugguuuugauugaaugucuuucuuucccauuagacuauaaacucuuaggaacaggaccacaguugucuucugugugacugagaucagagcaugauaccuuaggcauagggagauugggagcacucacucuguucucauaggugcguaaaugcacacaaguaggcacacaggccuaugaccacacacaaaaugaauaaacaaaugaagaaaaaaaaaaaaaaaaaacacugauugagucacccugccaccuugccugcauagggccagggucugaccuuuuucucaccuuauuucaagucuucucuaggucaacccacaugaacacugagggaacacagaaugccuucuguauauaugucuaccuaccaccuagguaacaaguggacuguggguguagggaguguuugguuuuugcuuuguuguuguuuuuaucauccuuggaaaaacaagaaugauaagugaugagucaaauucaagauuucaggggaucccuggggacugaugacacuacauagagccugcauucgcuaccuuccuucaggcaaagcuacugucuucuaauaugacaguaauuacugccagccccuccaugcuauuccuaggcaucuauuucaccuuuaacuguuucaaagcaccagucacucagcauuccaaagacuggaauaggugaaguccuagguuugaucucuaccacuaauaaauaaguguugcuggaaacaacauaguccuugagguauuguggugguuuaaaugagaauguucucucuacacccccucccaaauaucugcaugcuugguccccaguuaguggaacuguuugggaaggauugggagguguggccuuguuggaguggguguagccuuguuggagaugggagaggguuuugagaucuuaaaagcucacaccaggcccuagucuuguucucagucucccucuuccucucuuugcugacaacuuguggauuagcuacugauccuauuccuucccaucauuacauuuauagacugacccucggaaacuauaagcaaauccccaguuaaaggcuuccuuuuauaguugccuugaucaugguauauuuucauagcaauagaacaguaacuaaaacagauaccagguuuuaaaaaagaagaagaagaagaagaagaagaagaagaagaagaagaagaagaagaagaagaagaagaaagagagaaagagagagagagagagagaaagagagaaagagagagagagagagagagagagagaaagaaagaaagaaagaaagaaagaaagaaagaaagaaagaaagaaagaaagaaagaaagaaagaaggaaaagaaaggaaggaaagaaggaaggaaggaaggaaggaaggaaggaaagaaggaaggaagaaaggaagaaaggaagaaaggaagggcaggcuggaaagacggcucggugguugagagcacugccugcuuuucuagaggacucuaguuuaauucccagcacccacauggcagcucacaugguaauuccaauuccaggggaucugacacccucaagagacacacauacagacagaacaccuaugcauuugaaauuuuaaaaaagaaagauaaaaagaaaugcagaggccaggcugaugguacacaccuuuaaucccagcauuagggaggcagagaaaagggaauuucugugaguucaaggccagccuugucuacauagagaguuccagaccagccaagucuucauggugagaaccuguuucaaaaaaaaaccaaaaaaccaaaaacaaaaaauaaaacaaaaaacaaacaaaacaaaaaaagcaaugcaggggcucagugauuaaaaaugcuuacagaggauuugaguuuggcucccagcaccuacaucagauacucauuacugccugaaacucuaguuuaagaggcucuaacaccuagccuccacaagcaccuagcaugaguuaucuaccaagccagacaucauggccucugcauaguucucuagccaaaggagucauuuucucaugaagguuuuuccagagcgguuugucccagaguuacuggagggugguuuugaggccuugugaacacuguuaagugccucaccaacgaccaauauugccuggucugacuucuucuauguauccuucauagacagagacagaaauuaaaauccuuucauuugguuuuguuucuuuuugucuuuccuagaauagaaacuucaagagggcaggaugcacacugcagugaaucacugcccagcuuaaaccacucuucugagaaagccacucaacacaaaccacucacacacaggccacuuacacacucacacaggccacucacacacacacacaccagcuuagcuaaguuuuuucacuucauuuuuuaaauaauuauuuuacuuauuaggcggggcucauguaggggucauguaugugccacagugugcguguagaaaugaugcuacagccucugcucuccccuuccauggguccuggggauggaccucaggccgucaggcuugcauggcaaauacauuuacccacugagcuaucucacuggcccaaguguuuucaccuaugacacacaggaagaaaauaauuucacauuacaaucuaauaaacaccauauauauaaacacuauauguaauauuacauauaauuagccaaauguagcuucagaaaaacaagacacuggauaauagagauauacuuugauaucuucaggccaauguuauauaauauuuuuacuacuuuuuuccuaugauuaguuuucuaaacuacuaaauagugaaaaagggaaaaaaagcaccaacugauaugggguaaggauguagguugguagcagaguguuugcuaacauaaagcccuggucagugcauagcaucccacaaaccauguguggaaguagacaaccuacagucucaacacuuaggaggugaaggccagagguucacaaguucagaggucaucuucaucaacguagggauuuaaggccugucuaguauacaugacaccuuguuucaaaucaaaacagacacacacacggagacacacacaugcgcacauaaacccagcaagcaaugauaugcacuaauuuucauuucuaaauuuuaauaaauaaaaccaauagcagugauuuucuuuucaggcaaauguaaucugguaggagauagauauuaccaauucuaaacuaucacacacucuagucauauccuaaucuaaccagucaguaacaaaauaaaauggcaaaccuauagauucaagacagucagaucaagaggcccucacuagggcuggugagauggcucaguggguaagaguacccgauugcucuuccaaagguccaguguucaagucccagcaaccacaugguggcucacaaccauccguaacaagaucugacgcccucuucuggugugucugaagacagcuacaguguacuuacauauaauaaauaaauaaaucuuuaaaaaaaaaaaaaagaggcccucacuaauccccaagugacuccagacuggaaggagacagacgcaggucuuucucaucucaucuaagagcagccuuccugccugcugagucccgagagcccagaacccuggaucauccucagcagggucuucuuucacaucuggaauccacugcaucauagaacaucagugcacacacaggcagcaauucuucuugcccacacugaaaccacucuggcccgagccacucuuucuugccuuaguuacgucuuccguaacugagcucuucaauuccacuuuaguccuccauuguugcuuucucaauggugcugccagaacaacucaguuaaucauuaaaucauagcaccucaggacugucucagcaauuuuuccaucugagaacaaaaauucaucggaaaaaaaaguucauccuaagacgagaucgucccucugaucguucugaucucaucaugugccacuauccgaccacugacugucucaaacauaccauguuccuaccucaagacuucccuugccauuccccagaauucacauggacacccacguggauaacuccuucauuuuacuccuggccuuaaggcaucaccaugacauucucucuggccuucauaaaaaaaaaaaaaaaaaaaaaaaagucaaccuccuucuucaugaucucaccacauacacagauuacaccauccucuuagcacccaucuacccucuaaccgugggauacaauucauucacuuucuguuugcugucugcucccuacucuagauggcacagguauuuacugacuacuguguccucaguaccuaaaacaguagcugguaccaagcagugauuugauauucgaguaagcagauggaugaguaagcuuggacggggugaaagacaauggaacaaguuaacuuggaacaggcagcugcaagcucggcguggugguucaaguguguccucucagcacugaggaaggugacacuggaggauugccacaaaugcagggccagacugggcaccaaagagguggccuagacaacagguaagaccaugucuaaacaauaaggacaauaauaaaagaaauagcuaaccacagauaaagaucuguaucucaaguuuaaggaaagccuugccuagaagauaucucuagcuuuaucagaacauggugaaauaggcuggcaauguccccuuaucuggguccuuccgaacccacuaucuaugcucaaucaaucaagaaauucugggacauggacugucuauauacuaugcuuuaacaguaaauguauuaaaagacaaauaccagaaaacaaguguuaagacuaguauuuugaaguaauaagauaugggcaaaagaaaucaaggaaucuucuaagcuaggcuccaucacucaucagacaauuauauaugaucagaaugucacagaaacuguuucugguauccauauuaauauaauaguuacgucuaucuauguugcucucaaccaguuauuuaaaaaugaagcugggccaccuuuaaucucagcacucaagcggcagaggcaggcagaucucugugaguucgaggccagucuggucuacaucgugaguuccaggacagccagggcuguguagaaaggcccugugucaaacaaacaaacaaacaaacaacaacaaaauguuggcccaagauugacauuacacagccauaauucuagugcuugggagguagaggaagaagaaccaggaauucuagguuauauaagauccuaucucaaaauaacaauugauacagcaaacagcuaggcugggggcauaagggguuugguucaguguuugcccuguacucaucuaaggcccuggguucaagccaaaaaaacauuguuuuaaaaggaggaaaaagccgggcgugguggcacacgccuuuaaucccagcacucgggaggcagaggcaggcggauuucugaguucgaggccagccuggucuacagagugaguuccaggacagccagggcuacacagagaaacccugucucgauaaaccaaaaaaaaaaaaaaaaaaaaagagagagagagagagagagagagagagagagagagagagagagagagaaaacaagaacuggagaaauggcucagugguuaagaacacugacuguucuuccaaagguucugaguucaaaucccagcaaccacaugguagcucacaucagaugcucucuucuggugcgucugaaaacagcuacaguguacuuacacauaauaaauaaaugcauaaaucuuuaaaaaaaaaaaaagaaucuuuaggcugggcagugguggcgccuuuaaucccagcacuugggaggcagaggcaggcaaauuucugaguuugaggccagccuggucuacagagugaguuccaggacagccagggcuacacagagaaacccugucuuggaaaaaaaaaaaaaaaaagauugacagucagcaaaggaacaagagaguaacaucuuaguggggugaaauguucuuuuuccuuacuguagugacuacauggucaaauacacuugucaaaccccagcuagagguguaauauaguugacaguguuugccuaauaagcaugagcgaucugaucccuagaaaggcauauacaggaagauuagaaguucaaggucuacagagacuauguaauaagcugaaaaacgcccugucacaaagaggaaaauuaucuguggcccaacagucucaaagagaucuugaguaauaagauuugauuugaagcacuaacaaaaggguugaaagccagguguugguggcccacacauuuaaccccagcguucagaaggcagaggcagaaggaucccugaguucgaagccagccugcucuacauaaaaguuccacggacacacacacacacacacacacaccccacacacucuacugccuaaccaggaacaggggugggaggaaucucagcucacuggauaagagcacaugugcacauguucuguuuucucggaagauccaguacccaacacccacaucaggaggcucacaaccuccucuuauccagcuccugggguucugaccucuggcaccaaacgcagaugcagaugcccccacccccacccccaccccccccacauacaaaauuuaauuguuuuuacuuuuuaaaaaaacugccuucuccucuagaaaauaaaagccccccaaagcacugcuuucuaaggcauacuuccuggaaaggagcaguucugaacugggcucgauuaggucguuaagugugugcccuugagagcucccggccuccgugagccucaguuucucuuuaugggaaacggguugauggccuggcgugugaucuagcauccugcaagugcuccaugcauugagaaacgcacguugucagucgaggcugagacugcagccccuccgagggucacgguuccuuccgggcgccggacagccacgcguggccucuccccacccccaccccggcagcgcgcggaggccucccgccuccccggcccgcaccucgcugaggaagcgggugauaucguagacucgcccguggaucaccauccacgucucuuccgccgaguuucgcuucgccaccuccuccagccgguaguaggugacggagggcucggagcccucgaccuucucgccacugccgcuggccuccggggucgccaugggauccgaagcccucuccgccgcuaucugggcuuccaccgcuaacuuccuugacuugccggcccgcgcuggguccuccucggcuuccguaaccggguaaaccugguccgacguccgacuggccaaucggcgucg

SEQ ID NO: 4756 - RNA, 580 nt, Mus musculus
uacaauguucuuuagauucuuuuuuuuuuuuucauagguauauaaacuauuuauuaacagcaaaggcccagagacucauuucuucuuggauacacccacaguucagccccugcggccaguggucuuggugugcugaccgcggacacgaaggccccaaaaguggcgcagcccucuaugggcucgaauuuucuucagccgcuccagguccucacgcagcuuguugucuagaccguuggccagaaccuggcuguacuucccauccuucacauccuucugucuguucaggaaccagucugggaucuuguacugucguggguucugcaugauggugaucacucgcuccaccucauccugcgugaguucuccagcccucuuggugaggucgaugucugcuuuccucaacaccacaugagcauaucuccgccccacgcccuuaauggcagugauggcgaaggcuauuuuccgccgcccaucgauguugguguugaguacucgcaaaaugugcuggaacuucucagggaucacuagagacauggcggcggcacagacggcggcguguaggccuccuguggaagagcuc

SEQ ID NO: 4757 - RNA, 86050 nt, Mus musculus
cagauuccugucagcggcgccggcgguggcggcggccgucagugugcgcugaggagaagcccgaaacggacccguuuggcucucccucuuccccuuuccccgguccgaagcuucuggucucuggacucaccgggagucaguucuccacuccgcagagcuguucccuccacuccgccgcccuucucaucgcucggccgggugggaagugacugcccucgaggaggaggaggaggcagcggcugccgcccucgccucaccgcccccgguucggugcccgcggaucccggagaggaggugccgccgccaccgccgcucccccccucccgcugcccucgggccgggcugggucgagcugcgaugcccucggacuucaucucauugcucagcgcggaccuagaccuggaaucgcccaagucccuguacucgcgaggugagucagauggggggguggggggguggggcgugggggcggggagcgcgagcgcgcggagucccgggcuggggugggggggucccccgucggggccgggcucgggcgggcuugccccucacgagaguccugggcuggccgcggagggccaggggugaucccggagcugccgagcggcgccccccuccccagcgcggcgcggcgcggcggcgcggcggggggcuuaggguccgcgcgccccccagaguccucugcggucccggagguucgcaaccugccggucggcggguccggacuccaccacacucggcggacugccggcccaguccucccccggcucgggaaucaccccacuggucccgcugcuggggacaccggggaggggggguggaaucggggcgccgcggcucgugucccccggacucuccucuuuggcaaaguugccccacgccgggcugcguggccccgaggggcuucggagcucagggucaccauuuuuuuuuuuuucucccucuggucuuguuugugcgcggucguccuacuccccccccuuccccggccuaguccacucccuccccaugucgggacggccccccucggccaggcguucuuccuuuccucgucaucuucuugccuggaaaaggccccaaucuucuuucucucuuuccaccuccgugacauucuaauuacuucucuuuuacaaagauagggaugcccuccuuggaguacuuguauuccucucccuggaguaccaggcucgggcacaguccugcccuuugagaaaaauucucuucuguugcuguucaagggcuucgugcagagaggaggcaaugaacagaaaaucccauuuaaaacuacuuuggcuaaggccugcaggggauucccagcaucuaaaacauuaauacuugaggugaucucugcugggguuaaauuccuacacuggacaccacaagaaugugucagaacagguuccccuugcaagggguaucaaaucaaaaaugcccccaucuguacucauuucuuauaccaguggaaggaggcuaaagacaguucuuuuauauuuuuuuuuacaaauaaaccauggugaacccuuuucccaagaaauccagcauuucuccuauuuuuuugguuuuacaaacccaccagaaaauuucaccucuuugggguagagaaggacuaagccugguguuaauguauuuauaugaagugaaucagagggaugugguuugcccuggaaggugcuagacuuuauagacuacaggccauugucuguugcuuugaugaauuuaguuggcagucacuauccuguaggauguuuuucagauauuaccuaaaguagcuuagaaauauuguaguuugaagugucagaaagaagagaaaauaucaagagaugauccuuagaauagggcuaaugcacaauuggaugcuaaaaauagucaagacaguaauaccauuugggcaguaaucauuagauaauuuuccaugaaacaaaugcuuuaucaaaaucuaaguuuagcuuuagagaccaguguagaagcaacccaaccuuccuuuugcagacuaaacuaauaugggcuuaggcucuuaaaaauacauaauaguuauguaagagauguaugcuauccuuggcauuuuuuucucauucagcauaaaaaguacuuaaugcuuuuuguguuuuucagauucucugaaguuacacccaucacagacuuuucauagagcuggacuauuggaaggucagcaaagugcccuguuacagcauagugugucagugugcaaaggcuuucucugagauggaguugaagugggaaagugggaaacuuugcagacucacacaaucuaguuuuuuuuuuuacuaagaagccugauccuucuuuuagagcagcuaaauguuucaguggauuucauugcugugcuugaauugcuuguaggccguuguaucugcuuugagaggccuugggaaaaucccuuaggaucauuuaaaauuauguguuggguguucuacuuuaguauuucaguuaaauuguucuuaaacacaaacuaaauuugcaaagauucaaacguaaagaugacaaauuaauaaauacagcagugacaccaaacacauacuuaguuugaaaauuccaaacugaaaacuuuuggauguuguaaauuucaaaaugauauauaaucuauucagcaauuauugacauuauuucuguuucauuauauguaaggauaagaaaagcuacauaauaggaaugaugcuuaggggggaaaaaaggccccaagacaguucugggaaaguuuauaggauauguaccuuaaacagcugacaauuacuuuaaaaaauguuuucuuuguuguaguaaauauuuuaacccugcauuguuuggauagauuuauuuuuuagacuuuacacuuaccuucuuugaauuuuagggucuugguauuagauaucaaggauauuaauuuaauuucuccauuguacagagcugagaaacaagcugaaaguaagaggcguggggggaaaguucaaccucagcagaaacaaugcuuucuguguuuuagucaguacuccuuacccaaagccaagugcuacuaugaaguauauauauauauauauauauauauauauauauauauauccaguaacauaacaaguauuuuaugaucucuuugaaaaaggcuuuaaauauuuucauaggacuucaguauagcuuuuuuucucccuuagagguagguagacuugaagauacaguggaggaaguggguguuguaauucagcuuagguuugaauaccaguuuagcaacuucuucagcgcugugaccuggggcaagugauuuuaauauucuaaacuuuauuauucuuucuacaaaaguagguaucaaggauaccuuaauuagcuaauauguauuaaaacaccaaguuacaguauuuggcuuuauuuacuuauuauuauauuauuggguaguauuagggauuuauuuauuuacuuauuuuuaguuuuugagacagggucuuacuaugaagaucuggccuggaacucccuauugucuggaacuuagaucugccugcuucuucuuugagugccgagauuuaggggugugccacaauguccagcaguucuggggauuuaaccuggggcuucaagaauggggaaaguguucuaucacugagccuuagcagggaucauaaucagagauuaucaggaaggagaaagauacugaaaguguguuacuuagggaagaauuuaagaagguauuuuauaaauguuagggguuucguuuuguuguuguuuugagguuuauuuuuguguguauaaguguuuugcuggccuauaugucuguguagcaugugugcaccuuaagcccacagagcccagcaagaucuguguuggauucucaaagauuggaguuacagaugguuaugagcugccaaguauguacugggaaucaggcuuacguccucuagaagagcagcuagugcucuuuacugcugagccaucucuccacuccccuaaaaguuauuauuuuuuaacuuuagcaucaacucuauuguuuuaacaauaugauuuagaacauauaaaauguucucaaguauuuacugguuauauuuguacauauaaaaggagagagagcgcgcaggagcguguggguauuagugugaagauacuuuuguuuuucaagacuaguauuuuuguuguuguuuguguguuuuuuguuuuguuuuguuugagacaguuuuauuauguagcccuggcuguccuagaacucacucuguagacugagcuagccucaaacucauagagauccaccagccucugucucccaagugcuggauuaaaggcauguagaaguguuucuuaaugaagaagauuuuuaggcuuuauucuuauuauuguuuaugaugauaugagaccauauaugucuucacugcccuaucuuuucuggucagcaagccuggggaguaucauaaucagaaagauuauaaggcaggaugaaaguuuaauuguuuaaggagguaggcuuuuucuguuuguuuuguuuuugagacagguuucucuguguagcccuagcuguuuuagaauucauagaccagguuggccuugaacucacagagaguucugucucugccugccaaaugcugggguuaaaggcaugugccacugcugccacaugaucacugucccaacuuuaaggagauauuuuuaaugaauuuauagaaauaaaaccauuuaauaugcuugugacuauauguuaauuuuuaacuucauuugacaaaaugucuuaaaaagaucacccuuuuacagauauuuaauuaccagccauauauacauauaaauguguguguguacauauauauauauauauauauauauauauauauauauauauauauauauauauauugaauuuuugacucacuacaucaugaauuugcuuguuuaauauuuugaaacaauauuuaacaauuauauugcccauuauuaacuuuaacuuuuauuuuagaaaguuuacauuucuuuguguauauacacguacacauauaacaugcauugccauggaagucagagggcaauuauagguaguucucuccaccacaugaaauuuuaauucaaguaaucuggccuuguggcaggugccuuuaccuauagagcuaucuuggccugugagaaauacaucuuaaauaauguauaaaagcagagacaauacaaugcugagucuuuguauacccaucaccaagcuuuaacaguuuucagugucuucuuuuuaccuucuguuucccaaacauuacuuuaaaauaaauggguuauuuuaaaauaaaugcuaaauauuguaaucauuucacacauaaacacuuuuacauuauggugaguucuuucuuuuuaaaaagauuuuguuuauuacuaacauaaaagauaauacuuacugugcaugagugucuugcuugcauguuauaucuccacaccauguguguguaguacuuucauagaaguuaagggcagcaugugagagcugggaauccaaccuauuccucugcaagaauaccaagugcucucaucuucagagccaucucuccaacuccaagaucuuauuuauuuuuuaaaacauuuuuacuuaaguguguaugaguaagcagauguacuuguagguaccuaaggagaccagaagugagcaucaaauguccugaagcuagaguuagaaguaauugugagccaugugauguacauguguucugggguacaaauucugcuccuuuggaagaacagccgguacuuucaacuacugagcuaucuccagccucauggugaauugacucuccuuuuccuuucuuuucuuuuuucuucuugucuucccucucuuucacuuucuuccuccuuucuccucuucuucuuucuuccuuccuccuucuuccuuccuucuccucuuucucaucuuccuccuccuccuuuucuucuauuuuuguuucuuuaagauaggguuuuaccauguagucuuggcuggccugaaaaucacuauguagaccaggcuggcuuugaacucaagagacuggucugcuucuuccuccugagugcuggccuuaaaggcauauucuaccagcccuggcuucuuguauuauuguuuuuuauuucguuuuguuuuggcuuugguuuuuccagacagagauucucuguauagccuuggcuguccaggaacuaacucuguagaacagaguucaaggcuugccuugaaaacacagagauuugccugccucugccucuggaaugcuuaaagaugugagcugccacuacccagcuuugaauuaauuuuugaaguacucuguuuuauucuaagaaguguauaugcuaguucauuucuucauucuuuucauucuccuuugcuaucuuugcaagauggaaugcauuaggaggcuguugcuucugguguauaaguaucuuguaaucuacacuaaaauugcaguccaagcagguaaggugggugaggcaggaagguuccaaagauggaaacaaagcuaaugaguuccaggcuacagauugugaaauuauauuuaaaaauuuacagugggaaaaacuauugaacauaaaucucugcagagugcuguauguuaagagcuugacacugaauucuuuuaaaacauuuacuuauuuuauuuuguauagccauguguuccauaguaccuaugugggguuccaagaacaguuuucauaacucaguucuugcucucuaccaugugauucuggggagucacacucaaguugacagguuugguggcaaguguccuuaccugcuaagccuaugauucacugaauucguucucucugugugugcauguauguguaugaaugcauguguguaucucuguauagagccuagaagcuccucagucuaucucuacuauccuguugaaagucacugaaucuaaaauucaugaauuuggccucucuggugcugggauuauaggcacagguaauuuuuaaagugaaugcugggucuuugaacuuaggucuucaugcuuacauaaaaagcacuuuuuuuuuauagagccaauuuccccagccaccaaaucuacucauguucauuuauuucucucuaaaaaaaauuuuuugagccagguggugguggcacacgccuuuaaucccagcacuugggaggcagaggcaggcagauuucugaguuugaggccagccuggucuacagagugaguuccaggacagccagggcugcacagagaaacacugucucgaaaaaaaauuuuuuugagauuuaauuuguuuuuauuuuauauguaugggugcuuugccugcaugaaugucuuguucaucacauacauguagugcgugaggcagccagaagaggguaucagaucuucuggagcuggaguuaggcuguuagccaccauuugguugcugggaacugaaccuggguucucuggaaaaacagccaggaguacucuuaacuacugaguugucuucuccagccuuucucuuuugagauguggucucacagccaagguuaacauugaacuuuugguccuccugucucauccuuuugagugcugggcuuagagugcuagcuacugaaucccaauggacuagugacuuacaaaauuugcauaacccuuugagauguuaaguagcaauuauccuacaugagagaugaggaaauagaggcauauagacauuuaguaacuuuccuagacucacguaguugaucaguuguagagucaugcaucuguuguugcugcugcugcuccuccucuucuuucucccugucucagacuuuuaguccuucuggcucagucucucagugcuggggugacagguguucaccaccauguccagccaguuuaaguuuuuaagaaaacaaguuuuaaaaucugcaacugugaauuauuaaaguugacaaauagauuaaaaauauuuugccauucagcagaguuugcacuuagcuuaccuauuaaacagugcuagaccuugcuaccacaauuacuugauuugaugauugccugccaguggguauagggucuuaacugauuaauacaauaauacauaaccaugaaaaaugaccucagguucaagggauccaguguucuauucaggccucaaagggcccccucacaugcauggcauacacacaaagugugugugugugugugugugugugugugugugugugugugugugugugguauuuuuguuuuuaaagauuuauuuuguauuuuaugagugugugaauaucuugcuugcaugcaugugcaccaugugcaaacagugcccaggagacaauaaggggauaugagaucuccuggaacuagaauuacaggugguuguaagccaccauguaguugcugggaauugaacccucuauccuguguaagaacaggaagugcucuuauuucucguguguguguguguguguguguguguguguguguguguguauguguguguguguguuuguguuugugauauuuaaaaauaacaugauuucuaguuaaaggcucaguuugaggcagccuguucuuuuuauagagugaauuuuaggauagccagaacuacacagagaaacccugucuugaaaauccaaaagaaaaaaagaaaguaagaaaagcaaaacaaaaaucaucugaggggaauugcacuauuucuuagacauucuguacugaaaaacauuuguuuugauauggcuuguuugccaaauaagacaaauagccagcccugguaguguagauuacuugugaggcugaagcaggaagaugacaaggcuaaccugaacaacuuuaugagacauugucucaaaauaaaagucugagagauaagcugggaguauagcauuaguacaguguuuucaagguuguagguucagugcucuguacaaacaaacaccuaagaaauuaaaguaaaaagacuaagaaagaggugaaggugggugugaugguucacaccuuugaucccagcacuugggaggcugaggcaagaggaucucuguaaguuugacgucagcuuggucuacagaguuccaggacagccagggcuauggagagaaaaacccugucucaaaaaagaaaaaaaaagggggggggggagaaugagguuguccuaguuauauaguagagguuuaaaauaugacaggaaauaauagaauaagaaagguaaggauauaugcaaauuagaaaucaggcuuaggaguaaaaaguaggaaaagaaauaagcagaagcuaucuccuauagacacauuuagaaaugggagaugcuuaaggcacuugaguguucucucucauucucucucucucucauccucucucucucucucucucacacacacauacacuuuaauuuuauuauugucucuguguaugaagugugauguggaugcauugcucaccauacuuguggagacuggaauacaacuuuguggaguugauguucuuuccaccauggguuccagggauggcacucacaucaccaagcuguuagucuugcugagccagggcacugauaucuuuggcaguacuuuuacagaaucauagggauuuguuucugcuacuuccuacuuuugcuaguacauaucagagacaaagugaaauugagaagagaugggcaacagaauagaagccucggaaauuaguucuuucucuugcugggucuuuuguuuguuuguuuccugaacuuccugaaaguucuccuaacuguauuagaauauuucaguucuaaugcuaguguggcccugagaaccuaccuggggaaaucacagcaguuuuuuuuuuuucacuacagacauuuaggguacuuucuuuggaguuaaguuucuucuccuuuucauaaagguaaaacaacaugaaggguuuuguuugaagcaguaugucuuauaguuuguuuugaacuuguuauguaguugaggaugaccuugaacuaacugauuuccugucucuaucucccaaguucugggguuauaggccuaugcccccauaccuacuuuuaugugaugcuggggaacaaacuuaggccccugugcaggcuaagcacacauuguacugacuggccuaaauuuucagaacagaauaugaguucuuuggcuucguacauguguacuuacaguauuuugcuuaacuguauauagaaaauucugauuuugaauaaaauagaaauucgauuaauagucagacauacuaaauucuacagggcuaguuaggauguuaaacauuaaaauguuuuuuaacaauaugaaaaaacaaguugucuaucuauguaucuaucggucuauuuugagacagagucucuauauaucccugccugucuuaguacuuagucuugccuugaauucagaucuaacugccucugccucccaagugcuggaauuaaaggcaugcacuaccaugccuguccauagaggcauuauuauacaaguauguuuguuuuaaaguuucauuacagucaucucuauaaauuaauaagauaggacauguuuaaaugugcccuguggcagugacuguaaaccaaauguagguuuacgcuaacaaguugcuguucuguacaaugggguaaggaugagaagucuuggaacauguuguuucuguuuaccuuaacuaauuguguauauaugugggcaggugugccuuggaguacaugugaggaaguaagacaguaaccuaaagaaacuuacuugauaguuuguguugcuccauauugaaccaaaguccucauguuugcaugcucagcauguacuccaccacugagcugcacccuaggaauuaaucccuuuaaaaauaaaaugagcccggcagugaugcccaagcacuugggaggcagaggcaggcggauuucugaguuugaggccagccuggucuacagauugaguuccaggacagccagggcuacacagagaaacucugucuugaaaagaaaaaagaaaaacaacaacaacaacaaaaauaaauaaauaaauaaauaaaaugaagcaggcauuuaucgauacagaaugaguaaagucugacuacuagguuucucuguguuucauugauuaguagagcuauuuuuauauaguaaggcagcaaauuucuacuuguacuagucaguguacuuuuuauuuagggacacgcugacuuuaguacuaauaaacuacuuguauuuaagggcauacugauucuaauaguuauuuauaaauauugcuaagcuuaaauguuuuagcacaaaaauauccaacaagguauauaaauugucuaauauauacaugugugauguucuacaucauuaaugggaaauaauuaaauggaaauaaugaaaauuaccagaaacaacuuucacuuccaaggauggcugugaucaaaaagaugagccaagcauugugguacauacuuguagucccaguuacacagguaacugagguaggacgaucccuugagcccaggaguuugagccagcuugaauaacauaguaagaccuugucucaaagaaacagaaaaggacaacaacaacaacaaaagauucguuuggagauguauacacuacuggugguaguauaaaauuaagaagcaaccauuguaaagaaucugauuauuuccucaaaaaguuaaguaugcuggagagguggcucagugauuaagagcacucacuggcugcucuuucagaagacuugguuuguuucccaacacccacauggcagcucacuaucaucuguaacuccaguuaagggcauuugacacccucuuccgaccuccaagggcaccacgcacacauguagagcagacauauguugauagguaggaccucaacaccuguagagcaguaggcaaaacauuuguacaugugaaauaagaacaaaucuuuuuguuguuuuuuguuuguuuguuuugguuuugguuuuuaagacaggguuucucuguguaauucuggcugaccuggaacuuguagaccaggacaggagagaaguacaaaggaucaggaaauugaauagaaacauguagcagagggggauggggaacuggggguagccauuagaaaguuccagacuccagggaagugagaagcucccaggagccaauggugaugacuagcugaaauacccaacaaaggggagauacaaccuguagaggccaccuucaauagcuaggcagggccccuaguagagggauggggccacccaugcaucucaacauuuuuaacccagaaauguucuuguccaaaggaaagacagggacaaaaaaaauggaacagagaccaaagauaggcccuccagagaccaccccaccuagagauccaucccaucugcagacaccaaacccccacacuacugcugaugucaagaaguacuugcugacaggagccuaauaugacucuucccugagagguccuaccagcaccugacagaugcagauacucacagccaaccaucagacugagccugaggaccccaauggagagcuaggggaaggacugaaggaucugaaggggauugcagcuccauaagaagaacaauaguaacuaaccaaaccacccagagcucccagggacuaaaccaccaaccagagaguauacauggagagagccaggacuccauauguagcagaggaugccuuaucugaagucaucccucacauggggcaucagugggaggggaggaagcuugaugccccaugugggggguacugaggggugaggcaggagugggugaauggguagaagagcacccucauagaggcaaagggaaguggggaaggggcaugggaugggggaguugguggagugguaacugggaagggggauaucauuugaaauguagacaaauaaaaugauuauuaaaauaaucccccaaguaauaaauaggugaauuuuuuauauuauaugaauuauaucacugcauacauacaugcauaacguguuuaggaaaaguuaauaugaucaaaacaauaggauuuauauacucuuuuauagaaggcuagcucuaauaauuaaauauuaauuguggaauauaaauuaccuugacuguggaaauguagacugaugcagcugcuauguacaacaggcaguucaacugguuaagcauaaucucagauagucuaucuauucuacucgugguuacacaugagaacaggaauuuaaaguaaauauuuguauacuagcaacaauuuuuacaauaguuaaaagaugaaaaggaugggaauguagcucaguggccugccaaacauacaaaaacccuuaguucauucacucacacagaaggccugguaggguagcacaugccuguaaucucaguaggcuagaaaauuaauaggaguuugaagccaaucuguacuacauaaugagacuggcucaaaauuaaaaauaaagauggaaacaacugauaugugugaguacauguaauggcuaaacaaaguauguuccgugugagaauagucaagaaaagaaauuuugauucuucccacauugaaagcauagaaaguaagccaguaauggcauaugccuauaaacccagcacuuaggagguggacacaggaagaggaucagaaauucaagguuagcuuuggcuacauaguaaacuagagauaggcugggcuacaugagaucuugccccagaaaaccaaaacaaacaaaaaaaacauacaaagugaaacaagcuaaacaaaaagagacaaaguauggcuaaaaguuuuuuguuuuuuguuuuuguuuuuguuuuuauauuacugugaguugccuaaugccauugaauuguguacuuaaaaauggcuaugauaaacuuggcagugguggugcaugcccuuaaucccagcacaugggaggcagaggcaggccgauuucugaguuugaggccaaccuggucuacagaguaaauuccaagacagccagggcuauacagagaaacccugucuugaaaaacaaacaaacaaaagcuaagauaguauaaacuuaauacauauuuuaccauaauuuuuaagcuuuaaguaagucauacugguucucucucuuuuuucuuuucuuuucuuuuuuuuuuuuugagacugaguuucagauagcucaggcugaucucaaaaucacuauuuaugaggaugauuuuaagcuuuugauccuccuaacucuugccuccucacuucugggauugcagccaugagccuugguuacuguacuacauacuuaauaaucaaaacuaaaauuugagaagccagauagaugacuauaugaaaaauguaugaguagguauauuagccucauuuagauaggaugaaguaauguuuuucacuauuguaugguugauucauuuuguugauuuguagaaagcaaauguuuauauuuaauaaucgcaggaggauugugguugucuaauaaaugucacagaauuguggcagugagccagaaagaagaaaaucuacauuagugaagugagacauacuuuuguagcuauggaaaccucaagcucuaccgacucucacaaagguguucuugugcuuguauuuauaucauuaauuagacauugaugugguuaaugaggaccuuggauaauuguuaaauuaaauugagcuauaauuauauucauugaaggucuugguuaaagggcacuguugagugguuuaaugcuuguuuuauaugaacaguaacauuuuuguuuaauuuauacgagaucauuuuauaugaggauuuauaugaauuuuuguguuuuucagagacagggccucacuuuuuagcucaggcugacccuuuuaacucaagguccucauuagucucugagugcuaagauuacaagcuugugcuacuaugucugacauauauauacuuuuuacauuguacuaauaccuauauauauuuuuagguguauguacuuugcuuugagcauuggaaagaaaaguugaaucuauuuaaaggaaauauaauauugggaguaaguuauuuucaguuaauauuuuuaacagaagucuuuuaaaaauuaaagcuuaauuuuuagguuauaacaaaauuaagcucuuuuuugaugauuccuuuuuauuuuuuuaauguguacugcuauuuuguuugcauguaugucugugugggaguaucuccugaaacuggacaguuguuacagauaauugugaguugccauguagguucugggaauagaaccagggucuucuggaagaguagccagugcucauaaccugagccaucucuccagcccccaaauuaaaguuuuaaaugcuguuauguguaugcuuggaauugaaccuaaaaccuuagaugugcuaggcaaaugcuucuaccacuuaguucucagccccaagaaauuuuuguguagggggcaaaauauugcuaggaauugaacuuaggacuucuuguuuguuucuauuucuugguacuaugggcugcauuuagggcccugugccugcuaagcaggcugucuaccacugagcuauauccccauccuuguuuuguuuuuuggagacuguccuccugcuucagcuucuuaaguuuugcauuuuguuuuauugcagaaagacuacuuugaaaauuauaaaguauaaaaacuagaagagacaguauguaauccucucacacagaaauaaccauuguuaauauuuuuaugugauagguuauucuuaccuucauuucugcucauuaauggcuauauucugauuuagucucaaauaacugaauucucuuuuuuucauuuuuauuaguuauuuuauuuauuuacauuuuaaauguuaucccaguuuuaccuccacauaaccccuauccccuacccccugccucuauggggcucccccacccaccacccacuccuaccucaccgcccuagcauuccccuacacuggggcaucaagccuucacaggaccaagggccucuucucccauugaugccauauaagguaauccucugcuacauaugcagcuggagccaugggucccuccauguguacucuuuaguuggugguuuaguccuugagaucucuagggagucagguugguugauauuuuuuguucuuccuaugggguugcaaaccccuucagcuccuucaguccuuccccuaacuccuccauuagaaccccugggcucacuccaaugguuggcugcgugcaucugcaucuguauuggucaggcucuggcagagccucucaggagaaagcuauaccaggcuucugucagcaagcacuucuuggcaucaguaauagugucuggguuuggugucugcagauaggauguaucccuagguggggcagucucuggauggccuuuucuuucagucucugcuccauucuuuaucccuucauuuucuuuuucaguagaaauucuggauuaauauuuuugaagugggugggcagccccaucccucaaaauaauugaauucuagaagcuggguuuuuuuuuuccuucuuuguacauuugaacauucuuuagguuauaaauggagcauaauuuaacuguacuuuuugcuaaaaggaagauauuuauuauagaucuuuagauaugcuaggcaugcuagcauauaccuuuaauccuagcauuugggaggcagaagcaggcagaucucugaguuugaugcuagcuuggucuauaagaaggccaaccagagcugcauauugagaccuuguuucaguauagaaccaaacagucuuuaggcaauaugaaaauacuaagaaaaaaguaaaaauuucuuuucaaauauauuauguguguguguguguguguguguguauuacauaaauaggacucuugauuuauuuuugagacaggaucuuguauuguccuugcuggguuguauucacuguguagaccagguugaacuugaacuuguggugacccuccugccucugccucccaaguacugggauaguggcugagcucugcuauaucuauuuauuuuauauuugauuacaugugagaaguggagguacaugaauguguguacaggugucacugggggccagaaggggaaaucagauccccuaagguuguaguuaacaugguuaugagaugcccagccuggguauugggaaaugaaguugguucucugauagagcuguacauaguucaaguacuuuuaaccugcgagucaucuuuucagcccuagauuuuuuuuuuggaauaauuuuacacuguuuauagccugcuuuacuuaauaguuuguuacagaguggacauuugaugugguccaaaucuguguuuuuaaugacuaaucuaucaugauaugauuugagucauuauuuaucacucuugcauugaugacauuuacauuuaggguguuuccaguucucuuuucauaaacaguacuguagagaacaauuuuacacauguauuuaacuguauuuauaaauggcuagaacugaucauauagguuugaaauacagcugcucagaagacugaagcaguagaauuuaaaguuuaaggcuagcugggcaaacauugaguucccugacagccucagcuguugagugaaaccauugaacaaaacaaaacaaaaaggaaaagaaaauuccagguucaaauauauauuuuucuagaucuauuuuugccuauaccaaacuaagguuuugauauaauuugagauuuguauauauguguacuuccuaaauaugaaugcauggaauaacugacaaauguugguuauuuuauugaucaacuuuuaaaauuaugaccuuugccuaguccucucuucccauguuauaguaaaauaucugaggagggagcugaaaugaaaugauguuugccaaauagauacuugacucaacacuuguauuaugggcacagcuucugagaacuacugugcaugccaccuuuccuuucacuuguuauucugagacagccuuagcagauuguccaggcuccucuagaauucacucugugaccuagucaagcuuuaaacuuuugaauacuccuguuuccaccacuauaguauccaggauucuauuaaugacacuaguaauucugagaauacaagagugguuugauccuaaacugucuaguauguagaaucagaaauaaggaugagauaagaugguaaacugauauaaguucauuauuagaagaaaaugcaccauuaaauuauauguauggguguuuugccugcauauauauauggugccugcaggaggccagaagagggcuucagauccucuggaacuagacuuacagaugauuauaagcuaccagggugcugaaaauugaaccuagguccucuggaaaaaacaauuaaauacucuuuaauuacugagccaucuuucuaauccucgagauauuacauuuuguauagugaaagaacacaagcuuuccaagcuucaugauucaugccuauaaucccaguagaggcaagaaaauugggaguucaagguuauccucagcuacauagucaguuugagagcagccugaguuguaugaaacuuagucacaaauaaaaugcucugaaaaguaaagucauuauuguuguuguuauuguuauauuacuauguauaugauggcagggggcaccugugccauggcacagauauggaagucagaagacaauauuuuaaaaucagcuccuuccuucucuuauguuucaucuggggaucaaacugaagucaaaaauuuuuauuguaaccuagucccucauuagagccauuuuuuuucuuucuagaugcugauuuuagcuauaauuaauggaguacugaauuuacuucagucuucuaguuguucauuaaccuauuuguacuugacuacuuuagcaaauucacagaaauuuaucacuuguuaguugaaacugccaagaacuggaaucugguugcuaguguaucuugccaaaugaauugauuugagaaaaguuacuuuguauuaacaaguaggauuguuuaguuuaagacuucuuuuuuucuuuucuacucauaacucuuuaggccuaagaaaguuuuauaugacucuauagguauaugaagucaauauacagaucuaacauuuacugcuaauaaaucaauagauuuauuuuaaaaaauuauuugguauauguauauguaauuuuacuguuuauuaaauacaaaagaaaauuugcauauuaaugagaugaauguuauuaucuuugcauaagaguuaaauuuuggcugaauuuugauaccacagaguguagagcacauucaguguuuuuucagagcugauugauauuuugauuuuguaaucuucaaugcaagaauacaccuuggcauaauacauaguacaaaauaguaaaacuauguuuaguaccauuucaaaaauaguuggaaauugucuuaaucucaagcuaaaagucauuuaaugacuuuuuaccugauguucaaaucaaacuuaauuuuagggaaauauaguuaauaccucugucuuuuuuuuuuuuuuuuccucucaaauuuuauuuguuuguuugguuugguuuuuuugagacaggguuucucuguguaguccugcuguccugguagaucaggcuggccuugaacucagagauccacuagccucugccucccuagugcugggcuaaagguaugugcuuccauacccagcauuuucaccuuuuuguuguuguuaagauuuaaaaauuuuaauuuuauuuauguguguguguuugccugucuguuuguagguaugugcacauguguauuguauguaugucuauagagaccagagaugccagguccuucuggaacuagaauaauaggucugacauaagugcuagcaaccaaauuucaguccucuggaagagcaauacauacuaucuuuccagccccaaggacacuuuuuuagagauuuauuuuuauuauuucuguguaugugucugugugaauguauguccauaugugugugcagguguccauggggaccaaagaggacacuagcuauagagugguccuuuacaacugggauuacaggcaguugagagccacccaacauggaugcugggaacuuaacucuaguccucugcagagcagugaggggacuuaacugcugaauaaucucuucagcuccaauauaauuuuacuuuaaaaaauugaauuaacaauuaauggauuuucuacagauaacugagcaagucucuuuaccaucuacauacacauacuuuuuaaaaaaguuuucuuaaacguauccugcuuuaauacauuuuaaagcaagucuaggcugggagugguagucacaccuuuacaccuuuagguacagcacuuuggaagcagagacaggaagauaucccugugaguauaggaucucugugagugugagguuagccuggucugcaaagccaguucuaggcuauccagagcuaucuaguacgguccugucuuuaaaagaaaaaaggagggcuggaaagauggcucagcaguuaagagcacugacugcucuuuccagagguccugaguucaauucccagcaaccacaugguggcucacaaccaucuguaauggggucugaugcccucuucuggugugucugaaaacagcuacauacucaucauauauauaaaauaaauaaauaaaaucuuuaaaaauaaauaaauaaguaaguaaaagaaaaaagggaaaagaaaagaaagaagaaagagcuggaugguggaggcagaggcagguggaucucugaguucaaggccagcuuggucuauuaagcaaguuacgggacuacucagagaagcccugucuuuaaaaacaaauaaauaaaaaacaaugaaugaaugaaugaaugaaugaaugaaugaaaaggaaaaaagaaaaaauguaacuuccgcuaagauuauuuacugaaucucucccuccucgcucccucuacacacaaacacauuuauauaguguaaaaacaugcaucgcauauaugagguucugaguucaggcuuaguuaacaagaggcagauaacacagacaacuuaccuguacuaaagccucugugaagaguucugacaagaagccccugagggaaaauagaaagauucaagaucaguaguauuuguugggguaaaggaauugaucaaaagaauaacaaagaaaagauagggcaggaugaguggcacaggauuauucuaauccagacucuggaguuagaggcaugaggaucccaagcguaauaguuaacuagucuauagaguuagcaaggacaaucuuggguaaaguaagcccggagagagaaggggggagggguagagagagagagagaucaaccugggaguauaucuuuuuuuuaaagauuuauuuuauuuguuuuauguauaugaauacaugguagcugucuucagaagaucccauuauuacagaugguugugagccaccaugugguugcugggaauugaacucaggaccucuggaagagcagucaguggucuuaaccacugagccaucucuccugcccccuggaaauauaccuuauugauagaaugugcuuagugauaaauuagcuuagaauuuagcauguacaaagugcuaaauucaacucuuggugucagcaaacagauaaacaaauauaagaaaguuuuggcacccaagggaaaaacaaggauuugagauuuagaguuggugcuucuccugaauuuaaagggacagguaauaucaugcauggguaugcucacuuuuaaucccacugagguagauguagauggaucuuugugagcuugaggccagccuggucuacauagugaguuaaggccaaccagaguuacacagugagacugucucaaaaaauggauggaugauaaagggauagagauaaggauaaagaacuuugagaauucaugaccauggagaaaugaacauccaagagugacagacacagggggaguggcuuucaaagaaccacugugaggaauugcuaggaaagcugacaagaugacaaagaauaccuuuuuauaaaaggcuucuagguugcuuggaggaagguuaugaguucauagaaguucuagucuauaagcuuugcuuuuucugcaucaaaacguugaagcuguggauuuaggaaugcagaaggugaacaguuaguuuuucaggauugggcauuauuaacaagaugaaaagcaguauggacagaauaaaggaguauguucuaggacacaagcuuauauuucaucuuacccucaguuguugccuucccuaccuuucucuaccuccuuuccuuuuucugcaugugauggggacugguucuuguuuugcuuugcuuuuuugcaacagucugaugaccuuggauuugugauccuugugcuucacaacugcuccaccuccaugauguuggccacuauccccaguguauguguucuuuuggaauaaacccaggcuucauguguguuaaacaagcacucuuucaacugagcuacuugccagccugccuccccuaucccuuucauccaccuuucucuuuucugacaguuuuuccacuguaggcuaagggggcuucagaaucgugguaguuuucuugccuuagcuccuacaaacuugucaguaagagauuaguuagcuaaaauagcuaauaauaaaagaacaauuaaaaauauacuguuaauauaguaaaaucaccauuguuacuauucuuacccauuggaaccauuaauaaguagaauaaggguuccuugguuuccugaauaguuaggauuccaaucacaugguagguugauuguguuuucuuaaaugaaguuuuucuuuuugguaucucaggcuuuuucuuacuagcugguacuuuucuuuauauugucaaguauauacaaaguauaugcaaucuuuuuucaccaaguagaauaccuuucaucuguagccuugucuucucaaguauccuuuuccuucucuuuggaaagguuauagaauaguuguuuuguuucaacuuacccuucaguaaggguauuauuuccucaguuccacuuggacuucagcucugcuuuuuggcuucugucucagucuuucccuucugcagcaaaaguaacaggaaguaccuuuuuccacaucaaauaaguggauucuuucagcuuuuuucuuccuugagcugagacauuuucacaguuuaaagucuucaacauucuucuuucugacacuuuuuaucugugauacuuauauugagacagaaucuccguagcccuggcucuccugaaacuuauauagaacaggcugaccucgaacucacaaagauccaccuuccucucucugccuccugaaugcuggaauuaaaguucugugccaccaaugacuuucccaccccuauagcuuuucccauucauaccugucuacauauuuaaaaauuuuuaaauuuauuuugugugguacaugauauagguauauggagguguguguaccacaaugcccaugugaaagucagagaaaaacucuguggaguaaguuuccuuccaucuuuguguugguuucaggaaucaaauucaggucaccagguuuggcagggugccugugaaauuaucuuuccuuaccgccuuuucuuauguaccauuagcaagcuacgucuucccagucuauuuucuuauuaaugcacuuauaaaagggguaccuaagcaccacaccuuuguugagacaguguggaugagacugaccuagccacugcccgcaugauguguguagucuaauaaauacauagaaguaaacuggaaguuauuaaagugccauaaguaucaugguaagagaaauagaacuaaguaaugaaauugaagugaauuugacaugguggcacauaccucuaauaucagcacacugggaugcagaaagauuaacacaaguuggaggucaguguagccaaaaaaaugagccuugccuacacagugagacugucaaagauugagguggucagggagaaccacuuggaaggaaugauucaguuuaaaggggauauaggagggaaaaauguauuucaagcaaaaaugaaacauuugcaaaauuaagaauacauggaugaagaauugaaaaucauuguaucuuggggaguagagggaaagaugaaaauggaaagaaaaggacaggcaucguaaguaaauauucaacaaauauuuaauugguacucaugauacuguacagcuauauugucaacuaauuauagaauuuaauagcccaaucuuuacuguuguuaggagcaaucagagcaagguuuuagugacuugaguuccuuauuuugccuaaugcucuaugauugccuccuccccuccuucccuccuccccucccuuccuuccauucuuccuuuuuguaccuagccuccacuucccuauguagucaugaugacuugaaacucauguuuuuccuaucuucccacucaugugcuggguuuauuauuuuaaacaauucuucuuuuuuuaaaucugugauugucuacgugauauucuuuuauauguauguccugucccaguauaggagcuaguuuaaugguguuuaagcuauauucuaucagauuacagaugagaguaagaacaagaugacacauuuugaaauaugcugaauguggcaaacaaagaaaugaauguuuugccugaaugucugucuguguaccauauguaguaccugguaccugcagaagccagaauauaaucaaauucauuuuuauuugugugugugugugugugugcgcgcgcgcgcgcgcgcgcgugugcaugcaugcacgcacaugaauauauauguauuugcaucaaaggugugcaaguauccaugggugccagcacacggcaucugauccucuggaacuggaguuauagguggcuauaagcuuccugauggugggugcagggaacugaaccuguguugucugcaagaccagcaagugaucuuaagcauugagccaucuuuugaacaccacuuuucuucuuucacuaaaacuuuaauacauuuuucuacccaaguauuugauuuuguaagauuugguuuuaagcagauauucugacaaaggaugaaagaacaauguaagggcuucuuuauuuuuauuuuuuuuuuguggucauauuuguauaugugggagcaggggacagaaggcaacauucagggucauccucaggagcugucuuguuucuugaaacaggcucccucaccaggaccuggggcuuacugauuuuguuaggcuaucuggucaguaaagcugcaguggaucugccuucuuugcuuuuccagaguugagauuacaguuguaugccaccacaccugaccuuuuccaugagugcuagauauccaauuugagucaaggugcuuguucauuaaacacuuuaguaagugaacuaccucucuagacuguagauuauuuuugauggucagauguccaaauucagagauacuuaaauuugcuuccuuugauucauugauuucuuuuagacuaguuuucucucaucauguagcuuagguuggcuucuuugaucuuaauaguuuguuaacuuggucagucuccauguuauuagucacugccacuaccuccuuuucccuucuaacacauuauccagcuugaacauuguguuuucuuuuuuuuuuuuuuuuuuuugguuuuugcgagacaggguuucucuguauagcccuggcuguccuggaacucacuuuguagaccaggcuggccucgaacucagaaaucugccugccucugcaucccgagugcugggauuaaagaugugcgccaccacgcccggcccuacauuguguuuucuaauauggaugcucuuaaagcucagagcaaaccuccugcucaccugugggugucauucaaucuuacuuuuauucuuauuucucacuuuggacagcccuuuuaggcauauagccaaucucugguaaucccacaugugcugcacuucuuacacagaugcccuccucauucugcucaggaucuauagucuuagauaaaugcuucuauaacugcacauauuauagcuccaugcuacauuuuacugcucucacacaggcauaaucuucauagcucucaauacuuagucuugagcaacuuucucuguagguaucuuuauuacuauuuaggcucuggugcuguauguaaggugccuccaacauucauacuuccuauugcuguucuaucucugauauccaugcugcuuuucacacucauucccucauguauccuucucaugcugcuuaggcauuuacuuuacuaccugggcugaacuauccacuuauaugucaauucccaguagguauuggaguccaauguccauuugaaucaucuauaaagauucauucugcuugggucuuaccccaccccccacuacacacacuauccucuuacacagacauugcuucauauuacacagucucuguaccuggauaucuuuccucuccuuuccccucaguuguccuuucuucuucuagcuuaggcuuugaaaccacaaggaucuauccucccauagauacccuccucucccuacuaaguuucugauaucuuuucugggucaucugacccuuuuuuuauuucugcuucaccuugguuugguuuuauuguuuguuugguggcaggguuguucuuuucugaggcaaagucuugccacauagcaguccugacuuagcauccuugauuuccugccucagcuagcugaauguuggaauuauaggcauucacuaccuaaugcgcaguucauaguuugaacaaucuuacaaaguaucuauacaagacuucuagaaauuauaacuaagccuuaaauguuucauaagucauuuuaugacuuuauuaauuaagaguuuuguuucuucugguacaaacuuaaguuaaaaaaaaauaauaugggggcuggagagauggcucaaugguuaagagcacugauugcucuucuaaagguccugaguucaaaucucagcaaccacaugguggcucacaaccauccggaacaagaucuggcgcccuuuucuggagugucugacgacaacuacaguguacuuacauauaauaaauaaaucuuuaaaaaaauaaaauaauaauauaaaggguccuggugacuugugauuggugaagugcuuuccacacaagcauaaagaccuaaguuugaucuucagcauaaaaagcugggugugcuagcauguaccuguaauccuaguaaccucaugcaggcagagaagguagauucuugagauucacucgcuaaccagccuaguggaaugggaacuucagauuaaaugagugaaagaugaaggagucaacuagaucgcucagccuauaaacaccaagccugauaaccugaguuuaauccucagaacucacaagauaggagauaacggagauaacugauucacaaaaauuguucucugacuuucacacacucaucaagauguguccacacauacacacaaaguaaaugaauguaauaaauaaaaaucaaaauggagagcaaaugaaggcacacaacauugaccucuuccuccacaaguucauagacacaugugaauacauacaaccucuccccuaccugcccuacugccacuuagcaaaacacacaaaauaauagauuuaaaguguaggugagguuuuuucuuuuugucuuuuuaguuuuuuggcacaguuuucuagcccaggcuggcuuugaacucccugaguagucaaggaugaucuugaacuccugucuccugcaucuacuucuagagugcuggaauuaacaggagugucaccaggccagguuuauacugcuuuggggauugacuguacccuaggcaauugcucuaccaacugagcuauauccccuauccuaaaauaacagauaauuaaagaacuggcuaaugucuauggaacucauuaguuuucuaaccccgccccucccaauugguauaaaguguacucuuguauauuaucuaaauauguuauaacacuaguauguuuguaaaaguaauaugaauaaauacauauuugauagcaaauuaguaaauugccuuauacuuaaaaaccaagaaaaauuuguuaaaacagaguaucaccuaccaguuauucuuggacucuauaaucuuugagaaacaaaauauccacuggaccuguagccaguacauuuuuuccaguggagaugccaaauaugaugacuaucaagggugaaguguuucuuguuuuuaaacaaaaugaaugcuaacucuucaguguagaacuguguuggcacacuggagauguuaggacuuugucauagagugauaaaaggaaaccuuagcuuggagcuucaccuuuuuacugagcucagcagugaauggaggaggggaagaauaagacaaagacuuccuaagcauuuuuugauugggggggggguguuaaagcaacuuucuaugcuuaaugguaguuucauauuuacaaagauggcagauguuauuuuauuuucauauuuaaagugaaaggguuuacaaguagguuuuuuucaguguguuaucuauaccugaugauugggcauuugagggauaaucaaagaacuucuacugugagaauuucuguuauuuguauaauaguaccugcuuggggcauuaauucaugcuuuuuugcuuuuggggaggaguguucuuuuuuuguuuuguuuuuguuuguuuguuuuucaaggcagggucucuguguagccuuggcuaucuuagacuagcccuguagaccaggacagccucgaaaucauagagaucugucugccucugcuuccugagugcugggauuaaaggcguguaccaccacugccuggcuuugcuuugcuacauuuuuaaguacauuaaaauuuuuauguguaugguguuuuugccugcauguauguauguacacaugucuccugguuccugaagaagccagaagagagcauuggguccucuagaacuggaguuauaacuguugugagcugucauggggugcuggaaauugaaccuugguccucuguaagaacagccauuacucuuaccuauugaggcaucuuucuuggucauauuuuuaaaguauucucaacacaaaguaucauccaucuuugcuuggcaugguagugugcaccuuuaaugcgagcauucuggaggcagauggauuuugaugaggucaaggccauacuggucuauauagccaguucuaagauagcaagaacuacacaacagggagacuaauguuuuaagacagauuuucacuuuguagcccuagcucuccugaacuugcuauacagaccagggugauauuuaacucacagagaucucccugcuuuuccauccuuucuaccacaaguguuuuuguuuaguugcuugcucaacaauuaaacaaaaaugcuugugugugugcgugugugugugaaugcccuucuaaccagaaacauuucacaaaaacuguuucccccgcuguuuucauuucuucauagauauaaaucaauauuaguucuuucaacuugauuaccugaaaguaaaucagagauucuugagaaaaguuacaaagaaaauaaacuuucuaacaauuuuggaguuuaaucuaaccccaaaguaguugaauucccuaagucaauaaagguaaagacuaauaauccaaagaggaauaaucuaguucugugcuccauccucacguacaaccuuuauuguguguauuuauucaauacggucuccugaaaagaacacaaaugagucgacugauccaguuugguauuuuauuaucuaucuaucuaucuaucuaucuaucuaucuaucuaucuaucuaucuaucuaucugguuccuuuguccuaucuccgcauuucuuuuuuuuuaaaagauuuuuauuuauuuauuauauguaaguacacuguagcugucuucagaucucauuaccggugguugugagccaccaugugguugcugggauuugaacucaggaccuccggaagagcagucagcgcucuuaaccgcugagccaucucaccagccuuccuaucuccauauuucuuguuuuuguuuuguuuuguuuuuugguuuuaguuuggcuugguuuuugguuuuucgagacaggguuuuucuguguagcccuggcuguccuggaacucacucuguagaccaggcuggccuuguacucagagauccaccugccuuugccuucuaagcgcugggcuuaauaugugcacuccaguagccaccacugcugccuggcuaaucuguuauuauccagcugugguuugucuuucuagacucaacuagagaccggggauauagggcuuggaagacuugucuuuuucugaaaugaguaaugaccaacuaaagcuguagacaaugguacuuagagcacagaaugcccaccuaggaaggggaaagaaacucaguucacaguagccacaaggugguucacaacuaucucuaacucuaguuccagggaauccagugccuucuucugauuuuagugggcucuuguauucacaugguacacauacacacacuuaggcuugcucaugaguacacacacacacacacacacacucacacacacacacaccauuuuacaaaccacaguuucagccaggcaugaugguccaugccuuugauaccagcacuugagagacagaggcagguggaucucugugaguucaagguaaccguggucuaaaaagugaguuccaggacacccaaggcuauauagagcaauacugucucaauaaacaaacaaacaaacaaacaguuuuucuuucccucuuacuguguaugccucuggguaagauuucuauuuugagcuuguuaugcacuguggugaaacuucuucaaccccuucauagcagcacugaagaauaaagaacugaauugacccagaaauaaucuguaacuaaaguggaucaauuaaaauuuguagaacaggaccaagcagacaagccagccagcucauuuugacauuguugucuuuguaacuagagacauuauuuugaguaccugaaaaugcugauuucauuccuucuuuuccaguuagucugggcccuuacaucaaauucuuagucuucugaauaugcuccccaaucugcucauuuucuuuccuugugcucugguaccagucaugugacuggagggaccuuuugucuuuacuuugauagaaaucuuaaguagguaaggagaagcacuuugugugcugagcuuugaugucccuauguuuugacagcagugagguggcagcaagcaagccaaagcaaugguauuuggcgcccucuaguguuauagcuccugugcagacuucagauggaggaggugagggagcagauagaggugggaggcugaaggagaggaaggggaaacugugacugggauguaauauaugagacaacaaauuaauuuaacaaaaggauuauauaauaaaagaacaaauacuggcuaauagggauucacaaccuucaugaugcaguuauuuuugggagaauaaaauucucaaaagaaagaacauacucauuucuuguacauguuauugacugacuuucuuucaaaaauuuuuuccucccuacagaaucugucuaugaucuucucccaaaggaguuacaguuaccuccaccuagagaaacaucuguagcaucaaugagucagacaagcgguggugaggcaggcucgccuccuccagcuguaguugcugcugguaugcauuucauuuuacuucauuaaugaaaacuaggguacuaucuggccaacaugaacaguauuggaaaaguuuauaucaaaaagaguaugauuugaggguuuuagacaggucuaaagacuuuacccuuuacguugaaagguuuucgguguguuuuuuuuuuuuuuuaauauacauacguguauauauauguauguaucuuaaacuuuaguccauuuguaaaugcugucuccuaaaguggaccuggucuucaaauaugagacccaguuuaaagugacuuuguugagugcucauaaaacaaauaaacaccaagcuauggcuaaaaaaauuauauuugaccuuuuauuuaacaauuuuuaaaaagaaauauuuacuuauuuuauguauaugaguacacuguagaugucuucagacacaccagaagagagcauuggaucccauuacagaugguugugagccaucaugugguuacugggaauugaacuuaggaccucuggaagagcagucagugcucuuaacugcuauuucuccagcccuuaacaaauauuuuuaaagauuugcccaaagggaaaaauauuauaugaucuaaaaaaggacucaagcugucaagucuuuuuucucuuuauagcauguaacuaugaccuuuuuccuauaauuaaaaaauaaauaaauguggcacagccagagcuacauagugauaugauacacacacacacauacauacaugcacacaaauguguguauguauguguauguauguauauauauauauauacccugauauuuauuuuaaauucaagaaaaauaguguccuaguugaauauaauuuuuaugaaauauauucucuguagucucuuguaacaaugaaacauauuaaaaauaauguuugaaauuuacuaguuuauuuucacucagcucucaaaucauacacuuugugaauacauuaaauugguucaaacuuuuacuuugaauuagaauuaaaaaauugacaaacuaauaaagucuugauugguaauaauuuaguaugaaugcuugcccaacuauagcaccuuuuuuuaaaguugggauuauagguuucuaaauguauuugcuuuagaaaaaugaauacauuaugucuacuuuuaugaaguuuuaucuguccuauaaagguuucuugccucaugauacuuaucaucuuuuaaaaugguauuuaaaguccaucaaaacaucauuuccaguaaguucuuuuaauuucaccaagagaaggcuguagucuaaaugacaguauuaguacuguguucuagcugcagguguuuaauuucuuauauacauuaaucuguaugucauuaacagugcugaaaagugaaguaugaagccuucaugcuugagggcaggaaaauuuuaaacauaucaaagaaauauuggccccccucacuguucauguguggccagacauuuucuaacagcuucuguggauuuaacugugaauuagugagcuuuuuauaaucaaauugauaugaugaucuggcucaccucagaucuaccagauucuaaaguggcucugaauaucuuuggggaauuugaagcuuuaaaucuaguuuuaaaagacugaaucguauauaaaauagaaaauauuuugaagaaguauuguuucacuuuaaauccacauguagaaauugacuaacugauuccuuuuguguuuugagauuguuucuguaaggacauguugaaucuacauagaacuacaagucuguuucuucugugcuuuuuaacaucuguuuacaguagauccaguuccuuuuaaaagcugaaaaaaauaauagcuaaguuuagaaaaaguacaugucccuuuaaauaauaccacauuuuaguaguucuuauguauaaauauuuaaaguccuugauuuggggucacuaaugaaaaguuuucucuuccuguauaguugagaaagucuuuacagguaauuacauuaaaagcuaugaauugaaauaugaaaauagaaaauuugaccaaaggaaauacucuaaacuaucuauauauguacauaaauguauuuauauuuguggcucugaggauugaacucauggccucauacaugauaggcagguaggugcucuaccaccaagacacaucugcaucccaguaaagucuuauuaucuugaaaucauugacauaaaaauagugaagagaguaaaaagacaacuuuuaaagcuuucuucucacagaaaguuucugugauucuuguaauuaauaaucuuuuaauuuacauauuuacuuuuuaguaaccaacauaguuuauucuauuuuccaaugucuuauuaauagaaaagaccccuuuaauguacaccuuuacagauaagaguuuaauuuacagaguaauaauuguaagggcaucagaauguaucauuggagucacauuuuuauuaucagauugauagccuuggugauacaacuaucaaaagaaaaacugggaguauuuuaucaaguuuggcuucuggucaaaagcuugguagcuagggaaaugcacauuaauuuaaauaucugauguuuuuuaaaaacaaaaaucuguagcauuugcuguuuacaugugaaaugcauaaaaaugaugacuguugauauaguuaauucuucagcgcuuugaaggagcuggauuggcugcugucagguaggagggccugguggggacagacuucuaguucugccauaaagguuugugucacagauuuuaaaucaguuuaaaguuuuuaaaaaacaauuuagagacugggaauauguauguucaugacauucuuuguuauuuaauuauuaaaaaugcauuucucaaauucaccaaaguaguuuuuccuccuccugccucgcauauuacugagggcauaaaucagugugaugccgcugauccacaauccagaauccuggguaauaggauguuucucagccccuuguagaucguuaggauuuugauuuuuauacuauuauaccuuuacauacucucucugcucugugaguucaaagguuaggauagagaaagaugagggcaggagacacaguuucucuuggguaugaagacaaggucagacagagccuuucauuaguuuaaaauuuguccaccuuuguauuuuuaagaauucucuugggaagauauuaagaauuuaaauucaguaugucaguggaugauagauucagaaauaagaacuuuuaaaacaguguucuaggcucuguaaauagcuaugacagaggccauuuucuuaaagaaaaaaaagucaaugaauuaauaguauuagcaaaaugaggaguugaccaagagaaaugaaaguuacagcaaucaaauauuuuaguuacauguuuacaguuuuuaauccugagauuuacuuguuuacaguaauaaaucuuucauggagaugaguguuaaucuauauugucuauacuaugccagguaguauacuuauaauaccagcauuugagaaguugggagauuaguaguucagagucaaccucugcuacauagugaauuugaagccagcaugagcuacaugagacccugucccuugccccaaaaaauuaauuugcaaauuaauuuguuugauuuuauuuggggauauuugauuggcauuauaucucuuagauuauauuugggauaaauugucuucaaacuccagagguuccuccugccuuugccuuuaggaugcuggaauuaaaguagguaugugccuucuauccugugaauaguucauuguuuagcucaagaauuuaaguuaaaaaaucuauagaaucuaugccugccugcaaggaugacugcuaguuugagggcagccuagguuacuuaagagugucuugccgggcagugguggcacacgccuuuaaucccagcacucgggaggcagaggcaggcagauuucugaguuugaggccagccuggucuacaaagugaguuucaggacagccagggcuauacagagaaacccugucucgaaaaaaaaaaaaaaaaaaaagagugucuuuaucucaaaaaacaaacaaacaaaaauaacaacaaaaaaaagguaaccaaagaauugauuaaacuauagguuuuauaauucaguggaagagacuuaauaaccaguauacaauucauuguuuucauaaaauuaguacuuuacuuugaauaauuaaguuaguauuuauuuuguauguguguguacaggaucuuuguagcccaagcaggcuucaaauucucuguauagacaagccuagcuuggccagauccucuugcaucuggcucucaaguucuggaaguacaaguuugucuuuuuuagaagcaauauagccucaguacacuaauaccuaaggcaucuuuuuaaaacauguauagguagcuauacucauaaagcaaauacaauagaaucuguugaggcacagggagaugguaaagugcuugaaaaccugaguucagauuugcagaacccauggugcagugguacauuucuguagcccuggcccugggcuaugaaaagacagguagauuucucagagguuccuuauccagccaguguagucaaaaacagcaaguuucagguucagguuuaaaaaaaaaaaaaaucucaaaaaaauaauaagauaaagugauugaggaagauaauccuaaugucaguggcuguucucuauacacucccacacgagugaauaccuuccccacccccaguacaucauacauauacgguccuuaauaaaggacuguauuuuuuuuauuuuuguauuuuaaauucucuugcuuuauggguuuuuacucaugaucaguuuugaagaggccuacccauuccccaaguuucuugacaucaaccuuaauuagguuuauuugguucuaaguauaaagagccuucaccaauuuggcauacauggguucaucaaaguuguauguuagcaugcagaaguuggcuuuggcucuugucuaaggcuuuaaaagcuuugacaaaucaugcucuuguagaugaggaacagcagucuugagcugcucuggugaagcaaugcuaacauccaucacauauccagccacacugccuuccucagccacaguggggagcugaugaggaagcagaguuuugaaugugauaaggcagugucauggaacgggccagaguauguguaauuuaaguuuguaauuuuguauaacagcuacaauauagacuuuguuuuguuuugguuuuuuuuugaaagaaccuuacuagauagugcuuugaauucuguacuauggcauuuaauaaauuucaaguagccaacacauguuuccuacacugaagcaaccugucgcgugaguguugccuaugcuauaggaaaggacaauagaaaaucaaaggucuguaaucagagaacagcuaugcuuuaauuaauucacuuuagaccuaucuaaauuaaaaccguaggaauuugggcagugauaaggcaugucuuuauggauaucugaguuugaggccagccuggucaaaacaaaaucugucucaggaauuuguuuaauuagccaucugacauuuuggcauaaaccuguaauugggaggcagagauaggagaaucucaaauuuaaggccagcugacauguaauucagugguccaauuuauaccuaacauuuacauguaucugagaucaauauucaguauuaaaaauaaagaaaacagaacaauagaaagacauaggaaugagguggaaaaacauguuagaauuguacugaacaauguguauaucauugaauguaauuacaucucaauccuuccagcuucaauuaccuuuuacuuucuuaaugagguuauuuuacucuuugauguaugcuaggacagaguuucuuaagcuuuuuucacucauagccaugauagacugaagagauuuuuuuuuacucaaccuuaaauagauacaugaauaaauuauauauacuaaguacaaauauuuacugauuacaacucaaauuuauuuuaaggcuauuuuauauuuuaguucaguagagggcuuauuuaguaugcucaaagcccuagguuuaauccccuguaucgcauaaacugggccuaguggcauauuccuguaaucucacaguuuuggagguggaggucagggaauuagauauucaaggucacccuugucacacagugaguuugaggcuaguuugggcuaugauaagacaucucugucuuuuaaaaagauaugauaggggccgggcaugguggcgcacgccuuuagucccagcacucgggaggcagaggcaggcggauuucugaguucgaggccagccuggucuacaaagugagguccaagacagccagggcuauacagagaaacccugucuugaaaaaccaaaaaaaaaaaaaaaagauaugauaguuuugcaaaguugauugaacaguuaaaaaacguuuuuaaacuauguuuuauucauagaacuagcaaccucuguuucagaauuuuuaaaaauuauuuauuuuaugaauugaguacacuguagcugccuucagacauaccagaagaaggcaucggaucccauuacagaugguugugauccaccauguaguugcuggaauugaacucgggaccucuggaagagcagucagugcuuuuaaaccacugagucaucucacuagucccucagcauuaauuauugagauaggucuuacuauggaucuuaggcuagccuuguacucacagaggucugcaugucuuugucucuugaacucuuuacuccaguuguuuuguugagacccuuucacacuauuucaggcuggucuagaacucacuauguagccuaggcagggauuuaacucauagcagucuuccugcuucagccucuaaaaugcugguauuauaggaaucgaccaccacaccguguugauuacuuuuuaaagggguauauaaggaaguauguagcuauugaugugacagagaaauuaaagauagggaugucuggggggguguuguuuuugcuuuguucagauuuguucagaauaugucuccuacuucuuaauauuuggguaaaggcacagccuaaaauuuaaaaacagccauaaaacaaacacauaaaaaaagaguauucuggcuuauggauuagauugcauuuauaaacaguaaaauaaauuggugaauaugaguuaaccaaagcuuugaguaaaaaauuuuuuacaugcauuuaucuguuaauaauuaaauuuuuaaagcuuacauugauuauuguagcauguaaacuuauuuugggugggaaaaguacauucgggaaguugaaacuguuuuaaacauguaaauugaucaguccuacaauuuuuuuuguuuuuuguuuuuuuuguaaaauaaucuggauugcuuauuuuauaugcugggaugcuaguuguuuuucuauuaaugcacuuaacuugcauucuagcuucgccauucagagacaggcaucgugugguggguuguaugacagugucugucaauagugaagacaaauaguaccagagacacuugacccauccaaucucacccagggucuaggucggucucguuuucagacuucuucauaagucuuauuuuucuuucuuucuuucuuccuuccuuccuuuuuguuuuuuguuuuuauuuuaguuuuuaaauaguggguugauacugauuaaaacuaaauuuguaaaguuuuaaacuuuacauuaguguuagaauaagaagaaauguagaaaaugaagguuggcauguaagguguugacaaagcagguuugcagccacuuugugucuuccauguuucagucuauuggcaacacaaauguuguucuuaauuuuuuuuucugagaaaugucuuccuucuaugaucugaaaauauguucuuacauggugacuuuuaucagacaaaaaugaugaguuuugaauucauuguuaccaguaagacaaauauuacuccucuugaagaacucucgauauguuuuagaucagaagcuguacaggugccuugguuguuuuuuaggaguauuucuggguaggcagucgccuccuucucuguuccacuauuggcucacauaaugcacuacagaaguucaugggcuuuacuguagugaccuuuuagauaauucgacuauugcagauaauugaaauguauaaauacacaugugcauuuaauuguuagugucagaucugaacucagggucuuaguuaaauaucauuuaugaaauguauuuuaagucagugaaacauguuuauuuguuuugaggaccuuaaagaauaguucugguuugagaacacucuuuaaguguuauuagauccagauaaaauauaagcucuuuuuaaugucauuuuaagcacuaaaaugauauggucauuaaauaacuuguaguugacaugacauaccuagaacuaacaucuucauuuuaaaguauaguuuaagcaaggaauauguaaaauacccguauguuucucuuaugugauaaaacuuaaaauccaguauuuauuuaguuaguuuuucauuuuguuuuguuuugaggcaggggcucacuaugcaacccuggcuguccuagaacuuacucuguagaccaggcuggccucaaacucaauagaucugccugcuuuugccucccaagcacugggacuaaaggcaugcaccaccaccucuggcuugguuuuuuauuuuauuuuuuaacaaauuaaauauuuguauguucuggcaaucuuuuuauuccaaguacuuuaaaaaaucauaaugggcuuuagugauaugucaguucucuuuguugugaaaugggaagugaagccagggcaucaugaguaguaagcauugcuuugccacuaagcuauauauaaucuuaauacuccuucaucaauaauuaaaagaagccuuauagggccagugagaugauucaguaaguauagaaacuugccaccacaccugacaacuugaguuggaucccuggaacccacauggcaauuugguucucaacccaacucacacaauuugucaugugacccauauauauauauaugcaauggcauaugaacauacacaugagacaacacauacaaaacaaguaaauagguaaauaaauauagcaaaauaaaucuuaacuuuaagaagaauaagccauauguccaguucgucguggcugacauuuaauuugcaaaaaauagaauuauaggcaugauguuaauguuucucuuuuuuuguuguguuuuaauuguuuuuguuuuugaaagucauucuacauugcucuggcuguccuugaacuuacagagacagaccugucucuaccucagccucugccucccaaguuuugagauuaauggcauauacuguugcacacagauucccuucauuuuuacauuuuaaaauuaauauaauccuucugauguuauaaauuuucacuaguuauuuauggacugguaaguuaguuuuccuauugguuugagauauucuugguggucacagaaaguguuauagaaaauagcauauauaaauuaagcuaaauucaaaauaguuauuuuauaaagaaaauaaaaaauguguuuauaugcuacuuagaugagaaaauaauuuucagaaaaacuuccaguauaaaagaucgguaaaagacucaaggaacaaauaaaauuauauaguuaaucauggaaguaccuuauaacuauuuugcuuuauaaagaaauaaaagcagagugcucuucuaagggaccaggguuugauucccaguacucacaugguggcuuguaacaaucuguaacuccaguuucacacaacacaaugcucuguuauggccucuggccucuguaggcacuucaggcacauaguacugugauauccauacagccaaaacacucauacacauaaaccuauacacuuaaaauuaaaacaaaucuuuuuaagagaaauaaaaacauauuaaaacauuuauuugaggaguucuguauuuuuaauaugcaggaguuaguuuaacagagacugaacauuacugacagauaaaaauaaagacuucgcacugauuagggaaguggguaccauauuucuuuucuuuuuuuuuuuuuuuuuaaagauuuauuuauuuauuauauguaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccccauauuucauucaugcaaacuuauaaauaaaaaugaguauccagggccaggauggucauacacaccuguagucucagcacucaggagaauguggcaagaagaguguaugaauacaaggccaaccugcacuacauagcaagaccuugacucaaaaaaacaagcaguaggagggcggugacacauuccuuuaaucccagcacugagaggcagagcaggcagguaggucucugugaguuccaggucagccagagauacauagaaacugcuuuaaagauaucacacacacacacacaaauauauaagcauauacauacauauaugcauacacacacacacauaugcauacacacacacaggauuuuauuaucacuucagucuauagaaugccuuucaguucuauagaaugccaauuaagguguuucuugugggguuuuuuuuuauuuguuuguuugguguuuuguuuuggagugauuauaugauuugacagaaagaucuuuuacuuaaguauauuuauaguauucccagaaauaauucucuguuacuuuucugggaauucuugaaauugacagguuaggggcuggugagauggcucaguggguaagagcacccgacugcucuucugaagguccagaguucaaaucccagcaaacacaugguggcucacaaccaucuguaauaagaucugacucccucuucuggagugucugaagacagcuacaguguacuuacauauaauaaauaaauaaaucuuuaaaaaaaaaagaaagaaauugacagguuaauguuuagaaaucuaaaauguccuugauauuguuucuauauuuuagugaauuaauauuaaaaauuuguugugauaaauuuaggguuaauauaaauauauaguuucauacacacacauauuaggaaagacuguuguagcauucucuggggaaagagcaaguaguuggcucuaaacucucaguaauuuaucuguaucagguacugcuacuguaaugcuauacaaucuaagcauuucacauuuuaggugcuaaauccuuuuuaaaucucuaacccuauauauuugcgaaucuaacuuaauaaaauucaauauucaucugacugcuuauaauuaaacuucccaugauccccucuuuaaguucaguuauuuuacuaguacaacaacucacagaacucagcaaacacacuuacugguugauaauaaauaguauauuaaagcauagaaaugaauagaccaaugagcuaacacauaggagaagaccuagaagccuuggccuccagugggaguuugugccucauuaauagcaugugguaguucuauucaccuuccuacacaccugaauuaaguuuguuugaauuuuuauauagaaaaaaauuuuaaagaggcuucauuggcuguuuaucaaccuaaacuccagcuucucugcuuuuucgggcaugauugauucuuguggcaaccaccccccuucccccaucuuguguuauuuagcaacuucacccaaauuaucuuauuaauacagucucaggugguugaaaugugcuuguuauaaauuaaaaccaaaaaauaagaacgacccuguccaaaaauaaauaaaacccauccuucaccuuuaucacuaugaaguagaagaccaaaauuuuaaccacagauacuuauugcucuguucaacuuagaaaguugcuaggagcuguaagcuaagaacccugggucuauauauagucauuggcagggaucccugaaauguuuguauucugcauucucaugugcaugguacuuggacucagagaggagggguuggggaagagcuuuauagaaauacaaguucacagcauucauagugcaugcuuugugugagccacugcaaagagugcuugcuaccuaauaggauuucucugaaaaucaagaauauagacacacagaagcacaaauuuuaguuucauuuuggccaauaguuggaacagauggaggaacauuagauauaucuuuccuguuucguccaaaaugaucaugguaguauuuuuccaaaaaagaaaaagaaaaagcuauauuuaaacccaaaguggcuacaaaucagcuccuaaacugucauugacauuagcaucuagauuuuguaguuuuuacagaucuuuaaaaauauuuauuuccuagaaaacauugcauuaaugcaugauacaaauuugauaaauuuuucuuuaaauuggaaugcaguuuaaaagugacugaauuuucuaauuucagcuacugcauuugacaaggauacaaacuaaaaaguggaacugguauuaucuacuccuucagguucuuugacauaugauaguuaggagaaaaauuuagaguguggcuuuauauagaucacauuauggguggcuaacauggcugugcucuucaaccuuggcaacaaugagaauuuuuuguuauuucaaguaauuuacauauuuugauauaugcuuucaguugaguucaguuaauuuauagcacagcuuuuuauuauccaaacacagacuuccuuacauuuuagcucuauaauuggcaaugaauauuacuauuucaauuuaaaauuuuauugugcaguuuuaaaacuguggcauaagugguugaagauacaaaauuaaauuuaagcauuaccaauuuuuacuuaugugcacauuauaucuugaacaugauaaaauaguauuugugagauuacagguaacuuccaaccuaaacaauaguuguguggcuggagugaugcauuuaagaacuaaaguagcagugaucucagcuacugcuacugcaguuugcugcacagucugggcuacagagauuuauuuaaaucugcuuuuuucccccccugcuugauaagugauuuaguuuaaaauauuuuuauaggaauucugacauucuagaaaauuucaugccuacuuuuuuguuaggcuuugaacaguaagauuugcuauucgcuaccauacuggaaaaggaccugauagucacaauuaagcaggccuuuuaaaaagagaaguaauggacagggauagccaauuuuugagcacaugagaacuuuauaggaaaaguccaucuagcagcuacccugguuuugcuuuuuauucauucuuaaaggauagauuuuuuuuguuguuguuguuguuacuuguggauuugaucugcuauuuccaaccuugagauucucaguggccacccuguaagcaagccugauccacaccaagccuuucucagcuuuauucuuguggauuuuacagucaguucuagugauguaccaguuccauuuugccuccaguucaguugauuaucuauauuuuucucuauuuauuuuucauuuuauaauugguaucuggaauaaucagcagcucuuuucucauuuauuuucucauauuuuuauuccaggauuugccucugaagcagggagugucugcauuaaaaaugaccuguaguucucugcuucauagguuagaaacuuauuuuaauauuuuguggcuaagcacagucccacuuuucaaauucuauaaugaauuauuuaauuggcauugaauguggaccacaagcauauauguuucauauugggguuuucuguauuacuuuaaaugaucaaaauucaacagaacguucagcugaggcaauaaaagcuuuauucuugcuuuacagcuuaaaacaccaaauuagauuuuuaaaaaaucuaucaauuauaacaaaaguaaaauaacgcuauuugggcauuuuuucaaaaauuauauuucuaggcuuuauauugcuuaaagcauuuauauucuaaaacuuaaccaaauuccaauuauucuuuuggggaaagcaaucaguucacaaaucacauuuucauugggacugcuagccagccuaggugaaaacacgucuaguguacuuacucuuggauuauacacugcagaugcuucuucagcucccuccucuuccuccaugggcggugcuugcagcuccuuuaccaccucuuccagcccuaccauuuauucuaccucagucaccgacagcaaggcuaugcaaguggagagcugcuccucagccguggggguaaguaacagagggguaagugaaaagcaguuaaccgguaacacaguucagcagcauccaucaaccccgaagaggcacacaguuuuguacaucucaccaccaccugaggacuugcuggauaacagucggauguccugccaggaugagggguguggauuggaaucugagcagagcugcaguauguggauggaggauucccccuccaacuucaguaacaugagcaccaguuccuacaaugauaacacugagguaccucguaaaucacgaaaacgaaauccaaagcagaggccgggggucaaacgacgagauugugaagaaucuaauauggauauauuugaugccgacagugccaaagcaccucacuaugugcuuucucagcuuaccacggacaacaaaggcaacucaaaagcuggaaauggguugguauccacauuuuuuaaaguucuaucaccauuaugcaaaacaaaaaaguaaaucauucccaaauuuucuuaauucucagcucaaguuugcauauaaaguaaaaaaaugcuaauuuuauccuugaaguacaugauauuuuaacuuaaaauaaucaaauuuuacuagaaaaauaauauaaaauagcaguagauuauagcaaaggaauuuuaugcauaugguuaggcauagaggaaaagauaaucuguuuugaaauaacuuaaacuucaaaugaacuuauauuuuaaaaguauuuuuaaaauaucuuuaccugcagaaguaaggagcaauauaauaaugcuauagcuaaaacaccuuaguguucuccagaaacugauuugcucuucuagcaguuuguuucaugggccauucccuuagauuuuucagagaauuuuacauuauauucuuguuuuuugucuuuacuugauaaaaauaagaaaacaaaagagaugacuuaauucucauuuagguucaugugcuugaauuuuuuuuccuuuguacagugugccaauuugggacuuuuaaagaaauuauuacuccccccccauucuguuucuuauuugaaaaauaaugaaacagaauugugguacacauuugagcuuucuguucauaugugccauugaugcacuauuccaugcuauauagauagauuaauaugauauacuuuaggauuccuuuugguuuuggggggucuuagguucuugggggguuuuuuguuuuuguuuuugcuuguuuguuuuuggaggucuuuuuugguuuugguuuucguuuuugguuuuuuugagauagaguuucucuguaaagcccuggcuguccuggaacuugcuuuguagaccaggcuggccucgaacucagagaucugccugccucugccuccugagugcuaggauuaaaggugugcaccaccacugccuggcuuaggauuccuuuaguauuuuaauuguaauauuuagucgcuagacuuuugaaaguaaaaguuucuacaguauauucaauaaaauuuaacucacuagauuuugagaauuaguuuuugaggagugugacucuuuagguaaugcagggucauuugcaauuucuucccaucacaaaagaaauagucugaaagcuuagacugguguacuuugugaugacaucuuugacuuguuacauuaaaaaauccaauucagucuuuaucauaauaaagauuaaauguguccucaaauauuuccuguguacauuuuaaaauuaguaagucuauacucaaauguaugaaacccuaaaaugaaacucauguucuuaaagucuaaccugaaaauuaauuugaaaaaaaaaauagccuacucuuuuucuuuauacuuucauuaaaacuccuuuagagugcuauaguuaaauaauuuaaaugcuuuacaguuucaaaaagacuagauuaggcaguuuccaaaagaaaacaagauacagccuuuccuaacacgucacagcuuaacacuccggaacucuagaaaggaguauuuauucaaagauaaauaagauucugaaaugugcuggacacuccaagucacauaaagaaaugugacugauaguacagaucugaaagguguguauggcaguaaauauaugugggcuuauuugggcugcagggaaaaggucuuuuuuuacagaguuacaguggaagauauuuuccuauuuguacugaaauaguuauuaaaguuuccagcuaauaacaguaaaguuuugacuuggggauagucaaacagugauuuacuguugcugauuaaagagauuucuugaccuacaucuuuucugcuucugcuuuuguaugauagauauaucuuagaaaugauuugagguuaccagggaaaguauaaugacauuggucaagacaaaacuuucaugaaauaauucaugaagcagaaacuccaucaagcagcagaagaaaugcccaucuucuuagguaauggaaaauuauuuaacaauaguauaugaaaaugauaaagaaguuuaaaauuugaauuuauaagauauauugaggaaaaaaugaaaccaaauguaaaauacacggacagccaaccauucuuaaacaaccuucaguucuagcuaacugccuuuuuaaaaaaaaaaaaaaaaaacaaugagaaaaauauuagaaacaugaaauuugagccgggcgugguggcgcacgccuuuaaucccagcacucgggaggcagaggcagguggauuucugaguucgaggccagccuggucuacagagugaguuccaggacagccagggcuacacagagaaacccugucucgaaaaaccaaaaaagaaaaaagaaaagaaaagaaacaugaaauuuugaaauguuuugagagauaaguuauaaagucuuuaauaugacacaauuugaaguuuauauaauacuaaguauuuauuaaaugaacuugagaugugcugcauagagcaguucauuugucuccuugagccugaaguuuugacaacugacaaacagagagaugauuauuuuuacaacuaaaaaguuagcgcuuacuaaggaaacaucugucucuuaaagccucuuguaugucaguauugcugaccuuaucaaucuuaaauucuucacuaauguccugggaaucagcagcccuauuucuuuuaaaguucuagaaguuuaaauaugauauuauauggauauggaaaucauuuuaggacuuuuuguaguuaaaauuauuuuuuaacagaaaaccugaaggaauaucuagcacaaaagaaugugaaugucauucugagacuucuaaguagaaugugccacaauacauuaucuauggaaguugucauuuagauguaagauuccagugaugaaaucucuuucuaacaugaggaagcccugccuuugauauccagcucugcaaaaauaaaucaacuaauccccauguaaugaacugcuguuuucuugcuuuuuucugaagcuguuuuaccuuaacaguuuauaaauugaauuacuacuuuucuaagaauuaguugaugauuucacuguuuuacaugucuguagaugaaaauauacauuuuuuuccacuuuuacauuuaaacuuagagaauaaagagauuuuuagaauauaguuucaaagccaggcauggugggugguaaacucauguaaacccagcacuugggaagcugaggcuauggguuugugagagggagaucagccuggccuguagugaguucaagaucaguuugggcuaugugguaagaauccacacacacccccgcaccccccccccaaaagacccaacaggaacauuuucaguauguuaggaauuaaauuuaauuccuuguggucuuuuuagugcauguguguguguguguguguguguauauauauauauauauauauauauauaauauuagcauauauguuagcauauauguuauauauaugcauaugauauauauauacucacucaacaaacauuuauuacaaauaagauauuuguuuuacaggaaucauuuugauuuacucucaaaacauuagcuugauuaguauaaauaaaagucucaccaguugaaauaaguuaucaugucguucaaguuuucuuaguacuucaguaucaaauuuuucauuuuuguuauaaucaauacauaugaauuauaaguaguuggaaaaaauacaagaaauuaaguaaauagcccauaaucuagucacucauguaaauugcuguugucauuacacuauaauuucauuuaguuccuuuguauauacauaugggagauacuuuuacauaguuuuuaaauauaccuuuuuucuuuuuugcuuugguaauaagaugaauacaaaacagauuauuauagaaucucauguauaagaaauuauauacucuucaauccuaacauuuaaauucacucagaaugcuaaaaagaaaaacauuauuuucccuauuauuccacuucagccugauacuuuuguucauagauuuaguccucuagggacuuuaaaaugacuuacauauacagguuaucucugacuuaccuguguuagacuuagaaaaaugguguuucucagccaaguaaggucugguccugcccuucuuaccauuauaaaaacuccuuuuccucucugcucuccuugucuguuucuucuuccuguuugccuucaucagcaaguaucucgcaugaacuugcccugucagucaccaggauuccaguuaccagugcuacccuucccuccauacuucugucccuguccuagggaguccuuccaacugagugacugccuaccuucccuuugcucuuaugacugaggcagcagcuuggucacaacuggauugguaaauuuuagggccaggguuaaagcuguucuucuguuuuuaaaaucauaauauuccucuggggaucugguuaccuugcugagaguaagaaagggcaugguagacccugacuuuucaauaacauacauguguaauuuuacaugcuucccuuccuggggguugaggguuauucugcuuauuuucauaagguauuugcauuacauagcuacuuuauagagguccuaaacacuauuuuggacauuguauaauaaccaaagaaaugcuuaaauuaacacaauuuuagauggacccucacuuagguaggugggacaacaggaggaucugcaccucaaggccaccuucagcuauauacaacagguugaagacagccugggguauaugagacccugucucuagaaaacaauaaaacaaaacuuccacaauuaaaaaacaaaaccacguagaauuaccaguacuauagaagcucagguuauaagauuuuuacuuuaaucauuuaaccagucacagauaaaaguaaucuuuaaaaaaaaaaaaucacacugauuauuuacuaaaucuuauuuccaaaaaaaaaaaaaaugaaucacuaauuuuuuuauuauaaauuucucauuuugauuuacuaagaaagcaguccaaaagaauauacuacauauaccuucauuguugaaucuuuuagauagauuugguaauuuuugccaauuccucuuuuuuucuuucuuucuuuuuuuuuuuuuuuuuuuuugcaagacugauuaaaaaguaaccaugauuagucuuuuagcuuuaugugacugauauguauaauuuuuacacuuuauuuuaacugaauugcagugaagaaauaauacuuauuacacugucuuucuccugccacccaacuauaauuuuucuuuccuguccagcuuucucuuucauggcguguaguuacacuugggucaaaaauauuuuaaagauacuuuaggcuguguuuuauccauaaguuaagcaguuguuuucaguguuauuaccuuucuguuucuuccuuuaucuaagauagcuuuuauagaagacuguuuuugauauuuccuucauguugugcuuuggauucucagaacauuggacagccaaaagggaacuggaguaaagaagagcccuauguugugcggacaguauccgguuaaaagugaggggaaggagcugaagauagugguacagccugaaacccaacaccgagcccgguaccugacagagggcagccgaggcucuguaaaagacagaacacagcaaggcuuuccuacggugaagguaaucauuuuauuuaguaguaugugaagacuggcccaugaggugacuuugaggugaagguuuauccccaggaucuggucaauggugggagaagagaacuggcucuacaugguuauccugaccaccacacaaccacaccauggcacacacaugccccacauacauguuucucaugcaaaaccaucaaauacauguaaaaauaauacuuaucuaugugaugaauuuccuucaauuuuacuaauuauuuuaagcucaggaaaagcuuccugaaauagaaggguagaaguauuaguuauauaauaaaaaaacaaaugucuaauugggccauaagccaaguaguacuuagauaacauuugaauuuuuuauuuaucugguugauuuugucuuucugagauuauguuucacuauaacucaggcugaccaggaacucaauauguuguccacgccagucuugaauucaaggcaagccuccugucuccugagugcuugaauuauagaugugagccagcaugccuggguaaauuuugguuugagagaugugaguauguucugaaaagaaaaaaaauaucugcaggucauuaguuaucuuccuccuuuguuuaauagugauaguagauucauccaaaaaugcauuauuaagaagaaauuuuaaaguaaaugcaaaaaaauaguagaaauuauuaugaacuucaccaggcaugguagcacauucuuuuaacuccagcauuuaggaggcagagacuggcagcucuaauauaaauuagaggccaaucauagucuucauagcaagcauagagaguuccaggacagacagaacuauauggugagcacuugucugaaaacauaagaacauggaaauaaggguuuuuuuuccucuugguuuuugacaguguuucuugguauagcucuggcuguccuggaacucacucuguggaccaggcuggccucaaacucagaaauucaccugccucugccucccaagcacugggauuaaaggugugugucacugcugcucagcucagaaaauaagauucuuaaaauuaucagaauuaccuuuucagaacucugacuuaaaguaaaaauuuaucacuugguacuuuuauuauaaagaauauuauuguuugaaaauagaaaaaaaccaaacaaacaugaacugccauucauuucauacuuaaaugaaaucaugauugaaacucgggauugggaaaugugucuuugagcauuuguuccugucuuaccacacuaauccaucugcaaccaaucccucaaauccaguaacaaccucaagauaaguaccaggcaagagagaaauucagguuuuguuuuguguauauuuagcuggauauuuucauaguuuagucaguauuuuucaucugauuaccugccuuuauguugugcuuggucuaaguacuuacauauuuauuuauauauauauuaauuauugauuaauugccugacugugauagggaaugaaaaugacugcccucaacaguucauuuguucauucacucagcagacacuuauucccuuucaagugcugagaccgguccagguauugccaacuaguucuguaguaacuacauuccauuagaacuuuacauauucucugcuaaacuauuacauaauccauuuguagaagacaucacaauagauauacacuuccuuauuucuuuaauuauuugccugauuaugauaaucucugcacuaugcuaauauaauggaauagaaaagauugacuuuuauaauuuuuuuguauccuuuaucaacagcuucaguguguuuauuguaagaugcauuuucuauuacaacuauuauucugaauaugaacuaucauuuauuuaugagaguuuuguuagagguguauaaugaucacauaucuuacuuuaagcaaacacuucuuaucauagaugauguucuggccuaggauuuaaugauucagucuuugaacuccauuuuccugucauuuguuuggccgccuuucaaauacuucccucaaacugcuuaaguaguaaaauuuaucacauauauucucauugaugaugaagauguugccauuaauacaaugcaguggugguagcagauccugaauaaucuauauacugucugggcaauuguguauccauucccaacuuaugcaaauagguuauuugacaguuuagcauuagcacaucuaaauaauuaaaauguaguuauuguaguacuaauacaguaguuuuuuguaaagacccaguuuuuauuuaauuuuuguuuugaagcuagccuuuaauugagccaucucuccaguguuccccaucccucacuuauuuuucauucuuuauaguuuugguuuuuguuuugguuugguuuuuuguuuuguuuuuuugaggcaggccucuauaaagucauguaacucacagagauccaccuaccugccucugcugugauucugacuucaguuuuucuuuauaagaaaauguuugggcuggguguguggcuuggguggaguacuagccuagcauuugugagcuccuagguucagucacaaaaaaaaagagaggaaggaaaaggaaaguuuuaccuauuuuccuuuaugcuuaaauuauuucuccauucaguuuuaaauacauuauuugauuuugaaugucuaguucauaaugaguuuauuugaaaugcuaacuaguguuuaugaugcauguuaucuguuuccagcuggaaggccauaaugaaccagugguguugcagguauuugugggcaaugauucuggucgaguaaaaccacauggauucuaucaggccuguagaguaacugggcgaaauacaacucccugcaaagaaguggacauugaagguaccacuguuauagaaguuggucuugauccuagcaacaacaugacacuggcguaaguacuuuaauaaauucccccucccuuuuuuuguuuguuuaagauuuauuuauuauguguacagcauucuggcugcauacauggcugcaggucaaaagagggcaccagcucucacuauagaugguugugagccaccaugugguugcugggaauugaacucaggaccucuaggaggagcaaccagugagugcucuuaaccacugagccaucucuccagccucccccaucucccccccuuuuuuuuuuaaacaaaauuuuguaaguuacucugauuagccuagaacccucuguguagaccaggcuggccucaaauucacagagaucugccaccugaaugcuaggauuaaagaugugauccacugugccuggcagcuuuuuauguuuuauuuauuuguuaguuuauugaguuuuuguuguuuuggggggauuuuuuuuuuuuugguuuguuucuuuuuuuguuuuguuuuuuguuuuauagauaggcucuuucuacauugugcccuggcuguccuagaacuaauguguagaccacuggaccacccucugccuccugaguccugggauuuaaagugugcaccaccauaccuggcucuuagcaaauuuuaaaauagauuuauuuuacuuauguguaugcuauaucccuaugugaguuucugugcaauaugugugugcaguugcccacagaaacaagaggaagauauuggaucuccuggaacuagaaugaccaaccuacauagcugcuaggaacccaaccaagcagcaagugcucuuaaccucugagccaucucucuuagcucccaagaauuuuuuuuauuauauuauauucuuaugauaaucaugaaaauacuggguuucucuuugaggcccuggcuauccuggaacugacucuguagaccagacuggucucaaauuuauagagaugcaccugccccugccuucugagugcugggauuaaagguuugcaccaccaccacaggaugauuuucuuaggaccuuauuaaaauguuuuaaauagaacaaucuguucuuacaggacuauagagauggcucagccguuaaaagcuaggaucacuccaaaaagacaaaagggcuucuuccagaaugguuucagacugaauugcauucaaguuuugcuuuccuaaagaguucccaaagcagggaaauaaaggccaaagaacaugcuggcuuuuuuagaagauaagaucaagacuugcuuauugaaauuuuaauuaauauacuaaaaauaaaaauuguauggucaggggucuggggauauagcuuaguugguguaguacuugucuaguuaugaguaaagcucgagguuggaccccagcacuacaugaccucugugugguggugcaugucuauagcccaaacgcucugagguggaggcaagagagccagaaguucaaggucauacuugacuauguaguuguuuguacucuauuucuaaaagaaaacagaaaaaauauacacuucaaaauuugaccuagagaaauggcucagaggguaaaagcaccugccaccaaucccgauaaccugguuuugauacuagaacccaaaugguaggagaguacugagucacaaaagguugucuucugagccccacacagaccuugcugugcaugcucccaacaauggauggaugauguuuuaaaaauucuacaaauaauagcuauuauauuguuuguuuguuuguuuugaaacaggcuuuccaaaaaaaaaaaaaaaaaaagauagacagggucucucuguauaguucuggcuauccuggauuucccuguguugaccaugauggccuugaacucacagcgaucuuucugccucuaccuucggauuguugggauagaaggugguaugcacugucauaaccagcaaauuaccauuuuaauguuuaucuuuccagguuuuuguuugguuuuguuuuuuacaaacuugagguauuauuuuguaaucugcuuuuuaguuaauuuaggaauguuuuacaauuuucauuaacuguuacuauguaauuuucuacugcaggauguaguugcuaauuuuugaaaaagcauaacucauucugguuuuuuuaaacauuuugcuuuauguuuauggaaguuuugccuguaugucugugcacuacuuacaugccugguacccacagaggcuagaagagggcaucacauccucuggaacuggaguuauagacaguugugagcuuucauguaggugcuagaaacuaagccaugguccucuggaagagcaaccaauguucuuaacuacugaaccaucucuccaccuccucauucuuuuuuuaauaucugaauuagcugcaaaaaagaaagucuuuuuuuaaaaaaagcaccagaauacagaauagaggccagaaagauaguuuauuaguuaagaacacucaugacucuucuagaagacaaggguuuuagaucccaacaccuacauggcagcuuacaguuggcuuuaacucuaauuccaagagaucugaugcccuucuccagcuucagggacaccagacacauauggaaucaaauauacacauaaaauuaaucaauuaauuaguuaauacaugacaaauacauauaguauguacuuuuuuuuuuuucaagacagagucucacaauguagcuuggcuauccuggaacucacuauguugaccaggcuagccucaaaauucagauccccaugccucugccuccugagugcuaggauuaaaggcaugggacaccaugccuggcaaaaauaaauguuuuuuaaaagcacagaauaagucuuauucuuauauuuauauuguaggcuauuacuuauguuucuauuuuuaaagauuuauuuauuuuauguauaugcguacacuguugcugucuucagacgcaccagaagagggcaucugaucccauuacagauggcuaugagccaccaugugauugcugggaauugaacucaggaccucuggaagagcagucagugcucuuaaccauugagccgucucuccagcccccacuuauauucauauuuuaaaaauaauuuuguuuacugauuuuuuucccaugcagaaaauuaacaagauuaggggcuuugaauauuuaaaauuuauccauugguauuuugugaguuuggaccuuaugucuauuaaauauucaaagaauuaauaagaaucagcuuuucuucuuuucuuuucuuuuuuuuuuuuuuuuaaaccuuaagacagaauuucuguguguacuagcccuaacuaucuggaacucacucuguagacuagaacucacagagaugcaccugcuucugccuccugagugcugggauugaaggugugcaccaccacugucuggccaagaaucagccuuuuuaaaaaggaaacuugucauaaaauguugacuauugccaggugaugggcuuuaaucccaacacucaagaaucagaggcagguggaucucucuuuguguuugaagccagccugguguauggaacaaguuccaggucaaggucacacaaagaaacccuguuucagagacagaaaacauacuguuuauauaacgagagugucacuugguauauuuucucuguuuuaggguggacuguguuggaauauugaagcugaggaaugccgauguugaagccagaauuggaauugcuggaucuaagaaaaagagcacucgugccagauugguuuuucgaguuaauaucacaaggaaagauggcucuacucugacauugcagacaccuucuucccccauuuuaugcaguaaguaagaaaauaggaagaugcuagauaugugaagaguucuuagguuuaucaugucaauuuuucagauaacuguaaauuuuaauguuuuauacuucagcuuuuauggucauguugaacuugaaacauuuguagccaagagcacacaaguggcaagcacucauguuccuagccacuuggaaugcuaaagcaugaaaauacugugaacccagaaguuaaagucuaggcuggagaaagcagcacaucucugucucuucgaccaaaaacaaaguuguagucagcuggguaugguggcacaaacuauaaucuuagggacuaggagcagaaacaagaagacugccaugaauguaggccagccuauucagaaagacaagaucugucucagaaaaacugacaaaaaaugguuguguuaguuuuuaggcaaaacuaaagaugaucuugggagguagggccaaaaagaucaggaguacaggucauccuuagcuacauugugagauuaaggacagcccgggcuacuggaaauuuaucuuagaauauaaagauauuagaauacauuggaaagauacuuagcuguguauaguuuccuauuauuaucauauacugaauuuuaaaaguaauuuaagggcuggagagaaggcucauaaguuaagagcacugguugaucuucuagaggaccuauuuuuuuuaauguauuuuuuaaagaauuauuuauuuuauguauaugaguauacugcagcugucuucagacacaccagaagaaggcauuggaucccauuacagaugguugugagccaccaugugguugcugggauuugaacucaggaccucugaaagagcagucagugcucuuaaccgcugagccaucucuccaguccgaagaccuaaauuugauuccuagcaaccacagggcagcuuacaacuaucuguaauuucaguccuugggaaucgagucuguugcacuuaugugcacuuauguuuugccuacauguuccaucuccaugggcacuucauaugugugguguacagauauacauucaggcaaaacacauaaaauuaaauuuuaaaaaauuuaauuugagggcugucaagauggcucaacaaguaaaagcacauuuugucaaacccugaccugaguuggcuccuuggaucccacauggcacagaggacugacucccacagauguggugcacauacacugaauaaauaaaccacaguauaacuugaaaaauauguuaugugaguugaacuggagauuguaacacuuaaaguagccuggauugguuucugagcaaauaagucauuuaaauaggaugccaggaguaaaagagaauggcacgucacaaaaaaauuuuaaaaaaauuaaaaauaaaaauaaaauaaaaacaagccaggugcugguggcgagugccuuuaaucccagcaaucccagcacucaggaggcagaggcaggcggauuucugaguucaaggccagccuggucuacaaagugaguuccaggacagucagggcuacacagagaaacccugucucgaaaaagccaaaggggggcggggggggggaagaauggcacaucacauuucuuauuacaaguugugguuguacagcacaaugcuuguaaaugagaaaccuaacuccgaucccuaacuuuaguauagaaagaaaaaaagugaaaguaugccuuugaguucaaugaugugccuuuuacuuuuauaguuuuuauuuauuucaagcaguaaaugggacaauuuuuuucuuuucuuaauuauuaaagauccauuugccgggcgugguagcgcacgucuuuaaucccagcacucgggaggcagaggcaggcggauuucugaguucgaggacagccuggucuacaaagugaguuccaggacagccagggcuacacagagaaacccugucucgaaaaacaaaaaaaaaaaaaaaaaaaaaagauccauuuaucuuauacuuaugugcacauacauuuugccuacauguauguuugugcaccguguauuuaucuagugauuguggaggucagaaaaggacaucagauccccuggaucugaaauuacaauuaugugucauaaugugggugcugggagccaaaccuggaccucuacaagagcagccaguacucuuuacugcuuagccaucucuccagcucugagaauuuuuguuuuuguuuuguuuuguuuuuguuuugagcagggcuucuccauguagcccuugcuguccuggaacuuguucuuagaucagacuggccucaaacucacagauucaccugccucugcccucugcccagauuaaagguguaugcugccacugcccagcuauuucuggagguuuuucuugaggauuauuuggauuauuuucuuuggcaaggagguccuuguucuguuuuuuuuuuuuuuguuuuuguuuuuuuggggggguuguuuuuuuguuuguuuguuuguuucgagacaggguuucucuguauagcccugacuguccuagaacucacucugaagaccagguuggccucgaacucagaacucugccugccucugccucccaagugcugggaucaaagacaugcgccaccacugcucagcagcaaggggguccuugauaguaaccuauaauucaaggucauucugccucagauucuauuuuauguguguaaguguguuuguguuuguguggacaaguaugccuacagguacaugugcauguguacagcaucugucuuucuuaucucuaccuauauauuugagacuuggucucucacagaaccuaaauguauagguuugucuaggcuggcugaccagugagcuccaggauccucuuuucucugccuccagcacuggggcugcagauaugcacugccacacuggcuuuuaugugagugcuaagaauccaaacucagauccuaguacuugcauggcacuuuacccagugacucaugugacucauauucccaccuuuaucucagccgggguuacaggccugauugguauuuuuuauaacuuauauaugacuucaaaacagaaaagagauguuccauucaguugaauuucauguuauuuuauuauagauauuaugaucuugcuagucccccuuggucauuuaaacccuuuuuuuuuaaauuguauuuaguuuuuucaaauuaucauagcuauucuuuaccuuagcaaacacccaaauuuuauguucauuuauuuauuguggauguuugugucuguguuuauguguacauguguguauguguuugauuguauguaugccacugugcacaucugaaguuagaagauugcuuguagggaugaauggguucuuuccucccaccaugugaauucugggacucuaauugggucauuagagccauugcaucacagaauuuuuaagaaagauuuuuaauuuuuuaauuuauuuaauuugugcauggguguuuugcaugagagacagagacagauugagagagagagagagagagagagagagagagagagagugugugugugugugugugugugugugugugugugugugugucacaccaugccugguggccagaggccagaagaaggcaucagauucccuggaacaguaguuacaauguuugugaacugcuaugugggugcugggaauuaaaccugacaacuugaguuuuauccucugcuuccacauaguagaagugaagaacugacucccauagguuguucucugaccaccuacccacugugguguauguacauguacacauacacagagagacaggugguccaaaauaaauaaaauguaauaauaaaaaaagaaaacaaaaauuaaugaucuacaaaaacaauucauaaaaguggauuuaugauuacaaguuguuuucagauaagaauuaaggguugguggcucuucuauguaaaacuuacauauguguauccacagcucagccagcaggaguuccugagaucuuaaagaaaagcuugcauagcuguucagugaaaggagaggaagaaguauuuuuaauugggaaaaacuuucugaaaggaacuaaaguuauuuuccaggaaaauguuucugguaaguagacauauaagugguaaagaguguuccauguuucauuuguuauaaaaauacaguuauaacuacaaaaugaaaacguuaaaaaaaauuauaagucgcuguuuuuauuuccaucagaugaaaacucuuggaaaucagaagcugaaauugacauggaguuauuccaucagguauaaacuuuuuaauaauuuguucuuuacuuggcaauuaauucauuuuuguucagauaagguagcucaauuauuugagguuccuuccaguucugacaucuuauucauuccuuaauauaaucaggugacccugcucugcaugaccagcagucauggccucuagagcacucuugucagucagaccccaacaccaagcuugugaagaugcucgcagaaggcugccagcuuacuccguucucccugagggagaagggagcucugcucucaagucuguucuuucuggaguucuaauuuacuucuuaaguaccuauuuccacuaccagcugaagccuuauuacuccagaggauacuuucguaugcugugaaugugcuuuaguuugcuguuguuucuauuuuggacagggucucacuugguacauguuuuagguucuggcauacuaguuagauuaauguaaucucccuuuauuuuaguacucucuccccuuuauuguccuuuccuuaucuccuucucuccuacuuguuucuuuucucccucuuucccuucuauccauuugucuauucuuugucugaggaauaggauguaccuacuccuacauccuuuauuugcuuugauguaaggucuccuguagucuaggcugguugugaacucacuauauagccaaggauggccaugauuuucugccucugcuuaccacguauugggaucacaaacaugugucauuaaccugguuucuacaguacugaggauuacacucagggcuucaugcauguuaaauaagcacccuaccaacugagcuauguccaucuuuaguucaaaaaugaaauaauaauuaaacaauuaaauuuauaaugauauacuuauauaauauaaauaauauauuuaaaauaagauaaugaugaauaauucaauaguaaaacuuuuuaaauuuacuguuaguauuuuauaugucauguaggcacauaugacauguaguguguaagucaagacagauuuauggacuugacucuauucuucaccaugugauccagauaucaaauucaagucaucagguuugugugacaagugcaaugcuagagguccuuagaggguuggguuuuguuuguuuauuguauaggauguaggugggugugguguauguguguaguggcagucagaggacaacucuggagucaguucucuccuucugaccucugcagacccuggacuuuuucagcaaguauuuuuacccagugagccauccuagcccagacuuaaaguuuuugucugcaaauaacuuuauaaacaaacuaaaucauaacaugauaggucauugguucugugguuuuguucauuuuuaauuuuuuauuuuauuucaaagagaggaaugaguuaagugccuuucugggaaauauuuucuuagacuagaauuagaacugguaucuuggagagcugaccuagagauuguagcaaauggagaacagaagugaaauauuagagagagaagaagguauugaaaugaaauaaaacuuuguaguuggacauggugacacacacaccuguaaaaccgagcauuuagagguugaggcaggacuaagacuuucaggccagguugguaagaauucacaaaugacaucugaguacuuguauguaugguacuauugucuugacagauugugggacagaacacccuagaucuuugugaagcuucuauuuuuguuguucuagagagagagaaagcagagagguugaggcaggacuaagacuuucaggccagguugguaagaauucacaaaugacaucugaguacuuguauguaugguacuauugucuugacagauugugggacagaacacccuagaucuuugugaagcuucuauuuuuguuguucuagagagagagaaagcagucaguaauuucaagugcuuaaaaaguacuguuauuuaugggucuggagaaauggcucagugguuaagagcaccaacugcucuuccagagguucugaguuaaauucccaguaaccacaugguggcucacagccauauguaauaggaucugacgcccucuucuggugugucugaagacacuacaguguacucauguaaguaaaauaaaugugacuggguuaaagagaguacugcuuuaaaaguauagacgggaguggaagggaagacuacaaagguggcauuuguuugagaccuggguauagguuaggaacuugccaucugagaagaugaaaauauuauaguuggagagaacaagucugagauaaagcugaaguuaguaauuaaaaggaccauggugagaguaggaaugagaugaaguuggcuaagcaggaaccuuguagacuguuguaaaaaugagggcuuuacuaugaacggcauacuaagaugaaugacaugcacguaccaaccugagcuuuaaagcauccuuuuuuguuugacauagugacccacaccuaaucucagcauguaggaguaugaaugaaguagaaagaucugaggauugagacaggacugagcuccauagcaagaccugacucaaaaaaucuauuguggcuuuuuucuuugcuuuguuuuguuuuguuuuucaagacagaguuucucuguguagcucuggcuguccugcucacuuuguagaccaggcuggccucaaacucagaaaucugccugccucuaccucccaagugcugggauuaaaggugugcaccaccacugcccgaccuguagcuuuuuucuaaucaaacuucuaaauuguucagauaacaggaaauuuaccauuuuuuuucuuaaacauugacuuacuaucugauucuuauauuuuuccuuaauuagaaccaucuuauugugaagguuccuccguaucaugaccaacauauaacuuugccuguaucagugggaauauauguugugaccaaugcuggaagaucucaugauguucagccauuuacguacacuccggauccagguaugucagaaugaacaguucugaacuaaaaggaauaauuaaauucuauaccuuuaaaaaaguuugaagucuagacagccaaaacaugaagcccuacuaauuuggagaugaguaauauuuuauaaaaagacagcuaccaaaugcuacuguuacucugagaaucauuuccacuuguucucucauaauaagagaggagagagugcuuaagcccugaugcuccagaguuagucacaggucacuuucuaguacuaucacuguuauugagugucucuuaaaugcaggaaggugaaacucaaaacugggaaauugcuaaaguuugucugguuuaugagaucucucccccauccccaccaucauguugggguugauuccaaggcuuuauguaugcuaaccacaugcuugaccacugaacuauacaccucugaucacaggguuucucuguguagcccuggauguccuggaacuugcucuguagaccagucuggccucaagcucagaucucacugccucugccuccuuaguggugggauuaaaggugugugccaccauugcccagaaauaauaaauguuuuaaauguaauuuaagcauuuaaugauuuagaaagcagaccacaaaagcaacugaaauguuuaaaauuuauuuauuuagccaaaauguaacuucugaguuauuugccuauuuuguuuaguuaccugaaaaauuaagaaagccucugacaaaaaugggaagaucauuuuggaaaugaaaaugaauggcuuguugcauugccaggaggcucaguuucugcugcaguuguuauugguucaguuuguucuaauaugaagacuauuucagaauuagcaguucugcuacuguuauuaaccuguaguccugcuacaggcuauugauaauguuauucccacauauuucaggacccagugagacagaaggugagggaaaguaagaaagcuucugcucaggcaggaaaguguuugccucacaagcauaaggacuugaguugauuuccaacauccacauaaaaagcaguucugaagcugggcggugguagcacacaccuuuaaucccagcacucgggaggcagaggcaggugguuucugaguucgaggccagccuggucuacagagugaguuccaggacagccagggcuacacagagaaacccugucucaaaaaaaacaaaaaaacaaaaaaaacaaaaacaaaaacaaaacauugaaagccaggcuggaugauuccaguuugucaccucagcagucaagagccugaugcacuaagauugccgguuugaggacaaccugggccacauaggaauacuuuacuucauaacaaaacaaacaagccuugacaaauaaaaauuaagauguguuuuagauaaaaguaacaggcuaggugcucagugugguaaugaccuaggagccugaguucaguuccugagacccaugugguagaggagaaccaauuugaccaccacauauauucuguuguacauguguauacauguacacagacaauaaguaaauguaauuuuaugaccaaaaugcaaguuggagaggaaaggguuuguuuuauuuggcuuauacuuccauauugcuguucaucagcaaaaguagucaggacagaagaaacucaaacucaaacaaugcaggaaccuggaggcaggagcugaugcagaggccauggagggaugcuacuuacuggcuugcuuccccuggcuugcucagccuacuuucuuauagaacccaggaccaucagcccagggauggaacuauucacaaugggccgggcccucucacaucgaucacuaauuaagaaaaugccuuacauuuggaucuuauagaggcaucuucucaauugagguuucuuccuuuuagauaacucuaguuugugugugucaaguugacaugagacuagccaaaacagugguuaagagcacuuguugcuuuugcagagaacccagguucaauucccaacacccacauugugguuucacacaaguauaguaguaaucacagcacuggcgagauggagacaggaagaucacugaggcuuacuaaaucuaucaccuucugguugggcuaggucacagugguucucaaccuuccaaaugcugcagcccuuuaauacauuuccuuauguuguaauaaccccaacuauaaaauuauuuuguugcuacuuaacugcaauuuugcuacucuuaucauaauauaaauaucugauauacagaaugucuuguauauuacccuguggaggucccuacccauggcuugagaaccaccagguuuaggaaaccuucucucaaaaaaaaaaaaaaaaaagguggaagagaauccaugaaauuucaaaaaucaaaaaugacaguaauaaaaauaaugaccauuugaaucagaaccuacucauuugcaguuuaacauuauuauuuagaaaugaucucuguucuucagcuccuuaagucaaaagcuguuauggaagauuuaaucaacaugacuagguauaguaaccuugugguucucuguuagugcuagcaaagauucuuuuucaaaguuuuacugaaagaauagucauaauauuagagaccuagucuguucaucauguguguuuuaauuuacuuuaaauauugacaaguguuuuccaguugguacuuuuuaauaaacuuacauagguaagugauaacuuuuuuucuugcuagugcucuaauguagcuguuaaguguuaaaugucugauauuuggugucagucuuccauucauguauuaaacagauucuuaaaguuuucuguuuugguaagugauauauuuuaucugcuuauagauaaguauauuuuagagaguagucugcugguuauaaaaaauuaaccuaggguucuaguaaacaagccaaugacaugcuaagaaauuacuccaauuaaagauuauuagaauauguauuuuaccaaaaugaauaaauugaacaaaauauaugacuuuuauuuuuaauaucagcagcuggugcuuugaauguaaaugugaaaaaggagauaucuaguccagcaagaccuugcucuuuugaagaagccaugaaagguaacaaguugauuuuucucaaaaacuaauuuugcccuccuguguguuuaccagcaaaaccuuaaugcuuuguuuucucugaucuaaugugauacuuagcaagguguuuuccaaauuauaaaauaaauacuuguuuaacuucacugaugcagagacuuauuuuucaacuugauauuucccuucauuuagcauauaaaaacaaaacaaaaacccauaauagaccagacaugguggugcauacuuguaauccuagcacuugggaggcaaggggaucaugaguucaaaauuaccaagaccuugucucaaaauaacaacuaauauguuugaguagaggagugugguuucuucaguuuaacccuuaugggccuucaagauggcucaguggauaagguacuugccaccaguuccaaugaccuggguuuaauccccaaaacacacggggauuguggaaaaaggggaccaacucucacaaguagcugaccuucacauguaucauggcaguuggauacccacacauacacacaagauaaauauauaaauagaaaaacaccaaaauaaagcccaaaucccauaaaaguaaugagaauaagucauacaguugugcuuuuuacugagacugaagagacuaaaauaugaacuguagguguuugaagaguuacuuugggaucuaaccauucuuaagucugacauguuuauuuacuucucuaccaauuuaaaaaacaucaaaacagugaagaccaggagugauagauagcacauuccuacagugucuuguuuuguuuuguuuuuuucuuucuuuuuuuuuccgagauaggguuucucuguguagcccuggcuguucuggcacucacucuguagaccaggcuggccucuaacucagaaauccaccugccucugccucccgagugcugggauuaaaggcgugcgccaccacuacccggcauuccuacagugucagugcucugguaucugagacagaaauuucaugcacucaagacccaucuagccuuuauacuaagacuugucuccaaaaacccaaguucaaaagaagcaaugguuauaaaccaacuuaaguuuguuacaaugugguaaggcagauuauuguccacaauuacaguauguggugauggugcuuuuaugccuuuaucuaugaagauacagauuacacaaugacacaguucuauaauucaugagucagucugccuccagaaauggcaacaguggaucccagugcaucaucccugugccauaccacacaacagcaagucagccuucucuguacugacaauccaugcaagcucaguuauuuccuuucucuuacccagcccagaagcacuagcacuccaccuaacuagaacaccuaagcuagggaucuuacagcuuucuaccuacuaacaaaagccagucuaagcuaaugagagccagguguggaagcccaugcuuuuaaugccagcacuugugaggcagagguagguagauuuuugugaguugccuggucuacauaguaaguuccaagacagccagggcuauguagagaccccaucuaaaaaaaaaaaaaaacaacaacaacaacaacaaaaaacaaauaaaaaugccagccaagugucagaaagccaacuagacaucaguaucccaguuugucacacacacccagagguagcagaggcagcccauguagaugauucucuacucuaauaucaccagcagugauagauuagaaagccugcugccacugugauaccaaagaaacauauaagaaaaaugcuuuccucacuucucuaaagacaccaauaaccaggaaagcacuucccacuagguaggcaauaccagacacagaucagguagaguuaggaauaaccagaccagauaacccaaaauugaacuaagcugucacugaaaguaagccagaaccugugcaaguuaaacaagaugagcacgguaaacaugcuuauauuaguuuaaguggaacuacgucuccuaacacaaaaauccgacguggcuuugaaauaguuuuuaaaacauuuguuauauuaggaaccaagaaaaaucacaugagaaaagauaacugauaugaaucauuaaggaagguguuggaacuaucuaacaaaaugauagaccaugaaauuaaugcaacagguaauucuuaauuucuugaaagucaaaacuaaaaauagaaaauuuuaguaaagaacggggagauauuuuuaaaagaaccaaauagaaauuacagaacagaaaacuacagauuuuuuguuguuguugcuaguuauauuuuauugaaacugggggaaauuaugucuuccaguguauaguggaaucaaauaagaaaucagcaauaaaguagagacagggaggaucucucugaggcacccuggucuaauagugaauuccagaacuacauagacccugucucagaaagggaggugguaggggagaaugaaaaaagaaaucaguaauaaaggaaauaggaaaaucuucacauuaaaguuuugagccuggugguggugauggcacguggcuuuaaucccagcacucagaaaacagagaaaagacaaaguuuugagcugaggauguggcuuacaguaagcaaagugcuugcuaacagacugagguccuggguuggcucuccagcauugcauaaaccaggugugguguugcacaccuguaauccgagugcuugaaaaguaaaggcaggaguauccgaaguucaagguuaucuuuggcuuuaaguuuaagccacccugggaaacaugagagucuaucucaaagaagagugcagguggcuggagagauggcuuagugauuaagagcacuugcugcuccugcagaagauccagguuccauuccaccaccucauggcagcucacagccaucuguuccaggggagccaaugcccucucuugaccuuuaugguugcauggugcacauaccugcuagcaggcagaacacucauauguuuaaaguaaaaagaaauaaauauuuguuaaagagagcauagguaucaaaaggaaauuuagaaauaaacugaauaaagauaaaaaauaauggcuuugaaaguuugugagauacuaggcauaguggcaugugaacuguaaugcuagcacccuggagaaaggaagagaaauguuugagaccagcaugagcuguauaauagcaaaaccccaucugugguucuuucuguagucucaaaguaauaagaauuugagucucaaacuuguacaucaggcguuagcugcaugaucaauucacagacugucacuagcuggaacaguagacuccauaaaguaccaauggcaaacucgaggaaaaguugcaaaggagaaaggaaaugagugaaaggggggugggaguugaguggaaaggugguaauuggcucuccuagcuguaaaucauagcgagcuauugaaauuggagguuggugagggggcacaugguuuagaaaugcauuuaauugcaauuguaccaccuugaauuguucaaguuucuaaaacacugauucagagaacaaaauuuguaaauuacuuuauauauucuugaauucuugcugagaaauacuucaauaaucucagucuucaaaagguuggaaugcuggauuguaccuauguguucaaccuccuggaguaaacauacaaucuguaugcuaaauacucuuaagacaugaucccuguugcaugguguauaaccccagacacuuagacacggcuugugggauacagcugauagcugaaccaguucaguuuauuacuugaccuauaagcuguagguauuucuguagugguggagcucuccucuagauugcaggugauccuagguuuuauuccccagcacgguaccacauaaguaaaccuggcuucucuucaggccagucacacuugcguaaagggagguuagguaggaguagggauauaacagugggcagaaugccugccuaggaugcauuaagcccugggcucaauaauugucucugcauauagcagacaugguggcucacacauguaauuccaagcgaagacagaaggaucaaaaauuugagaucauccuacguuacauaucuaguuugaggccauccuggacuacaugagaguuucucaaaaauaggguaagcauaaauguaucauggauuauaaucaugauauaaucuauccaaaauagacauuuaacccagguauggugguguagcacacauauacuuugagcucuuagggguugagguaggaagaugacaaguuugaggccagccuaggcuguauagagacuacuucaaacaaacaaacaaacaaacuagauuuaaaccauggccuauaguaagcagauugcuucuuaugguuuacaacuuucucuuuuauguguauagcaaugaaaacgacuggauguaacguagauaaggugacuauccuuccuaaugcccugaucacuccacucauaucaagcaguaugauuaagacugaagauguuacuccaauggaaguaacuucagaaaaaagaucuuccccaauuuuucagguaaguuauguaaugaaugccccauaucucucucauauacgaaaaauagcuauauuccccuuucuuguuuuguuggcaucuguuuuccaugagaugugguuaaugaauuuugcuuuucagagcaaaugcuuuauaggucaguaaaauugcuuacaaaguaacuucaggacacauuuugauaagaggaggaauucauucccaugagaugaaguacuacaaguugguuuuaggacuaaggaaucaaagaugugagauuaaggccaaccugggcuacagaggaagacccugcccccaaaaugaguugauuuaaugaaagcaccaauuuuagcauuuucagaaguagcagcauuuugauuaugguuccuucucuacucucuuuuuaauucuccucuuguuuuccccauugcaguguuacugaugauccacaauauggaauucuugaacuuacauaguuguaguuacacacaaacuaucagauuaauguucucuuguuauucuuauuuggcuaagcauaucaauaacugcuuuuucugcuuguuugguuaucuuuacaauacugaaagucagauauugucauaaagaaucagucuuacacugacuucuagugauacuguagaguagaaagcuuauucuguguguaaucuuagaaauaauuuuuggaguaauauaugugauuauuuaauuuauaugugcauauuguuuguggcuuuuuauuuuuuagacuacaaagagcauuggaucaacccagcaaaccuuagaaacuauuucuaacauagcggggggugcacccuucuccucaccgucgucaucuucccacuuaacuccugaaagugagaaucagcagcagcuucagcccaaggcauacaacccagagacccugacaacuauccagacacaggacaucucacagcccgggaccuuucccgcaguuucugcugcuagucagcugcccagcagcgaugcacuacugcagcaggcaacacaguuucagacaagagaagcucaguccagagacacaauacagucagauacagugguuaacuugucacaguuaacugaagcaucacagcagcagcaauccccacuacaagaacaagcacaaacguuacagcagcagauaccaucaaauauuuuuccaucgccaagcagugucagccagcuccagaguacuauucagcagcugcaagcaggaaguuucacaggcagcgcugcuggcggcaggaguggaagcguugauuugguccagcagguuuuagaggcacaacagcaguuaucgucuguucuguuuucuacuccagaugggaaugagaauguucaagaacagcuuaaugcagacauuuuccaagucagucaaauucaaaauaguguaagcccuggaauguuuucuucagcggagucugcaguucacacuagaccagauaacuuacuaccugggagggcugacagcguccaucaacagacugaaaauacacugucuaaucagcagcagcagcaacagcagcagcagcaagugauggagucaucagcugcaauggugauggagaugcagcagagcauuugccaagcagcugcccagauccagucagagcuguuuccuucagcugcuucagcaaguggaagccuucagcagucuccaguuuaccagcagccuucucacaugaugagugcacugccuaccaacgaggacaugcagaugcagugugagcuguucucgucucccccugcagcuucuggaaacgaaacuuccacaaccaccacgccacagguggcaaccccuggcuccaccauguuucagacaccaaguucaggagauggagaagaaacuggagcacaagcaaaacagauucagaacagcgucuuucagacaaugguccaaaugcagcgcaguggugacagccaaccucaaguaaaccucuuuucaucuacaaaaaauauaaugaguguucagaauaaugguacccagcaacaagggaauagcuuguuccagcaagggagcgagaugaugucacuucagucugggaacuuuuugcagcaguccucucauucacaggcucagcucuuucauccucaaaauccuauugcugaugcucagaaccuuucccaggaaacucaagguucaauuuuucauaguccaaauccuauuguccacagucaaacuuccacagcauccucugaacaacugcagccuucaauguuucacucucagaauaccauugcuguguuacagggcucuucaguuccucaagaccagcagucacccaacauauuucuuucccaaaguucuaucaauaaucuucaaacuaacacaguagcccaagaagagcagauuucauuuuuugcagcacagaacucaauuucuccacuucagucaacaucaaacacugagcagcaagcugcuuuccaacagcagccuccaaucucacacauccagaccccuauucuuucccaggaacaggcacaacccucucagcaaggguuauuucagccucagguggcccuuggcucccugccuccuaauccaaugccucaaaaccagcaagguccaauuuuccaaacacagcgcccaauaguuggcaugcagaguaacucuccaucccaggagcagcagcagcagcaacagcagcaacagcagcagcagcaacagcaacaacaacagcaacagagcauuuuauucaguaaucagaaugccauggcuacaauggccucccagaagcagccaccaccaaacaugauguuuagcccaaaccagaacccaauggcuagucaggagcagcagaaccagucaauuuuucaccagcaaaguaauauggccccaaugaaccaagagcagcagcccaugcaauuucagaaucagccuacgguuuccucacuucagaacccagguccuacgcagucugagucaccacagaccuccuuguuccauagcucuccucagauccaguugguucaagggucaccuaguucucaagaucagcaaguaacacucuuccucucuccagcauccaugucugcauugcaaaccaguauaaaccaaccagacaugcagcagucuccucuuuauuccccgcagaacaacaucccuggaauccaaggaagcacuucuucaccccagccacaggcuacuuuauuucacaacacuacaggaggcacaauaaaccaaauacaaaauucuccuggcucaucucagcagacuucaggaauguucuuauuuggcauucaaaauaguaaggaacucaaauuucucaguaucauuugaaauguucagaucauuauaaggaagcauaaggcacaguaguuucaaagcagaguggaauuccaccagcuaaagacugagccuuggacacguuauuugcccuuuauaggcaugaauuuccauauuuucagaaguaauuauuuuagacuggucauauuggugcaugccuguaauccuagcccuucagagguguaggcaggaggaucaggaauucaaagucaucuguggcuccauaguguuugagucuagccuaggguacaugagaccuuaucucagaaacagacaccaaaaaaaagugauaguuuuuauaccucacaaagauguuaagagguuuaaaugaaaagauauguacaaauguguguaccguuuuaugacauuaauuugaaaggaaaugaaaguaucuuagccaauuaaguuguuucuaaaaagcuaggcacccacuuuucaucuguuacgucaaguaauuaaauaauacuuuuauuuguaugacugcauuuauuuagagguaaggucucacuauuuagucaugguuguucuggaacucacuguguagaccagcuggccuugaacucacaagguucacuugcuguucuucccaaaugcugagauuaaaggugugcuccaccauacgcaauuucaguaguacuuuuauauaugguuauaggaaucccaagauagauucuaguguuguauugugaaaaccauuuuguuagacugucaagcacuuuaguuuuaguaauguagaucagcauaguaauaaauuucugcuggcaacuaaaaaguguuuuuucagaaaucuuaacuaaucagauguuucugauuucgcugucuuuucagauuguagucagcuuuuaaccuccggaccagcuacauugccagaucagcugauggccauaaaucagcagggccaaccacaaaaugagggccaaucuucugugacaacacuucuuucucagcaaaugccagagacuuccccacuggccuccucugugaacagcagucagaacauggaaaagauugauuugcuuguuucauugcaaagccaagggaacaauuuaaccggcuccuuuuagugagauguaaguauuacauuuggucucuuagugaaaagcguuacuaaauuuuacucacaacagacucggauuaggagcacuguuuagcuuuuacgguuaguuaaaauaggaccuucacuuugaguaagucacucugaaugacagcuuagauuagguaggaaauacugggcauuccuucuggcugagagcuucuuucauuuagagugacagaauaucaggcuagcauauaaggcccuagauccaaucauaguagaaaaggagagcaugaaagaagaaaaaauuuuacagaauaacaaaucuuauaaucuggggcuauaucuugguuggguacuugcgcagcauauuugacgcccuagguucaguacccaacaccaccaaaaaagcaagaaagauugaauaugaugaaguucccuacauaggacaguuggagccacucaugguaacagauacuuuacaauuuuuuuuucucuaaugagauacugacuuuuuuuuuuuuuucuucagaaauuccaugaagaauucuguaacagugauuccaagauauccugagaacugugguuccauaaagauuauugaacucuggugaagaacuauguuugaguaaauggauagauuuccuggcuauaagaguacacccaugcugccuguugcagugauuugccaccaaugugcuuuuuguuucuaauaacagugaugacugagagccuguuagauuuuccagcugacagcauuguugcuuguguccucuguuuguaacugcaaggcugggccucucaguuauuauugcuauuaggaaaucauauuugucauguuuacuuauauucuuacuuccuuuccugcauuauuuuaaucaaguaguggcuuaggacaacguaaaguccaguagugacuaaggcugugcuuuuguugauguaaaaaacguggcuguuggccaaagugaaggaguuucuuuuaguuuucauggagaagcugaaggaguaauuuagcuguauuaggaacucugcagaucugaggacuccuccucacacacacaagcagaugacaugccugcaaaacugguuacagcugggaaguuauugaguucauuuuucagagaguuguuaguucucuguauuucuacuaagggauuuagccauaacugcauaaaaauauuuuguucuaugaaaaugaagggggugauauaugauguguuacguucucauagucuccuccgguagcuuaaacugacaguacuuugagccuguugucuucuugcccagcguuaggcuaguauucccuucuuaugugcaucaccuguauuguguugucugcauuuuuucuucguaguuuuauuaauauucuacuggcuuucugacccuguaggaauuagagaaggcagccacauugauccagugaccuggcagucagcagcacaggccaggaauacucuuuuaggaguuauugggauuugauuccugggaaaaaaccauucucuuuuuuucuuccaugaacggugcuguucugaagucuucaaaauucucccucugcugauaaauagcaguauacauuuuaauuuuacaaacaaggcaaacaaacauuucucaaacuauuacuucuccccacgcugcagugacuguuuacaugucagucagcucagugcuuuacaguugaaguggucacuuacaugaugguucccacagccuugggcuccacagggucauagcauugauuuaaaaggaagaguuaacuguguugcaucuacagagagcaaaauuacacacuccagaacuugcauuuguagcauuaguuguagaguuuuggguguccuuaccacccgugggaugccugcuucucacuaccaccuacaucuggacacgugcuuaugucucauuuaucuuuggcaugugggaagugucaaugcagcguuagcccaucauguaugcagcuucuauauguugacaugcuuugguuuccuguucaauucuuuuacuuucuaagcuuuuaaaaauuagccaguucaugguuguugccuuuuuccuuacuuuuccuuucaguuuuucucccccuauccuccacauguguugaacuguguggagcuugguguugguuuaguuuauauggccagauccugcuuugggacucuuccuuuguuauuugacugugguucuugucaucuguuucuucucuuuguccuucucccucugcccuggcccuuccuuucccucucugagaggcauuggauuacguuuucaguaguacaggcuucuugccaauaugaagggaacuuuccagaaagagaccuacucuggucauuuaauuuugaaaacaguuuucaaucguucaaguuuuggaugguuuauaucuaauguguguuucauuuuuuuggaaagcuauauuuuauauuuaggaaaugguauacuauuuugcuauuuguacuaagugaguacauuggcauaaauauagaaauuuauauauauauauauauauacauauauaaacuauucuuuuuugccacacauuuuugugguaaauuugugaguuugucugauguucuaccacaacguggcgucugauaacagugagggggguuuguuaugucuuucuugaguauuuaagcaccuuuugaagcaaauggccuguuuaucuguagccauuccaucaggcaguuccucgauguuauuagggagcugaagggcgacugacuguguguuugcuggaucuucacucagugagauguuaaagcgcaaggaaauucauuugaggcagugugucaaaugguguuugacaagaaugagccacucugucuuuguucacuauauauuuaauauuuuauuauuguuguuguuguuguuauuaauuggcuuucuguauccuaugccuuuuauuuauaaagacacuaaaaaaaaaccauguuuguaauuuuaauaacauuuccccaucuuuuaauauccagagcuacuuuauaaauucucuaaaccaaaaguauuuccucaagaucuccuuucuccccccaguuccuauagggaaaaaucacccaacauaguucggguuacaagaagggucagccacacaauucagugcuucaguuuuaaaaguaaaacagacagacacuagaguguuguccagagcaucauagaaagcagaccuagcagauuuaggaaaaacagaagucaaaguuuaauaccacauuuacuucugaguuuucugaauuacuuugugagaucauguagaagacucaggaaaucuguuucuucaccaagaucaaguuagaauguuugacacugccaugcuggggaugacguggcagcaggaagccuggcucgugugguggcuucuggucguucuggacuagcagcuuauccuuauaaaaugcugauuggcaaugccaagucaccgggaccaauuucuguuuuauaauguuuaaguuuagaacagaacaucaccugaacuguagugcuuugagaggauggagguggaaacccccauuuucagucucaucacuucugugguuauuuauacaagggcugugcugugcuaccauauuccugcucgaauaugauggaguuuguuuauuuucucgcauuguuaaauguuccuugccccuaaagguccauguuaagaacaauguucugaauauaugauuugguuacaaaaaguaugucuucuuauugaagaguuagcucagugguugauauuugugcuaagaugcagcuucccaguuacuguuacaaguuacagcugccaaugggaagacucaauaagccagcaaaggccuugaaaaucaugauuuauuaaauuuauaucuggcagaaggaccuaaauaaacugugaacuacauuguauuccuuuguuacauuuggcucuugcuuucagcaauucacagaaaugcuuggagcucucucucucucucucucucucucucucucucucucucucucucucucucucucugucucuccccucccuuccucucucccuuucccucucccucucugucccccucccucucucccucccucuacauccuuuccuuccucucucccuuucccucucccuuucccucucucucucccucucucccucccucucuacucucccacuacauccuucccuuucucucucccucuuucccucccuuccucuuuccauccacacacaccucuguguguguguguguguguguguguguguguguguguguguguguguguauguguguguguguguaugcaaguuauuccuucuugucauuucacaccaaggagaagauauuacauacuuuuuuccuaagcauugcuguggacuuuucugauucuagcaucauguugcuauuugguauuuagccauuguagaccugucuuacccuuagaccaaguguuaaaagggcuuuuauuaauagaagcaguauuaacaagaggccucuuucuuucccucccauucucccauccuuucuugcccccucuuuguauaauauugugaguuauaauuuauaauugcauuauaguagauuuauugccuaucagaauuuugacuaauguacccagaaaaaauagaaggaagaaauugugcaucugucccuucagaauuaaagggacaauuccuuuugaccuuuugaguguuuguuuuuauuuuuucagcaagguugcaguauccugcccaaguccugggccugcugguaugaagcaccuuaccgggaccccuuuuuuaaaccaguauaaaugcuuguuuugggaaaaugaaaucugucagcaaauaagaaccaaaacugaauaauucuuuuuuuuuaauuauuauuauuuuuguauuuuuucuguacauugacacugucuucagacaccagaggagggcauuggaucccauuacaaaugguuuugagccagcaagugguugcugggaauugaacucaggaccucugggaaagcaaucaguucucuuaaccacugugccaucucuucggcuccugaauaauucuuaaauucagcagaguuauacuuacucacagggguuagccugagaauuuuucauuuuccuaguaaaauuuuuuguuaucccuauuuccugauuguuaauuaguugaaaguuaugggagaacuuguggcuuuacuuugcaucucuagcacaggcucuaucucuaaccaaaaugaccacuuuauaucuggguccuuuggguuaccuggaggggcucagugaaagagaaaaacuaauucaauagacauacgagaaaaauaacccaggccuugaggaguggcucagagguagagaguuuauguagcaugcgcaaggcccugaauuugguccccagcaccaccaaaagggagagagagaucuuggguacacgugcuagcaagaggauuagcacucacccauucaucacacauacugagagcuuucccauucugccuacuuuugucacuagagcuaaacugaaggugacauucaugaugcaggagauugacucucuucaguauauguaaauuaucccaauacccuaauuacuuucuaacugucugucuauuuucaugccaugcuaagccucauauuaauaaaguucuguuuuuacugcucuugcucuucaggcaauuuuuuacauuaauauuuuauauguagauuaaauguuauggaaaagugccuuuuuaccaugccagugcccccuucuuuaguauaugugcugccaaagcaagcaccgugcccccuucuuaaaaacuucaccuuccacuauugccaaaauucugugaacaacugguuuuaucaggucccaacuuguacuuuuuccaugugaccauuauuuucuccauuucuuggucaccauaggagauaaccuugucaguuccuuugacuuaaaaauaauagagaaagugcuuuggcagaauugcuugggaaaguaagugcacacuguucaggcuugugugaaucuaauuuccucaucccaacaaauuauagauggcuaucaccugaauaagaacaaaaauaaacauuuggcugucugugagacuucaugcacaaaaauguguguuaaauguuauaaaggcacuacucaacagccucuucucagauccuaauuagcugggggugggggggaacagucacuaaaacuuagguuuuguaaggccuggagguaacauuggguuuuuuuccuuaauuaaaugugacaaaguaguuuauuucuuaucuaucugaacuucaguuaauugacuuuagaaaacuuaaugucagaaaaaacuuagaagucauuugaguggggggggggggagagcuaaaguaauguuuuagucucagauacaguuggguugaguguccugguuuuguccauuuuguuucugauccaacucuuuaugguggugcuugaagaaagagacaucagcaucaaauucaggacaguaguaacuuaaacuccacaacaaagguguguuccccaugcaaguaugauuguaacuguugguggacugaagauagcauaguuaugcaguauuuguaauacucuauugugcacuuuaaucauuccaaaaaaagccaagaauacaucuuaacuauucagaauacugcauauuuauuuuggauauauggcuugguguguuagguuccugcuuaauuaaaguaacuuacaauaaguuugaaauuacuauuuucuaaaggacuuaagaccuugaaauguagcuguagggaaaugacuauauuuugcagaccauuuuagaaauaguaaaauuugacuggcugaugaguaugucggagagcuacuuagaaccauuccccuuccuucgugucccuuauauaagaaugcuauaguguauaguuucuaccccugugguuuaugcaaaccaguaugguccucugcccagcagcuagcugaugcaguaugagcagggaacuaguuaaaggugcacauucuugggcaguagcccaggcauacugaauuagaucugaaguggggcccagcagucugucuaacccaaguccccagugaguccagugcauccuuaguuucagagccacucuaacggaugaguucuaucuagugaaagccagagaauuucuucccacuuuuaagagauaauuauuucuucuuuguguauauucagccuuaccugguuaucugugaucauuucucaacaauaauaauuuauucucaguacugccuaagaaaugcauguguuuuauguauauacaguguaguuauugauaauucauuuaacuuaguuuggcauuucccuaccacugacuaaaaaguuuacauuaacugacugauuucaauauauaggugcaauguucuguauuucuuuaauuguugugacacuuacuuagcuaaaauaauugaugggugcuacagucuccuguuuaugcauaacauggguacauugugggcaguguaauacaagcuuucucuuuguugccucuuaauuuaccagcaggccaugguuuugcucuuggcuagaccagcucucagaacagaauugccauuccauaccauuuuucuuguaucugagaucucagauagauggcuagccaggccaacauagcaccuuauuuaauuucuucucuuaauagauucuuuucaaguagcuuacuuggcauuugaacagugcagucaagugaugguucuccuuggaacucacacuucaggugaaguacuuaacaaaaugauaagacagugcauuuuauaauuuggguauccccuuucucaguugugugcaucuuaauaaauacaagcuaagcagguuuauuuuuuuccuuuagaauucagcacuuccaucauccuuccacuguuuacaaaucgcugaugaguuaacucaugauagagagauucacuuuucagaauaaaacuaacugaauacuugcuuucugagaaucacugcuucuguaccacacuagcagugcuaaguggcuuacucuacaaacuggugcuggaaaguaaguaggcaagcuguugggaugcuguagagacccccucccuuccccuucugucacuggauacagagcauucuacacaauuuauuuaaccaagguuuguaacaccuccuuuaaagauccugcauucaacccaugucaccccuaccugcucucucacauugguccuucccuuucccaggaacccaccccagcaguaauaauaugcaugguuuguagggguggccuauuguuacuauuuuagcuagugagccucaggaaagcuuacacucacacauaaccccagacgcuugcaagugaguugagaaucaaacuucugugaccuggcuggaguuagaguucagcgacagagccuuuguacacacaaggcccaagguagguguaaucccugguaccaaagagagacagacagacagacagagcuguccuguaucgaagugaucacaauuucacucauuagagaccuucugcagugcaauugaacuaaccccuucucucuaaugaauguaucuguucaccuuguucccucuaaggauaagcuccaagugauugcugcuuuccuggcaacuugacugaguuucacucucuucuuuuacuuccuguuuuaaugaguaacuuggaauauuucauuaacauguucucaagugauuuagcugccauucugccauuuugaguuuuguuuaauuuuaucugcuugagcacacugaucaaccacugaccugccuucuugcauuguccugcagugacguaagagugacauuguguauacggcuucauaguuggaauuucagagcacugacaccagauauucucaguuuguucucugggggaauuucauuugcaucuauguuuuuagcuaucugugauaacuuguuaaauauuaaaaagauauuuugcuucuauuggaacauuuguauacucgcaauuauauuucuguaaacagcugcagucaaaaauaaaacauugaaaguuuucauuuugcag

SEQ ID NO: 4758 - RNA, 18174 nt, Mus musculus
ccagccccgcccucgcuggcugcucugcacagugggcugggcgggcauaagcaggauauaaagccuucgcucagcccauaccccaaggcucagcucuuacuagccuagccuguagccagcccuaaggaucucuccgaagagcuuuagggucgucuuggcaaccagcugcucagccaaucagcguucgguauuacgauccucccucaacaucuggagccauggcgggugaguguggcgccaacuccagucugauuuacucugaggaggauguaggggcuggcugugaguuuuguuccuugccucaaagaggaaaagugaggugguuaggaaccuggaugagccucgguuagucucuggaaggagaacuucuucucagaaccagcgaugcagauuauucugcagcccaaguucacccgugggcaacucuagcauugccccuucuacaccguuccuuaacagagcugccacucccuguaccgcguuuggacuauuuagaaaaaggguaacauguguccuagguuggccuuaaagcugcuguauagugaaggauagccuugaacuuggggucuuauugccuccacugccuaagugccaggauucuaagugcauaucaccacgccugauuucuacggcucugggaauugaauugaaaccaggacuuccugcauacuagacaaacucucuaccaccugagcucugugcacauccccaaccuaggccagauaguauuuaaccauuuggaaauacguugcuaacauuuagaaaugcaagcaggcaauuuacagggaccacugcugggcuugguggcacccuggaggcaaaggcaggcaaauuucuuuuaaguuccaagguagccuggucuauagauccaguuucgggacagucagagcuacauaaugaagagagacugucucaaacaaacuaacaaaccaaaccgcagauuuuuaaaagggguaucaccacuuugugaaacaaaacgggaagauguggagauggguacagggagcguagcugagaaggaguguaacagaaucggagccuaauuccagucuaccuggcucuggaaaguuucuacugugacccuggagcaggaaauccgauuuguuaauugguccauuuuugugacagucuccucacuuugccaucagcccaggggaaggcaggggagaguccuuggcaguuaccaccacauuauugucuaguguuugacuggcaucuacugcguucuuggccaaguagccuccagggcuaaguacuucccaacagggccuggcucugaguucugggcagcaauuagguuuagguguuuccucuguuggggcgggacuuaacuuuuuggaguuccuuucccuuuaaaacuauuucagacucugcaaaugcacucaggaucucgccuugcuaaaagcacagagggagggaaggaugcuucugccguuguacagggucaucccaguguucucuaagcucugcgaugaguugcugggagagccagcgagggaggguuuucaacagcugguaaggcugugucugcuucggucuccauuuaugcaugagggauaaauguuccaagcccccuccacugcagccgcagacagcacagagcacaagcauuaucauauuuaucuuacacucccacacuuguguucgguucaguucaguguuuguuuauucauccauccguucauccacucauucauuauggccagacuagcuucaaacucgauuuggucuaggcugaccuugaacaccugaaccuccugccucugcgccccagugcagguguguguccaggccaggcuaaauuuaauuuacaaauuagaguagaagauugacaaaauaaaaaguaaaacagaaaaaugacgcccauaggcuguaauacuggcaaccuagucugcucucuguugcugcgaggaaacgccgaccaaaagcaagcggagaaggaaaggguggguuucagcugacaguuccggguccuaguucgucaccaagggaaauggaggcaggagccuggaggugggaacugaagcaggagaacucugcuuacugacuugcucucugugaccuuuucaaccuguucucucacacaacccagugaguggcaccugcccaagggugacaccaaucacagggagcugacccuccccaaaucaaucacuaaucaagaaaaugccacccacuacaggccacugucugauggaggccacuaugggccagucugauggaggccacugucugauggaggccacuaugggccagucugauggaggucuccccugacauucccugcagagggcugggaagcacugaagcuuucaggugggggugggggagggaggcugaaagcaagacugggcuggauacuggagugagguuuguuuccaggggacgguccagauaacuucagcuacccaaauuuagagucaggguugccaagaauguuauuggauaaagggaccugcuaccaggcaggcuugaugagcuggguucccuccuuaggacccacauggaaagagagaaccaacuccaacuccugcaaguucugccuaagacacacacacacacacacacacacacacacacacacacacugaaaaaauaaauaauguaauuuaaaagcacucgggagguagaggcagaugggucuuuauaaguuugaguccagccuuuuguauguaacaaacuccagggcaaccaaggccacacaaugaaaccuugucucagaaaaacuaacaaaagaaaacccacaacaaaacaaacaaacaauaucaggguggagagaucgcucauugguuaagcacacaggcugcucuuguagaaagucugggcuugcuccccaguguucacaugggagccaaaacuuuuuguaauuucaguccuucugaggguaccaggcauguaucuguuacacaggcauaugugcaaacaaaacacccauaccuguaaaauaaguauauucuaaaauuuaaaaauuguuucuucucucucucccuuccuccuuuuuuuuuugagacagggucuuucuuuuuuuuuuuuaauuauuuauuuauuauauguaaguacacuguagcucucuucagacacaccagaagagggcgucagaucccauuacagaugguugugagccaucaugugguugcugggauuugaacucaggaccucuggaagagcagucagugcucuuaaccucugagccaucucuccagccacaacaaggucuuucuacauagcccuggcuguccugaaacucacuauguagaccaggcuggccuugaauucacagagaucugucucagccuccccagugcuaagauuaaaggcuuccuccaccaccacacuuggucuauuuuaauuucaauaaaaaaugacuuuuugugaaguuuaggcuccacaguaaugaagcccaggucuccagccccuacgguauguaauaggugcccaguuaacaaucugguacagcugggagcuuggugucugaugaccugagcauuucagggguuaaauggaguggaaaucaggcacaggugcgugugggggcggggagggggagcaaguucuccuccguuucaggauucauggaacaacgaacaacccaucuguuucuuggcagcccaucagagcagggaacaagaggcacugacaagaucacgcuggggcugcggggcuggcucgguuguagagagcaugagacuccagauucaaaccucagcauaaaacagaaagcaggggcggacccacuagauggggagaugcaaggcagagcagaagcugguguuggcuagggugcuaacagggcuuccugguguguuuccaaacucauccccaaacaaacacuaaggucuuucauuaccucggagguuauuucuguuuauggaauaauucaagugaaaccugggggcuggaaugcuuauagaguuaagagcauuugcugcauaauccugagggccagacuucagcuccagggaccagagugcaagaccaggcagggcacccgacagauaacuguaacuucagcuccaggguccaaccucuucuuuggccuccagagguaacacccacaucaacagauaaauaaaaauaaauccuuaaaaaauaguuauuuaacacaagaaacucuauacccacagcacccacagguuccuuuuguaaccuagucaacugucccugaccauucuacugauuuucuaggaagaucauuuuauuuucauguugguggucaauuaaauaugccaccauugucagguggugguggugaugcacaucuuuaaacccagcgcuggggagguggagacagaggcagccagccuguguuccaggaaaaccagggcuacacagagaaauucugggguuuuuuugggggggagggggcagcaucacuagacacuaauuucucacgaacucagaaugcauucuuuauucuucuugcucaucccuuccuuccauuucaauuuuauuuuaaaaauguauuuguuauuauuagagugguguguacuguguaugugugugccuguauguguguguaugccuguguguaugugugucugugugccugugugugugccuauauguguguauguuugugugccuuuguguaccugugugcaugugugugccuauaucuguguguuugaaugugugugcgucuguguguaugccugugugugugccuguguguguaccuguguauaugugugugccuguaucugagugugccuguguguguaccugugucugugugugugccugugaaccugugugcaugugugugccuuuaucagugugugugugugccuguauguguuugugugccugugaaccugugugcaugugugugccuuuaucagugugugugugugugccuguauguguuugugugccugugaaccugugugcaugugugugugccuuuaucagugugugugugccuauguguguuuguuugccugugaaccugugugcauguguguguaccugugugcuuguguguguaccugagugccuguguguaccuguguguguaccugugugcaugugugggccuguaucugugugcaugugugugugcgcgugcauguguauguguguaaguggcacagcauuuaugugaaggccugaggacaacccuggccacuguuuuucacacccuuacguggggucugagcaucaguuugggucucugcagaucugucaggagaccugggauugaaagccucaaagaauggguuggacuacagucucaugcuggagaaaaccuuacuucagguucagugcgcauuuacacaaguacagaacacagaaagccgugauccaaggaagggggaguuuagaaaaaccuaaucagaaucacguguaaaaauaaacgccaguaagcagguucuaaccgguagcagagcagcccuucccagagcuuucucaggacagagcacuuuaagcacaauuaccuggcacaugcuauggauuauaucugggaaaccagauucggggucagucuaaagacaacucccggcaaauccuuucaaccacgugggauucuauagcucgguuacaacguccaacaagaauaaacacgucuuauaaacugaauguaagcgucugucacagggaggcaggaaaucacauccaagaauaguccagggaacaaaaugcaccugagguaaaaggcccccugccucucccuggagccucccucaccucacggcuccccacagcgcuggucaccauggucacacacacaugggcuugaggcuuugacaucuuuaccuccuuuccaguuuuuuuuguuuuguuuuguuuuguuuuguuuuguuuuuaaauugggaagcugcugucaggugggcgaguucacaggcccgaggaccaaggccagggaagucaccaugggggagggaggaguaggggagggagagagaaagagggucauccaaaagggaagggggaugaggaggaggaggagggggaggaggacaaggagagccucuuuccauuuuuauuagaucguuugcauagcugugagcagaaggagugccagagcuugugguagaggcuccucaccucaagguaggcagggagagaagccaacacccggaucuaaucuuuuuuguuuguuuguuuuguuuuuuguuuuugagacaagguuucucuguguaacccugguuguccuggaacucacucuuuagaccaggcuggccucaaacucagcaaucugccugccucugccucccaagugcugggagugccaccaugccugacacccgggucuaaucuuaagaagcauccuccuagggacuccauugcuccagucagccccacccuuccuccagccuccaaccccuguuccccgaguucugccaccuucugaaguaccaccacaggcuggggacuaaguuuccaacccuugagcuuguagggacugguuuauuucuauuuuuuauuuuuuaagacagggucuauuuugcucuuugggcugggcuagaaccuauuguccuccugcuucucugccucucaaaugcugagauuauagauaugaaugacuagaccuaguugggggggggggcauuccacgugcaagcgaugaagccagaggcaaagcacacagaacgcaagcucaaucuaagugcacggcucgccucauucauuggcuucuuuauuuauggcugugguggacucagugcuacaagcaagaggccccgaguucaaaucccuagaacccauguuuuguuuguuuguuuguuuguuuguuuuuguuuuuguuuucuuuagaaaagccagguauggcagaguguaggaaaacagcgccaggaaagucccugggcuugcuggcagccauucuggcugaccuacuuggaaacugccaggcuagaucauguuucaguacuuuuuaauggaaacaacgugaccaaaaaucugucacaggauuuugagaccauuaaaacaaguuuaaugagaaaaaagaaaauagaucauguuucaaacaggguggaaggagcgugaggagcgacauccaagguuguccucuggccuucacaugggcacacguguacucccacaccagaauaagcgcaggcucacacacacuggaauguaaucacuaugagggcauauucagaggauccucuuaacucagugggagaguaagggggugguuggcgugggcacggaggucccagcauuugggagguagagauaggaggaucagggguugaaggcuauccucuacuacacggugaguuugcaacuagccugggcuaugugagacccuuuucucacagggcacgaggugauugggucaaaauggcucugucuucuguggauuaguguguggagagauuguuuuauaauggggguguguuuuugaaaaauauuuauuuauucauuuauuauuuguaaguacacuguagcugucuucagacacuccagaagagggcaucagauuucauuacggaugguugugagccaccaugugguugcugggauuugaacucaggaccuuuggaagagcagcugguguucuuaacugcugagccaucucaccagcccccaugggggauguuuuaagagucauuguagcucugucuugaaucugccucucuuguccuguguuacccaaaacugucuuuggauucuugaguucucaccagcaagaaggucuucuucacugggugccaccccuccuccucucaacuucuagugcugugaacuaaaaaaaaaaaaaaaaaaaaaaaaaaaacaaaaaaaaaaacuucucucucuuuuuuuuuuuauaaccaucuagccugugguauucaguuauagcaacaguaaggaugguaguuugaguaagaauggcccccacaggcucauauaugugagugcuuaguuacaggaauugaucuauuagaaggauaaggaggcaugaccuuguuggaggaaguguaucacuuuggaguaggcuuugagguuucaaaagcccaagccaggcccuguguugcccucucuuuuucuuccugugggucaggauguagcucucagcuaccccuccacuguuacugaguaccgccaugacaccauggugauaauggacuaacccucugaaacuguagcaagcccacaguuagauucuuucuaagaguuaccuuggucuugauauagugacuaagacaguaaguaaacgaagacaaauggguuccaaucaccuguuacuuaucaccucuucccuugugaucgcuggcuuccggguugcggaagcuuugcugguucauucagauagaaaagcugaaaucagaggcaagcuuucuuaaacgcuacuaaggauggagccaagagcuaggcaagcauucuaccaggaguuacaauaucagccuuaaucuuuuucuuuaacuuuuuggaugggggauuuguuuagguuuuccaagguccccucuccccugcagccugugcuuugcugaggguguuuuuuuuuuuuuuuucucucugugucugcuguauguaugcuuccucaugcccaauauacaccuuucuucaacugcaaaauaaaaaaaugaaaaauaaaaauaaaauuuuuggacaggaucuccauaugaagccaugauuggccucaagcucagagauccaccugccucugcaucccgaguguugagauuaaaagcgugugccaucacaucuggcguuuugggaaacuuuuuguuuuuguuuuuguuuugcuguuugagacagggcuucucuguguagcccuggcucuucuggaacucacucuguagaccaggcuggccucaaauucccagagauuugccugucucugacucccaaaugcugggauuaaaugugugcgccaccaccaccaccaccaccucuaccaccaccaccaccaccaccaccaccaccacaccuaggaaacucuuuugagcgcugacaugauguucaaaauauuuugguuuuauuuuggagcuugcuuguuguggauuaauucaaaugcuacuuguguuaauuagacuccaaaaauuaccagaucacaucugcauguaagacgcugaggguuccugcccucagcugggucugaauggcaaauaaaguugccaacuguagacggcugggcagggagaccgaggcaagggaacccagggaagaaggauuuaguacugccacgcugggggaagcggaaggaucagacuugagagguacagggcagagagacugccgacauguaggaguuggagauuguggcccaggaggacugcaggccuggguaggaggcagccaggaauaaagguuuuaguaaguaauaauccaggaauaugggaggggagagugugcuaccagcauggaggauuaaaauagaaggcugggggucaggugagauggcucagcgguuaagagcacugcucuuccagagguccugaguucaaauaccagcaaccacauggugacucacaaccaucuguaaugggaucugaugcccucuucugaugugucuaagacagcuaaaguguacuuacauauaauaaauaaaucgaggcagguagauuucugaguucgaggccagccuggucuacagagugaguuccaggacagccagugcuauacagagcccugucuugaaaaacaaacaaacaaacaaacaaacaaacaaaaccaaaaaaucuuugggccugagcaagcggggcgggagggagcagagguccugaguuguuuaauucccaguaacuacgugguggcucacaaccaucuguacagcuacaguguacucauauauauauauaauaaauaacuauuucuuuaaaauagaaggcucugugugugugugugugugugucuuucauuugagaaucuagagcauugagguagcuagugaggaacccacauggagccauugccagagagguagagcagauuaaucaacuauagcaauaccucuagacuucagauuuuuuuaaaaaauguuugauuacauuuagagagagagagagagagagagagagagagagagagagagagagagagagagagagaauguucuuuguggaguucaggauaacuucagaaguugguucucuucuuccaccagguggguccuggggaucuaacucaggacacccaacuuggcaggaagugcccuuaucugcugagccaucucagcagccucaacuguagauuuucagaugaaagacauuuaguugauaaugcuagccacuguucccuaugcugagaaacgaagguggcaaacaugucugaucccaaacacuuuagauuagggauucacccguccuguuuggauuuucuuuccaugccucauguaugucuaaacagcgagaagagcccugauuguacuggcccauucagagaagacaucauucaacuacgccaugaaggaggcugcuguagaggcucugaagaagagaggaugggagguacucgaaucugaccucuaugcuaugaacuucaaccccaucauuuccagaaaugacaucacagguaagaaccgccucucuccauugguagcggaccccuguggcucagccucagucccaucgcucuugcuacccaacaggugagcugaaggacucgaagaacuuucaguauccuuccgagucaucucuagcauauaaggaaggacgccugagcccagauauuguggccgaacacaagaagcuggaagcugcagaccuggugauauuucagguaucacaggauggaaaucuuaagaaagcggagucuggccgggcagugguggugcacgccuuuaaucccagcacuugggaggcagaggcagguggauuucugaguucaaggccagccuggucuacagagugaguuccaggacagccagggcuacacagagaaacccugucucgaaaaaacaaaaaacaaaaaaacaagaaaaaagaaagaaagaaaguguugucugugguauuuguccuuaugggccuggggaccucugcauucuuagugaugucagucagagggugugcagcugagcugauauaugcuuuguguauuugugugugcgggggggggggggggagcggcggggagagagagagagagagaacaaaccgugaucugacuucuuggucugccccacaguucccauugcagugguuuggggugccagccauucugaaaggcugguuugagagagugcucguagcaggauuugccuacacauaugcugccauguacgacaacgguccuuuccagguaggugaaccauuggccaucuccugaguagacacugucccgagaguacagauggacucuuaagaccagggaggaugcauuguauagcucuuauaaaucaaaugacaggaugguuuggacuuguucaguuuuuuuuuucuacauuuaccuauuuuauguauguauaugaguguuuuuuagacaggaugguuucuucugcucaauucuuuuuuauauuuacuuauucuuuuauguauaugggggcuuugccuguuuauaugucuguguaccacacgugugcagugacugaggccauccucagcuacuuagugaguuuuaggcuagccugggcuacaugagauccugucugaauaaaauguaaaacugaaaaaaaaaaucuuuguuuuuuggaggccaaauagugacaagaacucuaucuugugacuuuuauuuuuaaauagauuuuuaagcauccacuuauucuuauuuuacguacauugguguuuugccugcauguauguuuaaaaugaggguguuagauuccccuggaacaggcguuauaguugugagcugccaucugggugcuggaaauuguaucuggguccucuggaggagcagccagggcuuauaaccacugagucaucucuccagccucgacucuuuuuaaaaaaguaaauuaauaaaaauugacacagggucuuaugaugaagcccuggcuagcuuggaacucacucaagagagacccaccauacccagcugucuccugaaguuuugagugaguugauuugugcuguagucacggcuauccacaaccacaugcuggucccagccacaguuggaacaugugcagagucaugcugagguggcagaggaccugaagccugaaauaauagcccugaugggguggcuucauuuguccuucuccccgggggcccccuguucauuaacucacugggacccaggagaggagcgggugacacuuguuuucucuuucagaauaagaagaccuugcuuucuaucaccacuggggguagcggcuccauguacucucuucaggguguccacggggacaugaacgucauucucuggccgauucagguagcuccuuccagaggaguuuguuagccgagcguuccucagaguccaaaccuccagacaguaacucagaacugacccgaggggggaggagagcagccagggaacagggcagccacuccuaaguuuccuucaggagcuugugagaugacccugggcacauggucaaagucucuucuaugugcaccagggccucagcgugugcagccacagccuuggcucuuuccagucuuccuggaauuguaucuguaaccccagaauauuuuaauaauuaaaaaaaauguaugugugggcaugcaugugugugcuuguauguaugcgugcguuugcacaugcaugugugugccugugcgauugugugugcgcgcguguguaucagaggucaacuuuugggagccggcucucccuuuauaucuuguugguaccaggauuuccuuggcuuuuguaguacuguguggucaaggcucacuggccuucaacuucugucucugccucccaucuugccucuuggcaugcugggauugcagagucaugcugccgcauauauuggauuuucugagacaggguuucccuguauaucuguccuguaacucacucuguagaccaggcuggcuucaaacucagagauccaucugccucugacucgagugcugggauuaaaggcaugcgccaccacacccaacugcauucaccuuuuuacauagguucugggcucucucuccaucagacuuauaaggcugguaucuugacucuacucgcugagccaucucuccugcucuuuuauuguuuguuuguuuguuuguuuguuuguuuguguuuuggguuuuccaagacaggguuucucuguguagcccuggaacucacacugaagacuaggcuggugacgaacucagugcgccaccacugcccagcaagaccuuuuauuguuuuaaggugggaggagguucauauacaaucccaagguagacuugaacuuguggcaguucuuuugccucaaccuguugggugcuggguuuaaggcguggacugccauaucuggcuccccaggacaagaaucagguucaccgagcuugucucugagguggguuggacgcugaggaguauguccacucaggaccgggggugcagaggagagcgagcaagaugggugcugaaaagaccauuugugcaaacugaguucaucauguggagaggcagacaaaugcgcauccacaugcccucgcaugagccagagccaaggagcaaacgcucucccuaauguaauacaauuuccggcucuuuuuggcagaggauccagguuggcacaguuucaagguuuuuacucauucaagcucugccaaggagucuagggagggagggcagaagguaagagaaagacccgugucaauucccaggggcaccucagauuguacauucucccauuggcaagcccaacucacccucuuaaaaguuuuuuuuuuuuuaauuuaaguuuuauuuuuuaugaguuuugccugcuguuugucuguguaccguguguaugcaauguucaugaaggccagaagaguacauuggauucccuggaacagcaguuacagaugguugugagccaccacguggguccucuuagucaccaaugcaucucucaagcugcaaguuuuuuguuuuguuuuuguuuuuaagauuucuauuuauucauuuuauuguucuggguauguaugcuacguuuaugugggugccacagaggucagaaaagaucauccaaucccuuagaacuggagugacaggugagucccuccaucuggauguugggaaccaagcgggguacucugaaagagcagaaaaucucgagccagcucuccaccccgcagaucaacuucugaugcccguuuacaguacggacuuaacuccugugacuuaccgcuguguucuguuucuccucagaguggcauccugcguuucuguggcuuccaggucuuagaaccucaacugguuuacagcauuggccacacuccaccagaugcccgcaugcagauccuggaaggauggaagaaacgucuggaaaccgucugggaggagaccccacucuauuuugcuccaagcagccuguuugaccuaaacuuucaggcaggauucuuaaugaaaaaggaaguucaagaggagcagaagaagaacaaguuuggccucucugugggccaucaccugggcaaguccauuccagcugacaaccagaucaaagcuagaaaauaaggauuuuuuuccuaacauauaguuagacgcagcuuucuuuuuccccagcuugucugacuugcuuucauuuuuuuccuuugcuccacgaggaugggaaaaggaguaaguuugcuucaugcuuuuuuuuuuuuuuugauaguucugccauaacaacaaaaugaaugaagucagauuaggagccucagggcaaggugcagaagcgagcuggaaauacucuucuaggucauuuaugcaauauucgccauuuucuucgggcuagucccaguuagauggcauccaguccuccaucaagauucguugucuauaauuaccucucugugguuuagggcagaagggaauugcucaaaguaaacaauggccgagggacuaacuuguuuagcaguuagcaguuagcuaaagccuguuuaugauacauccugguuucaauuacugugcagugacugacauggcgcccaggggguuggcucuccagcucuuuucugucuuguacacagcacacccagguccugggaaaggaauuuuaaaacagaucuccgucucauucuuucuauuucuuuuuuuuuuuaaucgaaauaaaugaauacaucacacaucagaugguggcgcaugccuuuaagcccuuuaauacuuaauagcaauagccccuuacugaccuggagauggcucagcagccaagugcacuuguuggcucuugcagaaaaccuucagaaaggccaaccucuuuucuaaccccaguuccgagggauccagugcccucuucuggcuccugcagccacugcaugcauagauaaguaaauauaaauaaauaaauaaauaaauaaguagauauaaauaaauaaauaauaaagcgguguacauauaaaaauaauccuaagugccacaaugaaaaccgguagccuucuaccaaagaaaaacaacuugacauauacaaaugucuggaagguuugucugcaauauugugaaaucaaugacauuccuuuuuuauuuuuaaagaucaguugaucaguuuuauuuuuuaauugugugugugugugagcgcgcacacacgcgcaugccugaggguuugugaauauguguguacaagugcccacagacuccagaagagcaccuucuagcacccaaagcuggaguuacauguggcugugagccacucgaaguggaugcuggggagccaaacucagguccucugcaaagagcagcaacugcuccuagcuaugaaaccaucuuuccaguccugauaauuacauuccauuuaaggaaauguguggauaucauguaggccuuauuauuauuauuauuauuaauuauuauuauuauuuugguuuuucaagacaggguuucucuguauaguccuggcaguccuggaacucacuucguagaccagguuggccucaaacucagaaaucugccugccucugccuccugagugcugggauuaaaggcaugcgccaccaugucuggcuggccuuauuauuuauaguaaauaauuuuaaaugugugugugugcaugugugugugcauguuggugucuaacggauagucuuacaacugugaaccaaguacccuacuguugaacuacucucucaguuccugauuuuggcauaaaauugcauuuuauuuagguguguaugcauacgugagcauggcgcgccuguggagacuagaagguagaaucacaucuccuggcuggaguuacaggcaauuauaagccccuguuguaagugcucagaacugaacuccacuuggacuguccugcuaggacagcaagggcuuuuauguugagccaccucucucuagccacucaauuuaaaucucaaaugcacucgaggcauguugguggcacauggcuaucaucccaucacucaggagauggaaggcaggaaggucagaaauuuaaggucacccugagcuacguagugaguuugagaccaucuugggcuacaugagaaacaaauaaaccuugaaguauaucucuuucuacccugagugaaguuaaagaugacaauagugcgcccucuuguggcaaaugggaaguauacaaaacuagguggccagaaaauuuguagaccugacaauacuggaugcuuuggaauucauuuuagcaaaucaacucauuucuggcaccaggcagauuaagucaggguuaucuacaggagcagaacuuauagaaugaaucuagauggauggauggguggauagauagauagauagauagauagauagaaaggggauauauuagauugauuuauaggcugugguccaguucuccaacaauaacuaucuuccaacagaugauccaagaauccaguugaauuuuuguccaugacauuagauguuguuagucccauggguugagaauaagaccucugccacaaucuuccagccaaauuugaagcaagcuuuaauuaaauacugacaaggaggauggacucuggccaggucuauuccaggguuuccaugaaauggccacgagucacacuuggcagaggcuuaagacgacaaccccauaauggcaugguauuuuccauuacgugugaucaagcucacuuguuuaggggagugaaaacacguggcuuguuaucucucagaaacaacagcguccagcauugcaggaaaugucuguuccugaguaaaaggcuuacagguuagacgcauuuuuguuucauggaucucuuaggaacaguaaauuaaaauguaauguuggcucucacagggucucagcauuccaaagaaguaggcuaucuugccaguggaggaauggauuugccagugacagugaaggucguuagguagagagagcaaccuuccuucuucuguguccuuuauauagacugccagcagaagguguggccuagauucccaccucaaaagaucuggauuaaaagugggucuucccauuuuaaaugauuuaauuuuuuuuaauuaaaaaaaucccucacaggugugcccaaucacuugaguuuuagccaauuucagaugccacacaggcuaaaggagaaucuccugggagaccacuuuagagauucaguaacaaaugaugaccaggaguagguagccugagcuagcccaguagggcugcuucauauugaagcaccuaucccugguaccuacguggugagaggaggggaaugacuccugaaagcuauguucugaccacacaugugccauggcguaugugcuugagagaaugcacacacacacacacacacacacacacacacacacacacacacacacgugcaaacacacagauaaauaauguaaggagauguuuuaagagcacuaggaaagaaagugguguaggaauuauagcacacagugagaaugugagcaauagaugccugagugggcgugggggccgugcucacucugacauauccaacaaacccgccacucuuccaaugcuaggcacacagcaacaugcacauacccuugcagaaguguauucauggggaaaauggcaguuacagacagcuaugcugggcauggaaaaaugccaggaagagaaaagauuaaagggacagccuuggcacugagggagcugguuuguacagacuggucaagacugacuauuuaguccaugcuugucagagagucuaagugagacugguuaucaggaggaugaacacuucaggcacugggaugccuuuaaagaaguucaaggaaggggaaacuagggagccaggcuaaagcaaagaaacu

SEQ ID NO: 4759 - RNA, 8105 nt, Mus musculus
auaaaaaccaagccauuuaauuguaucuuugaagguaaacaauacauggccuuggaccccaagcccuaagaaugcuaguuacagguccaaaaggugguguggucucaaaaguucacaaggguccaagcucaaguguugggcggcauuguaugggauccaugaauuccauuuagcaauuaugaaaauuacaaccaacagaucccauggaucuuguaagauaggaaaaaaaaucccuuucaaggauaaaaggaagagugcccaaggcuagguuguucuccucaugaagucggacaccugagccaccacacccccaacucaugcaacugaagcuguaucguagggcugagauccguccuuuuguccacucaucuccacaaugccacagcaagggugaccagggcagagcgcuuguccacaagcacugaaugugacaaaggacccuccuaguggcacacggaguuaugguuauaagauuuuaauuuacuaauuaaaaaagcuacaccauuuacuuuuucuccuuuuucucuucuuucuucgcugcgucgcucuucuccuucucuuugucgucuuuucucuccuucuugcucuccuccuuuuccugucccuccuucuucucggcaucccgguuggcaaucuuguuguugaugagguuaugcaaggcgaccacagagcggaucagcgaggccagguacaccaccaccaucuggucauuggucuucagguagaaggccuugacaaacuccugcaggcuggcguccggcagcagguugaagacguccugcagcugguauaugaucuggugguugaugggcagcuugccgcuggcuaccuucuccagguagcuccugauauccaggagcuuggaguucagucccuucaagccauggaccugguuugugauccgcugggagagaguccccacuguaguguccuugaugucucugcaacagcccauaagaaaggcagaaaggcaucagcccacauugcccacaauguaaggauggucugggacaacaguucagagcuacaacaacuuucuggucaucugggucucuggcaacuuauguguguggggccagaagacaacaucagaguccccugcagcugacagggcugcaggggacugaacucagguucccagugacaccagccacccaucccuccagcccucacagcuaaccuugguacuguggcuucucugguuuauaaaggaugacacuuucccaccugcuuugcuacaauguugagcaacuuaaaucagucaguggccaucuucaaaaccaggauuagugguaggugaaaaugaagucuuucaaguauggcuuauacacagauccugccccaggaugaagguccucugcagaaacacuauuaccuggagagcacaggccugcgcuuacacaccugcauucugucacagucagcacuaugaauucuggacaaggaaugcugucagucacacauccucagucaagauacuccagaggaaagcgugcucaaccgcacugguuuggaagacaucuaagggcuggaaguggaagcuccggccuuuacuccuagcaccuugcaggaugaggcaagaggacugugaacuugacuaacuugggcuacagugaggccauuuuaaaaaccagaaagaaagaaaccaaagggcuagaccaagagaaagaagcauagcacauaacaggaugacaccugacccgaggucacaugcuacagcugacucugguacuguccaacugcuccccaaccccccacccccaaaaaagcuggcuucaaauuccgagauccaucagcuuccgccuccuaagcacugggauucuaagugugcaccaccaugcccagccuggcagcuucuccacauggacagcagguuuggguccccagcccauggagguuagaagagggcaugagaugccuuggaacuggagucacgguggcugugagcugcaaacugaacccagguccuuaguguuccucaccgcugggcuccgcagacucaccuuaguaagugcuccacuccgacuuccuccgccuccucugcuccaaucucgcuagucacaugcucaaaaguuuuugacguuggcgucccauccugugagaagaggcuuaacuguuacuuauuuucaaccagcaaugucucucuucucauacccgaaucuuuggcaguuagaccguuucauggcuauacgacaaagacuuccacagcaaugguggggucagguucuuuuugaaaaauaagcccucaaggcuaagucaggucuguggacacugcugcuagccuguuugcacggugcugccacuaugcuguucucugaacaaaguuuucuugucaagggaaacugugguauucccugaaguccacacugguggggguggggcacggcugggaagacgcagguuaagaguuugguuauuucuagaguggaaaauacagaauacacacacuugaggcacacucaugccaacacaucuaaauuaacuuuguccccuggaucacaugacccaggagccccaauguaauaaagggaguaacuaauuugaauuaaagcauccacugagggguugggucacuugacaucuggugacucaaugguggaaccagagaagacacauuuuagcccuguugcuagcacaggccauguccuucgaugagggcucuacagacugcagggauccaccaguuugugcuaagugagccguagugccuugggcaagucucucaagucacacugcacacuggaccugcuggaagugcagcuggucuucaugucacucaggacagugugaggauucccucaagucacucuagucuuugcacacuaggauggccugagccuucuacgcuucuagaacuuccugacaacuuggucaggaccagggauaaaagcuuuacugcaaccaaacaacaucuggaucuaagcuccuuggggcugcaaaagaacaggacaaggcuuaguguaaggcaggcagggcaccauccuagaacaucucuuuucaaauucaaaagaacauaguaagaaauauuacucuuaaucccucuugacucugaagaccaggcuccuuggacacacugauaaauacucugugcccauccucccaacccugucacaucagguucuaagagcccccacccagcucuccugaggauagagaaagaaaggccaccuccugcucagugcucuacucaacgcaaccccagccgcaaagaccacagguuuugccaccuggugcuugacagcucugucuugcuauguuugaaagcccagagccugucugaagggacugcaucucaggaggacacugcacacugcagcaggccuggccuuucccuugugaaagucucuguguaaccacgcaacugcuuggucucaaugacgauucugggguccaccucacuacucaaggcuucaguuucaagacaggguuucucuguguagcccuggcuguccuggaacucacuuuguagaccaggcuggccuugaacucagaaaucugccugccucugccuccugagugcugggauuaaaggcgugcgccaccacgcccagcuaaggcuucaguuuccuuagugaaaaaggaucgcagguuucucugucauuuucuauuucuagaauuagauguuuaaaaaacucaaggcuggucugauagcaggacucaaccuucucuuugucauagagagugaaagguuuguuaaauugaacauggaaaaccaaaccaaaccaaaccaaaaagcccccaaacucacccaagaacuugcuaacccaaucuccagcccaaagcaggugacuuacgucaugaacuuccuccacugagauguaggcuucggugggaaguccuagguccuuuggcuucacgucgauaaugaccaauaccuggaagaaaaacaguuuagcacguggcuuccuuuuaacacaagguacaacuuuuaagccuucuucugacuacucagaccauuuucuucauucaauuagaaacaagccagauguucagcaaaaauaaguuuacauuucacaugauccaguuauuucauucagcucugccucccucccaggucccuuuucaaacuauuuacacuuaaauauugccuuuugcucucucucucucucucuauauauauauauauagagagagagagaacauacagaauugugggaguugguucccuccaguguggguuuggaaacagggccuuuccucacucacauggccacccugcuggcccaugcaugagccauucuucacuuuaguucccucauuuacaaagacaacauccaguuucugagaggauuaaguuguuauacacagggcacaagcaggugccguuaaauacucuaggucacagcaaaucauaacuuagaacaacacauuacugccaaaggcuuuggaaaagcaacaggacuuugcuacccaggucuucugaggaggcuguuacuugaguagggagcagagggcaucacagugcugugacaacaguuacuuacugaguuggggcaguaucucuucaugaguucauugauggcgauaucauucuugugcaguuuggggccugugugguaccacccaacuauccuuucucuggcugggaagcaaaaccuuaguaaguuuuaacuauuucaucaagauuugugcagccgacucgcaaacaauaagaacaccagcacuuacuuaggcuuuccaccucuuugagaauuagacacaaaaauaaacccugacacauuugugaaacuuaaaacuccaaaacagaauucuuagaggguaagcacugugcagcccagaggcaucugucucccagacuugcuuaggggccagucacacgugaugugacacaucaguuccagagcaagaaugaauaaauucaaguuccccccagagagcagcugugugguguggggugggugaguggauccagagacuugauagcuccacugaaauaacaucaacacacuuuacuacaacuaaggcgcuagggcaggcagccgugagggccagcccagccuccagcuuggguggucuacacagccuuagacuccgacugugguuuauuuauucuaccucaguuuuuuauuaccacuagucuauuuucacuugguccagcuaagugaaucaacccuugacaauauacaaaaagaccagguuuacacacacacacacacagacacacacacacacacacacacagacacacacacacacacacagacacacacacacagacacacacacauacacacacacacacagacacagacacacacacacauacacauacacacacacacacacacacacacacacacacacacacuuagaaacucagacuuaccauugaccuucuugaacaucccauacauguuuuccaaauaaucauggucuaaaaaccagacagaaucaucuuugucaucuucaucaaaagguacuaaagagagaaagggaaaaagagaaaaugaaagacuuugccuagagcuacaaguucagccaccguggaaccucagcagcaccugccucacuaugugaacuguccagggcaguacugcuucgccuucauucaaaaccuccccacucccagcuucucuuaaaaugcuaaagacugagguaccccaaggagguaccccuuaaaaaggacacacucucugaccugcuaaaggcccaauuccugcauggucucuuuaaagaucacagauccugcuggcaauaaauaacacacggagccuaaacgcaauguucuggcaccgauucauuaccgaguguaagggaaacaguccccaucucucuccuugcuccaccaaagccaggguucaaauguuuagugcuggagcugacaagcuacccgauggcuuguucugaaaugcagccaggcuaccgugacacagucuguagcagcccuugcacuccaacagcugagcugagaagcuacaacagagacuaguguggagccaucggucucccuuuccuacguaucagcaauucugaaauaggagcuucagacuguaguaaaaaaguucuuuuuuuugggggggggggggagguguuucgagacaggguuucucuguguagcccuggcuguccuacaacucacuuuguagaccaggcugcccacgaacucagaaauccgccugccucugccucccaagugcugggauuaaaggagcgcgccaccacuacccugcucacuuuuuuuccccuuuuuugugaguaaacagacauucuaaccaugcucagcaaaaucaaaagcuuauccuuuaccugcaaaacuguuggauacaucaaguacuuucuuuugccaugaucccaaaagcacaccaacuacccgcuucugguuuccaaccuugccaauucugagugagaaaaacagguggucagucacagacacucaucgaaaaagcuauuacuugcgacugaguagcaaguaucaacaacaaagauacaauuuaguuuaugucggaccuaagguccauaaacaaauguaacagguuaguucccguaggaaagauaaggaaacaccccaacccgcauuggaaggauacuuucuaaagauuccagauacucccuuggagaaaaagucaugcuuguuuuucuuuuucucagcuuuauccuuuaaacucuuuccccuccucgcuacacugaaaucucuccagggaugaagaucuaagagaaguaccaguuuuguuuuuuuuuguuuguuuguuuuguuuuuguuuuuuuuuuuuuccgagacaggguuucucuguguagucuuggcuguccuggaacucacuuuguagaccaggcuggccucgaacucagaaauccgccugccucugccuccggggugcugggauuaaaggcaugcgccaucacgcccagcaagaauuguuuucuuuagccacuaacaaacugcauauuuggaaacaacuuaauucuaugcuaaggaaacacacaagccacagugaaaguaacauuacaccucucuaacccacuaaaacuacuucaaacaacgaguuuccacaugccaaaggaaacuucauccacgagucuuuaaagccccuccaucuguuccuugauacaacuaccaacagugucugcaccccccccccccauucuuaccaauuguuaaaauaaagcuuaaacaguguucaccccaucagggccccuaguaucccaggcauuccgaacaauacaacugaauucagacucaaaaggcuccgucuugagguuuuuuuuuuuuuuuuuuuuuuuuggcucugguugaguuagcugcacaaagccugcuucagaccaggcacuagcgccgacuugacugcaaguagacucccuacuggaccuucauauuuguuaacuccucacacuaauuaucuuguaaaacuuccgaacacgugcaacaggucuggccggaugaacggcuggagcaggcaaggguggcagugagcuacccaagggaacuguaggcuggccccaaucugcaccugccucguuuuuagaggaacaagccgacaccuuauucauucccauuuuaaagguaccauucgaccagaaucccaaaucgaaacuuggcuaugaucccugccucauccagaaaaucguucaucggggacuccgagaccgggguuucagugacagcuuuuacaggcacgggcacacgagacugaagcucggucuuaaacggcgcccagccguucugggaaaaggcgcggccucggcggguagcaucguuccggcuccggggccucgccaggcgggccagacucaggaguggcggccucggugggggugcgaggcugucaauggguaccgagcaccgcgguguggagccgcuggggucgcuugucccaacccguguccccggccgccgcguuugugcccggcgcgcccgugacucagcagcccugcgccguguggccgccacgcgccacccgcucaccgguugaaaugauccaccacacugagcagcaccagggggugaaccaccaccuucugcaccgccagcuccggcaucgcgacacagcccgaccaccggcccggcucccugcaacccgcaaacaccagcaaccgcagcgacacaggccgcuccuccaggccccagcaccuccccuuccgguuugaccgccgcugcacagucgacuucc

SEQ ID NO: 4760 - RNA, 8105 nt, Mus musculus
ggaagucgacugugcagcggcggucaaaccggaaggggaggugcuggggccuggaggagcggccugugucgcugcgguugcugguguuugcggguugcagggagccgggccgguggucgggcugugucgcgaugccggagcuggcggugcagaagguggugguucacccccuggugcugcucagugugguggaucauuucaaccggugagcggguggcgcguggcggccacacggcgcagggcugcugagucacgggcgcgccgggcacaaacgcggcggccggggacacggguugggacaagcgaccccagcggcuccacaccgcggugcucgguacccauugacagccucgcacccccaccgaggccgccacuccugagucuggcccgccuggcgaggccccggagccggaacgaugcuacccgccgaggccgcgccuuuucccagaacggcugggcgccguuuaagaccgagcuucagucucgugugcccgugccuguaaaagcugucacugaaaccccggucucggaguccccgaugaacgauuuucuggaugaggcagggaucauagccaaguuucgauuugggauucuggucgaaugguaccuuuaaaaugggaaugaauaaggugucggcuuguuccucuaaaaacgaggcaggugcagauuggggccagccuacaguucccuuggguagcucacugccacccuugccugcuccagccguucauccggccagaccuguugcacguguucggaaguuuuacaagauaauuagugugaggaguuaacaaauaugaagguccaguagggagucuacuugcagucaagucggcgcuagugccuggucugaagcaggcuuugugcagcuaacucaaccagagccaaaaaaaaaaaaaaaaaaaaaaaaccucaagacggagccuuuugagucugaauucaguuguauuguucggaaugccugggauacuaggggcccugauggggugaacacuguuuaagcuuuauuuuaacaauugguaagaauggggggggggggugcagacacuguugguaguuguaucaaggaacagauggaggggcuuuaaagacucguggaugaaguuuccuuuggcauguggaaacucguuguuugaaguaguuuuaguggguuagagagguguaauguuacuuucacuguggcuuguguguuuccuuagcauagaauuaaguuguuuccaaauaugcaguuuguuaguggcuaaagaaaacaauucuugcugggcgugauggcgcaugccuuuaaucccagcaccccggaggcagaggcaggcggauuucugaguucgaggccagccuggucuacaaagugaguuccaggacagccaagacuacacagagaaacccugucucggaaaaaaaaaaaaacaaaaacaaaacaaacaaacaaaaaaaaacaaaacugguacuucucuuagaucuucaucccuggagagauuucaguguagcgaggaggggaaagaguuuaaaggauaaagcugagaaaaagaaaaacaagcaugacuuuuucuccaagggaguaucuggaaucuuuagaaaguauccuuccaaugcggguugggguguuuccuuaucuuuccuacgggaacuaaccuguuacauuuguuuauggaccuuagguccgacauaaacuaaauuguaucuuuguuguugauacuugcuacucagucgcaaguaauagcuuuuucgaugagugucugugacugaccaccuguuuuucucacucagaauuggcaagguuggaaaccagaagcggguaguuggugugcuuuugggaucauggcaaaagaaaguacuugauguauccaacaguuuugcagguaaaggauaagcuuuugauuuugcugagcaugguuagaaugucuguuuacucacaaaaaaggggaaaaaaagugagcaggguagugguggcgcgcuccuuuaaucccagcacuugggaggcagaggcaggcggauuucugaguucgugggcagccuggucuacaaagugaguuguaggacagccagggcuacacagagaaacccugucucgaaacaccucccccccccccccaaaaaaaagaacuuuuuuacuacagucugaagcuccuauuucagaauugcugauacguaggaaagggagaccgauggcuccacacuagucucuguuguagcuucucagcucagcuguuggagugcaagggcugcuacagacugugucacgguagccuggcugcauuucagaacaagccaucggguagcuugucagcuccagcacuaaacauuugaacccuggcuuugguggagcaaggagagagauggggacuguuucccuuacacucgguaaugaaucggugccagaacauugcguuuaggcuccguguguuauuuauugccagcaggaucugugaucuuuaaagagaccaugcaggaauugggccuuuagcaggucagagaguguguccuuuuuaagggguaccuccuugggguaccucagucuuuagcauuuuaagagaagcugggaguggggagguuuugaaugaaggcgaagcaguacugcccuggacaguucacauagugaggcaggugcugcugagguuccacgguggcugaacuuguagcucuaggcaaagucuuucauuuucucuuuuucccuuucucucuuuaguaccuuuugaugaagaugacaaagaugauucugucugguuuuuagaccaugauuauuuggaaaacauguaugggauguucaagaaggucaaugguaagucugaguuucuaaguguguguguguguguguguguguguguguguguguguauguguaugugugugugugucugugucuguguguguguguguaugugugugugucugugugugugugucugugugugugugugugugucugugugugugugugugugugugucuguguguguguguguguaaaccuggucuuuuuguauauugucaaggguugauucacuuagcuggaccaagugaaaauagacuagugguaauaaaaaacugagguagaauaaauaaaccacagucggagucuaaggcuguguagaccacccaagcuggaggcugggcuggcccucacggcugccugcccuagcgccuuaguuguaguaaaguguguugauguuauuucaguggagcuaucaagucucuggauccacucacccaccccacaccacacagcugcucucuggggggaacuugaauuuauucauucuugcucuggaacugaugugucacaucacgugugacuggccccuaagcaagucugggagacagaugccucugggcugcacagugcuuacccucuaagaauucuguuuuggaguuuuaaguuucacaaaugugucaggguuuauuuuugugucuaauucucaaagagguggaaagccuaaguaagugcugguguucuuauuguuugcgagucggcugcacaaaucuugaugaaauaguuaaaacuuacuaagguuuugcuucccagccagagaaaggauaguugggugguaccacacaggccccaaacugcacaagaaugauaucgccaucaaugaacucaugaagagauacugccccaacucaguaaguaacuguugucacagcacugugaugcccucugcucccuacucaaguaacagccuccucagaagaccuggguagcaaaguccuguugcuuuuccaaagccuuuggcaguaauguguuguucuaaguuaugauuugcugugaccuagaguauuuaacggcaccugcuugugcccuguguauaacaacuuaauccucucagaaacuggauguugucuuuguaaaugagggaacuaaagugaagaauggcucaugcaugggccagcaggguggccaugugagugaggaaaggcccuguuuccaaacccacacuggagggaaccaacucccacaauucuguauguucucucucucucuauauauauauauauagagagagagagagagagcaaaaggcaauauuuaaguguaaauaguuugaaaagggaccugggagggaggcagagcugaaugaaauaacuggaucaugugaaauguaaacuuauuuuugcugaacaucuggcuuguuucuaauugaaugaagaaaauggucugaguagucagaagaaggcuuaaaaguuguaccuuguguuaaaaggaagccacgugcuaaacuguuuuucuuccagguauuggucauuaucgacgugaagccaaaggaccuaggacuucccaccgaagccuacaucucaguggaggaaguucaugacguaagucaccugcuuugggcuggagauuggguuagcaaguucuugggugaguuugggggcuuuuugguuugguuugguuugguuuuccauguucaauuuaacaaaccuuucacucucuaugacaaagagaagguugaguccugcuaucagaccagccuugaguuuuuuaaacaucuaauucuagaaauagaaaaugacagagaaaccugcgauccuuuuucacuaaggaaacugaagccuuagcugggcgugguggcgcacgccuuuaaucccagcacucaggaggcagaggcaggcagauuucugaguucaaggccagccuggucuacaaagugaguuccaggacagccagggcuacacagagaaacccugucuugaaacugaagccuugaguagugagguggaccccagaaucgucauugagaccaagcaguugcgugguuacacagagacuuucacaagggaaaggccaggccugcugcagugugcaguguccuccugagaugcagucccuucagacaggcucugggcuuucaaacauagcaagacagagcugucaagcaccagguggcaaaaccuguggucuuugcggcugggguugcguugaguagagcacugagcaggagguggccuuucuuucucuauccucaggagagcugggugggggcucuuagaaccugaugugacaggguugggaggaugggcacagaguauuuaucaguguguccaaggagccuggucuucagagucaagagggauuaagaguaauauuucuuacuauguucuuuugaauuugaaaagagauguucuaggauggugcccugccugccuuacacuaagccuuguccuguucuuuugcagccccaaggagcuuagauccagauguuguuugguugcaguaaagcuuuuaucccugguccugaccaaguugucaggaaguucuagaagcguagaaggcucaggccauccuagugugcaaagacuagagugacuugagggaauccucacacuguccugagugacaugaagaccagcugcacuuccagcagguccagugugcagugugacuugagagacuugcccaaggcacuacggcucacuuagcacaaacugguggaucccugcagucuguagagcccucaucgaaggacauggccugugcuagcaacagggcuaaaaugugucuucucugguuccaccauugagucaccagaugucaagugacccaaccccucaguggaugcuuuaauucaaauuaguuacucccuuuauuacauuggggcuccugggucaugugauccaggggacaaaguuaauuuagauguguuggcaugagugugccucaaguguguguauucuguauuuuccacucuagaaauaaccaaacucuuaaccugcgucuucccagccgugccccacccccaccaguguggacuucagggaauaccacaguuucccuugacaagaaaacuuuguucagagaacagcauaguggcagcaccgugcaaacaggcuagcagcaguguccacagaccugacuuagccuugagggcuuauuuuucaaaaagaaccugaccccaccauugcuguggaagucuuugucguauagccaugaaacggucuaacugccaaagauucggguaugagaagagagacauugcugguugaaaauaaguaacaguuaagccucuucucacaggaugggacgccaacgucaaaaacuuuugagcaugugacuagcgagauuggagcagaggaggcggaggaagucggaguggagcacuuacuaaggugagucugcggagcccagcggugaggaacacuaaggaccuggguucaguuugcagcucacagccaccgugacuccaguuccaaggcaucucaugcccucuucuaaccuccaugggcuggggacccaaaccugcuguccauguggagaagcugccaggcugggcaugguggugcacacuuagaaucccagugcuuaggaggcggaagcugauggaucucggaauuugaagccagcuuuuuugggggugggggguuggggagcaguuggacaguaccagagucagcuguagcaugugaccucgggucaggugucauccuguuaugugcuaugcuucuuucucuuggucuagcccuuugguuucuuucuuucugguuuuuaaaauggccucacuguagcccaaguuagucaaguucacaguccucuugccucauccugcaaggugcuaggaguaaaggccggagcuuccacuuccagcccuuagaugucuuccaaaccagugcgguugagcacgcuuuccucuggaguaucuugacugaggaugugugacugacagcauuccuuguccagaauucauagugcugacugugacagaaugcagguguguaagcgcaggccugugcucuccagguaauaguguuucugcagaggaccuucauccuggggcaggaucuguguauaagccauacuugaaagacuucauuuucaccuaccacuaauccugguuuugaagauggccacugacugauuuaaguugcucaacauuguagcaaagcaggugggaaagugucauccuuuauaaaccagagaagccacaguaccaagguuagcugugagggcuggagggauggguggcuggugucacugggaaccugaguucaguccccugcagcccugucagcugcaggggacucugauguugucuucuggccccacacacauaaguugccagagacccagaugaccagaaaguuguuguagcucugaacuguugucccagaccauccuuacauugugggcaaugugggcugaugccuuucugccuuucuuaugggcuguugcagagacaucaaggacacuacaguggggacucucucccagcggaucacaaaccagguccauggcuugaagggacugaacuccaagcuccuggauaucaggagcuaccuggagaagguagccagcggcaagcugcccaucaaccaccagaucauauaccagcugcaggacgucuucaaccugcugccggacgccagccugcaggaguuugucaaggccuucuaccugaagaccaaugaccagaugguggugguguaccuggccucgcugauccgcucuguggucgccuugcauaaccucaucaacaacaagauugccaaccgggaugccgagaagaaggagggacaggaaaaggaggagagcaagaaggagagaaaagacgacaaagagaaggagaagagcgacgcagcgaagaaagaagagaaaaaggagaaaaaguaaaugguguagcuuuuuuaauuaguaaauuaaaaucuuauaaccauaacuccgugugccacuaggaggguccuuugucacauucagugcuuguggacaagcgcucugcccuggucacccuugcuguggcauuguggagaugaguggacaaaaggacggaucucagcccuacgauacagcuucaguugcaugaguugggggugugguggcucagguguccgacuucaugaggagaacaaccuagccuugggcacucuuccuuuuauccuugaaagggauuuuuuuuccuaucuuacaagauccaugggaucuguugguuguaauuuucauaauugcuaaauggaauucauggaucccauacaaugccgcccaacacuugagcuuggacccuugugaacuuuugagaccacaccaccuuuuggaccuguaacuagcauucuuagggcuugggguccaaggccauguauuguuuaccuucaaagauacaauuaaauggcuugguuuuuau

SEQ ID NO: 4761 - RNA, 1250 nt, Mus musculus
gggcuuucccugcccccccugcaccagugcggaaggcagagugugccaagcggcuggcgucuguacccugugggaaaaguuaacuguaauucuucggcuuuuaaaaucaauuaacccguguguuaauuaacgucaagucgacgggaggaggagaagaaggggagggcgggagaaaagaaaaaaaagcugcaagggcggauggcagaagaguuggcacggugccauccauucaggggcaacgccacaguuucgugugauagcagcagcggguauauguuaccgggcccuguaugcgggccagacagugcgguaaagccaagggagauuauccagacccccaggagcgaacagcaagcagcaacgcaaggcgcaagugccaggauuacagcccaggcugcuccaacuaugagcccuuccuuggacccugggaaucggcuacuugggguuuuggggucuuccacaccaaagaagcacaaagcugacuuuaaucacuuuuuucauuuaaacuugauucugccgcaguggaagagccagcacggcggauguuuucacacccagcaagacaaaggccguugucuccgccaugacaccauuccguuccaagcagaggccgggguccuggacaucuugaaaaaucaaaaagaaacaaggaaaacaaacaacagauacagcgacagucagagaaaaucaucaaccacccaaacuguuuguccguugcccaugccaagggugaugugggcaucuguugcagcagaaggcacuugugugggcuauuuuuguuuuuucauuaauuuuuuuuugagagggcaagcuacuggcuuauuugcuacucaacuucguuuauaauuaacuuaaaaaaacaacaacaacaacacaccguucagccaagucaacaacaaagaggaaaggcagacaucggaagagaaaugccugaggaaucggcaugaaugcaugccacagccgguaccacuugccauucggaaaaccucagggaaagaugccaauuuuauagcuccgaagaaggcagagaaggaaacauaaaggucuacagauagaaauucuaaggaaggaauacugcuuucccaauccuggauggaaauggcacacagccucugcugagagaaaagagggaauguuuaaaaggagcuaucuagauggguagacgugaaaacaggcaaccaucgagugcauauagagauguguguaaggcucugcguguauacaaauacacagacucucugacaaacuga

SEQ ID NO: 4762 - RNA, 1126 nt, Mus musculus
cuuuuuuuuuuuuuuuuaacuuuugaauauuuuauuuauuauuguuacauguaugaaugcuuuugccugcauggaugucugggcaccauaugugugcaguguccaaggaggccagaagaggguguccuauccccagacacuggagguccuuaaggaguugugagccaucagguggaugcugggaacucaccaggugcuauggaagaauaucuaguccucauaaucgcugagccaccuuccagccccacaauucagcauuuuaaaaccaaaacuaacugcugggcacaguagugcacuccuaaauacuugguacucagggagcugagacagaaggauaacuugguccaugaguucaagccuccccaggguaauauuguaagaucccauaucucaucuuugucacuaaaauugaauuugggucagaucuagguauugguagcucguuccucuaaucugagcauucaggaggcugaaggagauacccugccagaagucaaagccauccuggucuacacagagagucagccaggauuacagugugacccugucccaacugcaaacaaaaacaaaaauaaacaaacaugacaaguacuaucacagcacugauuuaaauccagcuguucccaaacuccagaccguccucuaguacaagagagaucugaguuagagccaaagaaagcacacugccaguguucucuggagacccuaaggugguuccuagaacugccaaccaucuggaaaagccaucuggaaguaaggcuucauuaaguaucuccuacagcucauuaaagcagggauucaacagcagcagccacaucagugugugucacaauguucuauacugucugggucaacaagcaauggugacagccaccucuggcccagccuuccaaauacugguuccgccaguguuuuccggcuucuuuccaccgcuguccuucgaguuugcucgaacauggccuccaagucaaaugugcgagcuuucuucccgaauccugugaagcccauggugaccgccagcugagggucgggucccgccgugucugcgccugucacuucgcugguucccgagugcuccaugacugcccgagcccaccgccuccguggaugcagcagcgcgcgaccu

SEQ ID NO: 4763 - RNA, 1126 nt, Mus musculus
aggucgcgcgcugcugcauccacggaggcggugggcucgggcagucauggagcacucgggaaccagcgaagugacaggcgcagacacggcgggacccgacccucagcuggcggucaccaugggcuucacaggauucgggaagaaagcucgcacauuugacuuggaggccauguucgagcaaacucgaaggacagcgguggaaagaagccggaaaacacuggcggaaccaguauuuggaaggcugggccagagguggcugucaccauugcuuguugacccagacaguauagaacauugugacacacacugauguggcugcugcuguugaaucccugcuuuaaugagcuguaggagauacuuaaugaagccuuacuuccagauggcuuuuccagaugguuggcaguucuaggaaccaccuuagggucuccagagaacacuggcagugugcuuucuuuggcucuaacucagaucucucuuguacuagaggacggucuggaguuugggaacagcuggauuuaaaucagugcugugauaguacuugucauguuuguuuauuuuuguuuuuguuugcaguugggacagggucacacuguaauccuggcugacucucuguguagaccaggauggcuuugacuucuggcaggguaucuccuucagccuccugaaugcucagauuagaggaacgagcuaccaauaccuagaucugacccaaauucaauuuuagugacaaagaugagauaugggaucuuacaauauuacccuggggaggcuugaacucauggaccaaguuauccuucugucucagcucccugaguaccaaguauuuaggagugcacuacugugcccagcaguuaguuuugguuuuaaaaugcugaauuguggggcuggaagguggcucagcgauuaugaggacuagauauucuuccauagcaccuggugaguucccagcauccaccugauggcucacaacuccuuaaggaccuccagugucuggggauaggacacccucuucuggccuccuuggacacugcacacauauggugcccagacauccaugcaggcaaaagcauucauacauguaacaauaauaaauaaaauauucaaaaguuaaaaaaaaaaaaaaaag

SEQ ID NO: 4764 - RNA, 17980 nt, Mus musculus
acauaaaagccacccugagagcuaagguucuagaaagagcuacccaaggacacaaagggcccugccucuccugucucuauugcagggauaagagcuauaaaagagaaaggagauuuaaaaugcaauaauauuguacaaauaauauauuuauuuccaaaccccaugugauggacaaauuacguuucucugccucgaucucgcuucuuuacacaaggauuaaaaaagucucagccccagcgaggcaucguccugggcagguuacguggguacgaugguccagccaccuccugcugcucaagcagcuucguguucacccugcacuaggcuccugcugagcccugcaucaggacugcccacucuaggacagagccugacucagcaggaacugcuccagccucgaugacccacagaugaacacgcaggugaaagccuugucugcggaguccuuaggaaacacgggcuggagagccaagaucuuaguacguggccaccauccuccccugggacagccucagcucacaguccaaagcgggcuggcgugcggcgaggcgucaugggcucccccugcucuuuccguccuggaguguagaucuuuguggaccuggacacacagaaagagguaagaaacaaugcuccucccugagcaggaacccaacagaaucaaaggccucgaagccuugcugucucugacccaaugcacagcagcuucaaggcugaaggaccgcaccugcagcacaugcuaccucccuugcagccccaccuccagagacuguaaaggaagccauccacccugacaucauuaagggacauucacagugauuuuuaaacagcuccuuuuguggccccuagauaaucaggucccuacuucaacugugugacaaagcacggcacuugccuuuguccccaguuccuggaggaauuagccaaaugaucagggcaucucugcuacucaaaaagaacacuccugacagcucauggucgccuugagggagcuggcgcuggauguccuggccaaagagaccagucaccuagagaaagcgcgggguccgagccgugugcuaucagccuaacccacggagggcagggucaggaagaagaccagaggcuguguucaacaaccauccacaacaaugucguugaacuccguuaaaacucgcucacuggagugugccugacuggcaaaaccugugagcauauacugucacacaccaaugggccagguaauggcccuuaggacaccuccuucuacacggcucuuccuuugguucuuuuucaguaauaaaaauuaucaauuaaacucuguccucagccgggugugguggcgcacgccuuuaaucccagcacucgggaggcagaagcaggcagauuucugaguucgaggucagccuggucuacaaagugagcuccaggacagccagggcuauacagagaaacccuuucucaaaaaaacaaaaaaacaaaaaacaaacaaacaaaaaaaaccucuguccucaguuucugaacccaaccagaaaccagagaaaguccgugugaguccccaaaucuaaagaggaaaccuucuggugguguguggagugaggacagcaccacagaaggcugugcccuaacugucauacucagccugacucccugcuuuacccgaacacaggugccgaaguccaaggcucucuucugccuggcauuuuuuccaagccccuugccugacaauaaaacugcaagacucacagcaagacucaggccacuucgggcccugaaucuacaugaugaccaagaacugcagcggacacccgugccuccacaugugcccaccuggcacaacaccaccucugcaccaauugcugauuuaaacugacaacuuuucuuaccccuacucagcacugccgggccucaccugacacugcccaaggggcugcgcuucuccugcuccugucgccgggcacgcaacugcuccucggccaaggccaucuccucuuccauggcagaggccucuucuuuagcccgacgacgauucuccuagagaaaggcagaugggacugacuucagaggcucugucugugcuugggaccaguucuaggaacccaggccuguguagcucuaugucccagcaccaagggcaccuuuccuugugcagcucaggacaguuuguaaacuauucaagauagauauggauaagcuggucuaagccaguuaccccucagcacuccaguaaguacugacaugcugugugugugugugugugugugugucugugugugucugugugugucugugugcacacauguguggguagaugaggccacacacaagccagggauaggcugauucuucaccugauuccuugaaacuggggcucucacugaaccugaacuucaccuaggcucacuuccagcuaagcugaaggucaggcuuccaggacccccauaacaggggguuacagacauacauggcaauucccagcuuuuggauaugggugcugaggaucuggacuucggucaccauguuuacagagcacaucuuacccacagagccucccaaccccaagaacugucaaggcaaccucaagccaaguuucacguuucucuccgggcaguacuggagacugaacacacaccagugguuuuucugcugagcuacugccacagugcaguacacacguucaucucaucaagucacggccaugccaggagguacagagaaaucaugaagacacuguguuugucccaguguggagagaaguaugugaaaaaguaggaaugcgaaagcagagccacauuucacaccccucagugacagagcaaagcgucacucauuaguagacaccaaaccccugacauggagucauggguggaaggaacugaagagagacgagcugacaccaccuggaccacaaaugugucugagcauuugagcaucaucacaacugcgaccaugugcacacaucugcagagcacagcugagcagagccacucaggccuucagucacugaaguguaugugacagagacucaaguuagccacugcuaaaggaaggaaucagccaagugcaugcuguggacagaugacaacugcuccaauaaaucagugucacaaagacagaaagcagguccugucccggaacaaagguguuaacacacauagccaccauggcgacguccuauccuauucaaguaaaucaacugugagauguuaucucagagauaaaugaggaacucugaaugagaacuagaaacucaggugacacggaagauuaacuauuaggagugacacugucguagaggccauguuguugaaauaaguccuacccaucaucaaauacuuaaggauaaaauaacaaucuggggaagcacacauuaaaaugcucugggagggcaagggaugcgugggaagugggggggggggggaauaaacgggaaccacugaugucaccuacagggacuaagaguuuauuacaguggcugccuuagaguacugucuaguuuaugaauguuugaaguuuucaauuaagcuuaaagaguaaaaaaggcccagccaacccacucacuggaggagcacgggacaugagacagcuuuuacauucggagagaauguggaauuaagacgaugacaagccuuccacagcaggugaaaggacaaucuuuuccacaggcaaacagcaucuccccagaagcacagcgcccuuaccuggcgagauuugccugccugcuucacacuguagaacauggggccuaacucggccagccacucuccauccacagcggucacacacugcauguacuccugugggcacaaggcaaacagguagaggucaccagggaguuaggucccuccuguaaggcugggaaaugucacuaagggacacuagaauugucauugcuucuccacccacauuccccugugagaguaaacaguccucagcauccaaccaugcaggaagccccucugaaggcucuagcaggggcugcuccugccagcagccagcagggggcgauccucugccugaggccacagugcucucuguugacuggagaaucccgacaggaaccccaagcugaaaagcagccuugaaggcccugcaguuaaaacuggugccucaagucuccaggacucuauagaggcaguaguaggauucaaaggccuggcucuagucagugggccccaaaaugggaacuccuugggcgagacucaccuugguggucaugaccagcucgugauacacaauguagucagggguguagcccaugccgaagagggagcuggugggguguaaguggcagggcaucccugugcggauguucacauauuccccaauccccuagagaagaaaacagguagccacaucaccaauaugcucuugacaggcuuaggggaauccuagagcuacaaaacugccugagagagcaggcagacuuggaaaacugccuuuacguaggagucaggaagagaaagaagccaaaacuuuguggcuccgggcucaccuugagcuuggcugccugguggaaauaggcagcacagauacacuuccugacaaugucccagucggugccacaugaggccaggcucauccgcugcugcaccauaauauccuuaagcugggcccguaccucccgaaccuaaagaugacacaggcaagacaggauggagcccuccucccucccgucucccacaccaccccuucuccagaccgcaccccucugggcugccaccccaccuuccgcauggccuuggcguggaugaaguggucauugcaccagaugguggaguaauuguuguucuuccacugcagguagacauucagguaggucagguggucacuuucggggacagcaaacuucucccggauuugaucgcucuccucuucucugcccuaggaaaaggaacagggacuuuuaacaggcauggggaggcugaccccacaggaccccaaagagucucacacuauaccugcucacaucaauaugccuaacaacacagaauaaaaaucauuuauaacaaaauaagcuaaacaguagacuacgagauugaagauggucuuucaaauuuccaaaacacuacaaggaccacugacccagccuuccgaccucccuuuaaccagccuacaagacagcacagacagaaucuccaucccaccccaugacacaggacagccccacuuccccgccagugaucccuggaagucccugggcgagcuacaccacacugccucccuaccuugggccuguagaagauggcggggaccgagagcauggagacgaugagcaggaucucggagcugcagcccaugucacaggacacgaugagcaucuuagagagggccggguccagugggaacuccaccaucagccgcccuguggacgugagaccaccugggaggggagcgcaaagccaacacugcagucaacaguggacaaagggcagaacuguccccucuguguacacaccaccgggccccagccgugugcacaccuguguuguccagggcuccgaggauccagagcugguacauggaguugagcauguuguccucggggggcggguccaugaaguggaacugcagcagguccugcacgcccagggacuugagcagcagcaccacauuggcuagguugguccucuggaucucgggcacggugguggucagcaguucguucuuguaagcgcucugcguguagagccugccagggaggagccagugacccggcugcaccugcccugugccagccugccagccucucacguguuagcuacccucaggaaccacucggcagaaugucagcagaaguuauuccagccucacaagugugaccccaaccagccaacaaauccuccaagcagggacgugaccagcccgcugaucugcuuagccugucuccuaagucucacucuuuugcuggagccuccuagugccugugagggccaaagcgcccgagacuagaauuguagcaaaguuuuacuggcuuaacgucuguauugauucugaauuucugaugaaugcauucuuuuuuaaaaucauaaaaacaggaggaaaaaauaucugggcaagugaaaagcaccccguuuuacucaggcucacccacggagggcagccugcuguccuuacugcuguucacugagguccccuccuacagaacugccuagagcucagggcucccugaagaccaguccuuccccucaucagccccagacaagccccucaccccacccccgggcucugggcaguaagcaguuccagcaccgcccuaagaagcaggcuagcacagggcuccuaccugaaacacugaccugggcccguccugccagcucucccugaccucugguuggcauuggccuggcuaaugggguaaaucugcagggcauccaugccaauccugggguugaagaccuagugggggacacaaaagaacugaucaaggacggcgugacaagagaggaaaggaguccucagacaaaggcaaacccaguucugcucaccacagaggaugugaugagcagccuuggugaucgucaacuuaagagccaggagacucaagaaagccucagaggucucuccauccacaccagcucugggaccacuacagaacugcuuaaauaucuauaccaucaagcuaccacaaggauaggcuggaaaggucagugcucacugaauguuggccuaacaccuccaccacucucaugcacugagugucucuaugcugaguucacuuugggugaagcuuuggaauccagccuccugcaucaccccucgccuccugcaucgccccucaccuuuaacuugcaguagccagagucgaugacaaacaugaugccaucaacagucagagacgucucagcaauguugguagcgacgaugcacuuccggacaccaucuggagccuagggccaaucaggacaucagaaggaaagguaaguuuuggggagggagagacugaacaggcaagaaaagcccaguucacaccuguucuucuaggaaagaaauauccccccucuugcgccuuugagggacaccaagagacaggcauagcgaagcagugcaccuucuggaagaucuuggccugcaggucagacggcagcugggaguagaugggcaguaccgccagcgcaggcgcguucuccagcuccuccaggugcuccacgaucuggucagaugucaccugcggcacagaaggagucaugagaccccagagccccuaacccucagguggaggguucccauccaacccaguggugacugaagcacgcaccucaauguccucuuggccuggcaugaagaucaggauguccccaggggccccagacagguguaccugcaaggacugcuucaccgcggccuccacguaaucuuccugcggggucugaacacagcagagggaacaagggcgccauaggucagcagcccccagacgacacacagcuucauccugucugagcugcagcacuggacucagcaaagccaaccucagggugagccugauugcugaggcccuuaaaauuagagcugguaucccugggcuccuugcuucagagacaaggacucaaauccuugaggcuggcgucaggcuuaagcagaccauagccuccagugcaaauggcagaagcaaucaggaaaaggcuacauggcucggaccucagacacggcucucugucuaccuauggcgcuacagugccccauuuaccucaugccacuaaaucuucgccaacgcuguacccccuccuccagcugacuuuucaccagagaaugucaaaggacagagaccucuguaccuugcugaagaggaugucaacaggaaaaguccgcccagggauguggaaaauggguacauucccaaagaaggcagcaaacuuuucugcauccauaguagcugacgugacaaugagcuucaggucugagcgucgagccacaaccuaagagaaggggacagcagggguuccugugaucuugggacuucagucucagcucuguccacagacagagcaaacacuaacgcuggcaagccgguagcuuugucugacugagcaauggagcuacagcucagcgugaagacaccagcagggcugaccaggugaccuggaagcuuccgaggaagccucacccauccucugcaccugagccgcagaggaaccagagcccgccguggccuuaccucccggagcagcccaaaaagcacgucgguguugagggagcgcucgugggccucauccaugaugacggcgcuguagugguccaggucagccucccggagggacucgcgcagcaggaucccauccgucauguacuugaucaagguguuuuccgaagugcaguccucaaagcggauggcauagcccaccuggggucagagacagagcucaccaagaggcuaacuacuuaccguuugcccucacagacuggagucaggcuuaagcagaccacagcuuccagcacaaauggcagaagcgaucaggagaaggcuacauggcucagaccucacgcccacucaccucuucuccaagguugccccccaucucuucacugacucucuuggccacugacauggcagccacacgccggggcuggguacacccgaucaucccauaguccguguaaccaucuucaugcaaguacugggucagcugaguggucuugccacucccugucuccccgaccacgaucacaaugcuguugucucugcagggaagagcaagcaaggcacugagcagccugagaggaaagccaagcuugagacaauucccugagaagccuuaagucuggcugccucuggcaaagccuagcucugcaagaagcauucauggccagaggguucaccagaaaccagcaucuuauggggcuuccacaugagaugccagggacccagucaaggugaaccuggaccacuaaaggaagugaugucaucuuacugugcgcagcacacacucagccagcccauuacgggcaaaguguuucccuugcccauuagacaaugcacagacaggagagccacggggccugggccguuaccugaugauggugagcagcuccugcugcacggcaaagaugggcagguacugccucugcuccaggaucgacuucuucuuggcaaacucacugcuggccucgcuuuucuccuucaugugaucugcaaacuucugcuccguccugggaaacacagaggcacacaugaccucccacacugucccucaggcugaaguuagcugcccuuccugcucccaagaaugugaacaacugcgacaagaaucagucaaccuccuggacuccaaagcagccugggcauccaagacuguaucuaaaugggccuaaggagcagauaucacacaagacuccaccuccauaauacacaguccagagcccugaucaaacagcugcauagggagcagacaucagacucuaggugggcagaucgccuauccuaaacaaaguguggccagaagaggggcugaaauuaaccagcagguaccaauuuagaaagaagaucuuggacaauguuaggaccagacuuaaagggcucaaacagcuauaggggucucccaagugcuagcuacacagcacaggacauagaucugaauuccucccucccuuaauaggacuaccaagugcaaaggccucguuuucaaagaacuaugagaacagcucacuucuauuugccuugcuucuagauaacaaccauguaucagugucugauacauggacacacaucccaagacccuugcucccaccuucccccucagaguccuuuccuuccucagaucuuacccaagcucuucaagugucuaguucucauuuuacucagucccccuggccaccugacaacugaaacuaagggacuccagcaauaccaaccucuuaguugggacacuuuacacagaaguacuagguaaagacgacaguuccacgggacacgucgucauuaggggaugcgcagugggagggcuauuuugaguguagcaccaagccaaugcagggacucagacaagcagugacugaacgacugcaucagaccccaugaacggagacacuaccaagccgagaguccuaaaaggccugggaagccagcccucccuuccguguugugcugaaaucugaccaagaaaagaaacccugccugucaggaccaacauuuccuagcuaggugcucugaagcaaaguccuuaaccucccugagccucaaucuacacaaccaucacuguaucagcggugguggugacagcaaggaaagcucaagucagaagacaggacucaggaagggaccagaaugcacaaagauucccgucacaagccaggaccuugggagccaacuugcuacugaccgagacuacacacacaccuguaguccacuuucccgucuucugucauagcuuuauccggcuccucuucuuuuuugacacccauuaugucuccuaguuuggucccugccaguucccaguguuugugcugagccugaaggugaaaacaagaguuaaaucacugcauccucuggcaagacgggaggccguggaggcuauucugauggaaggcaggcuuuacccagcagacaguaaauucccacaaggcaccaagccacacuucucaaaccucaugccuccaagcccccaacaccaggccccaugguugcuuaacugaguagaacacaguauucuccugggcugccucuugauccaugcaaguauguccucugacugccacuggcagucacuguaugcagucuugacauuuucuacaggaguaaaaagcagcccccaaggaccucagcccuaguagcacaccaccaaccuuucuccguucuuucuguucccugugcuugcggaccgucuggcugccuuuccgagcaauaauggccaggucagagguggcauccuucacugggaucacaggcuccggcugcaagaaggaggagaggucacuaaaggaaccagagggccugcugugcaugggcccuaguacaacaggcacuacccucuggcaccgacacuugccuguaccaacccucuccuccucccuccuucagcacuuucuaacccgcccgucucuggccacagaggccucaccugcuuggugaaaacgaugcgcccauccagaaagggaggcaccagguugugcaccaucagaugcaccuuggccgcauuguccucuucaaaguccucguccaccuccagccgauggaccaccccacuggugagcauucgguuugucucccagcgcucauuguccugugggacacaaggacagccacauuuagccagcagcuaaaaggggauccugaaaggucaacaagcaagcccacagacucacaacgggcucugcacccugcagcuccuuaaacaggagucacugaagccaaggccuugcaguaccuugucccaagaagcagcugggcaccagcccuaccccagacacaaaccacacacccagagaguaccaccauaccacuccccacacggccccucacagcguagugcaugagagcgaagcaggagccaggauuccucagcuacccaaagcuucccacucacgcuccuguccugcagaggcaugugugaccugguccugucuauagacagccagcuguguugugucaucgccuggcacccugagacuccucccacacgccccagcucugcccuaagccugugccagccgccgcuaccgccgccccugcggccucaccucguugauuugccugcgcugcgcugaaaugcgcuucugcuucuguuugugcaggugcugcucccgccgccucacguaguccucagacgaguaggccagaggguuguggaacucaucguagcccucauccaucauguaccagucccggucugcuugcugcagagacgagaacaaagggcaggucacacucacggggacaugcagccagagaggagcaagacagcuaucugccaagaguccaaggacuccacaagagccuucaugaugagagaccuggaggagggcaggggagccuuuccacagcuuugacugauuucacacggcagacugccgggccaggcuucuuacacucugcacacagaggcacccacagccggaggcaagucugacuggcugcaucaguauaaagccucccugggaagccuggaucucuccaaagguuccagggcucggaacggcagucaccaccuuccugaaagcccuuggcuccaacaccuuucacccugaccaccaccuccuguccagccccucaacgaugucgccuuuacccucuggucauccucccacugcugccgcuccuccucugugucaaacgcaaucccuucuucgccauccucacgucugccugaaggaaagcagagggcagaggucagucccuacaacucccaucugacccccaccccccaacccccaaggacaaccagagccacaaagcugcacagccucuugaguacagccucugcucagccccaccgggaccagccaaacaguuuuucugccucccaccucccaggccuuaccucggccccuggacagacgugggguagaccccaagugucuucuaucaucagcccauucauuguacuuauaggagggggucggcagaggugugucaucugaagacuugcuccuuauagaccuggggaucaucaagauuagcugacacugagcugaacuguguccccagccgccacaacccucccuguccacaucccucgacuacuggcugucccauccauccauccaucaccugucucgaucccgaguggacggccgaugaccucgcucagagucccgauaggaagguguuggggaggguguuucccacugagagcgccuugaagagccauagccacugucguccuccucccaggcggaccucgaagggguggcugcaucuggggccgcagaaacauccacagucaaugagaugugacuuuagacaauccuccugccucagcuuccaauguacugggauuauaggcauaagccacuacaccuacuuucccaacugauucuuaauuaccucuauuuaucuaacugugugugucugugugcgugcaugcagaggucagaugacaauucucaagaguugguucuccuuccaucguguggauccugguaaaccaacucagaucagaaggcuuggcagcaaguguccucagcaggugagccuuuugaucagaguugaucugauccccuguucacaaccuuguacuuacuuguuacagauaagacacugcgacaaauaaauauuuaaagagaccgaacauaauagucuggcuuucacuguuuaaaacaacacugaaagaaucaauuucucucuuugaucuuaaaaccaauaguucccuuucaacaaauccuucuugauccaccacaucuugggauuagaacuugacucacggccugggaacaaagcggacuaccucuuacucugccuuucugcaccugagcccuaccagcagaggacagaugagaauaccuuugggccgaugucgaggacucucagguucauuucuucugcugcugcgcucggagccuccgucucggucugaucugcugcugugccuacuucugucccgcucaucugcuguaagagucgcauaggcuuaacaccauucacuaacaccaccacacaccccagcacugggcagaaagcgcaggccuccccacugacucgcccauaauccaugggcugagacucacacacucacaccucaguggacaguuagaugcccagcauggagaguucuguguauagcagaucugauucuaagcgaggccagugcuggaccccgccucacuugucccauaacacuguccucuacccucaucagagcuaguguaaauacuggcuucuucaauggaucacccaucauuuccuuuaucaccaauuuucacaauaaaacaagauccacacacucaagcaaaguugcuguccuacaagagagguaucguuccuuaaacuucuuccuaauccuagucucaaagggucaaaaccaccggggcacacacuauacaaaccaaguuguccaauuaaugacuauuacuguaaaaguccuugugacaggaagagaaaggcuugcugguucgaugcuaacggaccccaggaggggugccaggcacguuaccucugucucucuugcggucauagucucgaucccgggaucucuccuucuuccgauccuuuucuucuuuagaugaggcauagaccccgugcucccuccgaucccgcucucucugccuacugcguucccaaaacucuucacucacacccccggggugggacggagucucuacccgagcagaucgguaaugccugaaacagggagagugaagaaaggggucuccauggcagaaaacauuucccucuaccuccgaccaugccaacaagcaguauguccucuccacugcaucucccuggugcugaaggccuggacagggcuagaacccaagcacuuacguccacuucuuagcagccuuccccgcaaauccuuaccagcuccuaccugccaccaguaucauggaaucacaauaaaaccguaaagcucuuagguguccgacaggagcugaggugaaccugggcgaauauuuucugaccaccacuuuuuacccucucuccuuaccugucucuccggcuacuucggccagccugguccucgcucuccuccucggcauccuucuggucauccuuacucuccucccagucuuuguaagaagagacucuggacuuuuucuuguccuccccaucauccuucuccucucgcucccuccguuucagggacgccaguaaguccagccccagcagugaagggcggggagcaggggcuuugaagacaugcugcucauuggcugcacuuuuggucuugcaaauaagaccaccaaccugagaguccaaacuggugccuuccaagcgauggauggagguauccucaccaggguccuccaucacaggcucuuauuucucugaaaggaaggcagaccguuagaacuggacauaagaaaacuccggucuacuguaucccagaauaacgagugcauuuaaguggcuaucccuaccucccuacacugagcccagaacaucuucugcuagcuaguguguauauauguguguugucaugcaggugcacauaaagccagaggccaacaucagguacuuuucucaguugcucccuuauuuacuuuugaagauagggucuucacugaacugggaacuaauuuggccaagaagcuccuugggaucugccucugacucuuagcacagaugugccucuacucaugacucuccauggguucuggggaucuaaaaucaggaccuuacacuuguaagaaagcacccaccaccggagccaccucuccagccccuccugcuacuugugaggacuuccucaccaaaucacuaucagucucuaaaagcugaccaguucccacuccaacacauccaaaaggcacagagacacauggacacggaccacaccccaacacauccaaaaggcacagagacacauggacauggaccacacacuaggaucgagaaggugucaucuagacaagaaucaaccucacuaagggcuucuuaccagacuagaaugauuuuuauaaagagaaguauaggggaacuggacuuaagucagaaacccugauuaaaacccaggcgauugagcugggcaugauaugcaccuguaaucucagcacgggagguagaggcuccagaggggggcaagugggaagcuagucugggcuacauaguuucacacuagcuaggauauuuagugaaggauucacucauuuauauucuuucucucuccuucucuugcucucucccucccaguuugucccucugcccauuaucucacucuucuacagaacacacuuccucccacuuaugggccaaaauaaucaccucuaggaguccccauuagcucccugccucugaacacaagccaggcaugcuugccuuuuucauaugaacuguagcagcacaucccacuucucuagugagacaagaaagaaagaaagaaagaaagaaagaaagaaagaaagaaagagagagagagagagagagagagagagagagagagagagaaaggaaggaaggaaggaaggaaggaaggaagaaaggaagaaaggaaggaagaaauaaacuaaguaacuaacucacuccaggcucuuggcauuuucugguuuuuuugggacaguaagcaguugucuugguuagucauuaguucucuaugugugaaaccacaaucacuucugcuuuccacaauccacagaaccacugugagaaucaauuguugguacacugaugugacgguugcauacuugguauuaugcuccuguacccugacuucccuuccugguuuuugauaugcauucucccacccacccaucccauucccuuuaagucacaaguuccacagagcagagaaguuagcuagcacacgauuucaccauccauauucuacacacuugcugacuuuuguuguggaucaguagugguuugugggaaaagagaaaaaaagcaucccauagcaggcaaaaaaaaaaaaaaaaaaaaucucuugaauaacaaacuguguucgccaaaauuacuuccaagaaauguuaggaaagagcaugucuggaacguguuucagagacuguaagaccucccagguguuuggcugaugucaaauucaucuuuaucuaacaccacccgauuauaagcuuggaccuauguuggacauguaguuaauuauucucauuccgauuaaguuuauaaagcaugagaacugugacuuuugaaucuagacuucuuuugcuguguucuaauuaacaugcacagcucucccaaggggcgcugcaacacaauguggaugaagaagcaaaaguuucccgagguagaagagagaaacaaagucgcaucuuauaugcauauuaagaaaucuugacaggaaggcugagauacaacgacuuacauccuaaagugucauuugcaugcaagcagagacuacugucugucuuguuaacaaauggcaaaguaaaaaccugauuagauaucauuuauugaaagcgaacaggaagucagacauuucucuggacaggaaauuauucacaacacaggacaaggaaggacuuaauuagcggcucaaaauagcaaauaaagcgguccacggccagacuauggagaaacaucggugacaaagaagccacaauggacuucucagguuagcaacugcuuacugcaugcgucguuaauccacuugcuauucucaacaauaccgauaaaggaaaaacaagagcccuuuccucuuaggguuaauacucuacuuauagauuauccgccagaucuaguggagacucuucagugagacaggaggaaggcaccagaagcccuacccaggcucuccaacuaucggguaccagguucgcguacugcccuaaacgagggcacagggaggaccccugaaucuccguggggccguucccaaacaccgggaugagaccagaacauggacaaaguccggagaaggcugaaugaacuucuccgcucaagcaaauagagaaacuuggguaacaaggacuagaggaacucugaaaucagggcccaaacagaagccgcgagccgacaccggccgccuggagccgccauggcugccgaaggacagaucuggaaagagaaagagacgcucaccucaccaagcacgacucucgaggccuucgguuccugaucuggagacgccagcgcggccaccgcucgauccgagggucucaaagaggcaaauuccgcuguuugaaagcggccaucaucgucccauaaugcccugcgcggagccuucuauccguccaaaaagaccaucgagagcagcccacaaauccaggguuccgggacgccagagugcaaccccgcgaacaggccuuccgagccucagucucuuccucuggguucagagucuccuugcgaccaaucgcgcuuggcguaagagucaacaccccgccucuggcucgggggugugcaagggaggacaacacgagaccggccauguuuacuaagggcggaaaugac

SEQ ID NO: 4765 - RNA, 8162 nt, Mus musculus
aaaguggaaaggaacuaaaauaaucuugucggauuaccggacuauugacuggggcgcgcgguggcacguucguuuucugcguccguguuucucacuuccguuugggaggauuuuuuuuuuuuuuuuuuuuuuuuuuuccugucggaggaagcguuucuaaggauacagcccagguuaguuggggucuuucccaggauggcagugaggaaagaggcaguugugcccuagcuaaccgguggaggagcccggguugcugacauguagaccgaaguguccuccauggcaccugugaaccagggggaacccaaccaccagguucuuaucaaaaacaugcguuggguguuuuguagacgucagcccugacguagauuaaagugacauaccgcuguaaucccagcaguugugagguuuaggcauaaagauugccacaaguuugaggccacucugggguacuaagcgagauccuuggaaaauaaguucauguucagauauguccuuugguuauaucuuaggaugcuuauuuccauuauccuaugaaagcauuacacguuaaguuucuacaaaaaagaagaaucagacuuuacauacugcuuccgaaucuuuucuuaguagcuguauaagauaguucgcaagacuacuacuaucagugcccuguugacagacaugaacauaggucuuugugucuauguucauauucucaaaaguagagcuguuguguaaagaggaggccaguuuucuuuccaaagagcuuuugcauccaaauuccaacgaaguaggcaugccuccgcucucucuccauucugaguguuaccgucucacuugguguuuguagacucaaugcauuucuuaaaucugccuuuuaacuugcuauccuuugucuacgugcaaaacuuggcuuuccaaauguguuuaguguucauaauuuuuaugauucuccauuugcaucccucaugcgaacacugucuuggauguggugucgcuuucccccuccuuccaacaucuggccuguagcacaccgacccucucuggugacacgccacacucccccuuccucuuuuuauuacuaguacgggauuugcuuacgugaauucuaacggcgagacggguccaaauucucuuuguguuucucuuucaucaguaauuuguucuacacucacaguugaugaaaccccuccuggaagucagcuucccuauuuaaagggugaccuacaggcuggagagauggcucagagguugagaccacugacugcucuuccacaugaccagggauucagcucccagcacccacguggcaccucacaucuaucuuuaacuccagucccagggaauuugacauauaggcaggaagacaugcacauaaaacuauuaaaauaaacuguggcuuauagguggaacaauuucauuucuuguguaaauuuuauucauaucuuaugugugcauuguuguguaugugcaugaguauauacucauguauauacaccugucagugcauguuuguacaccaaaggcaaccuuagguguuuggguuuggguuuguuuuguuuuguauuguugacaacaaggucucaggcugcccugcaacuuggugaacuggcuaggcugacuggccaccaaaucccaaggaucuggcugagugcacugaguucgugagcuacucucgcaggccaggcuucuuuuuagauggcuuccggggaucgaacuggguccucacccuucccaggcaagcacuuuacuaacugagcuauccucccagcccuaauccagaccacgaaauauaauuuuugaugaaggggagaaaggcaaaucacauuucauagcauuaacaagccuugaaauuaaaugcagaguaacuaauaucccaguugcaucuucuguggguacugucaauagugacuugucagucaugggauuuuucaauuaggaaaugacuugccaaaaauuaggagcuagacuagcaauuuuguagcaugaguucuagccuuugucucacagcuagaagaguaacagaaugaacuagucuauagagugagaagcccagcaccaaaggaagacagagagaaggucagaugaggccccucuaccucagucuccucugagucauuuauuuaauuaugacuuucacacacucuuaguuggucuguuugccaugugauuaaguguaucuaggaaguccccuuaagucaggacucgagaauauacaaacauucgucaaugaaggacccaugaaguaugguccacaaaugaaguaguauggaaucucaaagucuuuuguguagggauaugggaaguucaguaaacguuauauuaaaacaaugcaaagcgcagaaagggugaaucauguccccaccucugccaccccaccuuccagccacucucccuccuacuccagacugcugaggucaaguuugucugcuucagcacuugccauaagcugugguucuuucugcagucuggcagugcucugaggcacagccgcauccuucagcugcaggcgggccuccuuugugcagaugcuugccucccuacucagcuacccguggcucccccaggccucuugggugggagcagcacucugaaguuaaagcuuugcuuugucuuccuacucugauguggcuuuuuuaaagauuuauuuauuuuguguguaugaguacaguguagcugucuucagacacaacagaagagggcaucagcucucauuacaguugggagccaccaugugguugcugggaauugaacucaggaccuuuggaaaagcugccagugcuaucaacugcugagccaucucuccaguccuccuacucuguucuaauucaaaucuuuaauuucacuuagaaacacaugagaaauuauugugagaaguuaccuagugugucaggauggacccagagguggcaagcaaggggugagacgucuucacaaaaugggcuuccuaaaagguuucuuuuuaaaucaccucagugucuggucacuacuaaaugguguugucuucuuucuguuaggacccacgcacuucaucucagcagccuuuagacacugcagaauugauagugcggacuagcauuggacuuuuucaagaugagcuuccucuugcccaaacugaccagcaagaaagaaguagaccaggcgaucaaaagcacugcggagaagguguugguucucagguuugggagggacgaggaccccgucugucugcagcuggaugauauugugaguuuuaaauaagcagccuuaauuaaaaguucaccuguuaucacucagcauccugaaaaggaacaggauugauguagauugauguagauugucacacuuuguccaagagcugugccuguccugaucugaggcccaaacagacugcgacaccuguccugacacccuucccccacuagcaccugucagaacucaccucacugagcaggccuggggagaucaggaaaugccaacacagcaacagucgcauagugaagugcagaaaguucuagagaggacuggggaaacgccuccaagguauacagguugcaaaguggaggucugaacuguuucccuggcugccaguacucuccugugcgcugcuccuagaaugugccuuguggagaaaucaggucucacagcacuucuucacagucaguaaagagggaaacugugaagagaguuacuguguguuucuauucaccauggagauugaacuaaggucuuacaucucuucccacccaucuccgcugcagucauuaugaauagucauuauguacaauggauguguggugccggugagguggcacagcaggcaaagugcuuccuguaugagacuuugaaccucagucagucucuggaacccagaguggaggagggacccaacccugagcauuguccccugaccuccaugcucacccgugcucauaccagucaguaagugggaaucaucagaaacucaugcuuuuagcuauggaaaagaguauacguucuagacuagaaggguagcuccaugguagaacaguugucucuuaauguaggagguccuuggagcucagcacucaaggucaauaagagaauuagacugauugcuucugauaccacacuuccaaaguucauaucccaacccugcugcuuaagagcuguguguccuggaacaaguaacucccuccagugccucggcuuugucaucuguaaaaugggggugcugagugucaguaaguuaaaugguuauagguuguagguuaaauggucuaacagguguaaagcguugaggacagugagcagugggaagaggggggggggacaccaggcucuccugauuuucauuucuaggaggaaggagccuggggcuugucggcacccuaaguuguuguggguggguugucaggagcuguaguuuuuguuuugcaauaguaagcauugagacuagaccuaaugcccuaccgcugagcugugcucacagcagcucacuccaaaugaagagagacuucuuucuuucuuccuuccuuccuucuuuccuuucuuuuucucagaaauaaucaagcaccagcccaugagauagcucagccagucaggucuccugcugcuaaggagagcccugaccucagcaaguugucucuggcuccugcacaugcucuuuggcacacauacacccaucccccuccaaccccugcgcgugcacacgcaugcgcacacacacacauauauaaauaaaacuuaaaaaaaaacuuaauuucaaaaagaaacaaauaucaacaaaaaaagaaaaaucuuuucccugacauguccuaguuuuacauuuccacugcugugaagagacaccauaaccaaggcaacguauacaagaacaguuuauuuggggcuuacagucucagaggguuagaacccauggccaucaucgcaggaaggguggcagccagcaggcuggcaggccuggugcuggagaaguagcugagagcucgcaucuugacacaaacaacagagagagcuaccuggaaaugguaagggcuucugaaaccucaaagccugcccacaaugacacaucucuuccaacaaagccaguccuccuaaccccucucauacagguccaccagcuggggacccaaguaguuaaacaugugagccuuuaggggccaaucucauucaaaccaccacgcagugccuucuccugacccugucacccaugauccaguaauacugugucugggcuuaguguacacaugugaucccugcacucgggaggcugggcuuaguguacacauguaauccuugcacucuggaggcagacaggcagacaagcggaccucugugaauucaaggcagucugaucuacauagcaaguuccagaauugugucuuaagaggaauucaaaugggaaaauuucuccaaauaaaauucgucucaaaauacuauaguaagcuuccuguaccguuucacaguguguuucacaaaagaagcauuguguaacugccguaguauagcggaaccuccauccaucuugucguucacagcucucaaaaacuucagccgaccugaguaaaauggcugcuauuuaccugguggacguggaccacacgccgguuuacacacaguauuuugacaucaguuacauucccucuaccguauuuuucuucaaugggcagcacaugaagguggauuaugggugaguuacguuggcuuuuaugaaagauauaauccugccagggaaacacauuucucuguugccaaguguccucugccccucagagaauucugaugucauucuucaggcaugccugacaaaauaagucacaugauaucuucuguaguguccaccucuccauccuguucucacugcaauaugaguaguguuggcggcauccaggauuacggucccaccuuacucuggagaguuuacuacuguggguuuggaacugccgcuuauccuccgaggccucgguuagugugcuugcuuauuacagccuacugcauggaguucaggacgcaguaucaaaccccucuaaagugcuuaaucuuucaacccaguaacuacguuuccaggaguuuaauaguauguugaagaugcacacuuuacaacucugagacagauacuauuuuuuuuaagauuuauuuauuuauuuauuuauuauauguaaguacacuguagcugucuucagacgcaccagaagagggcaucagaucucauuaugggcaucagaucucaaccaugugcuugcugggacuugaacuucagaccuucggaagagcagucgggugcuuuuacccacugagccaucucaccagccccccagauacuauuuauuacuaaauaguuugugaugugauucuuuuaucuuaaagaagcagaacacucuccccaccccacacacagagcuagaagaguauacaacaaaaggugacuucuugccucacaacugauuuuguuucucuuuuaaaacuucuucaaccaauacacuugauguuuaagauaacucauaagguuguuuauuaauacccacaacucagaaggucgaugaugagaacuggggaggcugcggugagcuaauggacuuuuuucagaaacacugagcaaacucugcccaccucaguacucagggaacuccacaugauaguggugugggaagggaugggaagguagccucuuucccacgcccagaugucaaugugggggcucaaagcccuggauguagcccuguguccuagaccugcggaaaaggcaguggucaggccauguguagagagacaagaagggaggaagagcccacuacugcugcugacccugcaggcuucacacacugggacgcucugaccacaguuauuccccucugcugcaggucuccggaucacacuaaauucguaggaagcuucaaaaccaaacaagacuucauagauuugauugaagucaucuaccggggagcgaugaggggaaaacuuauuguccagaguccuauugaucccaagaacgugcccaaauaugaccuccucuaucaagacauuuaacacacugcuguuggagcugagagaagcacagguugagacggggccugaagccagagggccuguggucuggaguccuucagagacauguucacugccugagcaaagagguuugcggugucuguaaucagcagcccuuuugcagcagccccagugcuccaagaaucaggaugccugagcgucccuucccugagagccucacagcagugaggcaggagcccaaguggugccuguucgugacuuccguuuaucuugacuuugcuuuaccccucaaggucaggcguccuccuagacgcugugagaacagcuugcucugccauguuugugcacacguucucccccaugccuccguucucuugccccuucugcccccuccuaccccagcuuaucuugaacuaacuaauaauuagaugcaggugaguucaugguuuccucgcagucugaaagcaguacccuguccacguguuuauagccauccggccauugauugccaggagaaaaguguggcucuucaccauccagcacggcuugagcuuaaacaacaaguuugggaaguaagggacagagcuccccagaaagcacugccaccacccauuaccucaaggacuaaagaccaaaaggauaucagguuguuaagggagaaacgccuugagggguuugcgauuccauccaagggcuuuugaagaaugugacccaaccucaggaaacuuguguuucuccuaagccuuaugggagugguugucccugucgcucuggaaugagagcagguacagagcuggagggccguggccaggccgcuuguggccugcugggcagcaagggccuuguugccagcagaggcccaggugugcaggaggcagggccaacccuggcaucagcugcuuauuucuaagcuuguccuuuaggggaaagugaaaccacgaccugaaucuggcagacggggcgcagaaagaagaugguuuggguuuuccguguccucugcccaaagcugagagcugcuucagggaugggcagagaaccuuuucccaccaccuccuuaggaugcacggggcuauggcagccacccuggacacguggaugaaaacuucgagauucuaagagucagaucccuaaugcuacugaaguccuaggugaacaauaaauguuccuccacaucccuaugguggaauaaaaggucuuuguccaacucacuguca

SEQ ID NO: 4766 - RNA, 59872 nt, Mus musculus
auuaaagacaugcaccaccaugccuagcuugcuuacauuucuuugucacagucgaggcaggaaucuggaggcagaaaccaaagcagaaugaguaccugccuaaacucauagauuuguaaaacuuuuuauugauccuuugugaauuucacaucauguaucccaaucuacuuaucucugucccuguaccuacccuucacccuugcaagcgcccccccccccccccccccaaaucuuguuguggaagcuguagugucacagugagucccacaguaaacccuuuuguccauacuucuuggcaaugagucauuggucugguacaaggccuuuggcuucugcuacuuaaucaauacuggauccucacugggauucuucuuagauaucucguuguugcccugugucauggagacccuguaaguuuggaucuguagaacugccccuuuacaugccccagcaggugguagaugggguaaauguuggggugggcaacucaaagcccuggcugggagugaguuggucagccggccagcucuccugcaccaccagggugagcucucuagagcugcccugacuaaccaagucccguuggcaagagguggaaccagcucucccacucucaugcccuuggggcuggcucaccugugcccaugccagcagggccagcucuauuuuucagccugguuucuuguaccacucaggaccuacauaggagaggcauggcuuccagugagcugggccucugauguuaaucugguggcagcauuuucucaauugagauuccccuuucccaaaugacucuacuuuguauccagaugacauaaaacuaaccagcacagaggacaaaauaggcacaagcaauaagagugaauuuucauaaagcaggccauguuuuuguaguuaguaaguuagaaaaugaagugcuggacuggagagguggcuuagugguuaagagcacuggcuguuuuuccagaggacugagguuuaauucccagcacccauguggcaccucauaacugucuauagcaacagcucugggagacucaacacucuuacauagacauacaugcaggaaaaacaccaaugcacauaaaauaaauuaaaaaaaaagugcuacuagcaccccagaaaacauaucugaaauuagagcaguuggguguggggggugcaccgggaggcugaggccauaaacucaguguaggggacuugcccagcaucacaagucccuggauuugaucuccaguauugaaagaaaaggagaaggaaggaaggagagccaguggaagaaccguauccagaauagacuguuauuguuacaucagauaguaccagucugguuuuuuuucuuuuuucuuucuuucuuuucuagacaggguuucucuguguagcccccuggcuguccuggaacucacuuuguagaccaggcuggccucugccucccaagugcugggauuaaaggcgugcgccaccaugccgugggccuccuuauccacucgcuuccaccucccuagugcuggcauuuaccaccgugugcaguuguaugcagugcuggggaucaaacuaagcuuuguguaugcugggcaaauacucugagcuacaccccuggccucuccugcauuuuaauucauuaauuuauuuauuuagcccucugccaaaagggauugugggguguuugguacugguuuugucacagaaggcugagucauuccucugccacuuguaagauugugcucuuugaccugauuuaauuaggacccaagccagaagcuccugcaaagcccccuuccagaccuguggauaauuacaacaccuuuguacugccagaguugccaucggugccagacacacuuccaacugcaucugcuggagccagcaccucagcaucagaagacauagacuuugaugaucuuucccggagauuugaggaacugaaaaagaaaacauaggucucuuaaaccaggcagcauccacauucuggaaguugauagugaacaguucuccguguaacagugacucuccaugaaauuccguuuccucuguuaaccgucacugagcacucuuccucggggcucucugcugcucuaccaauuguguugcuuuccacuucuucagugauucuucagugauccugagagacuaacagcuggagacucuagcuggagcaguuggcuccuauuggcuguguuugccugucugucuuccugucacguggauccuugguucuuucccggccauuccauucccagggagugagaaguauuguggguagaguugccaaagauggcuggaccauggaagagaguacccuaugauggguuucaaccuugacucguaaauacuucccucugcaugggggugaucguagagagaaucaaggcuaccauguguuuucucaugagucagaagauggcucaggaagccacugucacgguuccuggaggcugggcccucucauugacauguacacuacuccucgcugcagggcacuguuccaccuggauccaguugcaaaguuuggaaaaguucucuuaguuuuacuggauucucagggagcccucuguggccuuuuccuuuauuuugagugcuguuuccuuuuuaggaaagaacagcacuguggaaauuugcuuuuccccauagcauguuaggaaggaaguacaggucguuaccuaagcuagcgugggcuuccaguugccuuaauagaaguacucaagucucuuggguagagaucuggaagccugcaggagaggagggguacuuguuuucauuggaaaacuuuuaugauuaagggacucuuuacaaacuggcaucuuaaguuuuagugccaugucgcuguagucugcugcuuuccuggguggaugaaccucuuuauuaugguaacuucugugcugcuuugccccuagccaaggcucuccuuccccaagagguuagcuuuggcauuggaagaugagauuuuugcuuaccuguaguauuucuguacauaccuguuuccagcaacuucagugucaauguuuuugauuuauuugugucuuauagcucuagcugcuaauaaagaucccauguccugcuuucucuaguguuggucaaaugagugaauuuggauuuuaguggacaauaguuacccaggugacccacguuaguguacaaggcagauccagccuucacuuuccucucaccacugcaggugucaggggcuguuggcagcucauuuccauccuuugauuggaggucagauggcaucaaugaauuugcucugcugcuccauuuaguaagcugcaggugugcucacccuuugggcaugagugguggcauucuguuaccuguugguuggcaguguaguggugcuguguucuuaggguaucauccuuaauacucugcugauacccaccagcaagaauauggagacaaguggacuuugauucuccacuaacacaaagugugauaauagagugaaagguaagcuaugcugggcagugaugaaagcaaugagaguucaucuuaagacaccaaggucgccgggggcgugguggugcacaccuuuaaucccagcacucgggaggcagaggcaggcagauuucugaguucagagccagccuggucuacagagugaguuccaggacacccagggcuacacagagaaacccuguuuccaaaagccaaaaaaagccacuaaggucaauacccaguguugucagcguguuccucagauggauucuggugcaggcggauuccuaacagacuugagagcuuuuguaguaacauaucugucaguguagcuucuuucugaguaguugaagacaaaaaagaguaagugaauggaaauuguaggggacaguaccaaggauaccccuccaaacaaccccacaaacauaguagauaguaaagauacaaagucuuuaauggcuuauugucagauguuggggauaucuacugaaugguugaagaccggguguuuacuuaugguuacagaauauaaugucuuggcaacuuuauauuuuuauuuuuucguagaaaaguaguugagacuaccaaagagaaugugcugauccugugcacugugucaguuuguaguguaguggggucuuauuuuguaacccagguuggccuugagcucuuaaguccuagcuccacuuccaaaugcuaggguuacaggcgugugccaccaugccugcuuucuaaauuuuauuuauuuauuuauuuauuuauuuugccaccaugccugcuuucuaaauuuuauuuauuuauuuauuuauuuauucuuucgagacagggguucucuuuguagcccuggcuguccuggaacucacucugaagaccaggcugaccucgaacucagaaaucugccugccucugccucccaagugcugggacuaaaggcgugcgccaccacugcccggccaugccuguuuucuuuuuuuauuagauguuuucuuuauuuacauugcaaauuuuauccccuucauuucuccucugaacccccccaucccaccccuccucccccugcucacuaacccaccugcuucccuguccuggcauuccccuauaguggggcuuugagccuucacaagaccaagggccucuccucucacugaugucccacaaggccaucuucugcugcauaugcagcuggagccaugggucccuccacguguacucuuugguugaugguuuaguccuugggagcucuggggguacugguuaguucauauuguuccuccuauggggcugcaaaccucuucagcuccuuggguccuuucucuagcuccuccauuggggacccugugcuccguccccaugccuguuugcuuaaagcagcauuucucaaccuguggguugcgaccccuauuaggugggugucaaauaacucauucaccggggucgccuacgaccaucagaaaacauauuuauauuaugauucauaagaguagcaaaaugacaggaaguagcgaugaagauaauuuuaugguugggguccucccaccaugagggacuggauugaagguucgcaguguuggaagcgucacuacacuuuccaguuugguuacuuaccucacaggccuuccuuucuuucccaaaggcaaugagaauggcagaaacaaaaagauuaaugaucacaagucccaucaagaugaugcuacugagaaccaaaagggagcccaggauuggguauagagcaauaaccugggaagacaguaagaucucggaguuagcaucacaaacugcuaagaucugggauucauuccuaagcacguguuugaaucugauaaaaacuagggagagaaagacccuaaggaaaauacuuuuaaguggauauaacaugaauauauuugauuugagaaucugauuucucagcuuuucucaggaaaaacaggaaaacaauaggaucgugauucaaaucccgguucacugaaaacaucugucuaaacaggaaagcuugggguaaugaguguauagaaggaaucauaaaaccugccugccugccaucugggaagccucucuggacaucagagucuuccaguaaaaguuaagaaaaacuggcuuuuggcuggaauagcugugguagguuuugugcaagguuucuauauguaaccuugugagguguucuuuuuaacaaauggucauacacacacacacacacacacacacacacacacacacacagacuucggcuuguucauuguugcuacuagcccuuuaaccagugacucacccccuugugaagcuacaaccauaacaguauagcaaauagcuguugcauccuuucucgggaagaaaaccaccgacuaaccuauguaaucagaagccuuugagucauggguguguuggcuaguuuuauggcaaccuuugacagacauuguaguucucugagaggagagaaccccaaucgagaaauggcugcauaauauugggcuguaggcaaaccuauacuguagugcuuucauaacuagugguugacgugggagggcccaguuuguggguggugccaccugggcagguggccuggguucuacaagaaagcagacugagcagagcugugaggagcaagcugguaagcagcauuccaccagggccucugcaccagcuccugccucccucccuaagauaacgggccaucaaagugagcaacuguccaaguguugccaguuccaucaauuuccuggucacacaacccuuucaaugcuaggagccaaauagucauaaaauucauaguugaaguuuuccccucacuuuauuuaauuuugcauaaaguuauaguaacgguacuggaugacugugugugugugugugugugugugugugugugugugaaguucuuugcccuuucuguaacaugggcagacaggguugugugcgggugagggaagagugaaccuuagagguuuguuaacuguaaacagaacuaaugcaaugcuuucuggcaugccuuugcuugcuucccugacagaguuucagaauggcuugugcuauucuggccagguguccuuuggcagcagggugaggauaugggggaagaggaggugaggaagagguaaggaagaagaggugagcacgggugccuaggaagcaguaguugaguagugcagggucgugcacaggcguuacuuggagacaaggguaagggauguagguucucucuccugugcaggaggaggcugcacauuaagcaaccccaccucaccccaccacacgaguaaagcugcuaagccaaacaccaaccagucugaaagguaacuaacgaggcuacuucuaccugcaaacuucucuuaccuccuugugcuuugaaguucccaucaagaggccaacaacagucacuauagaucugaagaagcucugguagucagagaugcuccauccaaacagcagguugaacugaacgggagagaggccagucagugguaaccaaucucauuucacccugaggugcuuguuacggccaacagaagcaauggaaauuccuuuuggcuauucaaguuaccaugacuacaaaaucugaucuccgugcuaccuccgaucucuauuuuugugucuguaucuuagagaugugauaacacaucuaauauggaacgugacuaaacccaguuuuccuaucugaccuuuucucaaaaaacaaaaaacccagugcuaaucugaugguuuccugaacagugaccuuuccugaguggacagacaggccucagcccuuggggaagaugcuggguuugggggcuuacagucauggcauagcugcuuaacaggaccacgaugaucaguauaaagcccagcaccucgucccaggcuuuggacagugucuuguugaugaccuguaacugggcaugaugucgcaguaggucccagacccgcacaguugcgaagagaagcaggaagccccugaggugggugacugcagaguucacucucagugccucguagaaacugaugaaccuguagccaagggaagcugaaugucaguuacguagcacaaggaguggcccucgcuugucagcagcuuccuccacagguuagcagcuucagccaugucugacacccaugcagugaaacagcuuccuagcucuaccguggccagaaacacuaugaaaacacaaacaggcccccuggcuaggagccauccugacagcuuuucaaagcagcuacuagcugauaucuuuccuucauauccuagaaauggggaccauccuccacaguuguuagagccuaaggggacaugucauugucauggauuguugucuagcacccaguguuaucugauggguagacacgagugaggucauagucacacugagaguuaagagagguagagauggguggguaugggggacuuuugguauagcauuggaaauguaaaugagcuaaauaccuaauaaaaaauggaaaaaaaaaaaagagagguagagauuugcccugcaaacgcagcuccguuuuguugugugaaguauguuucaguuuccuuggagagacuccuguagcaauaagcaaguuggugagcacagacccucuguuggucaaggccuaggccagugguucucaaccuguggguugcaacaccuuugcccacccuccaaaacuauauuaugauucauaacgauauuaauauaguagugaaauagcaacaaaaauaacaugguugggggucaccagagcgugaacuauaauauauauuaaagggucgcagcauuaggaagguugagaaucacugguugcagugccacacagcagccuggagcuaagcugccauagcucuuuggguuacauagacccacuaucccaguguagacaguucaacagagagcuacuuaggaccgugcuuugaaagguuuuagaucucaagcccuuugaguauucagcagccugauauggguaauagggguaaaaaaaaacccacaugaaaacuucauauugguaagugugucuugcacuggguuuguauccuuuuaaagggugauaaucugacuggccucaggcuuuaugcauacaaaguagccccaauuccaggcccuugcucugagacuuaaaugcauuaucuucuauagaagcuaaugagcaccacagagcuuucagccauggucccauguccaaguuguaguuuuacuugcacuuuacaaaugcagcccaacuggcggggaaguggaagagaaggagggguggggaugaggaagccuuuggcaugagccugcagcucgggucccucaccugucccggucacagugguacugcugcaucuuuuugugaaguagagagaggcucugcaugcugaggcccaggaugcugaagcuaaugaggacgaugcuuguguccaggagguuccuuuuccuagugaagaacgccagccucugccgcuucagccgacagcccugagcaaagacagcaucgucaccauuguugucuggaugacccuaagaaaauagucugcccgauugggacuuggccaggccaagcacaugggcagcagacgugggacuguucugcagucucucacacugcugaaaggaaaguagguugcuaauaaaaauuuaccagauauaaucauucuuggagauuauaaaacuauuguguacacuuaaucuauaagcuuuaaaauauucauuguuuaucaagcuuaacaauaaaauacuguuuacaauaauucuuguuuuuuucggugcuuuuuccccagcauccuuucuucuuuuguuguuuuuuuuuuguuuguuuuaaagauuuauuuuauuuauaugaguacacuguagcugucuucagacacaccagauaucagggcaugggaucccauuacagaugguugugaggcaccaugugguugcugggauuugaacucaggaccucuggaagagcagucagugcucuuaacugcugagccaccucuccagccccagcauacuuucuugacauuacuauauauauauaugguuuucuugacauuauauauauaugguaagaaaccguauuaaaaaaaaaaagaaaccuuauaaaaggucuagagagauggcucaguaguuaagagcauuguuuguucuugcagaggacuugaguuaaauucccuacauccauggguaauuggcaaccauuuguagagccauuuguucuacgggaguuaacaccugaauucuauggguacacauacauacaugcaggcaaaacuuugauacacauagauaaaccuuaaaaaaaaaaaaggaacgaugugaaauacuguguauuaagaagcaacucaauuucuuggacaugccagaauugagugagcuauucuacucaguagacaucagucggccaaggaccgaagcaucaucugcauguguagugcugggucaugacggagcccucccgagaggguuugcuggcugugugcacaucugacauguucagcucaccuggaugaaggcauaguaacagacgagaagguaguagacgaccugugagacgauccaggcgaagccccucucugaugacugaagggaaguuaaacuguccaguugcagggaggugaggaaagucccugggaagaagaacaccugcagucaagaauugaagcgguuguccuuuucacaaaacaaaacaacccagcuguuccuggguccucaacuucaaacauuucugucucccuguucuacuuaguauuuccuguagagccauccagaccauuaacugaauccuggguaggcuaccggagaaauguccaucucacuaaaguuggcagagggaguccucagcaagaggcacaggcacagcuguuccucuuuucaacccagagcggcugcagacaucaaaauaaaaguaccgauaucccgagaaugcgggaugcuuauaugaggauggacuacaagguuucagaugcaacccaaaaggauagaaucugcacuagauuuaugguuuuauaaacuuuucauaauuuuaugaaaggucuugugaauucuaaccccgaaacacuggaacagagauguaccccuggaagcagaaaaagccuuuuaagaaccccaggaagccuucgggggcauuuagagcagagguucucaaccugugggucuagacccguugggugucacaugucaaauauuuaaauuaugauucacgacaguagcaaguuacaguucuguaggagcgaugggauaauuuuaugguuggacgucaccacaacacgaggagcuguacuacagggucgcacgucaccacaacagaggagcuguacuacagggucgcacgucaccacaacagaggagcuguacuacagggucgcacgucaccacaacagaggagcuguacuacagggucgcacgucaccacaacagaggagcuguacuacagggucgcacgucaccacaacagaggagcuguacuacagggucgcacgucaccacaacagaggagcuguacuacagggucgcacgucaccacaacagaggagcuguacuacagggucgcagcgucaggaagguuaagcagcacugguuuagagagcaggggagaaggcgcuugcucugcugcucugggagggaaaugcuacccaguuaauagcaacacgcagugguuagugggaggauaccuguaagucaguucuagggcagagaagaggaggaagggggcuggaucaaggaagacuuccugaaaaggaacacuuagcaucuaaucaucugugagaucccccuaugacaaaggugacaauugccauugaguacccuggcaacgcuauaucaauggcaaaagcacaaucaugaagacaaagaaagcaaugggagacgaaaggugugcucgugguagggccacgugagaggugacacaugcuagggccacgugagaggugcaugcaugcuggggccacgugagaggugacacaugcuagggccaugugagaggugcaugcaugcuagggccacaugagaggugcaugcaugcuagggccaugugagaggugcaugcaugcuagggccaugugagaggugacacaugcuagggccacgugagaggugcaugcaugcuagggccaugugagaggugacacaugcuagggccaugugagaggugcaugcaugcuagggccacgugaguacaaaagcuaaauccccuucauagaaaaaguaacacuuaaaacaaaaaacgcaugaauaaauaaacaauccaaaacauuugaaagucugauguaguaauccacgaguuuaaccuuggcacucaggaggcagaggcagguaaucucugagucaaggccagccuggucuacauagcgaguucuuucuagccaggacuaugcagagagauccuaucucaaaaaaaauuuuuuuuaaguguaauaaaaauguaauauuagccgaaacugaaaguagcaucuggggagugggagguaaaaaggcugucgagcuauuugacuuuaaaaaaugaaaaucauacuucuggggcugguucagcucccagccccacauggcagaucacaacuguuuguaacaccaguuccaggaucuaacacagacacacacagacacacacacacacacacacacacacacacagacacacacacagaggcaaaauaccaauauacauagaaaaauuaaaaaaaguauacuccugaguaaucaauuaaauuuauuugaaugaaugguauauaaucaguaacggcugccuugucccgagauagccgguggcagagcgaggagagaaggccuacguacccacaccacuggauuccaagaugagggucaccgcacagagcagauucacauuagcauugaagaccgugaauucuacaaagagggcuuuugugcagugguccagccagcgccucuguuccagaugcugcagaacccuggagacacagggaaacggagccauccaggacuguaguggagaacagcacccuggcacugugacagaccacaugaggagccucaucccuugaucuaguguuccuauaaaagacuucacgacuagccacuccccaagucucgcggugauaacauggauaagaaacgugguggcgcacgccuuuaaucccagcacucgggaggcagaggcaggcggauuucugaguucgaggccagccuggucuacaaagugagcuccaggacagccagggcuauacagagaaacccugucucaaaaaaccaaaaaaaaaaaaaaaaaaaaaaagaaacgagauguucacaguagcguucacaccaaggacagagauugaggaaaccuuauuugccauuuaaucuguaagacaggauucauuguauaaacccugucuacuacuauuugagacauucaauacuccacgcuauuaagaguauccuauccaguacugagaggugaaagaggcaucaaugucaucauuugauugaaauuguauucuuuccuuuccuuucuuuucuuugcuuccuuuauuuuuuuuuuuuuuugaguaguuccuugcugcuauaacuucgaaaccaguuucguuuuaaaauuuuuauuguauuuacuggggguaugugugugucacagugagaguauagggaggucagaggacaacuuaaaggagucaguuacauaucguguggguccccgagucccagaucaucaugaugaccucagguccuugggcacgguggcaaggaccuuuaccugcugagccaucaucuugccuacucagaagacaauuuagaccuuuucauucacgguaacaaagacaaucaggauauauauauuaaaccacucuguagacuccuaacaacuuaguuugggcauuugaacuuuggguugcuguucuuaucaugguuuacaaaggguaaaguuuccauauacauuagaagaauacuaugugacuaagauucaucuaagcucaacuaccccuagaauugaaacuaaaaaucuccuuccagauuaaaaaaagucuuuugcuuuugacaaaacaaaacauaucuguaacuugaaguugaccaagacauuucuaaauuuaaagaugcaguuccuggcuguccugugaugggccucuugcucagggcacacacucaccugguugccgcacugugguuucuuccaagccucacaacauagccuccuccugaguaaguggcuagcuccccuuggaugggauagccucccagcgacuccugauucugauaaugccaaauacugucuacuuuugugauguuugugucaggggggacccagccagccccauaguucucucuguccuccugauguuggggaggcgacuucauuugcuuguggagagauccugggaagaauaugucauuaggaaugcgagucuggcggaucaaaacauugcccagaagaaaggaguucccgucaguaauaaauccuagugagaaagaaaaacaaacaauugucuuguugcugacugaaugaagcagcccagguauacuuuauaucagcaaucuugaaaacauuuagagacaugaacuaauuaauacaagcagacaaaagagguguaaaaaacaaauggaacugugugaucauuuauaaauuauauguauuaucuagauaaauuaggaggaucaguggaaaaacaauuaaguuuaaaaugcuaacuuaggguuacugggcacaaaauaauaauaauaauaaaaaaaucuagccauaccacuuacaauagguacagaaauaaagagccuaacaaaagauaaaaaaaaaauccauuuacucauucauucauucauucauucauucaaacaacgcaccuucugugcugacacaagccaagccauguuuaggugucaggagcaaacagauacaggggcauuccugcccgagagcacagacgugaggaacaaggaccaacaauacacaauguucaggugguaggaaguagggcuuugugaagcgaggaaugccauuaaaguuucucugaugggauggcguugagggacacuaauagagucagaaguguaacguggaugccaggcagggacaucggguuccaagaucccaaggggauagcaugauugauguauuuaaugucaugggaacacaaguggcuauaauauagcagaugagggucagaggggguagagaugaggugacagacauggcuaagggcugcuuugugggggaggauuugacauuuuauucuaaaugucucuguugggggggugguuugaacaggggacuuaaagcuuuauaacuuaaagccauggagaagaugaagaaugggaggagguuugcuuuuuuuuuuuuuuuuuuuuuuuucucgagacaggguuucucuguauagcucuggcuguccuggaacucacuuuguagaccaggcuggccucgaacucagaaauccaccugccucugccuccucugcugggauuaaaggcaugggccaccaagcccggcuggagguuugcuuuuaugaaaacagaaaacacugcuugguuugggucuaacuuacccucucccgagugcagccgcaaagccuuacacugacccagagccucuguaaacgcuucuaccgugugguuggggguguggacaacucuaguccuuugccaguaggauuacuuauugacaccacaagaacaaucuggaaacauuuguuuuucuagugcaggugacugaccacagauugacaacccaagcccuuguuucuguuuggguucguuuugagauaguuucacuauguagcccaggcuggcuucuccuucccaacugcuggauuucagacguuaugaacugccacaucuacucggugauacuuauuucagacuauuuuacauguuugaguguuuugccuguguguauguauguguauugaauguaugucuggagcccaaguucagaagagagucucagaucuacuggguguggacuuauagacaguugugagccaccacauuggugcuagguaauugaacuugaguccuuugccagagcaacaagugcucuuaacugaugagccaacuuuccaguccuggaaagaucuuuuuaaaaauuauuuccauuguacacgcauugguguuuugccugcauguauaugugugugaaggugucagaucuuggaguaacagacagcugugagcugggugggugcuaggauuugaacccagcuccucuggaagaggagucagugcucucaccuacauagccaucuuuccagcccuggcauuaucuuuuuaaaauuaaaaauguagggugcuggagaggcaccccaacuauuaagagaacuuacugcucuuccaggugguucccaacacccaaguugagugauacuuguguguguguguguguguguguguguguguguaaaaugggggcuagaaaaaugguucagugauuaaaaguaguugcugcuuuugcugagaccuugggcucaauucccagcacccacaugguggcucacaacuaccuguaacuccaauuucaggggauccaacacccucuucugacacccacagacuccugugcacacacacaaacaguacacaugugcucaugcaggcaaaaauacacacauggaauagaaaauaaguuaaacaauguguauacucugaucuagcaaaucuuuuccaaggaauuucucagauacauuugcucaugugugagguauuaacagucuuagcugcuuauagaaauuauaguacaucuauacaacagaccucugcauaguaaguggauaagauggaguaggggcggccucauauuacugauagggacacucccagguaaaccagggcagaagccaaauucaugacacugcuuguagcuugucauuuacugucacuugguuguuuuccagacaucccuacuucagugcagggaaacgggaacggucagcuggguuuuauacagcugcagcuccgugggcuccccauugaucuagucccugaacaucgucacagguuuaguuaugacuguuuucucaaaggccaauccaauggcuugagcagaagcauugcacaacgagauugggcuguagcaauuuugaaaacaaugauuuuuaaagaguagguaaaccguguuaccuacacacacacauguguacacacacacaaacacacacacacacaguuuuuuugaggcaggguuucucugccugccuguuugucugucugccugccugccuuccugucugucuuccugccugucugucuggaauagaccagacuaggacuagcccuagaauucuggaauucacccugcagaccagucuggccucgaacucagagauccgccuacccgugccuuccguuuuuuuugggauugaaggugugcaccaccaugucccgcuuguuagugucaauuuuaacugcuuuugaccccaugccuacucgacuauaucucuuucuuaaaacaagaucuugccuaguagcccaggcuggccucaaauucaggauccugccucuaccucccgagugccaggauuauaaacgccauccauggugugcuucuuucuuaucaucguccugaggucuguugcauuugucaguuuguccaucuggguaacugcugucaauucaauagcaaagcuccacuuccccacuguuaacaggcagcacuaacuuucucaguaccugugccagucuccguucugagcgcucagaucugucgugcagagcagggccaaggaugcauccccccugaacaggggaaaccagacagcgaaggcugagcgguguacucaggauugcauggugguaagugggcaugagucccagcaggcucucugucugcucuacacugugguacucuacuacagccaaggagcccaagaggagacuagcccuacuauggccucggcuuuugccauccuggguucuagucauuuugucaguauuuuauucagcacagagcuauguauuacaaauagaauguucucugagccucaagaacuguuauucaaaauuguacuuaaaaaaaaaaugucaccaugcaaugaguaggcguuuccuucuguaagaguguucacacaccaagugcacucuggggaagccaaaagugcuugcuaggaugaacacaggccucagguucucuccaggaacauagacgaugccaccaacccugagguagaaggaaguacugacucccagagcucagcuucucaggacacaguuacaucaggucaaagcuggacuggagaaaacagugagcaugcgccugaggggagagcgcgugcccaaggggagagcgcgcuaaccacuaguaccugcugcggggcaaagcggggcaaagccucucucacugagguucuuugaggacacagaauccauuaugagcauaaaaaaaaaaaaaagucagcuccuaggaaaggccccgaggacugcagauguucuauguauguuugugggaugcaccugggccagcacacagaaaagucggauacacacucacuuaaagaccguuguuauuggagcccgauccugugugcgguguguggcugagucccagggucccugcagcuacucuuugugcuguaagugaccaccaaugggugguggucauaccugugaccuggaucaggggaaucagaccccaugggucaccaagggucccuaccugaaccuuuuuggauggaguccagggggacuuugcguuguccacagagcuguggucauauggagaagccagcugaccuuuaguuuuccauggguugcaggagggguuucaggaggacuaacuugccucccuucugccccagaacuguccuuaccucuguaauccccauauagguuaggaaggagggugccguuggcccagggguagaaauccucuacaguuuugauuucugagaaacggugagaaaaccucuuccagauagcucgauggaggaaaaaucgacuagaguccuuugcagaauagacgguagucaucagcagggucaggaagaggauuugcacugguuugcaacagaaaaaaaaaauaauuuucaaguaauuaucauagagcucuaaauaaacccuuuucacuucucguaugcuuauucaccucuucaggucaaaaccagucaaaauggagcugggauguaguggugcacacuuuaaaucccagcacuugggaggcagaggcaggcggaucuccgaguuugaggcuagccuggucuauagagugaguuccaggacagccugggcuacauagugaaacugucuugaaaaagccaaaaacccaaccaaccaaaaaaaagucaaaaugggcaauuucaaauacuucaacccaauguguacacacauacgcacacauacacacacaugcacaccaccugaauugcuggaauuccaaauuucauuuuaaaagacaccuuucugcccuccccgguuuucugucuuauucuccccgacccuccccacuccagugugcugcagcggagccugcugccuccgccccgucauacccagaguaccacccgucagcuuggagagcugcuucuuccaggccuuccuuguaggcuuggcuagguuguucauugcuggggcaguguagaugggauuguucuugucucucaagccaggugccgaccaaggacacuuugcugucaagacacggaaauacaggccaaauaaauguuagauuccacgacagcuugcccacugucgagcaccuacugcaggcguugccuggugaacgcuggagcagauaagaugcucucuaagcagcacguuaucuauggaagaaggacuggauuuuucuucuuaaaacuccaauccaugaaaugguaguacuucucuuucuucccagaacuugggaagcagaggcaguaggacuccugugaguuugagaccagccuggucuauaagagagaguuucagggcagccagggauacacagagagacccugucucgacaaaccagaacaucaccaacaaaaaauuccaacccauuggaaaccaaacucguaagagacaaucuaaaucaguuucuagaaaaaguaaacguggguagaggagugugucucaggaggagagugcuauuuaccaccugugagccucggcgccaugacacacagccccucuuuccugacaaugucucugucuuacucagggucucucuuacugggaugaaaacaccaugacuaaaaagcaaguuggggaggaaaggguuuauuuggcuuacacuuccagaucaugguccaucauuggaggacaucagggcagagacucaagcagggcaggaaccuggaggcgggagcugaugcagaggccauggaggggugcugcuuauuggcuuacucagcaucccuugcuuacgccugccuucuuuuagagcucaggaccaccagcccaggaaugccaccacccaccaugggcuggguccucccccauugaucacuaauugagaaaaugccuuccuuacagcugugucucacggagguauuuccucaacugaggcuccuuucuucccgaugacuagcuugggucuaguugacacacaaagccagccaguccaaccaagcccuugucaacuugacccacaaacacguuacgauuaagccacaaccucuccuuucuuacuuauccccaagaccucacauuagaaccauaaauaacuuuaaaagucccacagucuuuacaaauucaaacacauuaaaauguuggccccuccuaggcucucugcacauaauuaauaguugugcagcuggaucuucauauaggacuccuaaagcaggagcagggucuaucucugacuacauugccugcuuuggucccuuccuccuaacugggcucccucguuuagccucaacagaagaugcaccuagucuuacugcaacuugauaggccaaggcuggugauauccaugagaagccuucccuuuucuaaggagaagcaggggaggagcuggaggagcuggaggagcuggaggagcuggaggagcuggaggagcuggaggguggaggagaugaaugaggugggagggacugggaggagaggaaggaggggccgcuaccaucaggauguaaaugauuaauaaaaaaauguaaaaaaaaaaaaauucuggucccuuuaaaauacccaauuucuuuccaaguccaaagucuuuuaaaauucaaagucucuuaauugugggcuccaguaaaauacuuccuuacuucaagagagaaaaggagcccuuuauuuacuucagggcacagccacaaucaaaucgaagcaaaaccaaacuccaacugucuaaugccugagaaccaacucauguucugggcuccuccaaagagcucaagccacuucuccagcuuggcccucugcagcacacagcucgucuucuaggcucaggcaggcuccaccccacugcugcugcugcuguucuugguggccaucccaugguacuggccucuccaaaaugcugggaucuucugcugcaacugggcugcacuucaccaauagccucuccuagacucccuucauggugccaagccucaacuucuuugcaugaccgcuucaguccugggccuuuaacugccacugaggcugcacugucaccaauggccucucuuggccucucacagugccaagccucagcugcucuccaugaccccccuucaugccuucaaaaccaguaccaccugggugacucuuguacuaccaaaacugacugccaacaggagauguucaaccucagccaguccuggaacacagcuucucugugcucuuuaaaaauauuucccagccgggcgugguggugcacgccuuuaaucccaguacucgggaggcagaggcaggcggauuucugaguuugaggccagccuggucuacaaagugaguuccagggcagccagggcuauacagagaaacccugucucgaaaaaccaacccuccccuaccccguccccccaaaaaaacauuucccagauuucacuucaguaaugcuggucucuucuuaaucccugcaaauugcuuagcuccagcuaaucaucaucaauugucccaguaaugccaauguuucacuucagugguucugguaucuugcuaaccacagcugacucuucagccccagcucaucagaaccacagaaucuuacaucaaaauagcaaacagcccugacagggucuuuaaucuucccucugaaagcuuacaauccaggccuccaucuccuauacugcucucaacgcucuuuauccuucaagcucccacagaacagcacacugaagucucaaaacccaaugguuuuucuagcccaaaguuccaaaauccuuccacaaucuucccccaaaacauggucaggucugucacagccauaccgcacuacacugguuccaacuugucuuaggguuucuaucacugcaaugaaacaucacgaccaaagagccagguggggaggaaaggguuaauucuguuuauauaccacauuacuauucaucaccaaaagaagucaggacaagaacucacacagggcaggaaccuggaggcaggagcugaugcagagggcauggaggggugcuaccugcuggcucgcuucacauggcuuguucagccugcuuuauuguagaacccagggccaacagcuugggauggcaccacccacagugcacugggcccuuuccacauugaucacuaauugagaaaaugccuuacagcuggaucucaugcagacacuuccucagcuguggaucccuucucucugaugacucuagcuuaugucacacaaaaccagccaguccagucuauguugucagaaauacagcccaggcuggccucacauuuaugaucucugccucagccuuccagacgcugagacauguaccagcacaacccaccgauaugcauucuuucagugcugagaauccagggcagugucucaggcaccugacaagugcucuaccacucaguauguccccagucuuuuuauguaaagaauuagauucaguagacauaaaauaacuugcuguaugagucuauuuuagacuagauaugagggguucuacucaguggaauaccguugggaauauuguucucaaguccaacacaaguagagggcuucuauucagugcagauucuggcauaagguccaacacagaacauuucugaagaauccaggagguggcagugguuuggucuaaagacuaugcugaauagacgaauauagagauugauaaacgaaagggaaggugagaggugggguagggaaagagagagggguggggugggggaaaugacagaaaucaccugcaugcuuguacaagugccaugugaucacuggagaauaaacaaagcuuccccaagggagguuggaggugccuuuguagagccauuggaauuuggcuuuucucugcagggcacagucacaaucaaaucaaaccacaguuuaaguaaggccuuucgugugccagcaagcaccacucucccccucaacucuaccccacgcugccuuugucuugaagggcaggucauagaacuucagauggguagggacaagaacuuugaaaaagaagucacuucacauaaagagaauaguucaaaugcacaagaaagacaagaaagacacuuccaagugagacuguuaauuuaaaaaaaccucuagaauuggagugcuuagccguuagcaugcccacugcucaguuuaaagaagugauugguagcucaugacugucacauacuccaucuuguuaccccuuccuucccucagagaggugacccuuuccugagcuuuagagauuauucccaaucaucucuucagaucuuacauuaauaggggucacguauaugucuucgagccaacacugugcuaacauuuuuguacccugcaccuuuuggcucaacguuauguuugcaacaccccuccaugugcucggaguaauuuugagucuguuuuuuuucccaggcuggaaccccucaggcuuggcgacuggauguagggaauaagggcacuuaggaucacgcuaacaugagcagaucauuggggcaaugccacucgacaggaacgagaauauacgcaagugugggcuuguggggcaggcagacagcucagucccagaggccacaggcagcaccaggaccaucuggggcucaggagggagggcagauggagcgaagcccagaagcacugagaagcacuggcuuccagaggaacggaugauuggggcacugggcuccugggcaaaggaggaagagaagucgcccaaguaaccaggccucugacuggguauguuggaucgcagaggcagugugaacucuugcuuugcucuuuguacgauuaaacaguggcuggaacuacuugaauuaccccaaagugcuacgauucuccgggcguguuguuccuugucuuuguuaagccacggcaugugguuugccaucagggagaacaacaaugucaggaagaugaccuggagacaagagucaggggaacgccaugagcagguguuguggggcucaaaagaugacgucauacgugcaggcggggguggggacgaaacagcucaucccauuuauuuacacaucuacguuagcuuguggucacggcacccauguggcaaucagggugacuucucuccuucuaccacguaggguccaggggaucaaacucagcuccuuugcagcuaagugaccugacuagguccuuguguggguuuuccaucuuaagaaacuguugcucucuuuuggugugccugaagacagcuacaguguacucauauguauagaauaaauaagucaagcuuaaaaaaaaaaagaaagagagaaagaaagaaacuguuuauuuagguuucuuaacaauuuuauauuugaaaaguuuaauuuuuagagacacacagacaaauuuuagagauauccagacaagguucaugugaacuuuggauuuuuuuucaaaacagaugaaauaauauuagcuauuauuggugauuuuugaugcugaguaacagaacuugagaauucauuaugcuauuuucuauacuuugguguguuuugauuuuuccuuaauuaaacauuuaaaagucuucaucauccuuaacuuuuugguuuuuuuuuuuaauuuguuuuguuuuuugagacaggguuucuauguguagcccuggcuguccuggaacucacuuuguagaccaggcuggccucgaacucagaaaucugccugccucugccucccgagugccgggauuaaaggcaugcaccaccacugcccagcuucauccuuaacuuuuuaaaaggacuuauuuguuuuauuuuauguguaugaguguuuugccuacagcacuugcaugucugcuacuugacgaggucagaaggaaaguaccucauccauuggagcuggaaguaagcaugucugugacacagcccaugggagccgggacucgaaccuggguccucugcaagagcaacaagugcucuuagcuucugagccgucuuuccagcucuauuguugauccuuaaaaagaaagugucucaccacuguuuuuuuuaaauauugucacuauuuuaguuauuaugaguaguaauauuaccauugcgugugugugugugugugugugugagagagagagagagagagagagaggaacagggacaggguagggagagagaguguauguguguguguugggugccuguuguagaaaucagaggacaacuccauggaguuguuuccuauuuuuucuuucuucuuucucucuuuucuuuucuuuucuuuucuuuucuuuucuuuucuuuucuuuucuuucuuucuuucuuucuuuccuuccuucuuucucucucucucucucucucucucccuuccuuccuuucuuucuuucuuucuuucuuucuuucuuucuuucuuucuuucuuucuuucucuuucuuucucucucucucucucucucucucucuuucuuucuuucuaaaaaggauuuaucuacuuuauguauaugaguacacuguugcugccuucaggcacaccagaagagggcaucagaucucauuacagaugguuguaagccaccaaguaguugcugggaauugaacucagaaccucuggaagagcagucagugcucuuaaccacugagccaucucuccagcccuguuuccuacuuucaugucgguugguggaucaaacaaguagacuugaggggucagauagcaagugcccuaaccugccaggguuugauuuuuuuuuuuaaaucccuaucuucagcuuuuucugucauauguacgcuaaucuauuacauucugcuagauuauuuucugcccuuccuucacauguaucucuaacaaacaucacucugccuguugauuuauuugcuaauugucaaaacacguggccucagguccucuagcuuccuccagcuguaaugaucggucccaugcgucacauaccuuuaucggcuggcugauaaagaugucuuguaguaccgacagcaucauugaaauaacccagcugguggcuuggucuuuguccaacuccaagcuauagagcguuauaaaaaaggccgaggccaggcugaugacaccaagaaggagccagcagcugcacuucaaccaucugaacaggcaaaaugacaugggcuucuucccuucuccugggcugaggauggggaaacugguggaaugccuugagaacagaaguugaagaaauuaucuccugcugaggccgggagaggcuccgaaaguugacaggguagcaacaagagcccacggugcuuaccugcauggcccuggcccucugcggagagucugugucuccaggaguuccuggagguuuugaaguuggcugacugcuucugagaaaucacaagacuggugauccuggguagcaccaagagccucuaaaugcgcuuucagucuccgcagaaguuggagaagguagcggcagaaaugguaaugguuuucagacacugcuguggguuuauuucaggucggcauguucacaaaugggaaaucucaauaaguagugauuaaugguggagaagaacaguuuaugaggugacaggaaggcuaaaauuuccuaguacccauggagacaagcuucugcaccuguggcccuguucccuucugaaggugcagacgcacaucacuguugugccauucuaaacuuggaccccaagacuuuuaaaaccuuaaugaauugucccaccagagagcugcagcauucacagccuagacuagcaagugcccaagcugcauucgagauccaaaaguccugccacuucuccgcucgagagaagaaaaugaugacaagacagguuucagcugaugggauauggggggucugacuacuuuuauguuuuuuacaacuaguacucuaagcuuuaucagcagguugugcagaucuuaagaugcugaagcuaccagcucaagguugaaggcuaauacaaucagcugagcaugaauugccuugggcugaaaggcaaaaaaaauaaguuaaggaugugagguuaucgagggaguggaggcgaagcuacgugagugacugaaaucaccagacuuuaccgucuucccagugggauucugucugcuggugacagccuucgucuucuaagugacaguaaaugaggccggauaaaagcuucgccagcuuguuaaugucacaagaacugcacgaagacggcucacacuccgagagcagcuguguauuucuccugagcaggaaucccacaguuuccuuuaauuccuggguauggaacggaguugagagacuucagucugucuugcauuagcucagcccugggcacaauuacagauggugagccugcuucuuuuagucaggggcacaagcuagcuuaguguaaagaaacucaaugcuuccuuuuuuuuuuuuuuuuucagagaagagucacccccacagugccucuucaaaaucacuucuaugagagacacugaauaagagggacaguuugcucagacaucaaaaaaaauaaaacagcucuggaguaguacacgccaccccacucagucucuagaacaguuccuaaccuuggaagaaagcuaaggcugaucacaucucaguggacaggaguuaggggaaagauaucaaagggaccaggaugcugugagccucccaagaaaucccccauggcucuuucccacagcacagaagggagaguguacuuuacuauuaaaaaacaguugauaccaagcuuaccuugaccaccuguguaagagagggggacucacaaacaagagcagggggccaggcagccuggaugaaaggaagcuggggcagagcuucuggugggugaaucaacuggaagagccgcccaaagaugagguggauggggaagaggaugauggaggucuggaugcugacgagcagcuccgacaaggucacagcaaguggaccuacugaaggaaagccauggcauucacguucgccggccuggguuagaacuacuuaggggggaauuuaucuggggucagaaagaauuccauggcagugaggauaguucugguagguuccuaaaacuguuuaucaacgagggcacucagagaggguaauuaggacaauggaggggagaugaaggcacaccgugacucaguuucugagccuugaaguaaggauggaaacacuggcagagcauccaccacccacugaggacagcacacaccagggcuugcacguacguuguucggugccccucuuggcaguggugccacccaucuuccagaacauaauauugaugaccaugucacagagcaguagugccaugcagcaggagagccucuggacucguguaaacugguuccagggaugucgaguugcaacugagagccacagauaauccugggugaacuuuucuacgauuguggaggagaacaggugucugaaacgagaaauuaagcgagggaagacagaaauugacuguugauuuauuuugcaugugugugugugggggggcauguguguugcaucaaguguggggaggucagaggauggcucauagaagucaauccucuccuugugcuauguggauuccagggacugaacucauaugaguucaugaguucaagugcccuuaccuaccgagcuauccugagcuuucacuuugaagcaaccuagacuagggcaugguuuguccagcaacaagaugcagagcaacauuucuuuucuuuuaauuaaucauuuuauuuguuuacauuucaaaugauagccccuuccugguuaccccugcaccaaucccccaucccaaccucccucucuccccuccccuuugccucuaugagggugagcuuucacccauuuuauccacuccccccuuaccccucuagcauccccccugugcuggggcaucaagccucccuccccucccacugaugucagauaaggcauccucugcuauauaugugucuagagucccggcucccuccguguauaaucuuugguuggugguuuagucccugggagcucugggugguccaguuaauugauauuguucuucagcaucugaccgauacaaaugcagauacuuacggccaaccaucagacugagcccucggaccccaguggaagagcuaggggaaaggacuggaggagcugaaggggacuguagagcagcuucucaaccuccacuuaacaccuuucugaucgagcucucggauaauacguauuauaauagauugaaaugauuuuaaagcuuuguuuauuugauuuuguauguaugaguguuuugcuugcauguaugucuguguaccacaugcauguccggugcucuuggaagccauaaaaggacaguggaucccccuggaacuugaguuacagauggccgugagccacaugagugugccacagaucgaaccugguuccuuugcaauagcuacaaaggcucuaaacugcugagccaucucuccagcccugaaugagcucuuuauaucauaugagauuuaaaacaaaaauuguuuggcugugggucuccauaucuagaggggaagaaggacugaaggagccagaggggucaagaacaccacgagaaaagucuacagaaucaacuaacuaacugggcucauacagguucacagagacugaagugccaaucagagaucagucaugggacugaccuacgcccucugcacauaccuaacaguuguacagcugggucuucauguaguacuccuaacagcgggggcggggcuuaucucugacucuguugccugucuuucuaucccuuuucuguaacuugagugccuugucuagccucacuaagagaagugccuagucuuacuguagcauggcaugccaaagccagcugauauccacuggaggccuccccuuuucugaggagaaagagaggaggguuggaugcagggaggggagagggagggacuggaaggagaagagggaggguuugaagcuaccacugggaugaagaacuuaaugaguaauaauaauaauaauaaacauuguuuugguauugcauuacuuuucuucaaaaguagacuucuauuaaaaguacuuuaugaaauucacauuuugaugaccuccuguguuccaaauguggaggagcuguaaguacuguguuagauggaagaaccaagaagaccugauuaggcuucacaacaacagaagcaggccaggaggugguagcgcaugccuuuaaacccaguauuugggaagccaaugcaggcaagucucugaguuccaggccagucagggauagacggugagacccuguccuaaaccccaccccaaauaaaaaucaacaacccucucaaaacuccagagaaccaccggaaagaauaaaaauuaugagaaaacacagacauaaaaacaauucaaucucuuuugugggauauuguauguguguuuguaggggguuaggcuuggaaacuucagccucauccaugguauuauuacaugauauuauaugguauuauuauguuaauacucucauugauauacagacccugaaaaauauggucaagaaacaaaaaagauuaccccauacuaauauggcugaagagaacauuagugaagggcaguccaccaggcagaggagacaguugguaagaagcuugcuuugcaaggaccaggaccugaguuugguuuccagaagccauauuaaaaaaaaaaagaagaagaagaagacaggugguguguguguguguguguguguguguguguguguguguguaaucccagcccuaaaagugggaagagacagguggcaccgugaggcuuaaugaucaaucagccuagauuacuugguaaacuucagaguagagauggacucaucucaaacaccaaggugaauaaaaaccucuggccuccaaagcaugcaugugcauaugcacacacacaucacaauggggagagacagagucagagacagaaacagagagacagacagagggcaggggagggaggaagagagagagugagagcgugagaaagagcgagugagagaggggggagggggaggggagggggagggggagagagcauucacccagguaagccacagacaccagaagaacaaauguacgaacacugcuuaccaacagggagcaaggcugagagcccucaacacagccagaaaauaggagagagguugcaucuucagaguuuacaagugcgagaguuugucagaauucaaacaugauuguaugcauuacaaggacauucugaaugucacauaggauuuuuuuuuaaagugaaccacaguuaaaaaaaaaugugguaaaauuuagaccagaaagaauaaaccccauuuccagaacuauuguuuaucggacacaacagggaguucacucaguccaaaguauauuuuuagugggguguggucagaaauauucagaggugguuuaaucuaccagcugucaaacaauguguggaccauaaaaccuagggggcauggaaauuauagaaggguuuugaaaagcuccaauaacaugucucggaucuagaagcuacuuggauauuugagguguucuuucucccuuccucccucucucucuguuucucugucucugucucucacugucucucugugucugucugucugucugucugucugucugucucuguaugugcaugugugguguguucaggaaaccccucagagaauccuaacuuuaucuuucuuucuuucuuucuuucuuucuuucuuucuuucuuucguucguucguucguucguucguuuuuugagacaagguuucucugugcagcccuggcuguccuggaacucacucuguagaccaggcuggccucaaacucagaaauccugccucaggaacucaugauccugccucugccucccgagugcugggauuaaaggcgugugccaccacugcccggugagaauccuaacuuucacuccuguaugaccuuuaaacucuuagcaaguaggaagggaaggcucaggcacuauuauggacggcccuucuacauggacugggaggcuggcagguucugggaauuccagugacucucuguuucaucuucagcugggcacugaacuaacugcaaacgcuuggguuacuuuaguugcugcaugcgacaagaaguacagaucucacagaaucgguucagaaacaucacucagugcacaagcgucaauaaacacagcaaagcuagcagagcagagaaagacuuggugucuagaacagucagcaauaaaaagcugcuuuuuaauacauguaaagacacgagagagcacagcuggcaacauauuaggaaaaagacaguaaauggauucccugugaggaggcuaagacauuguacuuacgagacaaagaccgguagcccagccuggccuugaacucaugauccccaugcuccagccuccaaaugcugggauuucaggggugcaucaccacaauuggcuucuagacaaagacuuuuaaucggcuacuuuaaaucaaagagcuaauggagauuguguucagagaaccaaaaaguaaguggagucuuagucuuacugaauaggagacugagauaauagaaauuacaauuaaaaaguagaagugaaguagaagugaaagcugaaaugagcuaugugagaagcucacuagagagccugggcaaccuacuuaucuuuuguuuccacaacaugcauaucugucaacucagaaauucuacuucgagaugcccaggggguagcuacaagacuguuccuguacagugacagaucuuacuggucaccuaaucccaugccauuuuuucuuccucccccuguucuaacgacacccaacuuugcagucauggaagucaugggaagccuuuuccaggcuauggaucacaacuauucaaagcccguuagguugaucuuacccaguuuguugugcccguuguuuauggguuucagagugggccaaaguaacccagagggaccuuacguaaccagcuagcacacacccggugugacugaauacaacuaaggacacaggcaaagucaagccacauagccuuugcuggggcagacaaaucguaacuuuauguuccuggaagaacuugaauacaguuucaaaauuccauuuuccuucuccuaggaaaugggagacucugucucuuccccaggaaucugaucuuuggagguggcucaccaagagcaagggaacuauuuaguccucuuaaaaugccagucuaggaaacuggccacgagguaagucacccaguuacccugaggcugccaugccgagguggccauguguaggugcugugugucugacagccagcaccgccugcugaccacagugccagccuggagucacagguggcuacagacccagccaacucaaaggaauccaacuacccaaucaugaccuucccuuaacuucugacucucaaaaugauggcaaaaccagaaugcuucuuggagcggugauuucuucuguagcaacagaaugggaggggcuccucaaaaggaacggaagcuuugcuucugccucggaggggaaaaaagaaacacucccgaggaaaggccacuccccccaccccaaccuuuagccacuuuauauaagcucccaugcuuggccucguacagccacucaucugguccaaggagggaaaugccaaggagaauccaacacagugaaucaaaagauugaugggaagacaacgaggaggaggaggaagagguagcuuagaucuaguccucagaucuuagacuccauccucuucacaacuauauccuuuuuaaacauguguaugcucucuguguauaauguuguguguggugcuacagaaguuugcaagaugucucaauuauaccugaaggaagagagcucgcuucuggaggcuggugugaacacccugucacgcucacaguugcccaaguccacggccagccaacaauugcacuggaaaugccauuucuuccucguggucaugucacugacgaucaccuggcuuacauaccugcagucagauaaagauccccguguuaggaaggugugcagggacugcuugcuaugugagaagucgccuggcacuuucacugaacaccuaaguuaguaacuggaugcuuuugcaaggcaaggaugagaagcagaugagccaggcccaccugcuaucccucgggagguuccuguccaaggugcugacugcaaacuacucccugagaagaauuuggaugugcgcacgugcaagcacaugugcaccuuuaggcuuuguuuguuccauguguaauaaugaucuauuacuucuuaaaauaucccacauaccuccauuuuucaccauugguagucaacauuuauacuaaugacuucucacccccuaucugggucugcagcuauaucagaacuauagacucucagauuuuugacucaauccucuucccaacuauauauguuuuuuuguuuuuauaauguguguguguguguguguguguguguguaauggggugugugcaugcuacagugugcauauggagaucagaaaguagccuuggguaucaguccucucuuucuaccuucuuugagacaggaucccuugcacguaacugcauccacuagggauucuccuucuccccaucccuuugagcuagaggaguucagggaaggcaaaugcauguuaccacauccggcuguauguggggccaguggauucaaacucaggccauugcacuugcauggcaaguccuuuagccacggagcuaccucuccagccccucagcuacagugcuguagcuuuuuaacuaugucuaaaacauagaagaacaaccgaacagugcacagagcacuuaguccuguucagaggcaugaugcacagcacagugacuagggccuucugaugcuaugucuguaacuguuuuaggaugccauaaaccacagcccauguauaagauggcaagcuuagauagucacuauugggugcauucugaccauucuaccaacuagccccucucacaguucuuuccacccuuuugggucucucuauucucugaggcacaacaaucaggccaguuaguaacuccacaauggcuuauagguguucaagugagaaucuuacagccucuuucuuuaaaucaagaaccaggagugauuaggcucagugaggagggcacugaaggcugagacagguguagcacugauaaccaugagucaaaaugaagccaacuugagaacacaagggaaaaggucuggaaggaaauaaaaucacuucccuaaagggcaccuuaccuagaugagaaagcagaaccaguuucacuauaacagagaauguuuuaguguucugggcaacaucagacaaguuacaaaguucccaaaacuggagcgaagcaacacuguaacucucuucagcuucccgaaagcuucucaaggccuugcagcagcaggagaggcugaggcuggaggaccaucauugcuguuacaacaagaagcugcucccaaacacggcagugcaaaggcaagggccagggcuaacauagaagaugcagaagaggaugcagaagacccagcuaagccccuggaugaagaaggugacccucaacugguauucgguguagcacuauauugaagaagccagcuuggauuuucagagcagagaggaaaaguuggugcucagcaucggugcugcugggugaccagaaguggcagcaaaugcuaauuuaccauucugaaauggggcccuggggaauuggguugaaugcucuguagauaacucagcaaagcccggaugccugcacggccaauauggugaaaggggagaauugacucucacguuguccuuuaaccuccauacauuugugaguagugugugcaugcaacauaaauaaauguaaaaaaauaaacaaaaagaaaagaaaaaaaggauaaaugagccagcaugggaagguuuuuaccaagaagggcugucgccagaauugucaugccacagccgaaggccaugcaggucccccagccaggauccgguggaaagaaggaaaacauccagugcuccacgcucaaaaacugucuucucagggucacaaaggugguggggcucacugugccccucugagccauagagagugauaacgaccuaagauucaaugaggaaagacagaacacaaggcacuguaacacugugccuuuggguuuuucuuaagcagaaggaagcaugcauuagacauuaggcaaguccagaggguucuucacauuacacaguaagccuaggcaauaccgauuccuuuucaagcauuauuggacaccaagauauugucaaguuagaguaugcagaagacacauggugaugagcucgggcucugcuaaccuuggcggugguagcagcccuccuccgauagccaguguagaccuggauaagguagugggaugcagagcuggggucauugucagccaggacuguuaccuucaccugcaggaagagcagaagccaugagcuugcuaagucucuccuuaggaccacccuagcuggggacaggcuucucuguggcaguuuuagggccccaaugggaagcagggggagguaguguuagcaaggcaagcacacaggccagcaaagugaccagagggcugaggucugaaacucuaggcucugucucccaagaucaguuggcugggccuuggguaucaggcucgacccucauugcccuugggaaggaagagcacccagggcagaggauacccaggaaaacuggaguuuuagauaaacaauaagggccaugggccagcuaaagauucacccacuguuuauaugaaaugcaaauuaaauugcugccuugcuuuuuauuuaccaaagcuggcaacacuucauccaggacaacacaaaacccauacuccucuucuaaaacuucaaguauaaacaagaagagacugaaguguagcuauggguagaacccuugccuagcauguguaaggcauggaagaaaaaaagaauaacacaaaaauaagaaauguauaaaacagaaauuuuaaaaaaagaaaagaaaagaugcccaggcuggagagacagcucagugguuaagaguacagacugcucuuccagagguccugaauucaauucccagcaacuacaugguggcucacaaccaucuguaaugggaucugaugccuccuucuggugugucugaagaaagcaaugguaguguacucauaugcauaaaauaaauaaauaaaccuuuuuuaaaaaaagaugcccaagaauuuuacugcuuaaauuuuuuuucuaguuguagguagguguggugucaccuggaggacagaggaaggaggaucucugugggcuugaggcuagccuuugcuacgugcugaguuucaggcgagccagaauuguacugugggaccuugucuaaauuguuuuuuaucuaguuaaguaugguggcucacauucauaauuguuauaucaaggccggccugggcucucugaugugguuuuagggggucaguuguggggacaauaugagaucuugucuuuaacuuuaaaaaacuucagcauuucuuugugugcaguguuggggcacagcugugccaugacacacacguggaggucagagagcaacuugccauucucuccuuccaacaugguauguccuggggcucagacucaggucggcaggcuugguggcaagcgccuuugcgcacugagccaucuugccagccccagaaaauaaauuucuuacuaguuuccuguauacuacaguuacguuaaauuauaaauuggcuuggcaugcugggcagugguggcacaugccuuuaaucacagcacuugggaggcagaggcaggcggauuucugaguucgaggccagccugagauccacacagugagauccagaacagccagggcuacccagagaaacccugucucgaaagaccaauauauguauauguauauguauauguauauguauauguauauguauauguauauguauauguauauguauauauaaauagauaaauaaauuggcuuggcauaacuuugucuaguguauaagguaagauaaauaugggccugauuucaguuaagcuucuaugacaguuauuuucugguguauuucuaaucugcaugacuccugugaagauccuaccauagcaccaaaaccaaagcaaaccaaaaccaaccaaccaaacaaacaaacaacccccccccaaaaaaccccaaacaaacaaacaaaccccacuuuguuuugagacaguagguuugcagagagauuuaauacaaucccacuggacuuucucuuccuguuggcccacaaucucuucuuccccuaucuagcuugauacacucaacacacuguggcccuuggggcccaagccuucucaccuucugcauaucuucucgauccuuucuggaagcccacauggcuaagaggauauagaauccuaggaggcuggacagcaaugacaccccgacaggguuguuggucacaugaagaagcaguuugaugguguuuucuacauccaccguccucggcacgaugaagaagucgcugcugaagaaggucagguggucacagagacacugugucuuuaaaauggugcucuucggccccaccuggaagucgauugaagacucgaguuauaagguagagagacaaggaguagagaauggagacauaggcagccuugagacagaaaaacagaaaaggaccugaaggauauauauguauauauauauauauauauauauauauauauacuacauauauauguauguuauauacuacauauuauauauuauauuaauauuauauauuuacagguuauauauccauuuauauuaauguaauauauuaauauaacauauucuauauuuauauaugauauccauuuauaauauagauauacuaacauuuaucgugugagcaugggccacaggaccuauguggaggccaaagaacaacuugcaggagugaguucucccuuucgccccauacggguucucgggauugaacucaggcucccaugcuuggcagcccugguauauggcgccuucuucacugaugucacugauguauuccuccaucucuaguuucuaacaugggcaccucacguguaagguauuuaugaaguaugucuugaaagauccaagacuguggcuucccacaacagaggagagggggugaggauggcaagggguccacggguggcuucuauuauuccugaguccuuuauuauuuuuaaaacccugaagaaggggcuaccaugggccaccuucuuauuuggucccaggcugauuugcuucccuucagacuggaauuguuucuggcccauucccaaaaauggaagggggaggggugcagugaagguuucagagagccccucccaucccuuacuuggcauccaucgcucuuccauguccuauuguaucggucccagaaauagcacugggugacagcugugaccacugagaccaggacgggugugugcugugccgccucuguacuuuuauucuccacagccauuauguaguaggugccagucccguaccacagguucucuggugucagcacccacguguacuccucaucuuaggacagagaaggaugcugcguuauagucgcagugggcuaagacccccucagauccacaaccacuauuauucauuauuauuaucuuacaaacaagguuaugagucuagcaccagagacgugcagaagagaccagcggcauguccugaauucauacacacuccaguaaaggaauugucuaggaauuguuccaugacugugaacagacaccaugaccaaggccaacuauuguaaaggacaacauuuaauuggggcuggcuuacagguucagagguucaguucauuauagguagacauagugcuggaaagguagcugagaguucuacaucuugaucugagagcaaccaggagagacugguuucugcacuggguggugccugaguauaggaccucaaagucuaucccaccccgcaacccccaccaugauggacuuccucuaacaaggccacauccacuccaacaaggccacuccuacuccaacaaggccacacccacuccaacaaggccacaccuccuaauggcagcacuucccaugggcuaugcauauucaaacuaccacaggaaucauuuucuuuugauacauguacacuuaggucuaaagaauugugaugaacuaugaguucuagaaaaaagaaauuagggcuagagagauggcucagugguuaagagcauugacugcucuuccagaggucccgaguucaauucccagcaaccacaugguggcucacagccaucuguaauaagcucuuaugcccucuucuggggugucugaagacagcuacaauguacuugcauaaaugaaauaauuuuuuuuuaaagaagaaacaaggaaucaucacacaugggcuguguggagguuugaauaagaauggcuccuauagacuaauagaugugaaugcuuggucaucggggagaggcauuacuugagaaguauugugggugggagugugucacugaggugggcuuugauguuuuaaaagcccaagccaggcccagucucucucuuccugccaucuguggaucuggauggagaacucucagccaccucuccagcaccauaaacagccaugcucccugccaugaugauaaugaacuaaaugucugaaacuguaagccagcuccaacuaaauacuuucuuuuauaagaguugcugugguuguucacagcgguagaacccugagacaguaggaaaugcagcucagugauaagagugcucgugaauugucuaugaagcccuggguuugauccccagcaccaguaaacccaucaucgugguacaaauaguagcacuugagagauggagacaggaggaucagaaguucagcaucagccuuggcuauguggugagcuugagucuauuuugggcuacguaagacauuuacuuaaaaaaaaaaauggcuuggagcuugcucagcaguugaagugaaagugcuugccuugcaagcaagaggcucagaguucagaucccgagaagcuauauaaaugccggguagcgauggcaaucugacccuaaucccagccuuggaagguagagccaucccuacagaagguggcuaugaggacuaaacaucucggcaagcucugggucugauugagacaccucauuucaaagaauaaaguguaagagugauugauggagguguucgacaucacugucagaaccccccugacuccuccacacucccugcccucauuacacauguaggagcuugagaaacauaaucaccugucuuagugguacacuggccuugucauacuaaacacacguucuaccacagagcuacaccccugcaggcaucugauggucgauaccuuucugccacacuuggucccuuggcaggcugauguugagauagaagugagugugggccagcugguccuggaagcccaaguggagcgucauuaggaggggacuuucaggcucgauggucacaaugagggucuucuccaaggaagugauguucacagagauugugaaauggucuguacuuguguugaggcuggugggcugggucuccaugcuggcauuucuccagagcaugaucuagaaagggagacaguuaacccucuaggauaagauaggccuuucuguuuuccuuguagugaggaaguaacggaauuccugaggccucuucauugggucuuaguaggcaucacaaaaccagugauuagcagaggcugaacagucuuaaguggcuuuuccugggacugaguuaggucugacucuuugugaagguuccugagauguguagcaaaauacuagcccuaacaugaaucucuuuuuuucguaagacagggucucacuguguagccuuucugacauagagggcucccuauguaaccuaguggccuugaacccacagaaauugcuugccucugccucccaagugcugggauuaaacacaugugccacguacuucacucugacauguauugaaaaugccaaguuguuguaucuucccauccuguaucccagcacggccuguuuccauagagauacuuguucccauccucuaucccagcacggccuguuuccauagaaacuuguaccucaauaucuucuauuaagucguggacucugaucgacugauaagcagagcucagcugcacauuuccaaugcuuccaacaauguucuugucauccaaagucuuaaaaggguugaaagccagaccugucaccugcagaggaagcaaauuccaguucuuccaacugccagccaaauuguucacacaggagccccacaauggauuacaagguagcaguuauauuuuuuuuaaagauuuauuuauuuauuauaugugacuacccuguagcuaucuucagacacuccggaagaaagaguuagaucuuguuauggaugguugugagccaccaugugguugcugggauuugaacucaggaccuucggaagaguaguaggugcucuuaaccgcugagccuucucaccagcccagcaguuacaaauuaaagacugggauucccccacugugucaggugaaaggauguuaaacauuguaacacugaugagaaacaugaaaguggggccuacauuuggggcccucaagaucaucuccacaccuuugcuccuuacacuagggaauaaguauucugcaauguaacauuguuucuguagguuuuuuuuuuuuuuuuuuuuuuuugcgaguuaguuaugacucagauaaucccaacuuugucaggagagaaguugagauuaauucaaaucacaacacagagacuuaguuaaagccacauaucuguagaaugcucccaagcucccuucuggauuuuucuuuuuuuugagacucccaaaauagcaauauaaugcaauauaguugaauccacagcaauccucuugcugcugccucucaaguguuaggacgauagacaucagucaucaaaacuagcuauauacuagauuuuugugugugugugugugugugugugugugugugugcauguguuauaugcauuugaguauguaggugcaggaguuuaugccaauaaguaggccagagcagcacacuagguaccuuccucuccugaguucugucugggauucucacugaaauggaagcuugugguuugggcuaggcuggccggccaaugaacucuaaucugccugucucugagccacaaagcugaggugauaagcacgcauggccaugcccacacuuauaagggugcuggggauucaaacucagguccucuuauugacagaacauguguucuuaccugcugagccaccuccccaucccccacuagaucaucgcacaccacuccguuccugucucggcccaguucauacucacuugaagguucacgccuggguguuuguucaagagcuccuucagagcuucugcugacgggaagcccaaagucaagggugcaggcucacccaaaguguaggugcucaggggcaacguugacacauuuuggcugaaaggauuuaaaugcacaucacuuucugaaugcccucuaaaagucaaagucaaaaugaaucguuccccagcccucuagcccguuaauuaaccugcucaacaucagaguagcagagggagaggccagggucacugcugacugagggcacagacucugcuggcaaaaugcucuguggaucucccccagggccaucagggaugucuccagcaugucuucaaccugcauuuggagagugauuccuuguugucuguggacugugagugacaagguucugauagaguuacaagcgggacagggauugugguguaaagaaaggagacacagccagaguggacuuugaaauaccauagaaguauucagaguuuaacaucuuugcaugaaguaagugggggcagccaaaggaauauuuuuuuggccccauguuggugaaagaaacuacucuuauucaaaguggaugagagaaucuauuuuggagccaacuaccagugaccaggggcccaggacacagggucccagacucugguuauccaauuuccacgucccaucacgguaagaguuuccugaaguuuucaauagugauagaaaaaaaugaagucuuaaacaaggugguuuucaaacacauuggugggaacacuggguaggguggguuaaagaaaucgggggaacucuauucuaugggucucagaugcucucugguagcauccucagcuuuuugguuagugggagcuagaugucuuuuggggacauuucaaaggauuuacccaauggucaccuagaugcuaggucacauacagacaacaaauggcuauuuagaaggcugaugauggcccaagacaauuugucucugaguuuguaccauucugagcucucagaaaucucugauguucugaucggcuuaucaaccucccucguggaugguuuagugugaggagcuuuuguucagaccuaauaugaguuuucuucaauucccuccuguuaguugcuccuuugggagugggagggcaaggucuccgguaucucaggcugaccucaaacucacuccguagcuggaugucacuuugaauuuccgaucccccugcacugaucccaaaugcauugugugcuccguccauggggugcuguggauggaacagaagcauccugaagcauaggcaagcgcuucaccacccugagccucggcaccaggaugaggaucugagaacagcucuuuugagaugaacuuuccaaacaugguagaacccaccuucucgggcuauauauuuuuuacaucuacaugggaaaccaauaccacaaucuagcuuuuaaauuccaucccaugaaauaaacugguuuagucuggcuuccagagaucugaugcuucuggacauuucacaaggugaacuacaguagauggccuuucaugugacaugacguuucugagggacgcccaugcuguagcaugugucgguacuuauuuccuuuguguggcgaaauugccucugugugagcaugcugcguuuuauuuauccacccuccagaucaugcuguuucccacuuugggcuccuuuucuaucugagagaucugugucugaacgugucuuuguguggacuugcuuuuucaguccucuccuguaucuaauaccaaagagcagaguugcuaggagacaccgccagucuauugcuaacauuugugggacugcuacauuauuucgcaacacaauuuacaaugguuacaauuucucagccuccuuacuaauacuaguauugguucucacucucucacucucucuuucucucucucucucucucucucucccucucauuaacuacaaaaaaaaaagucucacauagcucaggcuggccucaaacucaguauucugccaaggauaaccuugaaucccucaugcccaccugccccugccccugccucugcaccucucugccucugccucugccucugugccucugugccucucucucugccucuguguugucaucagacacauguggccauaccuggcuugcccaucuuuuugguuguguuaucacccucuuuuuuccuuccuuccuuccuuccuuccuuccuuccuuccuuccuuccuuccuuccuuccuucccauguuuuuccugucaacaaugccuugcuaugcagcccaggcuggccuugaaguugcucuccuucugucucagccuuccgaguacuggugugcacuauauccagcgucuuugcauuuuccuaagagcuaaggguguugucucucacugaggguuuauggcaugcuucgcuaaaucaguuucagcugauuaugaggugaagcgagcauucagcagucucugcccacuggugggcuggagaaggagaccagaggcucagcaguuucuccaguagaauucucuuuugaagccugugaagaggcuguacgacugaauguuaaagagagaguuccuggcagagccagccaccugcacacugcacacccaccuguuccaugucuugcugagccaucugaugacugcuuuuuuccguuguuguuagacguccaagaggcuggaaggggcagcugacugcuggaguuugagagcuccaacuguuguucuucugaaacgggagcaccagcaacugcucacucaggucaaugaguaaauuggccacacugaccuggggaugucagaaaggggacgcauggagcugcuugcuacuuucagauucauuuguaucuucuuauaagcaguugaguauuuccuuccuaccccucccucccuccuuuccuccauaccuuccuucccucccucccuccaucagucuuuucuuccuuccuucuuuccuuccuuccauauguguguguguguguguguguguguguguguggugcaugcacauauucacguggguguaugugcaucuagaggccagacugaugucacaugucuucaucuguugcucucugccauguuuuuuuuuugggggagacagagccucucaccgaaccuggagcucaccaacuggucacccuagcuguccagcaaacucuaaggcuccacuugccuccaccucuccauccguagguuuccggccaggugaggccacaccuggcucuuacaaggaugcugcagaugugugcuugggggcggggucucaagcuugugagcaggcacuucaccaacugaguuguuuccccagccccacaguucaauaucuguuauacaguuggaauguauuuuaugaaaggcgacaucaccauugggcaggcaagggaaaauauaugacuguguaccaccuacgggggaggguuguguugaauguugagugcuacaacuuaaaagagggaugcuugggaaaagagccaugccaggccagaugcugagcaggugagcucguuuugaaagcauggguguggcauuaaaagcuucaagacacccagaauacaaaaaccagggagaauuuguuuuuguuuguuuguuuguuuucgagacaggguuucucuauguagcccuggcuguccuggaacuuacucugagcaccaggcuggccucgaacucauagagauccuccugccucugccucccgagugcuaggauuaaagcaugugccgucucaguucuaagaacaacaaaaaacaucaguucuccuuucuguaggcuguucucaugcaaaaccaaagggaauaaagaaaggcuaagaagucagaggcagugugcaugccuguggccccagagcccaggaggcagagacaggagguaaaguaaguucaaagccagcucgggaugauuagugagacccugucucaaaccaaccgaucaguugccuaacuacccagaaggagacgcaaggcaaguuugauuggauaguuucuagacaccuacuguagcuacuauuaucuuuauuguggaguguuauuuucuuucagaguuauucuuacuaagagcaucuguaaaccaggcauggugggcuguagcuucaaucccagcacucuagaagcagagacaggaggaucucugugaauuugaggccagccuagucuacaaaacaagucccaggacagccagggcuguuagucagaaaaacccugucucaaaaaaccaaaaaaaaaaaaaaaaaaaaaaaagauucagucugaccagguaugaggaagugaugucaucaaacacggaugcaggaaaccgaaaggucagaagcauucugauucugaugccugucccaagaccauccaacuguaucuacggcaaacuguccaucacaacccgugacucugagaauaccauugguugacaacacacuccuuucagacuuaaaaaauaacucagcucucuucccaucagguucucucauggugcagggggcacaaccuccacguugucccuucccuuccugcugcugugacaccuugcccugcuccacucgcccuguuuaccugagcugaugugggagaagucggcaggaagucucucagucucuggaggauggcacaagcuuucuggaauucacugugggcuuggaaaucaggaauuguugggacccguuccccugcugucucauccaaggccugcugggaagaaaagauuuuugucaggcuggagaguuggcccuguagguaaaggcacuuacagcgaagacugaaggaccccaguuggaucccgggaacccacaggauggaagggcagaacugauuccuaagaguuguucucugaccuccacgugagugauguggcaugggcacacccacacucccagacacacaaacacaugaaggcaacaaaaauuuaaaagauaacauuuucaucaaaauuauuuauacaaaauuauuuucaugcauuuggaguuugguauaccauguuaaugaacacuggccaaggauaaucuucuagguuucaugaacuacaggcuucaaaagugcuguuacuuuagggagaauccuucauacaugagagaagaugaguaggacuuuuauggaaugaauaggauaaaaguagaugauguuguugguaggauuauaggcaugaguuugcagagagcuuaccuagaaauacuagguucugaguucaagacucaacaauggggcaaagaauucauguucaaaaggggaaaaaaaaaaaccuuuguagcaggagguggggugucaaacucuuccccgacaaaaaggcaauucaaggaggaaaggcaggcacuuccacaucauaguccgucacugaaggaagcugggacugggaacucaaacggggcuggaaccuggaggcaggagcugaugcagaggccaugaaaggcugucccuuacuggcucccucagcauggcucgcucauccugcuuucuuauagaacucagggccgccagcccagagauggcaccacuaauuaaucguuagugguuaaucuuuaaucacuaaucaagaaaaugccuuacagcugggucuuauggagaaaucuucucaauugagguccucuccuuuccgaugacucuagcuugugucaaggugucauaagcuagaccaccuccucagcacaccauccucaugggcuaaaugguucacuagguuauuccucacuuccugggagaggucacuuccagaaggacccuagacugagaaccacucuauugaggcuuugacugaggugcaaauaagaugaugaugugagggugagcuguagcugccaucccaugacccacuaguagcugggcuuucuggaugcuauccuagcuauaggcagcuguggagacacauaccucauuugguauuugcacccugggccacaucauauggcauaucuuaauauuuauguagcccaggcuggccuuaaauugacaauccuccugccucagccugcugaguacugggauaaaggugucugcuacaucacuugcuugugucuuauuuucucacuguugcacacauaucuugaguugggcgacgucacugaauucucuaaacagcuccaaaaauuuaucucuaaacacuucuggauauucacucuacauuucuagugucucuuuauuuaaggaagugaaucaaacuccauucguagguuaagguacugcaggcugguccuucccugguuggaggacaaugugggacaagugugaaccuuuagcuuccaucaccaugggaguagaguaaaugggguguuuuauuuuauuuuauuuuaaaauuaauuauuuauuauuauauguaaguacacuguagcuguccucagacacaccagaagaggguacagaugguugugagucaccaugugauugcugggauuugaacucaggacauuuggaagagcagucagugcucuuaacugcugagccaucucuccagccccaaauaggcuguuuuaaugcgaaagugccagguugcauaugaagaagguuugaacuuuuuccagugggaguggggaaugggauucuugccagucaccuugccucaguggcuuuaccucugguacauuggggcaggcuagcacacguccuucaccacccaauggugaauagaugaguccuaaucaaaaugugccaucaaguacugcaauaggcacucaacccacugggagagauugucuugggcucaguucauuuugcuuuuaguguacagcccuccugggagguaacaggguagccaucuucuuuuuaaaaucauaacccugggaauguugugauagaaggacacauguacucuuuucaugacuauguuuuucaaaacugacgccugaaccugggguucaugcacacgcuaggacaguguuuuaccacucgccacauccccagaccuguaagugcuuuuucagugucaugaagcuacccaguuaucuucugcguuccagacuuaccugacugguugaacucugaaaugacaucuguggauggguagagaugacucccaggggagagucuuccugugccuuugaagugauguuugccaaagaucuuccagcagguauuguggauucaggccuggugaccucuguuauaacaggccauggugggcugcuggaugcaggugugucugaugucauguuuguugggcugcuggaugcaggugugucugaugucauguuuguugggcugcuggaugcaggugugucugaugucauguuuguugggcugcuggaugcaggugucucugaugucaccuguggugggcugcuggaugcaggugugucugauauuaccuguggugggcugauggaugcagaugugucugaugucaccuguggugggcugcuggaugcaggugucucugaugucaccuguggugggcugcuggaugcaggugugucugaugucaccuguggugggcugcuggaugcaggugugucugaugucaccuguggugggcugcuggauacaaguguggcuguugucaccuguguugggcugcugaauccaggugugucugauguccccuguggugggcuauuggaugcaggugugucugaugucaccuguguugggcugcuggaugcaggugucucugaugucaccuguguugggcugcuggaugcaggugucucugaugucaccuguggugggcugcuggauacaaguguggcuguugucaccuguggugggcugcugaauccaggugucucugauguccccuguggugggcuguuggaugcaggugucucugauguccccuguggugggcugcuggaugcaggugugucugauguccccuguggugggcugcuagaugaaggugugucuaauguccccuguggugggcugcuggaugcaggugugucugauguccccuguggugggcugcuagaugcagauguggcugaugucaccuguggugggcugcuggaugcaggugugucugauguccccuguggugggcugcuagaugcagauguggcugaugucaccuguggugggcugcuggaugcaggugugucugauguccccuguggugggcugcuagaugcagauguggcugaugucaccuguggugggcugcuggaugcaggugugucugauguccccuguggugggcugcuagaugcagauguggcugaugucaccuguggugggcugcuggaugcaggugugucugauguccccuguggugggcugcuggaugcaagugugucugaugucaccuguggccuuccaguuagggaugugauugucauccuguguguggcuuuuggaggugcugaagaagcugggucaaugggaaagcacaaugucucaaacuaaaagagaagaacauguaaaggaagaggcuaaaucuuaucgagcacaguagcauggggccguguucuguguucccuuugggacccucaugcucuuuaggacacagacugcagacugccgucaaacaccuccgagagaacacaauuucacacacugaggacaacgcguucguugcucaucauuuaauaacuuacuaaacaccuaauaugugcuaagcuguguucaggagaacugggaguauugaacaaaaugagucuagugucuggccuccuagggccuccauggaaguggagaugaacaggcacauucuggcagguacugaauccacgcugggaagggggcauucagacaagcaggugggggagggagguugugcuucugagcagcccucaaauguacaggaggaaaagcgggcucugccgacaugucugaggacaucugagggggccaaagcuugcuggguguguuugaggaggaaguaggaggccagaaaugaaagaggggggaugggauggauugagcagugggguugaggggcaugugcagugucagcagucagagucugacucccaugaugaggucagacaagacaggaagggguaaaagaacgggagcgcugagaggggcagaugcagcugaugcggcagcucaggcccugcugucccuccuucuggcagcguuucuacggcugucagcuuggaaaacgcugagaugugaauuccauuucaccuuugucuuuuuauauauauauauugcuagaaacacuucuccaguugacauuggauggaagaaacagagcaauuuagauagguccuaccaggucaucaugcagcggacucugaagggaaagcugaaacucuaguagcugcccugauaguugcugccuucccuucccucgggccccucucccucucuuugauuuucagagcuuaucuucuucuuuauuauuauuauuauucauucauuuaauguauaugaguacacuccagaagagagcaucggaucccauuacagauggcugugagccaccaugugguugcugggaauugaacucagaaccucuggaagagcagucuuaaccgaugagccaucucucuuagcccuccagagcuuaauuuauugcaccugucucuaaaggcggccaccaguccucggagugaaucagaggggaaaacacacaacagcaaagaggugggcaucacaucugcacgggagcccagagaucgguagccaugauugucuucagauugcccgcuaaccuagcucuucccugugcuuuccuuucuagaacgcugugcccggcacacuccaagagauaauaauaaaauccuggcaggacccaucagaccgcagagagcugaauaugucacacuugucuugugacugcaguacuuacaagcucaggaggagcggguuggugacacauggcuaacggggggccauuuccuagagaaauaagaaagcagagcuguaugugauuaacuugaaauaauuuagaaaacgaaucugaucaauaauacacuguaugaaauccucaaggaauuaauaaaagcauuguuuuuaaaaaguugugaaaaaaaaucacugcuuuagagagcugaguuuucagcccagguguagagcgcuugcccaguaucugagagacccuagauucaaccuccaguacugccaggggaaaaauguuaaucgaauaauaacccacagauuauacuaauaaaauugugggcgugaggguaaagagguaugguaacuggauugcacauguucuugcaagauucucucagugaggucaucucugacuuccagaauaaucgcuagauccacuguaaauuugucucaguuuuacccucugguguucucucuaaucauccaacguggauauagacuguggugguuugaauagcuauauccguguagccucacguguuuaaaugcuuggcccauggggaguggcacuauuaggagguguggccuuguugaagaaagugcaucacuguggggguggggcuuugaggucuccuauucucaagcuuugcccaguguuggaacauagucuccuccuugcugccuuuggaucaagauguaaaacucuuaguuccugcagcaucaugucugccugcaugcugccaugcuucacgccacguugauaguggacugaaccucugaaacucuaagccagcuucaauuaaauguuuucuuucaugagaguugccuuggucauggugucucuucacagcaauaaaacccuaacuaagacacagacuaaaguguuuucaggcaaaugcaccuuccucaauuagcauuuguucuuauaugagccagagauagagagagagaaaacaaaauguuggggggugcuucugcuauagaguacuugcguaguauacacagagccccagguuugauagccagcaccacgaaaaaagauaaggucuccauacuuugcauugagaucagauacucagacacaaguaggugcuuccuuggcuccugauacaauaacucauuuggauuuagcuuggcuccagggaccuccagggaugacuggaucacacacuuagagauggaacauguuaccugggaucauaugucucucugucucagcuccucuucuuuucauggguaacagaggaccaggaccaaacucauuucuccaaaugcuugcaccuugagggggaaaggcggcuguguggagucaacacaaagguuuaucuguuggugauggcuuugacuguaacucacaaauagucacccccccccacaugcacacaccaucaggaaaacacaaugauuaucaaucauuuccuccacauaacagcaaggagauucugaaguagcccccauagccacaucuuacuguauccuacugggaaucuaaaauugagucuaauuaggccaacaggugagcgacagaggguuaaacuacuugugugaaaggacaugcugagcaaauuaucucccuuggcgguuuuguagcucugguggauagaacucagggcccagaaacgacuggaguggcuuuuguggugguccaggcaccaggcacuucaccgcuaagucauacucucagccguauacugacguucuggaaugcuucauuucccacauacgcacacccagguucgucacacguccaaacugaaaagcacuagagaaagucauauaaccaugcuggcuacaucucaacuuaaaguuaggaccucagucuuccucggccugcaucugcucugccugguggucagcagagugucuagucuagcugcugcuguucuugcaugacucucuaugaccuccuuacucagccuucaacaaccaggagccuucuguauuccccuuagggcagauaggaauggcucucaugggcucauauauuugaauucuugguucccagcugcuggaacuguuugagaaggauuaggaggcguggccuugcuagagaaaguguuucacugaggguguugaaguuucaaaagccuacaccauucccagguagcucucucucugacuugugcuugugcacugaaugugaguucucaguuucugcucuagccaccugucaccaugccaaccaaaacaagaagaacaagaagccggcagcuuucguugcccuuuggaaccacacuucugaaucuuuucugauuuugagcaaaauuacuuugagaaaauuacuacauucaagggcuuuguuuuuaucucaggggauugcuuuguaaaguucuugauccaaauguuuuauugucuuuuuaguuuguuuugugcugauagaguaucacagacagaaguuuagggcuggggguacagcuugguguugggugcuugauuaguguggauaagacucuggauuguauuaaagcacaggaagaagaaaagagggagggaaaagaagaaaagagaggagaaaaaauaaaaggagaaaggaaaaaaaaccagaaguuaacucuucucaguucaggagcuggagaagucugaagucaugcuguuuggugagggaugcauggggggggggggggacagggagaacaguuguggccucacacgaagagagaggaggagacuaucaccaaauaacagucacuagggaggggaccugguggccuaggaaccucucaaagguuccacuuguuagacucuccauuagcagaggcuggauuuuggagugauccacuugauggccagcccagaaguucaaggucacccuuucggacagaacagggguggggaggacuguauuuguaaaguccaaagccaagaauucuugagaguaucaaacacuuaacacucauucaaaacucaugcccaugucaucaagugggcuacauuaacuaaauauugcuuccccccccgucccccccccccgcuuucugggugguggugacacaagccuuuaaucccagcacuggggaggcagaggcaggcagauuucugaauucauggccagccuggucuacagagcaaguuucaggacagccauggcuacacagagaaacccugucucaaaaaaaaaaaaaaugcuucugucacauggagugggcugugcgaaacagucuucuguaaugaucaugggugacucacaaugguaauacagccggguaacauuagggaggcggcuugugagggggaaaugggcugcugaccugggagggugucagccuuacugucuuagccucauuaacacuggugagcucuuuagaacaguagacuugaagucugguaauguaaaguagacaugaacaccaugaggcauugggaauagugaagaauggaggcuugaagcuggacuuuauuacaucaagacaaaugcauuuacuacugcuauuugaggaagaugguuguggugguuugaauaugcuuggcccaugggaaguggcacuauuaggacuuguggccuuguuagaauagguguggccuuguugaaggaaguaugucaugguguaggugggccuugagggcuccuagggcucaagcucugcccagugcagaagggagagcauuccccuggcugcuugcagaagccaaucuccugguugccuuuggaucacgauguaaagugcuucguuucuccggcaccauaucugccuggaugcugccaugcuucuuaccauaaugauaauggacggaaccucugacccuauaagccagccucaauuaaaugguccuuuauaaaaguugccuuggucaugaugucucuucacagcgaugauacacuaagauaguggucuuucuauuugggacagagugaugaugcaaugaauucuguuuuuguuagcuacagcaacuucauauguuaaggagaacacauuaguagguuugaaaagcacagugauguggcuagacaagguggcacacaccuuuaaucccagugcuacuagagcagagacaggaagaucuuuuggaguuugagaccagccuguucuaaagagccaguuccaugacagcuagaaccacaaagugagacucuugucaaaaaaaaaaaagugggauaaaaugucugucuaaauugucuguaauauggcaaggacuucaagaauccaccaggucaaggcugaaugcuuugugaaggcagaggccacugccggguguaauaaaaauggcagguauguggagaguuagcuuagcggguguguacacuucuugcagaggaccugaguuugagucccagaccucaugucaggagcucacaucugccucuaacuccagccccagugggaauccagugccucuggccucuaugggaaccugaauucauguauucaugugcacauauauagaaaugacagucaugccaacacacaugcgugcauacacacacacacacacacacauacacugaccauuccaaucuuccagaugcagggaagcacacuucuuagagcucauggccucuggucuucucguuuuccuacgccacauuaucauuuccuucucauucugucucuaacagcccagugcugaucagacugggggugagcauucggggagggaaagcuaccagcucagucucuccugcacuucacccaggucgaccgugagaguucaucuagcagcuagcauggaggggugaagacaucacucacuccaaggggcaguuucuugggauagccaguguuaugaaacuagaaacugcaggcuggagggaugacucggaggcaaaaggcaccugccaguaagccugaugaccugaguuuaaaccccagaauccaccugguaggagagaacugacccccacaaguugaccucugaccuccauauguguccugcggcaccugugccaacccccaacucccaucuccacaggcaaacaggacaaguuaaaaaaaaaaaaacuaaaaauagaaauucuuggguuggaaagcaggcucagugagugguuaagagcaccgucugcucuccuagagguccugaguucaauucccagcaaccacaugguggcucacaaccaucuguaaugagaucugacgcccucugcugcugugucugaagauagcuacaguguacucacauauauaaaauaaauaaaucuuuuuaaaaagauagaaauucuuauaucuguccaauggucaauuccagacuauuuaaaauuuauccucucaugugcauaccuuauguaauaccaguuucgaaacuaaaauugauguaguuuggugacucaccagccuggcaaaugaaaugaugcuucucuaugcacagguuccaucuugagaagacagcauuagagugugugaccacggaagggcacucgccaggcuuuugguuccuuaagacgucaucaccuccuggaggggcaccagacucaguuaagucccacucuucagaguuagacaggggagguggcucagugagcaaaacacuugcugggcagaugugaggacccaaguucgaaucccuggagcccauguauggccaggcaugguagccucccauaucuguaaucccagugcucuuaggugagaugggaggugaaggaaggaggaucccagagaccugugggaccugggguacacuguggcggacaacaaaagagaccuugccccaaacaagguggaaggugaggagaaacaucggaguuugauacucggccuccacacacgguggcacuaaagcacauauaugcccaacuugucuggcuuccagcaaaugaaaaguuacgacuucucccugaguauuauagauuacucuucaauauuuagauauuuuaaucauagaucuuagaauuaauuaccuagacauuagggagacaugaugauauaauaauuucuuguuuuuuuuucuuuuugcuaaaauugcaagauuaugguacucgauuuuguaaaaaaaacaauaaagagguaauuucucuccuagcuucuguuuuaggaaaucuggaggcaaagauaacaaagaaagucacuguaagaguuuuuuucucuuuagaaucuuguauaauagcaacuauuuguauaccuggaaagccaacauucaaaaggcuuuccucuucauucaacauucaacacuuaaggggggggugcgugguggggggauugagaguuugagaccaguuugugcugaauaccaaguuucaggacaucuugcacuauaaagcaaaacugucacaauauaaaacaaaacaacaaaaauuccagauaccccaaaucaaauaaagcaaaauaacaccauacaugaagacucaggaauuaaguuuuagacaggcucugacaaaaagcucauugccaccggucaaugauggugcacaccuuuaaucccagcacucaggaggcacaggcaggaggaucucugugaguucaaggccuggaacgugaucuacagagcacauuccaggacagccaaggcuacacagacagacccugucucagggggggaaaaaguacauugccauugcuauggagacaaauguuggccgagacacaaaaguggaaagcguauggagagagauugauggucaaacuaacccuuuuucugauuauaaaagcugaaagggggcuggagagauggcucagaaguuaaaagcacuggcugcucuuucagaggucccgaguucaauucucagcaaccacauggacacucacaaccaucuguaaucgaucugaugcccucuucuggcaagcagguagaugugcagauaaagcacucauacguaaaauaaauaaaucucaaaaagggaaaaaacaauaccuuaaaauguaaucugaaaaaaaaaaaaaaaaaguggaaaggccaaagaugacuuucuuccacccuagaacacagcccaagaaagcuuuuccccucaacauucaacacgagagcccuaccugucugauuuaucccuggaugcgauccgggcagcgucagguuuccccugacccaccacacuguuucuucauucaggaagcuuuuuaggaaaccccgaagcuugggguuccacgugugggcuaggcguccucucugggcguggcaguaguuaucugcuuccuggaagucacagaaaagucuguuaagcugauagcagcuguuucccccauguugcucccggaugcuugguuuacgucccaaaauaucacccagaaugacaccgauucuaauguacagccagagccaggaccgccucugcaagagcauu

SEQ ID NO: 4767 - RNA, 21985 nt, Mus musculus
ugaccaacacuagagaaagcaggacaugggaucuuuauuagcagcuagagcuauaagacacaaauaaaucaaaaacauugacacugaaguugcuggaaacagguauguacagaaauacuacagguaagcaaaaaucucaucuuccaaugccaaagcuaaccucuuggggaaggagagccuuggcuaggggcaaagcagcacagaaguuaccauaauaaagagguucauccacccaggaaagcagcagacuacagcgacauggcacuaaaacuuaagaugccaguuuguaaagagucccuuaaucauaaaaguuuuccaaugaaaacaaguaccccuccucuccugcaggcuuccagaucucuacccaagagacuugaguacuucuauuaaggcaacuggaagcccacgcuagcuuagguaacgaccuguacuuccuuccuaacaugcuauggggaaaagcaaauuuccacagugcuguucuuuccuaaaaaggaaacagcacucaaaauaaaggaaaaggccacagagggcucccugagaauccaguaaaacuaagagaacuuuuccaaacuuugcaacuggauccagguggaacagugcccugcagcgaggaguaguguacaugucaaugagagggcccagccuccaggaaccgugacaguggcuuccugagccaucuucugacucaugagaaaacacaugguagccuugauucucucuacgaucacccccaugcagagggaaguauuuacgagucaagguugaaacccaucauaggguacucucuuccaugguccagccaucuuuggcaacucuacccacaauacuucucacucccugggaauggaauggccgggaaagaaccaaggauccacgugacaggaagacagacaggcaaacacagccaauaggagccaacugcuccagcuagagucuccagcuguuagucucucaggaucacugaagaaucacugaagaaguggaaagcaacacaauugguagagcagcagagagccccgaggaagagugcucagugacgguuaacagaggaaacggaauuucauggagagucacuguuacacggagaacuguucacuaucaacuuccagaauguggaugcugccugguuuaagagaccuauguuuucuuuuucaguuccucaaaucuccgggaaagaucaucaaagucuaugucuucugaugcugaggugcuggcuccagcagaugcaguuggaagugugucuggcaccgauggcaacucuggcaguacaaagguguuguaauuauccacaggucuggaagggggcuuugcaggagcuucuggcuuggguccuaauuaaaucaggucaaagagcacaaucuuacaaguggcagaggaaugacucagccuucugugacaaaaccaguaccaaacaccccacaaucccuuuuggcagagggcuaaauaaauaaauuaaugaauuaaaaugcaggagaggccagggguguagcucagaguauuugcccagcauacacaaagcuuaguuugauccccagcacugcauacaacugcacacggugguaaaugccagcacuagggagguggaagcgaguggauaaggaggcccacggcaugguggcgcacgccuuuaaucccagcacuugggaggcagaggccagccuggucuacaaagugaguuccaggacagccagggggcuacacagagaaacccugucuagaaaagaaagaaagaaaaaagaaaaaaaaccagacugguacuaucugauguaacaauaacagucuauucuggauacgguucuuccacuggcucuccuuccuuccuucuccuuuucuuucaauacuggagaucaaauccagggacuugugaugcugggcaaguccccuacacugaguuuauggccucagccucccggugcaccccccacacccaacugcucuaauuucagauauguuuucuggggugcuaguagcacuuuuuuuuuaauuuauuuuaugugcauugguguuuuuccugcauguaugucuauguaagaguguugagucucccagagcuguugcuauagacaguuaugaggugccacaugggugcugggaauuaaaccucaguccucuggaaaaacagccagugcucuuaaccacuaagccaccucuccaguccagcacuucauuuucuaacuuacuaacuacaaaaacauggccugcuuuaugaaaauucacucuuauugcuugugccuauuuuguccucugugcugguuaguuuuaugucaucuggauacaaaguagagucauuugggaaaggggaaucucaauugagaaaaugcugccaccagauuaacaucagaggcccagcucacuggaagccaugccucuccuauguagguccugagugguacaagaaaccaggcugaaaaauagagcuggcccugcuggcaugggcacaggugagccagccccaagggcaugagagugggagagcugguuccaccucuugccaacgggacuugguuagucagggcagcucuagagagcucacccugguggugcaggagagcuggccggcugaccaacucacucccagccagggcuuugaguugcccaccccaacauuuaccccaucuaccaccugcuggggcauguaaaggggcaguucuacagauccaaacuuacagggucuccaugacacagggcaacaacgagauaucuaagaagaaucccagugaggauccaguauugauuaaguagcagaagccaaaggccuuguaccagaccaaugacucauugccaagaaguauggacaaaaggguuuacugugggacucacugugacacuacagcuuccacaacaagauuugggggggggggggggggggcgcuugcaagggugaaggguagguacagggacagagauaaguagauugggauacaugaugugaaauucacaaaggaucaauaaaaaguuuuacaaaucuaugaguuuaggcagguacucauucugcuuugguuucugccuccagauuccugccucgacugugacaaagaaauguaagcaagcuaggcaugguggugcaugucuuuaaucccaacacuugggaggcagaggcaggggcauuucugaguuugaggccagcuuggucuacaaagugaguuccaggacagccagggcuauacagagaaacucugucucgaaaaaccaaaaaaaaaaaaaaaagaaaaaaagaaaaagaaauguaagcaaagcaaaauaaacccuuuguuuuaucacaguagaaaccuaacauacccuuuaauaccucacuucaaaaaucaacuggggagcuggggugcagagugggggcucaaguagaggcucagugguuaaaaagcucuuccagaggaccgggguuuaauccccaggacacacacggucacucacagcagucuaucucaagcucuggauccaaugcccucuucugcucuccaagggcacugccugcacaugguguauagacacagacagaaaaggggugggguggggaaggcugaagagauggcucaacaguuaagaacaucaaaugcucuuccggagguccugaguucaauucccagcagccccauggugguucauaaccaucuauaaugagaucugaugcccugaagacagcuacaguguacuuacauauaaauaaaucuuuuuuuaaaaaaaaacccacuugucaagcucagcauaguggcacacgccuuuaaucccagggggcagaggcagguggaucucugaguuggaggucagccagggcuacacagagaaacccugucucaaaaacaaaccacccaucacugcagccccaggaggauuccuccagccuccauggggacccacacucguguguauaaacccacauacauauaaauacacaaaaauaauagagaacuaaaaaauuggggcugaagaaagaaguucugaguucuuuguuagacacauauuugaaaagaggguauggaucauggguugaaugccauggccccggagagagaaacuguaagagacuaagagaaugcagcacuaugaagcuuucugaaacacacucaccaacaaucugugcagaagaaacaguuuuaucaccauuaaugucaucaaccugcaaaacaaagauuguuaccaaaggaaaaagcaaugaaugacaucucuagacaaagcacuaacagcagcuccuuguuuuccaaaagcuaagcuauccaccaaaagcaacagaauuugcuccuaggaaaaugccuccuagacucuccaugcuucuccgaaccacuuaagacaccacaccaaccucugaccugcuaagcaaagaaagaaaagucuuaccacacugugacacuuuucagcuuccaggcaaagcaaacuaggaaaucuaccagaaccaaggccucaaggacugaagauccaccucauuccacaaacaguguuuugauacauggaaugcuaaagcuugagaaagacucaguuccaggagaaaacacaucaacuagagauggaaaccaacgggaagaaugauaagcaaacucaggaucugggagagcuuccuagugaguaauuuacauagcacaucccacaccaacuuguuuucuaagcaaaccaugagcuggaaacagcucugaaggcauguaugcauguaugagucauguauguauaugcaagacucgcagaaaacaaguaauucugaagcagagacacaguugaaggcauccuuaccccaugagccauuuaugaaaauguaugcaagcgcugcgagcugugccuagggccucccacacagcagacgcgcaccccaccgcucaacuacaaagucuugugggugaucuaucuacuuuagcucccaaacugccacaggguugcucuauuuuaaguuuuaacuacaagaauaaaauguggacuaaaugcuacaggccaaaaguaacuaacuauggacacuugguuaagucaaacaccccauuacuauccuuugccaugaauguugugaacuuaaaagacagaaagccuggugcucuaauaaauauaguaucaaauuacagcagcucaguguaauccucagacugguuuaguaagacgcgugucuccacaugaagugcucucuuagaggcacuacuucccuuuacuguuuuagaugggcucauguaguccaggcugacuugaagugcugagacuguaggcaugugccaccaugcccaugagagcauuuaauaacuuccuuagugcagcuccuuccugcucccuggcuucagugcugacacagcaugcccaccacaaaugccaccagcagcaccccccaucuccagggcgggaugaaagcaacaaagaauccagaagcaagaccaaacccauacuaaguuuaucaaaaguuugccuucccuguugucauuauuuugcucucuucaugggauucacucuccugccguuuaccaaaaggcucaggcacuuacagauucauaggaugggggaguugcugguaucugaggugggugaauguuaggaaaggccugguaaguccccacuggcaauccacugaaauccgacugcaagagaaaaacgguaucagagacccugccugccuccugaucuguaacuucuagaugggcugggaagagauguguguaaaagcacaugguguacauaugaacacauucaagauccucauagggaucaugcgucacaaagacuacaagcguaaagaucuacaaagguucuucuucaguuaucacaucaaguucuuuaaugucugccucaaagggaaaaaacuugauugcuaccaaugaccuacuauaaaaucagcauccuagcaacaaaggcucuucagcgugaugauaaaggaaagcucuuguuuucaggaaaaaaacaaacaaaaaacauuacugcagcagguuccuagcuguuuaauaacuuucccuaaacugguuuucuuaguacuaccuauagauuuuuauuuauuuauuuauuuuuacuucaguucuugcagcuaaagccaagaacuuuucuggcucugauauuguuccucaauacacuuguucgacuacucagcuaauacaaguguuguuguuauucuguauuccuggcaaccuacaacuucucaguguguccagagcccaucuggucucuucugcaacauugucuaaagcuuacgugcacacuuucuuuauacacacauacuuacuggucccuuuggcaguggguaugcgaagggagcauuuggagauggcaugggcauaggcaugggcaugggcacaaucccaucaggucccccaacgggggcugugaacccgcccccuccuccucuuccaggaccaccuuucuucacaucguccguaaauccaacaucaauaagaucugucuccaccccaacaggagcuucugccuaagaaaaggaggcauuuauuaacccaaggccauggcuagguucucuagaagucuagggcuacacauacaagcauaaaagcuguuuacuuuggucucagauagcccaggcuagccuugaacugauccucuugcuucuacaucccuaguuaauaggauuaacuacuuuucugcuaaucugauauugcuuuucuuucauaauaauggucacgccaucaacagcucuagggaaagugaaggcauuauauagggagaacacuacacugcaaugcugcaccacagccucagacaauuccucaggaagcaaggggaaagcaagggaaagcaagggagaugaaggucuccaagggagggaagggggcagaguauagaguuuaaaagucccugcccaggggcuggacagauggcucggugguuaagagcacugauugcacuuccagagguccugaguucaaaucccagcaaacgcaugguggcucacaaccaucuguaaugagaucugaugcccucuggggugucugaagacugcuacaguguacucauauauaauaaauaaauaaauaaaucuuuuuaaaaaaaauuuuuaaaaagucccugcccuaggagauucaggaagaaaauguuccagaaaagaaaacuuaauccagcagagggccagcucuaaagaacaugcacacauuuaauacuccugagagcugggggaauguugccuucugggugugucgugugcuggagguugguugguguaccagccucuaccauacccuacuaacuuuauuugcugauucauuauuagagucaagacagagacuuuguugugcauguuuauccacacucagcugucuacccacuccuggaacacagcacacuaacugaacuguguagauccuggggaaccgccacauacaagggcuucucgacuucaggcucacucaaaggcagaaauaccaugcuuuaacauuucugucaagguugugcauucucaggcugccuccguuugcucaauaucaugcguuaagugaccugugagauuugcagucauauuuauuguuauacaacaaaguaccaaaggcuuacaugcaccacuucagcuaguauaaauaauagcuccuuguuccccagaaguccuacccagucucauuuuccucugugcucaggcauaaacuuaccaugaccacagagucagguucguaggguacauuguaauucuuggcaauuucaaucagguaucucuccacuaggauuuuggguggggcuucuacgcucaguuugugcauuagcugugacaaaagauugguguuaagaagcagccauacaaccagccuagucccaaccugcuucuuaguuucucucauuuuucugguaacacugaggaagauaagaauaaagaugaacuaguucccagucaaaggcacacuacaggaugcaggcuuuccucgcucucuagcuaugagacagguucucagcaccaaugcccucccccuucauuccgccaacccuucuuuccacuuuccuccugccuuccuaacucacagcggauggaaaaagagaacagcucaccagucgggcuccaggccgggaaagggccagacugcacugcaggccacacagguacccucugccuucacuacaaaauauauccccagcuaccucaaccaugcaccuguacaacucaaaggccugcugguaaucaaacuaccugucccccuggguccuauuaaucagagcgguucguuacccuaucauucacagucccgaucugguugguccugcacaacuugccauauuccuugcuguauuuggcacagagcugaucggcaaccuacaaagaaaaagaaaaacuacuaacagaaaccacucucauaaacagcuucacaauuucuccuuaucaacauuaaacauaucuuuauuacuagguuuaaaaauaagaaaccaauaucuacuauuucuguuuguuuaagggaguuccaaggcagccagaacuauacagagaaacccugucuugaaaaacaaaaacaaacagcaacaaaaacaagacacuauuccuaaggagccuuauaaucuauaugcgaaaucauauuaacaguacuaauaacccagcaaagguccaccuccagcagaagagggaggggagacugccuaugaagaaaccaaugcuuugucaauauuuagaagauugucagaagaaaacuaagcaaagagcuggguacaguaucauauauaucuguaaccccuaauuagauagaggcagaagcaggaggacgccuacaaguuugagaccagccagggcugcauaguaagaaacaaaacaaguuaguucaacaagauagaaaaucauuauaggaaaacauguuaagguuuccuggggcuaaaacguagccaguucacaaagccgaaacaaagucagugagucuugagcagagccuaaggcauuuaguaacaaccgaaacaaugaaacaaguuccaugggagccacaugccacaucauggagaucuagaacaugagaaccacagaaagcuacuccaggauuuuuaaagcaaggaguugcccuaacauagauuuguuaccuuaaaauguuuugauuuuauggcuuacaacuguguaagaacuguaaauugugaacugcccacaguaaggccugucacacuagcacuuauagaguucaagauuacuuuuaauagcuacauaacaaauucagaaccacucugcguucugagacgcuguguggcagaugaauguaacugguccucacaggcuuauaaggagcgcacuauuaggagguacaugggguauggccuugcugggggaaguaugucccugggggaaggaucugaggucucacaugcucaugcuaaacccaguauggcacacagucccuuccacugccuacagacaaagauguagaccucucagcugccucuccaucaucaugucugccugcacgcugccacguuucccaccaugacaauaaugaacuaaaccucugaaauuguaagucagccccaaauuaaauguuuucuguuaugaguugccauggucauguugucucuucacggcaauagaaacccuaagacucccuaucucaauaaaaaaaaaaaaaagaaaaaagaaagaaagaaagaaaaagaagaagaagaagaagaaaaaggagaggagaggggaggggaggggaggggaggggaggggaggggaggggaggggaggggaggggaaagaagagaaaagaagagaaaaaaaaauagcauugcuauggcagcucauaacugccuauaauuccaguucuaggaaccuggaacucuuguagccucugcagaaaccaggcauacauacaugcaggcaggcaaacacucauacacauaaagagcuuagaaacaacaacaaaaauguucuggagauggacgcaguucagcaguagacaccugcucaguaugugagggccuagguuuugacccccaaaaacaagaugacagaaagcaaaauggauacauguacacgugucaaauacauguuuuucucccugucccucccugaccuccugucccuucugagaaaggucaugggaugaaguccggcuggccuuuacucaugcuccugccucaaccugcaaagcacagggacuaugcacagacuacuacagucaaccaaagacuaacuuaagguacuguacuggcugacacacaaaaugucaacuugacacaagcuagagucaucagagagaauggagccucagcugagaaaauacugccauaagauccaacuguaaggcauuuucucaguuuccucaagggaggggagggcauugugaguggugccaucccugggcuggugguccuggguucuauaaaaaggugagcugagcaagccagggaaagcaauccaguaagcagcacccuccacgcccucugcaucaauuccugcuuccagguuccugcccugcuugaguuccugcccugacuuccuuuaaugaugaaccacaacauggcaguguaagcugaauaagcccuuuccuccccaaccugcuucuuagucaugacguuuuguggcagcaauagaaauccugacuaagacaggcaacaaccuuuagcacguaaauuuagcccucuagaaaaaguuguucaaauucucaaaauucuucuaggcuaugaagaugugaagaguaguaacugauuaacacagccagaagcuuguguacaagauacccagcucaauaaacagacuuuaauuaagauaccaaaaaccuccccaggcuaggcaugauggcauuuccuuucauuccagcacucucagaggcagagaagaggagaauucugggaguucuagguuuggauauaaguuccaggccagagagacuggccagugacacagugagacuuugucuauaacaaaaccuaccgacauuauagaaauugcuuauacucacuauuuucaacucagccacuucugacugaagccgaggcgcagcccagaucaguguagacacggauucagcuagaccagaaucuagcucccuagugaagaaaaaaauaugucauuuaacauccuuuaaaacaaaccaacaaaagccauaguugucacgucacauaccagaugacauccacaguuauuucacaauuacacuggcuucugguaacuggcauucuagcaauuucauuucccuauuuugcuuguggagaaacuaaaacuaagugacaugcccaagugcacaaaucucagacaagcugacccaagcgagacucaaaccugagacacuggacuucagggucugcuuucuuuucacuaacaggcaaaagauccuugggaaugugaaagaaccucucaguguuagccugcugcagauccacacaggcugagaaacuauuacuccauccucaaauuccagauauguuuagccucugaggugagauaucuuacuucauagacuggauaaggccaaagcgcgccagcagcaggucacaauacagcuccaggaucuccauggccuccacgagguaguccucccggauuaugugcuccacacggaugcgugcucgcucauccuuuccggcggccagguagucagcaaucuccuuccuugccuucugagccaguuccgcugggacacaaaucccacuccagucacacagcaguagugcacugggcccuggcagaccuccacccaccagagaacacgaccuucacccaccagagaagacgaccuucacccaccagagaagacggcugcuguaaucuacagcagccuaccucacagccccuuagcacaucuacuccccucauuacuguucuagaauuugccaucuuguacagagaagauuguacacuggggcuggagagauggcucagugguuaagagcaccaacugcucuuccuaagguccugaguucaaaucccagcaaccacauggugauucacaaccauccguaaugagaucugacgcccucuucuggugugucugaagacagcuacaguguacuuagauauaauaauaaauaacucuuuaaaaaaaaaaaaagacuguacacuggcuagcacugucaacucaggagccaccggcuccaggauaccuaugugcaccacaauaaggaggcgugagcgccuaagacauagaaaauggcaaaaaaaaugugcaggucaucuaugcucagccucuugcgugcuuuuaaccacauuuagauugcuuagacugaauuacagaaaugcuacauaaaugguucuuauaaugugguuuuuucucugaauacuucugacuagcauuuaccugaaugcauggaugugaaacccaugugugcagagcacaggagaacaguggggucaacaucaugucccuuucucugcaaccaagugucuccguguaacuauacacaagaggcagacauguauccuaaccacacagcucugagaaauuccacaucacuagccugagagacccagcuugggaugcuggccgcccauaaaagacagggggugggguugguacaguaaugguacucacuuuuuuuuuucuccaacaguuugagacgauuuauaacuaaucucaaauugacucguaagcgcucagcuuugaacccagagcccagcauguuguccugcuccuccuggaaaaaguagcaguacaauaaagaguccaaauuaguucaggaacuagcacgacuuagaagcaagcuagaaacauaggccagaguggucucuuuccuuuugucuuuuugguguugggaauugaguacagggcgguguacaugcugagcacaucucuacccacugagcuaccccuucagcccccuagccuuuuucuaaaccaaugcccugaucuaaacaucuuguuuacauauauuuuaucacuguucaaagaacugggugcacaagaacaaguagauaugaaaucuaaaaaaauguauguagguaguggccaugggaggagggugauuaaaaagacaaggaggccaagcaucaccggcagugcacuccuuuagucccagugcuuaggaagcagaggcaggcaguucucuugugaguuugaagccagcauggucuauacaauaguuccgggacagccauugcuacggagacagacugucucaaaaaacaaaacaacaaaaauaaggcaggaaguaguccauuaaaaaacaaaaacaaaaacaaaaaaacuugggcuguagagauggcucagugguuaagagcacugacugcucuuccaaagguccugaguucaaaucccagcaaccacaugguggcucacaaccaucuguaacaaaaucuaacucccucuuccggagugucugaagacagcuacaguguacucacauauaauaaauaaauaaaucuuuuuuuaaaaaucugacagauuaagcaagaaaaagacaaccgacagacaguacgagucuuugcuuguguaaaaagcauuguuggaagauaacaggauacuuucuuuuaugaaauggcccccagaaaccuuuauacuacacuggguaacuucuauccagaaucagaaaguaucucugauccauuaugcugaaauacgauccauccauucaacaagaauuuauugauuaugugucagagccuggcuagauacugggcauuaggaaaguacagccuccgauucucacagggaaauuauaucuacugaagagaaaaauaauuaaaauccagaaagcuaucacagugcuggaaaaagcaaaccuuuaauccuagagucucucaauugggagugacuggaaacugugcauugucacaacuggagaggagacugucggcaacuugugggcagaacccuaggauaccacuaaacauacaagaaugaacaagacaguggccuuacaauaucugccccaaaccucaaccagccugagaaacccauuguaaagaaaugacccaaauucuuaggacaaccacaauagaagguccuccagcuggcaaagccuaaggaagcugcauccuaaauaaagacaacgcagacacuugugaggaagaaucggcaccgugugugguaguacaaguggacacgugucaggcagaauacucuaaagccaauacuuauacaggauaugcgucgauacagccaaacaguaucaauauucuuaggcacuccuagcagagaugaauuggaaguaggaagaaagacaagcauuaacaacuauuauacuucacauucuaguaacaugcacccagucaaccagcaacaguggguagaacugagacuaaaccuuaaacacaagccaggcaugguaucuauaccucuaaacccugaagaaaaaggggguaagauuccuugagucuaauaguuccagccugggcaauauagggagacacacaaaauuaaaaccuaaauucaccugaaaccaaauccuagguaaacaauccauuucaugaauccuucacugcacuacaaacuaugauagagcucagaucacaugcacaaggaaacgggaaugugcccacagaagagggugaggguggacuguagaagccagaggucaccgacaccacaagaacauagcccacagaagaaaccaagcgggucucacaggagcucagagaauaggaaauggcaaacauggacccuguguggucugagcuagguccucugcauaugccuugugguuguauagccugguguucuugugggaccugccuaugcuugggacccucuucuccuacuggguugccauguccagccaugacaugaggguuuguggccagucucuguaucucauuuagaccauguuugguggacaucacuggaaggccuacuauuuuuuuuuucuuuuaaagggaaacagaggaauugaucuaggggagaaggaagugggggagggacugggaagaguggagggaggggaaagcgagguuaggauauaacgagagaauaaauguuauuuuaaaaagaaaaaaagaaaaugggggcacaguggggguacugcagagacuguguaguuggcaaaguacuugcucagaucuuacaaucugaguucaauccccagcaacuacauagaaaguugggcagguagagacaggcagauccucgggcucagaguagccagccagccuagcuuaccaugugagcuccagguugucacuuaagaaccugucucaaaaaacaagguugacaacuccugaggucaacacuggagguucaccucugggcucuacauguucaaacagccucuacaacaaguauguauugaaugccuucuauacauaacaagcccuagcaauagacuaguuagaaaaaaauggacugaagagggcuccauggcuaagagcaaguuccaggacagacaaggcuauauauaaaaugagacugucucaaaaaacugaagcaccggggcggagggggggggggugugauugaggggggacugggaggacaggguggaguaaaggacuauuaauuaaaaaaaaauugaugacaaccccucccacucaaaaaguaaaaauaaaaauagauaaauaaauaaaauaaauagccuagacaagaaaccaucuaagagcucccuuaaaaauugugauaaggggagugcuagagauggcucagugguuuagagcacuuccagagguccugaguucaauucccaacaaccacaugguggcucacgaccaucuguaauggaucugaugcccucuucuggugugucugaagacagcuacaguguacgcauauaaauaaaauaaauaaaucuuuaaaaaagaaagaaagaaaaaaacccugugauaaagauguugaaguguauguccacagcugagggcuuccagcagcagaggucgaggugggaacguacggauggggaagacuuuaaggggcuggcuacugggaauuugaccaugcuccaacgaguauaaggcaacacacauuggacuaacaugugggggggaggauuuucccuguccaauuaaauauuagugcagcaggaggccugugaguggagagggggaagggaaggaagcacgacaggaugcuucagaugcaguggcuuuaaacagccacagguagauauaauauauagggauaaaguaauugggguaacuugucuaauccaggugggcagcuuauaccauuaucaauuaauugguucugauuuauuguaugggcaucuuaugaauugagaauuugucaauacacaaaucugacugauuaauuauaagcuucuggaguuuuauuugcuggguugaggggaacugugacugccgaccacaggggauugauggcugagaaggaacuagaggcuccagagaugaccgucacugcugggguagacuagagccagaggcggcgagacccaugccagggcagagaguagcuggcucaagagugggaacuugacguaaucauuuuuaauauuucccuuuuuuguuuguuugugguuuugguuuuucaagacaggguuucucuguguagcccuggcuguccuggaacucacucuguagaccaggcuggccuugaaauccaccugccucugccucccaagugcugggauuaaaggugugcgccaccacaggugucacaagagugggggcagacaugggaggacugagaagugagugugauggggugcgugaugguuuguauaugcuuggcccacggaguggcacuguuagaaggugugccuucuuggauuaggugugucacuguuggcgugggcuuuaaacccucuaaaccuguaagccagccccaacugaaugucguccuuauaagauugccuuggucauggugucuguucacagcugugaaacucuuaacuaagacaggguacaugaugugaaauucccaaaugaucaauaaagacacuauaaaaaaaucucauaaaaaugaacaaaaguggggcuggagagagauggcucagcgguuaagagcacugacuguucuuccgaagguccugaguucaaaucccagcaacuacaugauggcucauagccauccauaaugagaucugaugcuccuuuggugugucugaagacagcuauaauguauuuacauauaauaauaaauaaaauaaugaauaaaaucuuuuaaaaaaugccuuggcuuuggguauuccaccucuucaaauggacuuuaaaaaaaugaacaaaagcauaauuggagacagcucagugcuuguuguacaaucaugagcauggaaguucucguuccagcaugcauguauguaugcauguacagacacccaguauaugccggugauccuagcgcugaacugagugcagccaggcucacugaagcuugcuggcuuccagccucaccaagaaaaucugaaucccagguucagagaccuugccucaaugugcaagacaaugugcuaggacgacaccaaacacccacuucaggacuccaugcaagaacacagaugcacacaccugcacauacaugugaauguacaccaaacccauaaacacacacaaauaaaaaugaacaaagugcaccaggcagugguggcgcacgccuuuaauccuagcacucuggaggcagaggcagucagaucucugaguuugaugcuagccuggucuacagaaugaauuccaagacagccagggcuacacagagaaaacagacguuggggacaacaaaguaugaaaaaggaacucauucauuugaagagcgucagggaagggcacacaggaggacuuagaggaaagaaagggggaauguaauuaaauuauagccucaaaaaauauuuuaauuaacaaagccucaaauauugucaaaacaacagaggagccuguguguaucaaauucuagaagggcuggaaauauagcucaaugcuaaaacauuugcaagaugcccuagauuugaccuuuauacuaugcaaaaacaaacaaacaaaaacuacuugaaaaaaauauuagcuagaaauuccccuaaacacauauaaacacauggacuugaaaaacuccaaacaacaaaccuagagauuuaugccucauccuuucauaaucaaauugcugaacccaaaaucagauagagaucuauuuuuuuuccgagauaggguuuccuuguguuuaccuagcuguuuugaaacucaauuuguagaucagaccagcuuugaacucaagagauccaccugccucugccucccuaaaugcugggauuaaagguaguaucaccauauccagccauagauagauuuuuuuuaaaaacugaaaaaaaaaaagauaaaaguaauauauucccuauuaccuacaguguaucuauucaaauaaccaaagauacuguggcaugaaccuacugccccagcuacuugggaugaguagggaggaucaccugagugaggccaguccagcaacacauccaaggucccaaaaggcagaaaagaggggcaaucuauaacuuuuaccugagaucguagagaccauaagaaaacaaagucauuucaaaauacugaaagaaaggaaaccuuacauccaucaaaacauuccucagaacuaaagggaaaaccagaaaugcucucgcaagggaaagugaagucugucuucagcagaacugcuguaaaagaaaugcuaaagaggggcuguccaguucagagcacugauuguucuuuucccagaggauccagguucaauucccagcacccacauggaacccacauggcagcucacaacugucuauaccuccaagaucugacacucacacacgcauacauguagacaaaacaucaaugcacauaaaauagaaauauauuaagaaauggaaaagaacugcuacagaaaaggccaaugagaaagcugaguguaaaaguguuugcuggcaagccuggcgaucuggguucgugccccagaacccacaaaaaggcagagagagaaucaacucuagagcuauccucugaccugaacacacagcaccacacacccuuucacauagaaagauacagaaaugacaaauaugucaauacauguaauggacuguuucucucaacucuguuacacuugacagcuuagaauaacacuuugugggauugauuuucaauguacauaaguguaauacuuaguauaagcauuaccuaagggggaagaagguaaaacaaucuauauaaugcaaacauuccuaaacucuaccauaaguggaaaaacaaucucuaaaaagauagccacaucuaucacuucaagggcaauaucauacauacacacuugcacacaccaauauuuuuaauuauuuacuuuuauuuuaugugcacugauguuuugccugcauguaugacugugugaggguaucagaucuuagaguuacagacugcuuuuaguugcuauguggguacugggaauuaaaucaggguccucuggaaaugcagucagugcucuuagcccgagccaccucuccagugccuaaagauuuuucuuuuuauucauguguaugugugugucuguuaagccacaagcaggugggaguccucagaaggccauaagagggcaucagggauccuuggagcuagaguuacagggaagauagcagaagugggugcugggaaccagagcugggguuuggaaaagcagucagcccacuucacccuuuagccaucucugcuuuaaaacacacuggaaaacuacaagugaccaaguaaccagagggagcacagcaguaagagcagugagaaaaugaccaaacagaagguaaacagauguccaaauacacagcgaguuauguaacuaaugugaguggaaaaaauaccauuaaaagacagaugauuagccagaccugguagcaaaggaauuuaauaccaguaguugggaagcagaggcuggggaggucugacuuugaagccaguccaguuuacauagcaaguucuauaucagccugggcuauauaaugagacucugucuuaaaaacagcagcagcagcagcagcagcaacaacaacaaccagcuggugaugucaagaauggugauccggggcaguaaagagauggcucuugauggucagucaagagcauucacgggcugcucuuccacaugacccuguauucccugcaccuacaugguggcucacaacugcaguuaacuccacucccccacaggggaugagguggaaaucugaugccuucuuuuuggccuaugagggcaccauacauacaugugauauggacgaacaugcaggaaaacaugcauauacauaaaagagaaggcuacuagugcauaggugguucccagcaugagagacacaggcaggaggaucaugaguguaacccagccuagacuacacaacaaaccugucccaauaguauccagaugaaaaaagaaccaacuaauuacuguuaacaggaagagcaugccaucuaaauaggugaguucaccaagaaaacacaacuguaacucugaaugccucucaugagaaaagaugcaaaacacaugaaacaaaaacugacaugcagcaaaaagaaauacgacaaucuaguuauaguuagaaaccucaauauaccccuuuggcaauucaucaaucuagcaggcagaacaccagaaaaauaacaacugugguacuggcuacuaaugaguuugugaagcaaacaguugagagugccaacuuaaggaagaaggaauuucaaacuuugaugugugugugugcacgugugcauaugcauuugcaagggccacaguacaagcguggaacaguuguggguacucuuucaugcaaguaccaaggaucaacuuauaccaggcuuggccacaagggccucuaaaugccuagccaccacaugagccuuccuccucgucauucaauccagcuccuagccuaccuggugcuuacuugcagaggaccuggguucaauucucaacacccccacgguggcucacaacggcccaauaacucuaguuccaggggaucugaaacccucuuugaacuccacaggcaccaagcacacucaugaugcagauaugccugggacccuagauaaagggucuaggcaaaacaccauacacauaaaauaaauauuuaaagaaaaaaaaaaggaaaccucguuaucaguaauuuaaggguuccacaugaaauaauuuucauagacuacacuucguuuugggaaguguuggcacuuuaaaccacaaaagguuacauauaauugggaccugaucccgauuagagccuaaauuaaguggaucagagucuacuuaaggacucuagaggcucgggucuuguuagaaaccagaggcacaagaagaaaaagagaaaggcuacgaaaguaaucaggggaagaaagcauuguuuuuaucaagugaaaauguuaagaagccgcgugacuuaaacacaaggaugcggugaaguucccccacgaaggucaaaaaaccuugaagggugugagauguuaacaaauguaccgacuaauauuuuacuaagcuggaaaaagacaugcauauggaaauggaaaagucugacugaaacaaugaaacacagguugauuguuugauggagggauuauacuguuuuguucucguaagaacaaaaaaacaaaaacaaaaacaaaaacaaacaaaaccagaacaaacaccaagaaggcacaacaaaagaaaugacagucuccucccgggagccauucaacaacaacagacuguacacaauaagcccccguagccucccccugacaucagucggccgcagcccugguccgguccgcauccuagcucaaguucaagguccugagggccacgccugaccccaggacccggaagaggagcgcucccucgggcucuccuggucugacucaccccgcagcaaccgcggcgguggggacaaggccucccucagggucccgacccgaccgcacugcagaggggugucuccucagugcccggcucaugccgggggcaacagcgacgccagcaccugucuaggcggucccaccuccucccacggccggagcccgaccucaggccugaccccgacugccagggcuucccccgcugacacggcgcggacggcuuguccucacgguccuacagacuaacgcugggguuccguaaaagcgggacguagauggaagagggagacaaagaugcuuaggucuaaggagggcacgcucaccuggagggauccggacgugaaaacggaagaagccgacuuccgaggagccgcucggcauccaaaauggcgacucccucgaccuccccaccgcggacucgagcggaggaaucca

SEQ ID NO: 4768 - RNA, 27537 nt, Mus musculus
gaguucaaauuccagcaaccacaugguggcucacaaccaucuauaaugagaucugaugcccucuucuggugugucugaggacagcuacaguguacucacauauaauaaauaaaucuguaaaaaaaaaauaaaaagaaaagugucagcaguauauaggaacccaccaccaacagaaagccgauccaaagggaacgaccagggggcaaggucuaagccccaucaagcagcagaacuuggcagcuuuggccccgugguucugacuuuaagguucuacgagaggggcuguagaaucccgccuuagccagggaaagcugcugagacucagugugucagcagcgucccuucuguauagugagaaacagcaacaaaaccuaaaccaagugcuuguuguacaagcgugaggaccugaguucaggccuccagaacccaugggaauaaaaucaaaaucauuaaaaauaaauccuagggguugagauggcucaacagggaaccugcauuggcagcuaaugaucugaguuugauuucugggaccaacaugguggaaggaaagaaccaacuccuccugcaaguuguccuuuagccuaccacauacauauauaugcuuaaguacauguucacauacaugcacaagcaugauacauuuaaaaaaauauauauagguauaauaguaugaguuagguguaauauugugaacuuacagcccccaugcuggaggagggggcaaagacagguggauccuggagacuggauggucagauagucuagcugacacagcaagguuuaguuucaguuaaauacccugucaaaaaaaagagagaacaauggagaaagacauugaccucuagcuucuacacuggauacacacauacacacacaucaaacagaauaauuaguuacuaucaguuugugauaauuagccauuuuccuauauucagguuagagaagcauacucaauugaauguucauaaaauagacagguggcuaauaugaaguacaguacagcagcagaaaauucagagauguaugugaucuuucuugaugggccuuacacaugguuagcagguacucuaccacacagcuacagccucauucuguaugacuuucuucuuaaagcaauaaguaagcaaaauauuggagaggaguuauuuuuguuuuuguuuuuguuuuuguuuuuucgagacaguuucucugugcagccuuggcucuucugaaacucacucuguagaccaggcuggccuggaacucagaaauccaccugccucugccucccaagugcuggcauuaaaagugugugccaccacuucccggcuuggagaggaguuauuauguaagaauuaagaugacuaaaauuucuugagaccauugugaccaaagaaguuaugauagcuuugacaucuuacauuagugauacucggugacaaacuuugauauaugaucacuguuuaaguccuggaaauguugaauaagauagaaccaggugggugcuuccagcuguuaaucugggauagguagauuuccaaggcugcuuaguauaaaggugagucauuuaggaagauuuagaaauuucugcugaaacagauguaaugugucugcagguaaaaaaacaaaggaguuagugggguggcaguacaauuguacuaaagucuaggaagcagcaaagccugaguggcuugugccuaugucugcauagcuucugucuguuaggccugugccuaugucugcauagcuucugacuguuaggccugugccuauguuugcauagcuucugucuguuagguucaugcccuaccaccauagacagccaaaaccaagacagaacuagagucagaaaacuugaggcccuggcuuuaauuuuaguuuuaaauuuguguuacauaguauaaaacagguguuuaucucuauguccaugcaucacaugcaugccugaugcccacagagccagacgaggacaucagguccucuacaacugcauuaugaacagugggugcucugauugaagaguagccauuuccccagccucugaacuacacacggcugugagccaccaugugggugcuggggaucaaaccuggcuccuccaaaagcaguagcaggcuucuuuagcacacacugguuuuucuaucuaaaucauccaaacagcccguuccuaucuccuuuagcagacucaaugcaaaauugagaacccagaauuacucauuguaaagaaguugccacugaggugaaaccuuguguuucagaccuucucucuuaccugcuuucccacuucccuuucggaguacaagucugucuguugacucuggagaauuugaaaaugcaguccuuugugugcucacauuucauguccugaaaucaaggaagccaccagguaaaaaguuucccucaagacacuuggcucucagguugcaggcacugaagcugcagagggaagcuguguaaacacacagguccuuuccuuucugagaaaauggggggugggggggagugggauggaacugcuguuccccacauagacagcacuacucagagugccagcugggaaggaaucacggugugccccccucaccauauauccucuccaccacccccacccccaccccacacugcugcuuuuucugaacagacaucugcucacuuggagaauauguucaacuggguaauuucaggaagcccaaacuugcauuuauuaaacuauauuaaggacccaaagggaaaaagagcaaaaucuugguccuuugaagacuuuuaacuuggucuuuccagcuuuuuucaaaugggcuuucacuguucuucacugguuguucuucacuggucugugaaucccuaggcaaaagugagauaaacacucugcauuucauaccaaauuuaaagagagagagaaggagaaagaaaagagugccugggguuuauuguggaaccuggcuauugauaggcagauaaaugcccacauuuaauaagaaggugacccuacauaucugagagcuagagaauuuuaacuuaaucuaacagucucaagauaaaguaauaguuuuacauuauaaaaauagguuauucacagggcuagagaaguggcucagugguuagagcacuggcugcccuuccagaagaccuggguucaguucccagcacccaccacauggaagcucacaacugucuguaacucgaauuccagggaauaugucacucucacauguaggcaaaguauaaaugcaccaacauguacauuucuuucuuuuuuuuuucuuuuuucuuuuuuuuucaagacuggguuucucuguagcccuggcuguccuggaacucacucuguagaccaggcuggccuugaacucagaaaucugccugccucugccucccgagugcugggauuaaaggcgugcgccaccacgcccggcuaacauguuaaugucuuacaaccuuacaacuuuuguuuuguguaugggguagagagggagggcauguuguagcauauacaugacagcugccaaguguggguccucuccuucaaccauguggguuccaggaacugaacucaggaauggaggaaagugccucuauccacugagccaucucaucagcucuagugagauauuucuuagcagcuuucccuaccuucucucuaaaggauaauucuugacagguagauuuggagauuagauaaaaauaacuaccggacaaaucauuuacuuuuguuaggaaguuugauaaaaucaccuuuaagauuuaaaaauaaauauauauuguucauguugcuauuuagaauaggaacagccuuaaaggauaauauuuguuuuaggcuuuuccauagucaagaauagaauaaaagaguagugggguaguguuucugcacugcuaaaaaaauaauguauuucaaguuccuuagcugagaauaccaaaaagaaucuuaguuagguaacagugaagggacucuauauucuguucuagaaaguucuaaauaguuaacuuaauagaauuuucaguucauguugauaaagaugaaacugaauuacuggcuccuuuagaaagauucaucugcuuuuagauaucuuuuaaaauucaauuuaauuuuauguguauggguguuuugccuuacauaccuggcacccauagaggcaggagagguggguauugaaucucuuguaaucagagcuuacagauaguuuugagccaccauguggguccugggaaucaaaccuggguccucuggcagaggugucagugcucuuaaccaccaagccaucucuaccuuccuuuagauaucuguccccuggugcagugugacagggaacauuuuuauuguucauuucuggcauguuauagauccagcucaguuccucacagaccugaaguguuacggaugagaaucaccgacugacuucuuuccguagugccuggucugucuguggcccuuagguccaggaccaugagccaguguagaagauuucacuauuggagcuggccguggcuuugcugguucaguugggauccgcugggaagguuaaacacugugcagaggagcaugaggaccacuguaccccuucccuuugccuuccugauaggauauugucuuaguaaccuagagcccacagguugccuuaggaauggggaacacaggcuggugcacaccuucagucccaccacucaggaggaagagguggguaucuaccugugaauagucaagccuagccugcccuacguaaugaauugcaggccagccagagcuacguagagauaacuggucuaaaaaaagaaaaagacaaacaauaaaaaugugaacaugguuuuaaagcaacuaauuuuucuuuuucuugaggucuauauaccuagaaaaacauucuaagccucuccaccuccauuauugccacaggauaaguuugucacaaugucaguuucucuaaucuaggcauagugacucaugacagugcuaucagaccgucgucuuuuuuuccucuugucauauuguggccuugaaaacauuuugauacuugaguuguugcaugauaugaagauacugcaauacugugaugagagccagucuaccacaaagacacacguauuuguugcaacagaccugaaagcccugucacauccaauucguaccucugcuucuagugcaugggaagucgggacuuuggaggauaggguuauagcugaggaccaaaagcuaagcacgagacuguaggcuuuaaccccuaacccaagagaaaggucagcaagagcccagggcuggagagauggcucgggaguugucugcucuuccagagguccugaguucaauucccagcaacuacaugguggcucacaaccaucuguaaugagaucuggugcucucuucuggccugcaggcauacauauaggcagaaugcuguauacauaauaaauaaaucuuuaaaaacaaaaaaacaaaaacuggagcccagaaaagacauuauaguuacauaggccccaauacuugguuucaccauagaccuuuguuuucauccauuuuuagaaagugauuuauguucaauuauguguuuauaggcuuacguucacgugagucagguccuuguggaggccagaaacauauucccuggagcaggagcuauaggcugggagccucugacaugggggcuggaaaccacacuuagcaagagcaauacuauacacacuacugcugagccaccccuccaucaccuuuggcuaucuuaaugacacacagauaguguggggauauggugggucauaggcaguaagaauacauaccguauaaucaagugagggaccagaugcuagcgagcuacagugcgugugcagcaucagagcugagugcaguccccagaaccacagaccuguccacuguccuccauagguacacugugguacagcuauaccuccccacacacagguaagaaaaaguuaaaauguaaaaagagaaagaauuaaggugaggacuauguaguacuuacaaagccuggacgagcacacagugacuguaacugguaauauaguagcaguauuuauggauuauuugcuuaaugagggagcaaauaaauuacauggaauugagccccaucaguuuuuacacugaccaaggaacagcuaaccuccuuaacuuuguacucugccucccaaaccuuagccugucuacuguccuuucccuuuucaguaagaaagggccuggucuauaaacauuucccugagguuuuugauuauauuccccuguugacuggggaauugggccuguaguuccauuuuuuuuuuuuuuuagauuauuuauuuuauguauaugaguacauuguagcuguguagauguuugcaagcauucaugugauuguugggaauugaauuuuaggaccuuugcuugcucugaucagcccugcucacugaaagauuuauuuauuauuauaaauaaguacacuauagcugucaucagacucaccagaagaagaugucagaucucauaacaggugguugugagccaccaugugguugcugggauuugaacucaggaccuacaggggagcagucagugcuuguaccacugagccaucuugccagcccccuguaguuccguucuuacaauuuuuuuuuccgagacagaguuucucuguauagcccuggcuguccuggaacucacucuguagaccaggcuggcuucgaacucagaaauucgccugcuucugccucccaaaugcucaaauuaaaggcaugugccaccaugccuggcuuguaguuccauucuuaaugagauaagaaaaaccuaucucucuuuuucccucuauaccuagcuccuggaaauuaaaaggcucuugcagguuaacucuucaauaagcauggaucacaggcagaguucaugaaaaguaaaugcaaaaucagggauggccacaaggccagacugacccaaggagacaaggccggauaaguaguaucuguuguagguuagucagugugcuucagggaguuagaauguuauccccccaaccccugcuccuccccuccugccucccaucuguuacuuagccagucauguuuaucaugguaaauuucaguagacauuagagcaaggcagggggaaugaccaggacauagaucacaguuguaggaaugaguguugaaggaagaugggguuggagauuuacucaggauuacagaagcguuugugaaaugaaugagauagagugcauuaguuagggcuuugcuaacaguaauuucagacagaugguugcccagugucuugccaugccuccacuccacugcuccuccucuuaccucuucccgguccuaauggaagguugcaauggaauugagauucuguaguuaaauuuguaaaguagugauuaaucaccuuuccaagagucaagaauaggaagauuuaagauaagcuaacugcccaggaagagcagcuacacccacaaacuauuggagcuagcagcauugcuuggagauaaauggguccacacaggguacuugccucucacaggguaccuuugaauggucugagcuuccaacuaguuugccuaggcguguacugcccaacugguggccugacuacuuuuucuugugaucaccaggggaucaagucuuugcuggguuagaagaacaagcccgacaggcaaugaugaaaaccgauuuuccuggagaccuuggcagucagcgacaagcuauccaacaacuacgagaucaggacuccaguagcagugaguucugcaccuucugguaaugacucagggcaaugggagaggaacuaauagcgugugcgcugugggguugugcgugggggugggaggaagaucuuagaaggcagacugaucucgggucugaaucuguucacucgagaggacagucggcaugguuucaugacucauggacucuaguaauugacacugcuauaccauauacagagaguuucauggugacugauauaggacauucuaaguuaguguucaggcagcuugugggccaggucaaagaaaaaaaagucccuuugccucaggucuauuuauuuauaguuaaugaaguaugagagacauuaaugaauuuuugcuugagguccuuguuuuacagauuugcuuagugaugagauuauguagcauauaaaaugcuuuaaguccaggcuuucccacaccaaaguccuuaccagauuucuguguuuaggagauuuaaaaaaaaaaaaaaaggacuuaucaguuaaggcucauggauugucuguuccaugaucugccugaauagacucauucugagcuguguuauuucccagaaaggucucugcaugcuccugacuuuauccacuugauacugauuuuaugaaaugucaguuuagagugaaaucucugguuugguuugguuuuuuuaaccaguugaaagcuuggggagaacaaagagaagagagacagagagcguguguguucugaaguguguagagaauucuacagugcugcccaaacugauaauuaaagaauagcaaacacaugugcacacgagaaacuaagcagguagaaaaaagaaaugagggcuggagagauggcucauuggcugcucuuccagagguccugaguucaauucccagcaaccacaugguggcucacaaccaucuguaaugggauccgaugcccucuucuggugucucugaagacagcuacaguguacuugucauauauauaaaaaauaaauaaauagucgggcaugguggcgcacaccuuuaaucccagcacucgggaggcagaggcaggcggauuucugaguucgaggccagccugguguucagagugaguuccaggacagucgggacuacacagagaaacccugccucgaaaaaaccaaaaaaauaaaaauaaauaaauaaauaaaaccuuuaaaaaagaaagaaaggaagaaagaaaaaaaagaaaugaacccuaggauuucucagaauccuguggaacacagcaguuucuaauaggcuauuguucuaaaacaauaaaaaguugugccauccuucuagacagcauacuuuuuaaaaaaauguuccugcuagagucacucagauaauugacaaguuacaaaagugcauuguaugcagccaugccuuagacuaaaccuacaaguguuccacacuggaugcuagugagaaaaugaucuagucuggaccagcccuucauggcugagauggauuugagugacagaaagcuuuaaggaaacauucuaugcucuugagcaccaaagugaggucugucccgugaccgacacaucuauguagacgcacauaacccuauguuauccaaaggaaaaugauuuuuuauugcagauuuagaacuuaaugcaaaacagaaggggaacaagaagccuagucagcaggaaaaugagcccgcugugcaugcagggucugacgagacuccuuacgcuggcuguacaugcaggcucugaugagacuccuuacgcuggcuguacaugcagggucugaugagacuccuuacgcuggcuguacaugcaggcucugaugagacuccuuacgcuggcuguacaugcagggucugaugagacucuuuacgcuggcuguacaugcagggucugaugagacuccuuacgcuggcuguacaugcagggucugaugagacuccuuacgcuggcccuagcccuaggaguccagaaucccagcaggagggaaaagaagggcagucaccuaugacuccucucagcgggacuuccucugugaucuuuaaaacauccacgcugaacaucauuuguuauugugggucuuugcuccccucaaucauuuucucccucuauuuuuauuuauuuuuuauuuauaacuguuagacaaaucagcucacacaaaccgugcagauucaucagccacagguagaugaccugacagccacaugcuucccugcuaaacuaaaacagugacuucugucuaaagugaggaacaccacuucccccacuucuuucacauuuaguuuuccauuaaguaagguagagaaccaccugaaacagguuuuauuagcuuaaaauguacauuacaggguauuaguaacaguggacagccgagcauagugggauacaccuuugaucccagcacuuaaaggcagacacaggaaauucucuugagugugaggccagccuggucuacauagaguuccaggacaaccagggcuacacacagaaacugucucaaaagagggggaaggcugaugggggaagagaaaaagaggagaagauaaaauuggauaccuucuaucccuauaaauauaaacuguccaggguugguugcuaugcuaauucuauuuuccuacuguaauguauagcccuuucccuauaaauggauaaaauuuaaaacuaauugauucuuauauccuuacugauaugaggaaauaaaauucugcuacuauauauggaaguauguauuaauguuuguugugagagaagagauugguggccucaggguagagcugucugaggcagcaugggaagauugugcagguggcugaggagacaaguaaguaauaaggccaggaagagggucgcuaaguccacgaugacgugauggggcugaguuugggauggugcgcuucaggagguuccaucucaaggguuaagauacugagaaccaugaauaacacaagcauggugacauaugccuagagucccagcauuugggagaaagaggcaggagggucagaaguucaaggucagccuugaauacauagugagacucaagccagccugggcuacaugagaccuguuucaaaacaacaauuacuauuuugguaauguacaaagcuaguuaggauuuuuaaugcagauuugccucauauuuucccuguaguguguguguauauauauauaucaaucaaucauaaugaaugguaguuauagcugauuugugcccaccaagcacugaugcaaacuguauuaccugaagucugaaaauguuuuuuucauuguagcugcaaacuguuaaauggacagcugcucaggauguauucuuacaaaaaucagaacaagugaccaguuuauguguuccaggugacagugaaggugacgaagaggagaccacacaagaugaaguaucuucccacacaucagaggaagauggugggguagucaaaguggaaaaggaauuagagacugcggaagcaccugucaguaguggggacgcacuagcagagcgcgaggcaagugcacgcaggcccggccggccggcagcuuucccuccgccccagccugcaccccccgaagcucucccuuccuccccagcagagugagaacuacucucaggagcuucucucucaggaggaugucuucagguuauaucagucaggcugucuuguggaaccagcuuccaaauacauuguauccuaaggauucaugccaggaacaugugaaagggaaucuaguccuuucccugcagaguccuguguccucggggcagaaagccuugaaaauugaagaaauuuaauuucuuuuauucaaacgauauuuuauccuucagucugcagugggaaccuaagacuacugaaggagguggggcagggaagagacuagugaagagucuucaugacuugccuguuugguggauuugcaggucacagaaaaccuaaauucugaccccuuacuucaacucugccaguguccccucugccagcuagacugugggagucgggagcagcugauugcacauguguaccagguauggaauggggagggagcucuggggcugagugccagcaguauagaggucagaugcugcaguggccguugccucugcaaaggaagcucagguuauugguucuacuaggacuccuuccuccccucauagcaucuuaggaaauaaugguugcauucucauacagauagauacacuguagaauuaaguaucauggucuuguuuuacuaaauuguuuaauacagucaguagugaaauaaacuaaacugacuuaacaaugacggcuuuuaaagugggguagggccaacauaaauuauaugaugugagucaguaagauggcucuggugguaaagcaccugcucccaagucugaccugaguccacccuuguuauccucugaccucuacacacacacuguggcaugcuacaagcacacagauaaaacacagagcgacauauuuugggggugccagugaaaguacaaacaaggaaacagcguaagacauguccccuuaauagguacacuacuaagaguaugccuacuccuagugcucuguucugagacaacaguacacagcccagguuggaccaaacuuuagagaucauaccuguaaagauaguugguucauuagaaauacuucuucagaagcccgaggaaagacaguccaugaauacuuguuacacaccacuacuccugcccggccccuucaguguacuccuaaaaugcacuuguaucgguacacuauagccagggaagacaaaacuaucaggagcaugaauuccuuuaaagucucugaggcgggcucuggaacuccauuauucuucaaccauucacgugucccagaauauggccagaacucacaguaauaaaaucugagcaauggucugaauggcugggcuccucuggaaauccacuaacacaguaggcugugcuuuuuccaggagcuaaaaaaauaaucauuccaagucccucagucuaagggaaggaaaaagagggguggaaacuguccugaaagcaacaagaaauggacagcuuaaggcuuuguuuuacagcauacugcagcaguggugagugccaagaguuacauguguccugucuguggccgggcccuuagcuccccagggucuuugggucgccaccuccuaauccauucagaagaucagcgguccaacugcgcugugugcggagcccguuuuaccagccacgccacuuuuaacagguuaguacagcaccuauccuugugcucagagccagucaugggguguaagaugcugcuuucccagaccaaaggaaacaagcgacaaauaacucaaaugaacugacagaacaaaucuagaaauaaaagcaaugagacuuggagaugcgauagacaguaugcacuaguuaccccucaagggaaauggauugcuuucuuucccuaucagaauauuuccaacuagaaagugaugcagaaacaugcaagagcauucaugauaaagcagacagacguugcaguaugcuaagaggauccugguguaaggacacacugcuguguucuaggaagacuagaacacuguuuccucccauugccuuguuuguacaguguacaagcuacuuuucuuuguuuguuuguuuguuuguuuguuuuucaagacaggguuucucuguguccuggaacucacucuguagaccaggcuggcuucaaacucagagaucugccugccucugccucccgagugcugggauuaaaggggugcgccaccacugucuggcgacaagcuauuuuuccuucugggcagugucagguaggaggugguaaggcagugaauuaauuguaccugugugaaggaaguguccaccuccaggccccuucauucauacaccaggcuuagaccugcacagcuccuuaagaaacugccauucugacuuagccuugcaggguuauucuagguagguuucuaugguggguagcucaguugcuaauucaaggugggcccuaaaacauaguagguacccuaguccaaagaagagaaggggucuuccaacccuucaaaucaaacaguagacuugggacagucugccuagcuguuaaggaguaagaccuucuugccucagggagauacuaaccaucaaacaucuuuacuucucagugagaaacucccucaaguacuuaauauggaauccguaccccaaguccacagugaaggucccuccagugcugaaggaaaggacauugccuguaguccuccaguauacccugcuggaauucugcuuguuugcaacaacugugcugcuuaccgcaagcuacuggaaacacagacucccagcguacgcaagugggcccuucggcgacagaaugagccucuggaaguaaggcugcaacgacuugaacgagaacgcacagccaagaagagccgucgagacaaugagaccccagaggagagggagguaagacgcaugagggaucgugaagccaagcgccugcagcgcaugcaagagacagaugagcagcgagcucgcaggcugcagcgagaccgggaggccaugaggcugaagcgggccaaugaaaccccagagaagcggcaggcccgacucauucgagagcgagaggcuaagaggcucaagaggagacuggagaaaauggacaugauguugcgcgcucaguuuggucaggacccuucugccauggcagccuuagcagccgaaaugaacuucuuccaguugcccgugagugggguagaguuggacagccagcuucuagggaaaauggccuucgaagagcagaacaacagcucucugcacugaaccacacccucuugccugaccucccauccacuccagcccucggggauuggugcugcagucacucaggaggccacaguccuugcugccacaggcagguccggguugguugcagggaaaccugugcacccucugcauuugggaaaaggauggggucaggaggggaccuggcucaaugcaguucuggacaagggagcaggcacuccagaaaccuggacucuucagcccacgguggcaggccaggacuaugggacugugggacccaguaugguccaugaagcugugagggcaaauaaauuaauuuuaucuuuacuggccccuggcucccuugucucauuucuguuucauccagugacguguggcaguagagagcuuuucagggguuuguugguauuucugguggcuuuuucuuuuuggaggcagagugcucuucaaguuaggcuguccacgcagaggacuuagugauaggugagaucaagucaucuguggugaggacuagagcagaacagcuccucacucuugcaauuuggcugucaugacacgcaaaugagcuacuccucucucuuucugggcuggugcaagaugagcagaagcugccuuugccugcaaagcuuaugcacaguuugcauauuucuagaucuugagggccagaaggaugugcccuaguuaauuuguugcaagaaaaauaacuuugccaggaauguggaccucuuccaaugaaacagggacauuuggauuccucucccaccucuguaggucuaaggcuguuuaaaaaugaaucccaacaaacuacggggaaguccucccugaccagcugaaaaagaaucacauugaagcacgguggcacccaccugaccucagcacucaggagggcaagaggcaggcagaucuuuguggucgacaaaguggauucuagcuagggcugguuguuacacagagaaauccuaucuugcaaacaaacaaaaaaagaguugcauugaaaacgagagaaaagagacaauugauuccaaugccuuuugacaguguuccccacugaaguccuccuuggacuauuucagacaacaggaugcacugugucccaacaaaucccuugcccacuuuacauacauggguuagcucuuucuuuccacaacauucugaauuaguacaaauucaggaauuaguuacauggguucaaaaccccaggugagugguugcuugccuaacaugcugcaggcccuagcuuugaucccuaccauggcaaaaccaaccagccaaaaccacagaaucagcuaggugugguggugugcaccuuuuaucccagcacuugggaggcagagacagccuggucuagaccgugagcuccaggacagcuagagucauguaaagauucccugucuccaaaacaaaaucccacugucuuauuacuguguaacucgagccaguuauuuaauugcugucaaaaaaaaaaugcuuguaauccuagugauagacaguugauaaaucacagggugguuguggugcccaguaaauaaaugugcuugagugucucaccacccacgucagaagcagcggcuacggcugggauuacuucaauguguggcagugugccagagaaaagggccacauggauaaaccagcaguuaggacaucuauggaccuagagauugauccugccacacuuagucuaucgguagauuucccagacucugaaacccacaacagggggagcagaccaugguucagguagguccuaccauuugccaaguuuaccgaugaccugcaccaucuuuacuccaagugaugccacccaauggccacccaucaaacugagauaggaaaaaggcgcaaacaccaaaaggaaaagcuaguaguuuauauagaucgauauauagauauauagauauugauauauauuguguuuacauaguccacaaguuaaaugcagguauccauaagaagagagcauuaacaauaaaaauacaaucuguguagccaaguacagagacuuaaaaugguaaaacagcaaaaaggaucucacaaaaguacaaauauacaguacaaauugauuuauuuaaaacaguuacaaaaaagcacaacaaaauagagauuauccuuagaauuauuaaugcuuuguuaaagaucagguaggauuagaggguaagaaaugguauugggugggaggagcaccugacuaguucuaaggcuuuagauacaaugcaguugauuacauauuaauucagccauuacauacuggggauagugguugggggaccaguaauuuaucuacagggaacuccuacacaaaccagauccauccagaccuccccagugccauucucuacuccuuaggacccuaaagccaccuggaugacaaaauccccauccuuccuccaccccauuaccuauccauuuaucuucccuccccuaaggugcuaggcaagcugagagcagucugcucucugcagcuggaacauauacuguuuuggcuacagggauccugcgugacuaggaaguguguagaguacagccucauuuuaauacuucaaguuagccgugaguacagucagucuccuccccaauccaauugaacgagugcacuaggaagcaagugagggguccacccugccuucagcaauaccagcagcucaccaacccucaccauuuacaaguacaagcaaagucccuggcagggcugggggggggggugggcauaaaaccaguuaucaguucucucucugaaguuccuaagacccccuaacauaaagacagacgaaacgcuugcaaaucugacauuagguaaaggcacaugggcuaccgccacacacacugcaggcaggaacccagucuggggccaucuuuacugccaggcauuuacaguggaauggcuuugggaucacacagacuguugaguuugcaaucuacuagggaaagaucuaggcuuaacaggagaacaaagaaacuuuuagugugaaaagugcauuuauuacuauuauuccugccgagaaggcucagcagggcaagccacaccaccucucccucugcuccaggaacugugcauagucugcagguaaggagagaaugcagccaacucuagcaucgagggccaaugccauccuaggcccagaccagacuuuugguccaaagauggauccuagaguuuaaagaacaacugacagcugcaaagacccagaugcugauuuuauuauugcauaaugugggagaccuuuccuacccuggggaagcuagacggugaaggcuuccaagcaagggcucacaacauccauccauaguagaauucagcucuucaacuguaguguauaauuuuucugaucuagaaaguauaauagcuucaguguaguuuaguaaacuuaguccuaggaaguuaucacaucucuaaaacauggucuuuguccugcucacuuccaagacuauggccuaagcucccauggccaauuggaucaaucugguuaucuuuaccccaauggcuugagucuuucccaucuucagcuaacaccagugcgaccacccaacucuucaauguuccugcucagugcaggguuaaauuaugcuaccauucuguucucuuaaaaugccuaugauacccacugguaaaaauaaaaugaaacccaacuugaggagcuauugcagccaaacuucacuuucucaaccccagaaccaagcuagacaaaagcacugggaugcugacucaagcccuaacucaguuucucuuguucugagaaguaccauaaaggagagagaaaagaccuguuuguuguucucucaaaggcaggcaaauuuuuggagccuaaggguuccugagggcacugaagccacauccuuuccgauuuaacagcccaucaacagcauccccaccucccuguucaauaugacugagcuacacagucauacuggcagaacacagguuaaaaauggacaggaugccugagagucuacauggccagacacaugaaggacaggggcuauaaugagcaacaggcaggacaaugagcagacaacagcaguggcacagcagcacagagcaaacaaagcccauaguguuaagaccaaauggaacccuaaguuuacagggucagucuagcucuucuugggcuccaacuggguauaagcucucagugugaggacccaaaccccucccccuuauccaucaucauaaggaugagcaccauccuucaccaaguuccccuucuauacuggcauagguauuucugauagcuucagagagcaguucuuucuccaaguuuugggaguauucuaccauuaacuaggaccaggcuggucuuugucaacugcccagacuucaaaagcugauagcuaaccacugaaaugcucacucuaaaagccagucacgucuccuacauccucagaguuaaguacugccacagcucugacaagcauuagcacacaauucuuuucuagggugcauacuucaggaaagguagcucucagccaaaucaagucacaucugcauggugccacauuaagggaggcgccguguuuacaaacagggauaaagaaaggaagcagagcacagaggucagcgcuggcccgaucugucaaggcccucaacaacuguuuuccaaggauuccgcuacaagcagcccaagcagugauuugacuucaacugugagccaaucacgucugccccaugaggaagacguagcucagugguacccuggguagacauguuuguagcaucuacagugcaugucaggaaauuccgugaugaaccuucugaggaagggagggagccuugugagaaacccacacaugcaaauaacaccuaggaaugaguuguucaugaaacagucaggagaugaggccaucuccuauggcucucaucugagagaauuccucaagacucaaucccacaggcccccgcuguaggaaacaagccagagaagcagcagagaaaugggggcaacacagggaaaggaugugaucuccaaugcagcacaaggucggugguugauucugacagaaagcagagacuucaguacuugcggucaggcuaaacagcuuccuuugaacgccccccccuaaaagcucgcugaccagguaucugcucucaagguaucaaacagaauguaggauuuauagcaaacuagccaguuucuugucacucuguucccaaagagaacaaccuuuagcaccugaacacuaagaaugacuucguucucagaacucccccccccccaggagguagguaagauuauuuauccccauuuggcagcuggggaggaagugaaagagauaucacaagacucaccuuaagcuuugcucauacuucagaaguguaggacuccuggugacaggccaggucuaucuaugaaggaaaugccacacucauucccugggagaagucuaacuacauagcuggguggacaauacccugaguugccuucaagagucuaaagaaccccuccccaccccaucccaaaaaaccuucacaaaaaaauuacucaaccacuuuaaaguuggugggggugggggagccuaaauccuaauacccaauggggcccuacaguccacgcugacacuacuaugggcuguagggaaaugugggaauaagacagauggcagcaaauacaaccaagauagaaaauacuuucuagaagaauccaccagcauacaaggacacaucugcuaagauguuacaaagacuauuccuagacuuucagagcugauacugggagggcgcaacuuaggccggaaugcugagaggcaauggauugcagugggaggaagccgaguagguccacugcagugggaaugcccagccuagggcucaguuucuuucugguuucuccacuauauugcugccgguggaagaggacaugauuuugaguuucuaaauauaaaaauuauagcugauagggaaaccagggacccuuuuacaccaaaaacuagaggucuuaguggacaaaggcagugcagcuacacaugaggcccaggucaagacaccaugcagaggucaggcagcagaaggguaggggcagugcaggcacuaaggcacaacauagacagacaauggaggaguguaggugccuaggggaaagguccuccaggucuuucugaaguuacuacuacagacugaaugaauaucaaagcgggccugacaggcugggugggaguuuagguuagaggccuuucaaaagcuuugccuaagucccaacaucuaucagucaaaucuuuucuccacagucccgacuggguuccuggcaaggcaguccuucauuuucaaacccgaaggggcuucucucucucucucucucuccuggcccuaaaaugcuaaaaagccuuauagcggaauggugaggugagaugggaacgggcagaagcaaaggaccaagcacagucccguagaucauggugcuccccaacccccaaccccaccauaaacaucuguaacaaaaucacccuuuaaagugcacaucucucacaagaagaguucugggcgggaacccucuuauuuucaaccauugggccuccugcccucccaccacaaaggacgggagggagacaggaaaaaagaaagaaaacaguuuuacugcuacuauaagcugugaucaucauauuuggcucuuucuuugcuuccucccucugccaccugcucccaaagccugcacuuucccuuguaggagccagggaugaguaggaaaaaacagggaggcccugauuuuggaaugugucuuauccuaugugcacuccuacccuuucuugcuccaagccugcaaguccccaucucagcacccucuaaagguguccugagagggugccauggggucacgagcaacacacccugcuuugggaggcugucuuaaugucuguuucccccaaaucucacugccaagagagccacccucugcuuggcaugugcaaauccucucgaugcucacagaggcucaccucuggggagaaagccccaguccuggguugggaaagagguucauuuuccugcauuggaacgcccuucgauggacagcuuuaccuccuguggaaugaaagagggacggagcaucgcagcccgugccuccuccccuugcaugcugaaucuuuggaagcuuggggcuggccagcaggccugagcaccaggcucaggcugggaggguucucccacccgggaacccucuccugaaggcugguucuuccccucgcugucacauaggucucugggccccaagacuguccucucaggccuuucucgggguguacccagcugcccugggggagcacagcuggccugagauacugaguuacuguucaagcucuguaaacugauagagaugcagacaucucccaccuguagccgauggcagggcagagagaagaguugugcaguccgcccagggcugcaggaggaccaacccuggccauauacaaaaaaagggugcucagggggcaccucaaugcucacuuugcucugcuguucaccaaccacgaaaugcagcauaacaaauccaggccacuggcucuccugaauguccacgacugugcuagagucaauuuucagccccccacucacuuccgcacuucgcacaaaauccugggucuggagguccucuacccgcuucagcuccccuguagccagcugaaugauggcgccuuucaugaaaugggagggcaggugggaagagguaacgggagguggcguuggcuccuugucugggaagguggcucuggccugcagguccagacuugaugccaccaggaucucugagcccacaggcagcaggcuagggucaguuccagugggcaccagguugccauuggcuacaaccauugcuuuggguaaaggucuguguuuuacugguuccugaugggacugcggguagaacacacgggccugacuuuucuccaccaguucuguaggauuccuggcagacccucgucccucacccugauggucaagguuaugaugggauagguuaagagggcugggcucaucuuuccucugagcugccaccacacgauaguccugagaagcuaaagcgccaacuacccgcuggaccucuaggucggugucuggggucccucgaugugcuggcgccgccaccuccacucucggagucugagaaccugaaaacaacuguccauccgccaugcauuccaccaccggcaccaguccuuggcuuucacccuugcugcuggcggagucaagggcuucacuuucgcgucuuacauuucgcucucguugucucuguccauuggcagcagcugcuuccagagcagacuggcccuccugaggaguaagaauggggcuggcaccugcuguugaaguuucaugcaagguauauccagcagguagccuagacauuugauaauaaaugggcauccggccuggagcaagauccagugguugaguauucgagugauguggcaacuggccgggcggggagguggcagaugaggacuuguuaaaugacugagcuggggaugcggccuguggagggggaguagcuucuucugcgaggagagaggcauauggcacaaaguguggaaggugagugguggcaagguuggcagaaggagagaggagaggacuggguaggaaauuagguggcacagcauaaggaaggcuguauggagacccaauaaacugcagugagguggaugggagcugagcauaguggacugggggauaguggauucccggauguugaaucagugaagacgcuacauuaaaugugggggguaaggggcucauguucacaacagauggcaggccaguuggugagaagguggcagguggcacagccaccuuguacagcaugccauacugaucuacugucaggccagugauggccucaguuccaucacccccgaggcugacucuggcucccgucuggcucugcccagccaccacaaccccucgggaccauucagaagcgucacuggagggugugugguuuguggagcagcugguaguucuccccauauccucgcuggucacagggaggucucguuucuuugguggaaggcauuccugacuccgcucaugaacagguuucauauugcuuuguguucccggagccuggauggaguuuacgcgcuccuucgggcaucagaagugacuucucugugguuccccugcaccccgcucugcugcugguuguggugcccacaucugcuagggaauaaaccagaggcagagaagaguaaccuagggaaucaagucaaacaaaguaugaagacuuacacccaggagcaaagaccuaaggagagcagcacacaacugaggggcgagaggagagaggacgaggcugccuguucacccagcagcccaccacaggaagacaagaggcaggaaaaccaggaagagcuacaaggaugcacagccaagaaaccuaagugagcccagggcugaagcaucucuuccuggccaccugcuggguuagucaugcuuuuccugaggcccuuaccucuucucagucuccucccugaagcauagcugggagcaugagucuuugcugcagacccuuuccuaaaugucuccuucugcuaucaaagucuagcaugccaucuucuuucccugaaugcaugaucucauucgugcuuccuuuccccagcuuaauuuggguuaugaccucaccugcuccauccaaccgaagacuggcugaauucauguuacuaagugcugagguuuguaaaccuuguucccuaagcauauuauaaauuggaguguuuuuguuguuguuccaggaaacuugacauuccagcuuugaccccgugagaagagugacugugguaguuugcucuagagcuugcuucuccuccacccucucugaccucuagucuaaaagacuucuuucuucuuacugaucaccuuccauuugccuucuuuguucuuguuucuucugccagugccucccucccuguccaguguggcucugcucugaguauuaagucacacaauucuauucccugucuccauacuuggacguuuacuucucucccuuccuuagugucacuuucuauaccucuccuuuuuuccuuuucuuuuuuuguuuuuuguuuguuuuuuuucagacaggguuuuucuguguagcccuggccguccuggaacugucacucuagaaaccaggcuggcuucaaauguagacauccuccugccucugccucccaagugcugggaucaauggcaugugcuaacacacccagcuuuuauaaucacuuuuuuuguuuguuuguuuguuuguuuguuuguuuguuucgagacaggguuucucuguguagcccuggcuggccucaaacucagaaaucugccugccuuugccucccaagugcugggaucaaaggcgugugccaccacugcccagcucuguaaucacuuuuauccacugucaaaaagcaucuuuuuagaaccccaaugauagugcaugcacauaguccuggcacuugagagaagaguuuagaaauuugaggucacccuuaguuagacaaugaauuagauagaggccagccugggcuacaugagaaccugggguguugguuuuuuuuuuuuuuuuuuuuuuggugguggugguuaaaaaaaaucagaaagcaucuuuuuuguaugaacacuucaaugcauaugaacuuuggcaauaauuuuuccaaucaggcugaauucuguuuuuccacugucacgugccacgguuuuuuguuuuguuuuuuccugaaacaaggccuccacagugccucuauuaccugcgcgucugguggggcugagcagcugcaguacguguccuccccucugguuugggagccuagaagacacaaggcugaugucagcuggaggcagagcucucaccuuccccgggccauccugaaaggcaauuccaaagccaccaaaaaccacugaccucccuaaguucuugcuucauucucaacccagugguaacagcacguauacccgagugcccaggaaacugaaggaaaaaaaaaaaaaacaauccagggcuaaugagauggcucaguagguaaaugcacuugcugcccagaccuguucccuuccugggaccuaagcugcagggacuccuaaaagcuggccucuggccgucacacacaagaccaaaacaacaacaaaaaacaaaaaaaacaagaaugaaaaaaaucuuuaugcuuucauuuuuguaagacaucccuggaaagaaauuucuauguguugauuucagugguuucuuuaccauccuucauucuucauucucuaccccacuccccaaugagcaagcucauuuccaguccaaauuuugcuuaaaugcacaaauaaagaugagagacuucauacugccugcaugugagcaaugagaagcugggaguuucugcuuuauuaguggcccaugaacacacagauguagagauuauucaaauaagaaagcugucacuagaggaaaaggaacaauuauuuauguuucuggggcagagaaagaggucaagggggaguuacucaaagugaaagcuauauuaacagauuuucugaguaaaaguaaaagggcuccuguguguguguaugugcgcgcgcacacacacaauuuuauacgugacuuuacacuaaguacugaaugaaaugugaaagaaaaugaaaacgccauuuugauucuaugaagcuaacaaaggggaacaaaacuauuacuaagcuaccaauaucugaauccacacuugccagaaacaucaauaauuaaagaacauggccuuucaaggcuccggaugcagcucaguugguaaagugccugccuagcaugcauccagcccgagguuacaucucuagcaccucacagauuggaaaugggaguggacacuuuguaaucuuacuaccuuugagguagaaagaagaggaucgugaguucaagguacucaccaacuacauucgauuauuuagcaagucagaagucagccugagcuccauaagacccucucaaaagaaaacaaccaaaaccaaaaccggggccaacgaaguccuaacaacuggauuagcaguauugacuaguaccgaggaaccuguucugucaaagucagaauauugcaagcucgauccaacugaaggcaacguuuacuuaagauaggcaugguucaaggguacacgaaagauggaaauguggaaaaacagauuccuaaugccacaaauaaaucaccaaguggguacaagucacgcacucauucuucaucaaacguuuaauugaaagcacucagcuuucuuucauuuucuuaaucccccaaaaugaugcuugcccucuguagcuaaaaaaaaaaaaaaagcuaaggaaaauccgucuaugggucaccgaggaguuagcaaacacaaaauaaugaaaggacggaaagaggcaaaaagaaagcucagccugcccaccagguucccacaaggcaaaacacuucaaaaucugaaaccggguguggguguagggugcagcuuuggagaauuucucaugggaaaugacacaacuuguggcccugagcuaaggggcaacggaacuauuccagagaccugccaaccuagccgagaaggcagcuccucuucaugcagggaauggaaucaagagacugcacaccgagggggacccaaauucacugagggagaggugcgccccacaaaaagggagcagcaaaaagggagagacaccagggaugauggcuuuugaugauccuuguuccgacagggguacaggccugaacugggggagucuacguuuaggguuagucgggguagggggucggacguggaggugaggccaggccccgcuggcgacgcuuccuuguuuggggccccuucccgcccugagaacucggacauccugacccgcggggacaaccccgucggggcaucagggccugaggccgccuucugggccaggcgggaaagcagcaucuagaggggcuaggcacggccucuuucgcucgcucugcccgcuguuuagggggcccgcggccggggugaggcaacgggcuucuaggggggcccuuccacuagagcuccgaacccaggccugcuuggccucaggccaucccagcggccaccgcuccaggcgacacucaccggcccaucucacggagcucccaggacuccucccgcucgucccggagccgccgccaccgcggccgccgccauccccggccccggagccgccccacacccagcgggcacccccccaagccgg

SEQ ID NO: 4769 - RNA, 1163 nt, Mus musculus
aucaguagaucaucaccccgacuguaugggacgccaaaggccuggccagguaugaacuccggacaaucagucaacugagagaagucuguuuguggcacauuuccuggaagagagccaagaauuggccauuuuucugguucuaucuuuuuccucauuuucucauccacaauuucuacuucugugcuauccuuaagugccuccaagaugagauuagggucuguggugagagccugcacgcggugaaaaccagcaaucagggagugggacucccugcucauccaucuuucuucgaagaagucccauuccaaguucucuaugcugaaguaauacacucaauuuggcgcuuaauguacucauuaagcaguguuucuuccacaggacacaccugcacaccugugaggucaucauagugaugcaucaugcugguguuaagcucuguagaauauggcugcucaguccuuuccccuggcucucgaaaaccauaugaauaaucagaguucaaucuaggguuucuucggccucggccccggccuucccaucccccgccccccccccccaccucucauggaaccucgaauggcaccacccucacuucucacacuggauucuccaucuugaucaucucuuuuuuucucuauccugucuccaacuucguguaucauuuuuuuuuuauuauugugcgcugguuuauuugcuucaaguugacaucuagagcuguuccgggacccaggucucuccuggcuggcuggucucacaucaucuaaguggagugguacccauuugggcucauuagcucucuucggcuggcugcuugacugagccucauccucgcugacguucucaguaggaccauuuaguuuugcuuccgguuucucuuugcucucacuguugcuuccuuuuucaauuuucucuucuuuuucuuuucuaauuuguggcuuuuuauuucuuugguugauaacacacucugagaccccguguuaaccaauucaccugguguuggccaguuugcuauaucacugaagucacuacccuuguuggauuucuuugucuugaguuugcccgcuuuuauaauuuugggggaacugaucucggccuccagagaguccugagcgggcggcggcucaccggugcucuugggggacaggugcugcaaaagcuucaug

SEQ ID NO: 4770 - RNA, 3016 nt, Mus musculus
gggauuuauaagaugggggaggagugagaacuaagucaagucaaagagacucagccuuggauaagcugaccccugcuaggaacuaggaucccaaggcagggacuuguggguuugccucuuuuccuuaaugugguagacuuggcagcuagccagccucuugacaggugggcugacuccuugaauuauagcaagugaguacaacaggagaccagcuaggaacauauaugggcagccagaucucacaaguuagacuugcuccccucucucucucucucucucucucucucuucuuacucuucuuucucuucucuucucuucccuccuucucuucccuccuucccucccuuccuccuucccucccucccucucucaggauguuuucuagaauguuguagugaguguguuguuuggcacugugcccuucugaauauugcugaguccccugacauggugacaugguucaaagugcuggccucaacacagaggaagaaagacuauucaacugagcgauugcuaaacuuacagaaaaccuguaauuuuuuuuucacauuccucuuaacucuagcaagugaccacuucuuguguauuucuguugcucuuuccguagguuacuaaggaaacucauuccuauuuauugauguaaauuuuggcauugcuugauuuuacucaguugaaaaaugugcuuugaauuuuuagaauauugcacaacuaaaaaaauagauuggggcauuuuuaaaaauuuuccuuuauagaaacaaauuguuaaauauaagauugaaagugucuauuuuuccuuuguuuuugaggaggaaguuuuuguuuaaagcaauacugaaaagcagacagauaauucuguccucagaggcccugugcucaugugcacaggguuagugguuacacuggggguggggugggguggaggaugcucuaucacugcagcagcugccuaauaauucaguucucaagaaucugaacgugagcccccaagucggcaacacucagcuuccuucugucaguuacugucaguuacugggaaacauuagaacucaggugcuugauuugagauggggacccagcggcuuauacagauuguagguguacugcagggaggagagaccauggcaccaccuuguguucccaccuuauuuuuauaugggaaacuugaagaaaaaaaaaagaaagaaaaugagagugaaggaaaaacacaaggugaggaugcugcagagagccuccugcucagcagagccuuugagcugaagaacgagagguggugauuaugagaaaccaguuauguggaaaagcagcacuucgguagucuuagaacaauugucuuuuuauuauaugugaucuguuuucuuauccucuguuuguuuaccuccccauucacuaaagucgccucaaaacucaguucuaaacggaucuugacaaacaugaacguacuucccuucugguuagcagaacucuggggugcaggguccuuuguggggguucaggguuccuuagguuguguugagaaaccucaguguaggccaaaccaaaauggaugguucugguuuuguaauugucuuucuuucauguccuauuauacucuguauuaaaaaacagaggguuaaaaggccauaguccauuucccaaaacguaauacacgccucuuguaacagugaggugauuugcugauguuuuuaucugaguaggcugucaggugagugugauuccuuucccguacccagaggguacauucuccagguggccagaggacagguuccuucuuacacagagccugcccucccucuauaugauucuuggucucugcccacaucucccguucaguuaauuuaaacaaaucucugaggccaggugugguggcacaguggcucacaccugcaaaucugcacgcacaugggagguuaaagcaggagaaucagggaugaggguuagccuuggcuacagagaguucaaauccagucugguauacaugagucccagccucaaaaccaaacaaacaggauuucugaagaaagagcacucggcuguugggugugguucaggaagcucacuggcagagagugucuguggccccagucaagguuuuuacccagugacagauaacuggaaaugacaauguugauaggaaauaaaguguggugccaccauggagucaucccuggccacucccgacacaagcgaggcuugacuauacuacuguggaguauacacgugcaauaaucagugaacucaaucccugguggacagaagagccgcccaagcugcguguaaucucugggugcuaucacagugcguuucacgagugcuguuuccaggcaguuagguugggcugaacuugugaguaucaaacagugcucuucuuucuguguagaccuucagcaaaagcagguacuuggaaaccacaggcucaccuucucuaucuauucaguaauuauuaacaaagagaccuccauaagggagcacuuggcuguuacugauaauguaccaauugcuaaagaacccgucuccaagccauccggugaugugugcagcaucacuguagaacugucccgugccgcucuucacuucccuuuggguggagccuuuucgacuccccauggcaggcuaaucuuucucuccagguaguaacuuggccccgagguugggcaaguacuccccagacugagagaagcggcugcgucacaucugcuguguuccgucauuggugaucagccagucagcauucgcucccugugucuaacucucucucucgcaccucucccagaugcuaucuaucggguuuucucacuguugccaguggaugucauccaaacagugggcucauaucuuaugguuuuugugcaaucauugucguauuguaguccuaagacucauuauaguguauuuuugauauuuuugaaauguguuaaauuuuuuaauucaauaauaugagccagagcauguugcagcaaaucuauuguuuguaaaaaauaauaauaaacaauaaauaaaauaaaaugggauaucuuuu

SEQ ID NO: 4771 - RNA, 3016 nt, Mus musculus
aaaagauaucccauuuuauuuuauuuauuguuuauuauuauuuuuuacaaacaauagauuugcugcaacaugcucuggcucauauuauugaauuaaaaaauuuaacacauuucaaaaauaucaaaaauacacuauaaugagucuuaggacuacaauacgacaaugauugcacaaaaaccauaagauaugagcccacuguuuggaugacauccacuggcaacagugagaaaacccgauagauagcaucugggagaggugcgagagagagaguuagacacagggagcgaaugcugacuggcugaucaccaaugacggaacacagcagaugugacgcagccgcuucucucagucuggggaguacuugcccaaccucggggccaaguuacuaccuggagagaaagauuagccugccauggggagucgaaaaggcuccacccaaagggaagugaagagcggcacgggacaguucuacagugaugcugcacacaucaccggauggcuuggagacggguucuuuagcaauugguacauuaucaguaacagccaagugcucccuuauggaggucucuuuguuaauaauuacugaauagauagagaaggugagccugugguuuccaaguaccugcuuuugcugaaggucuacacagaaagaagagcacuguuugauacucacaaguucagcccaaccuaacugccuggaaacagcacucgugaaacgcacugugauagcacccagagauuacacgcagcuugggcggcucuucuguccaccagggauugaguucacugauuauugcacguguauacuccacaguaguauagucaagccucgcuugugucgggaguggccagggaugacuccaugguggcaccacacuuuauuuccuaucaacauugucauuuccaguuaucugucacuggguaaaaaccuugacuggggccacagacacucucugccagugagcuuccugaaccacacccaacagccgagugcucuuucuucagaaauccuguuuguuugguuuugaggcugggacucauguauaccagacuggauuugaacucucuguagccaaggcuaacccucaucccugauucuccugcuuuaaccucccaugugcgugcagauuugcaggugugagccacugugccaccacaccuggccucagagauuuguuuaaauuaacugaacgggagaugugggcagagaccaagaaucauauagagggagggcaggcucuguguaagaaggaaccuguccucuggccaccuggagaauguacccucuggguacgggaaaggaaucacacucaccugacagccuacucagauaaaaacaucagcaaaucaccucacuguuacaagaggcguguauuacguuuugggaaauggacuauggccuuuuaacccucuguuuuuuaauacagaguauaauaggacaugaaagaaagacaauuacaaaaccagaaccauccauuuugguuuggccuacacugagguuucucaacacaaccuaaggaacccugaacccccacaaaggacccugcaccccagaguucugcuaaccagaagggaaguacguucauguuugucaagauccguuuagaacugaguuuugaggcgacuuuagugaauggggagguaaacaaacagaggauaagaaaacagaucacauauaauaaaaagacaauuguucuaagacuaccgaagugcugcuuuuccacauaacugguuucucauaaucaccaccucucguucuucagcucaaaggcucugcugagcaggaggcucucugcagcauccucaccuuguguuuuuccuucacucucauuuucuuucuuuuuuuuuucuucaaguuucccauauaaaaauaaggugggaacacaagguggugccauggucucuccucccugcaguacaccuacaaucuguauaagccgcuggguccccaucucaaaucaagcaccugaguucuaauguuucccaguaacugacaguaacugacagaaggaagcugaguguugccgacuugggggcucacguucagauucuugagaacugaauuauuaggcagcugcugcagugauagagcauccuccaccccaccccacccccaguguaaccacuaacccugugcacaugagcacagggccucugaggacagaauuaucugucugcuuuucaguauugcuuuaaacaaaaacuuccuccucaaaaacaaaggaaaaauagacacuuucaaucuuauauuuaacaauuuguuucuauaaaggaaaauuuuuaaaaaugccccaaucuauuuuuuuaguugugcaauauucuaaaaauucaaagcacauuuuucaacugaguaaaaucaagcaaugccaaaauuuacaucaauaaauaggaaugaguuuccuuaguaaccuacggaaagagcaacagaaauacacaagaaguggucacuugcuagaguuaagaggaaugugaaaaaaaaauuacagguuuucuguaaguuuagcaaucgcucaguugaauagucuuucuuccucuguguugaggccagcacuuugaaccaugucaccaugucaggggacucagcaauauucagaagggcacagugccaaacaacacacucacuacaacauucuagaaaacauccugagagagggagggagggaaggaggaagggagggaaggagggaagagaaggagggaagagaagagaagagaaagaagaguaagaagagagagagagagagagagagagagaggggagcaagucuaacuugugagaucuggcugcccauauauguuccuagcuggucuccuguuguacucacuugcuauaauucaaggagucagcccaccugucaagaggcuggcuagcugccaagucuaccacauuaaggaaaagaggcaaacccacaagucccugccuugggauccuaguuccuagcaggggucagcuuauccaaggcugagucucuuugacuugacuuaguucucacuccucccccaucuuauaaauccc

SEQ ID NO: 4772 - RNA, 2164 nt, Mus musculus
agacagugaaaaaaaugcuugcuuuauuguuaagcaccucauacagauauacaaggaaauaugaucauggcugcuccccacuuuugcccuccagcuuaccccucucaaccucauuuugcuuuauaacuuccuguuagguccaguuacugcugcccauccuucgugggugugggcccagagcgugggagaccuccaaaaugaaugauucuccccccccccgccccacccccgguaugaaaauagcguauauauuuuuucugcuagucagcuuugugcccuuauaacagaguaucugacccaggcaguuagugaagagggagaugcuuguuucuggagugacgcagggaagaguggagaaggaaggggucgccgcucagccagauagaccuggucaacccuaguaaccaaugagucauguuucuaagagcaccaggcaucucacggccaaggcuucugugacaguagagaacacagaccacacccaauccauagcaccguuuucugcuggaauggcaacagagaugacucacuaaaguuuaugguugaagaaaugcacuuaggagguggaggcaggaggcucagaagucugaagccagccauggcuuggggcgaguaagacacaaaaaaagucacuauaggcagcauaguugucaaaugagggcuauuagcugaggaaaccgguuuaugagccguuaaguuccuuaaguauaucacagcuguuggcaccgcaggagucagguagcuaagcaacccugggcagcguucuuuccaugagguuaaaguggagcauuaggacuuuagacuuggugaguguugcuuuccaagagaauuagcguccaguuaagccuccagcuuacugcucucucugcucucaccaagugucuucuagucuguggauuucaaacaagaucagcuaccucucagcccaaguaaaggccguguugaagucaucuuucaggcuuccucuucauccggaaucaacauuuuaaacacuugguuucuuggcagcacacucagcucuuucggugugccugccaggcaagcacuguacccccgcuucuugauaccucugucccaugugauauaugggcugagguggcacaaguggucucaaguuuguuuuccagugccagugauauuccacggcguccugaaggccacaaggacuugucuguuacuuguaacacaccucuauuaugacucagagggccguggugguggugguggugguguguguguguuuaagaucuauuuuucuuuuuaauuaugggugugugugugugugugugugugcacaugugcuuguggacuccagaggaagauagcagguccccuggagguuuaguuauaggagguugugggccaccugauuggaugcugggaaaagcauccucauaacugcuaagccaucccucuauucuguguccaagucuuaucuccgcugcuuacagguuuugugacugugggaaaguuaaccuguuuaaagcaguuuaacauugaacagaagucacagcuucggucauuugugccaaagugguagauaggaagaacuucuauaccacugaacaauaauguucugcagugagucgcugguaaggaacaucagcccuugcccuucuuggaccuugccuccucauuuguagcacacgaaugacaagucagcguaacccgacaaauagugaaucccaucggguuugcuagaggguuucuaguacugaacucuggacuuguggcagugugguuaguuuacucccugauggguucuaaucagaagaggagcugccacccaggagccaaccggacacagggcuggggucacauagucagucuaccuuauccagugaaagauccaaggugggcagagauaacaauaggaacacagagaaaucaugaaaacagugcccugggggugccagucuuuuguugaagggcacacaugugauuuuggcgauugucaaaguuucuuugucacuuaucaagccuuagugcgggacacuaaucacuaccaggccaagggugacaauagagauuucccugauuaauucucccugagcuuugccucauuucuuaagaauuccuucguuuuuauuuuauguuuggauguucgccugccugccugccugccugcgugugcaugaccugugugccugugcccucaggcagg

SEQ ID NO: 4773 - RNA, 2164 nt, Mus musculus
ccugccugagggcacaggcacacaggucaugcacacgcaggcaggcaggcaggcaggcgaacauccaaacauaaaauaaaaacgaaggaauucuuaagaaaugaggcaaagcucagggagaauuaaucagggaaaucucuauugucacccuuggccugguagugauuagugucccgcacuaaggcuugauaagugacaaagaaacuuugacaaucgccaaaaucacaugugugcccuucaacaaaagacuggcacccccagggcacuguuuucaugauuucucuguguuccuauuguuaucucugcccaccuuggaucuuucacuggauaagguagacugacuaugugaccccagcccuguguccgguuggcuccuggguggcagcuccucuucugauuagaacccaucagggaguaaacuaaccacacugccacaaguccagaguucaguacuagaaacccucuagcaaacccgaugggauucacuauuugucggguuacgcugacuugucauucgugugcuacaaaugaggaggcaagguccaagaagggcaagggcugauguuccuuaccagcgacucacugcagaacauuauuguucagugguauagaaguucuuccuaucuaccacuuuggcacaaaugaccgaagcugugacuucuguucaauguuaaacugcuuuaaacagguuaacuuucccacagucacaaaaccuguaagcagcggagauaagacuuggacacagaauagagggauggcuuagcaguuaugaggaugcuuuucccagcauccaaucagguggcccacaaccuccuauaacuaaaccuccaggggaccugcuaucuuccucuggaguccacaagcacaugugcacacacacacacacacacacacccauaauuaaaaagaaaaauagaucuuaaacacacacacaccaccaccaccaccaccacggcccucugagucauaauagagguguguuacaaguaacagacaaguccuuguggccuucaggacgccguggaauaucacuggcacuggaaaacaaacuugagaccacuugugccaccucagcccauauaucacaugggacagagguaucaagaagcggggguacagugcuugccuggcaggcacaccgaaagagcugagugugcugccaagaaaccaaguguuuaaaauguugauuccggaugaagaggaagccugaaagaugacuucaacacggccuuuacuugggcugagagguagcugaucuuguuugaaauccacagacuagaagacacuuggugagagcagagagagcaguaagcuggaggcuuaacuggacgcuaauucucuuggaaagcaacacucaccaagucuaaaguccuaaugcuccacuuuaaccucauggaaagaacgcugcccaggguugcuuagcuaccugacuccugcggugccaacagcugugauauacuuaaggaacuuaacggcucauaaaccgguuuccucagcuaauagcccucauuugacaacuaugcugccuauagugacuuuuuuugugucuuacucgccccaagccauggcuggcuucagacuucugagccuccugccuccaccuccuaagugcauuucuucaaccauaaacuuuagugagucaucucuguugccauuccagcagaaaacggugcuauggauuggguguggucuguguucucuacugucacagaagccuuggccgugagaugccuggugcucuuagaaacaugacucauugguuacuaggguugaccaggucuaucuggcugagcggcgaccccuuccuucuccacucuucccugcgucacuccagaaacaagcaucucccucuucacuaacugccugggucagauacucuguuauaagggcacaaagcugacuagcagaaaaaauauauacgcuauuuucauaccggggguggggcggggggggggagaaucauucauuuuggaggucucccacgcucugggcccacacccacgaaggaugggcagcaguaacuggaccuaacaggaaguuauaaagcaaaaugagguugagagggguaagcuggagggcaaaaguggggagcagccaugaucauauuuccuuguauaucuguaugaggugcuuaacaauaaagcaagcauuuuuuucacugucu

SEQ ID NO: 4774 - RNA, 14308 nt, Mus musculus
gacugauuggucuccuuucacaacuuuacucugcucaggugccugagcacugagggagcuuaggaaucaaguaugggaaaucacguugugcuuguaggggaggaacaaaggagguuccagcucuccuuagagcgucccggaccacagguauucuggaacaucacgguaauuucuguguuguuccuggcugucuuuguagugcuucuguucucgguaggcccgcagggccaucaccacgcuggccgcguauaaaaucacuagaagacaagcgaagguggcugcugccccaucggugcccgccagcuggcaguucauccaggugaggcccuugcgggcguagacucuuucucugguuuugcaagugucgguggaauugaugcgcaacgccgcauacagguaaaagccaauggcgacgcaguagcccaccgcggccaggaggcugaaggcggccuccagcagcagccaucuccugggcagcuuccuuagacucuuagcucccugcaguaaaacgcccauagugaggacgcccagccccagggagacagccacgccgccguagaucaggggcgaccgcaggaucguguacugcugguccagcugccgaaccugcuccaacucggugcccucaaaaggugaguaauaguuauuuccgaagccgcugccgcuggcaaagcuggcgcugaauccggccaggacaaaauaggaagccacgaugcauaugagaaccauggcauucaaaaucaccuccauuaucugcaccacaccuaggggaagagagaguccgguuuaagguuggaucacucaccugaucaagguagggguucccuggauccuuuaaauaaaugaucugauucagcaacauugucaacacucuugguuuugucuuuuuuuuuuuuaagaucuuuuuauuuuauguaugugaguacacuguagcugucuucaugcacaccagaaaagagcaucagaucccaugaggaugcuugugagccaccaugugguugcuaggaauugaacuuaggaccucuggaagaacagucagugcucuuaucucacugagccaucacuccagcccccugguuuugucuuuaaaaaaaaacaaaacaauacaaaacacccuaugucauuuuaaaaagucccagugcuuguggugggacccaggaugcaagcagcaagugcucuacggaugggcugaacaaccccagcccagguguucuguuucuaaaacauacuuuaaaauaucauugcuggcuggguggguggaguguuggcucagcaguaagcgcaauuguugcccuuacagaggaccuggguuggguucccaguacccaugcaccagcucuuaggccgauuuaauuccgguuccagggaauccagugcccucuucugaccuccgcaggcaccagauauacaaacagugcacacaaaaaacucucauauacauaaaauaaauauucacauagaaaaaucaaugccaggcuggagagauggcucagcgguugagagcacugacugcucuuccaaagguccugaguucaauucccaguaaccacaugguggcucacaaccaucuguaaugggaucugauguccucuucuggugugucugaagacagcuacaguguacuuaaguagaacaauaaauaaaucuuaaaaaaaaaauaaagagagaaaagaaaaucaaugccaaucugaaaaacuuggaaaugcaaaaaaauuauauauaucuggucuuuguagcucaggcuagccuugaacucucgauccaccugccccagucuccaaaguauuagaauuacaagcaugcagugcuguaacugccuuagaguaguuaagacaguuaaacauguguguacuguguggcuccacaauuguacccuuaggcauuagcccuaaagaaauaaaaagcuacuuggcaguuuaaggagaaccuugaggaggaggccugccugggcuacauacugagagccagcuucaaaauuuaaaaaaagaaagagagcucuauguccacacaaaaacacguucgugagucuugacaguaguagcuuuauuuguaagagccaaaugcagggagagcuuaucugugacugggucagcggaauggacagggagcgaccuggguaaguuucaaggugauuaugagugagaaagaaguucuggucucaaagggugacauaaugagugacuccaucuguggaguggucucaguggaacagaguucuggagauguggcacacagguggugacuggggacagggcuaggugggaugggagggugaagaggguguguguggcuuuaaagagguagggauggagcgcuuccgguccguugcggagaucacaagaaucuaccaaucacaaaaccucucggaauccugcacagaggagugugcgccagcaaaugagaucugugacaacucggagaucuccauuuuccuggaucugagauccuuguucgagacgacagcugcagaaagcugcagaagggcccaaaagauugcgcuaugccgcccuugugacuucuugugaaauuucaaauuuaaaguuggugaaaaaacaagacaaaacaaacccagagacuaaugaaguauaaacugaacauuuucaucgauguccuccaucucucacacccaaaguacagucucgcuaugugacccagauggucuuagacucugacccagccaccgggacuccaagcaguuuuuaaaguuuuuaauaugcuccuccuacuuccuuugucucugucucucugucucugucucucucucucucugcaugcuuauggugugcugguaguucagaggacagccucaggugacauucauuccucagguauuuuccaccuuccguuugaggcaggucugucucagaucugguacuucaccaaaaaggcuggaauagcuaccuaccuaccagugaguuccaaggacccaccagucucugccccccaucucaccaacacuggauacaggcauucaccaccgagccuggcuuuugacacauucugggucucuggacucagguccucaugguugugaggcaaacacuuuauccauugggccaucugcucaccuguuucccagccuuucuuuaagcauucagcuuagugcuucucucucucucucucccucucccucucccucucucucucucucucucucucucucucucucucucucucucucucugucucucugucucucucucucuacacauacauacacacacacacacacacacacacaccuaaauauagcacauauaccaucaagcaucuugcugguuucauuuauuauacgccaacucuaucuagaugagucugcugcguggcuacaucacuuaucaugaaacuuccaguuugguuggauggaccaguuugcgcaaccggguuucuacaaauagauacuuggacuguucacuuggagagaguuucuuagaagucuggaagaucugcagauuccacaaggcagugagaaccagcaggugggucgaggccgaacaccucgugccuaagauccccugcugucagcucccaacagaaacuucaggcugcacuucugaaaguucgguuaucauccucagauccucggggugcagagaugagaauuuugagagacauagaggaaugcaaaugaaccccaaauucaaauaccggauuccaguaucugcucuuucccuguuugccaaaguccuccuaagcuuuagauauuuuaucugaugaaugaaguuaaagccuccagacccacucugccucccucccccacaguccuguggaaaggaucaaaaggaagggagagcagccagcccucccuuugcagcgucugcacugggagaguccauugaagacugaacugcaucugcccauggaacaaagacaggagugucuccuaaacaauacagccuagcaacuguuugcauagcauuuauauuaugguaggaguaaguaauccugagauagaguauacaagagguuauguuauacacaaauagcauucaugccguuuuauauggaagaccacagcacucucagauuucugcauugggagggauccuggggccaauuccuguagacacuaaugcaugacuaaaauuucuagaaaaucauaaauguauauaguaaggcuucccggagaguaguaugaaauguaagaagaaauggcgagaacuuugaaagcgugcuguuucccagagauuagcguacaacuauccauuacacuaaugguguggucuuuaucauugaggcagucaagggacagcagccaguucuauccccagacccagcuagcagagccugucuucugcaugcccacgugaauuccugaaaauccaggggacacgacagcguggggaucagagagccgagaaacuguauugcucuaauuugaaauucaacauuagauucuaacugcccacucuucaaccaggcucuguaaguacagcaaacgacgaaccagcccagaugucauggggguggggagacagcuaucucccacacucuacaucuuucccaagcccgauuuuucuuccaucagcauauagaaacagaaacacuguacugauacaagagaugggaaguaggagcccuuuccuucugguacacacagcaugcaucucugggcugaaguggaagaaaucuagguuucugugucuucugcuagauccagugauccugggguguuauucccggcacuagcuagccugaguugccuuagcgaagcuacucaaagugacaacugucuuuaagcaugcugcuaacgcacaaagaugaccaucagagggaaggaagaaaaggcagauguugcgcuuuauuuccaaguuggugugggucagguccccagaaagaugucacacaaaggucuguggaagcagaagccuacuggauccucagcaccuuucugagggaagcugcuuuuuuuugguugaccauauagcaccuagcuuaaaucuguaucuaccucugucuuugcacuguacggaacuauccugaggagggaaaaaaauccaaggcaaggaugucgguuugaucuuuuuuuuuauuuuuugugaaaauaaaaugaauaugugcagucauagucucuauagagugaaaaguuuccccaccccccuuuucuuugugcaaaacuucucacaguguucaagagaaugucuagccauguacgacaccgguauacaguucugucccuaagacugaagucuucuacaucagucgauggaguuuaagugaauaaaguaucaugaacauaaggaagaacucugccuccaauuuaaacuuuuucuuugggaugcuuggauuugcaucaagcgaagaacauagucauuuguacgggaauauacggugauggucccaagccauaauucaacagguaaucuagcccgugaaguugucuggccaaaaguaacguucuucuguugggaaaggggcuucacauucuuuuccuuugagcagauccugaaccagcggugggguuggauucuucauacaauggcacauuuacgggagguacaaaugcuuccugagcgcucccaggggccaguagaaggguuucuuugcagcucagcaaguuuaaucugauucucuuuuccuuaccacacacacacacacacacacgcucaaacuuaaguuuuucuggggaaguauccccccagaauccauacaguuaacgggguguagguagggcuugcauacucaguguggagaugccccacgugucugcugaagagggcugaguuuaggauaguugagacugagcugacuucuguugauguagcuuuuccagggcaauuguuucugccccgaucaugaaguauacuuugccuugcuccugggagucccagccucuaccacaguccaucauuguugcugauuaucugcuuuggagacagggucuugcuaugcagucagugcaugcuagccuugaacucaagauucuccugucucagauucagugcuaggauuauaggauuccaagucuguaccaccaagcccggcuccaguguuuggcguuuugauaugcuguuugucaguuccacauccacagaggauugcagaaaccagagcuuguugucacagagaauauuuacugcuccaugcaaccaggagcuaacuaagcccggcauauccacacuggcgugguauuuuggaagcauucgugaguuccacaucgaagaauucuuaugaaugauugugguuuaaaagugaugucuaucacguauaaguggcagaacauucuagaggucuaaaacucaagcauuucugugggcuucuccuucagcuucuugacuuuucgguaaccccuaaaggccaggacagcucccacggcaaagaccccaauggccauggcugcaaagacuccugcuccuaugucucccccauggacaccacaguugaagccacuauaaccuuugcucugguacagggucucccucuccuugcacacaucugaacuauaggcggcagagagguguuggaagaagaaguacaagccuggaacauaggccccagcaaugagugcauccauuaagcccucaaucaccagccauaguggacagugccaagggacccgcaaggcacccgcgaggagggugagacaggagaaggucaugagggcuccgcuguaggccauggcugcagugaccguaggcagcuugagcugguaaaacugaacguccaacugcugggcucucuccccguccgcaccgucaaagccacuauaagccccuccauacugguaguaguaaaucccccccaggcuggugaugcccguguagccccccguggaauuguaagagacagagcugcaggccaagaucagcaaguucagcagagccuccagcaucuggcagcaggcugcaagaaaagggcguuacuguuuggagaugcugcgguugcuaggagacgcuuucagcucaagguucauccuucccagggagcucucagcccacugcuuccuuucucugccccagugggcagugaaggggcugcccaguuaauguuagauggcagcggggaccugugcuuucuucaaauccuuuugauggaaaagcauacguucaaauaagccaaguggggauggcugccaguaaaguguucacuuuguaagcacaagagccaguucccagcacccacauaaaauaacaggcaugguggcacacuauugcuauccuaguacaugggaggcagaggcaggaaggucaggaguucuuggcuagccucaacuacauaguaaacuugagauuagccuggacuauacgagagcccccuccucuauagauacacauauuuuuuuuucuuucucaguaaaucuaaauuucaauucuaaauauauuuuuauaugucaguaaacauagaucuaccauauagauuucuuucuaauuuuuauuauuugugugugugugauuguauguguaugugugugaaaguccccccccccaaaaaaaaaaaaagaaggagcugaguuucagccauuucugggccacuugauguggugccaguccuuaugacacaguagcaagcacugucaaccccccgggacaucucuccagcucugcuucagaacauuaaaaaauguaaaaaguguucaaaguaguuucaccauguagcacaggcuagccugaaacucuugauccuuccauucugggguuacaagugcaagccaguauuccuggcacggcagugaauuuaacagcuucagugggacaaagggacauuuagguuucuccaguacguugugaugugauaauuuguguguguguguguguguguguguguguguguguguguguguguguguuacuagggaugggaaaucagggccucaccuacugccagagaacauuuccuagugaaacagcagaaggccuagaguccuaugggguuccuuccuccucuguuaggcuuaguagguucacaaaacaaacaggacuauguagaucaauugucauccuuaaaacaaaagcacaaggcucacaggccuucccugacgcucauucuucccagggcagucuuccaaccucuggcucaggcaagucccggauccccuuucgaauuaaccccaguucagauccaaccgguacuauaucagggcauuaguuauuaaaaagaagagauugagaauauaaauuagaaaaagcgcccacacaaguuucuaccgugacccucucaggcgaucagaagcacugacaacguggucccuguccuuccccucuuggcuggggacaguaugaugguugguggugacugucaaccugagcugacaagaaccucgggggcuaggacagugagauucugagggucucuguggccuuuccagagaggucaggagcuuaagacucuccccuccacaccuaaugcuggcagcgccaaccaaugugcuagauggaacaaaaaaauggaagggaggaacuccacugcagaaagucuccucaucccuguccccuccccugccucugcuuccuggcaaccaggaagcgaacugaucccacagacucuccccaucuucauggcuaaaaccucugagaccaugacccuugaucuccacucccuggggcuguuuuguuuaguuauuauuauuauguuuuaaaccacagcaccauuucuuguuguauguauguagacaaagcuacacaacacagaugcgggggggggggggggagcaggaucaaauuccucuuaugaaacugucccuuugaaaugcaaacccaaaauacucucaacaaugacaccaggaggagguucugagccaaagaccagcacucuacagaagucccaaggcacuggagagauccgccauagguaauauccuggcugcaccuguggguaagucucaggucaaugagagacccuuccucaaaacccaagguggacuguacuugagaaaugaugcuggcguugaguugcacacacucauauacaagagggagggggaggagggagggagggagggaggggguaacaguuuaaauugggaggaaaaaaaaagaaaaaaaauuuaaaauuuuaguuuagucuuuugagaaagcaucuuccuaggcuccccugaaacuuguuaacucucccaucucagccucuccaagugcuagaauuucaaguguuuucccacccagccuccuugucuguuguuuugcgacaacggucucacuauguugucccugguucgucuaaaucauggacucaaaugaccuccaaccucagccuccuguguagcagaaucagcugggacugcugcugugugccuccaugccugacuguaaaaugagacuuucagagacacuuagcaauaauggccagaaagcucguaguaaauacaaaccgcugugguuuaaggacuaagcuucuagaacccagagggcaaaggacaagaaggguggggagggaggaguguuccauaugcaaaugagcugagacucgcaucuucuaauccggaacuagcucuacucuacuccggggcccuccauaccucgaauaaacagaacccacacccacucaggcuaggggcggggucaagggaagccucgaggggguggugauugaaagcaccugcugucugucaaucucaucuuuaguuccagucccugaagagguuucaaucugagauuucuuucuggcaaaagugguuagagccuaucucuuucuguuggucucaggaucucauugaacuuuauagggcugaaccacaguccccagaggacugcagggugccuuguuugcugggagggauugaaguggggguaggggugaggagaugacguggcggcuuccccgacaaagaaaaagccacaaaggauccacucuaauguggacucaaaagccaucagcugaccugccuccagguucaucuuuccugcucuagccagcccugaugcacagggcugugucucuccgaacagugcuccucugugcaccugccugggagcucugaacuucacacacaccccugcccgccuccucuguucucaaaccccaccccuccccaucccccaucuccaagcucuccaauccgggacuuccauacccaaccgcuaggcucaaagccaaaaagccagaagcaauuaagccuaaauauagguguguuuugguaagaaguacaggcccugucuuuuccucuugguaaaucaaucgcaggaaaaaaaaaaaaaaagaaagaaagaaagaaagaaagaaaagaaaggaaaagagaagaaaagaaaagaaaagaaaaagaaaagaaaaagcaagucuagaaagaaaccuguuagccagccucuggcuuguuccuguuguuuacaguaccaagagaagaacguucugccaggaaacacuucgaugccuuaggcuggggcucuaaguuucaguuccagggccuuuacuuaauggcugugggaccuggguaacuugcugggccucuccgagccucagggguaguuaaaggcaucucuguggcagaacgguauguaaaguagcugaugaagauucccgcucagguggcagagaggccuuucagcagaguucuucauaaucuuauaauccuuccucccggugacacagcuucagcugcggauccgugauccccgccccccccccccccccaggcugggauguuucuucucuuagucaugggcagccugccugcgaggaguucacccugacaaaccagaguuuccuccuugcuggcaaggccaggaccugggcugagcugagaaccugggaggccaggcuggcugguaacuaacacuacuguaaguuuuaaaugcucaguacguugauuuuguuucguuggguuuuguuuaaguugagacacagucuccuacagcucuggcuggccuugaacuccuggcccuccuacacccacugaccacacgcuugaguuuuauuccuuuuuaaauuuggcuugucuaucuggcaugguguggaggucagaggacaacuuggggaagcugguucucuccuuucaccaagugggucccaaggauugaacucaggcagucaggcuuggcugcaggcaccccuuagccaucacacuggucccuggcuuugguuuuuaaugaaagagaaaauauuaaugcacugggugugcauaagggcuggguaguuucgugagauuuuuguuuuucucugugaauugaugugguuuuguuuauuauuugagacagggucuuccucugccgcccacgaugguggagaacucacaacaaucuugccucggcugggauuaugggcacguaagacaccaugcuaggcugugaacuuguucguaauguaauauaugcucuuacuaugcauuucaggcaaugaagauugaaagccagugacugauugggcgucagcucucugagaagaccacccugccuguacgcuuguuuugaggaugaacucugcuggggucauuuucccucuauggccucagcuggcuauggaagaggagcagguggccaccacaggcagcucacaacacacugaaaguacaaaguuucaccagcuggcugggaaggggaagcgagcuugagccaagcucagagcuaugcaugcacauuggauaaguguggggaaagccucauggcagaguucagaccuuccuguauucuuucuucucuucuguucuuucuuuuuuccacuuccucccuuuccuucuuucccuccuucuuucuuucucucucucucucucucucucucucucucucucucuuucuugaucaagaacuccaugcaacauggaaauggaaccuaagaggaaaaacuggacaaucugccaacucaccagcgcucaugccuccaccugccaccuugccucuccucaagccauuugcaauauaaaugguucggcagggucccccaaaggcucaccucucccugugcacaaguaucugcauuuguggcaauccaggagucccuccgcuuccgacugguaauauuccucuuccuggagagcaggcacggaguaggugggcacguaucuuuccgaagcccguucgcugcaaccaaggagcgcagagacauuagggacaggccuguaacucaacgguuuguuuacuauuaggccuucguuuauuuuuuuaguuuuuaaaaauuucacagaacgaagccuaggcuugccucaaacaugugauccuccugcuucagcuucccaagagcuacaucacaguugugugugcuaccauggcccgugguauuggaacucucaauaacgagcuugaccuuuggccccugauucucuugccucuacccuccacuagcugagauuauagucauguccacguccagccagcuacuuuugauaucuuacugauaucucuccuuuggccaccccuggcaccuucuguuuccauuugccuaacauaugccaggcucugcccaagauucaacaagaggcugcauucugcuuuggggacauagaagccaccccaucucucuuugguuugaaaucuuuaaaccuuucaucagcacacaggagacucugguacugugcacacuuacgaccuaggcguaccgagccagccgcagugagcugcccuucaccacuaaagaacccaggcuucuggggcacagaggaagcgguuuuucuacuugaaucgccuucuacugucuucugucuuccuuccacagaacucagcucuaggucaccuuccuuggcauccugagccucugguggcuguuuucacugccagucagucucugaacgcugacaguaaguuacugcaugcgggucccugcauucccucccuccaauaaaugcuuaggaggagagcagacagagagaagcugcccuuuggccucaaaccuuuaaauaagccacgaacaauugcaugucuuuuauucacucuggggugaggcgggguaaugaggacucugguuuuaagaggaaacgcacaaauguaccucuuguuuuucuacuccugugguugcaguccaagaugggugcagccagggaaacaauagcuagugucaaagaccgaaagagcagcccaaaucugggcgcagcuuucgcgaggugaguuggcuuuagauaauguaacauaaacucaugauagcagcuuucccugauguguggaagucuaauggcagaggcuccaagucuaauggcagaggcuggggaucaucagcuagaagaguugucuccagggaaaagaaugcacaguuuugacaaccacacacacacacacacacacacacacacacacacacacacacacacacacuuuuugcccucagggacaccuauuuuauucuauuuacccaguccccagagccugguuccacaucugugcaacuggauggcgcgcugagucucuaggaggggguaugacgaccgguccccugcuaguccuuuccacccucauucacaaaaccuucaaagacacaggggaauuucgggaccuacagaccaaguucgucuauucaugagggugggguuuaaacaaaccuacggucugaaacaagcugcugagaaagaccucacugacuuuguuacacaucaccggagaaugaacguuuaggugggcuuaguuucguguuuaaaacggcggcuucugcuagcagucugcugcgcauacauagccuugucaggaagagcgaguccaacuauuaacucuucguugggcuaacuuuauucagccccccccccaaccuggaagcuggacuuugaaagguauagagggaaggcuagggaacaagacuuaagagucuguggcccuccggcuagccccaccuaccuagccuucuaaaccguuccaguuucaguccugaaacucuccuccuuccucugguucucgggcuuucccacuuuuucuuuuaugucaucucuccuccacccucggcggucccuggucccuagcaggugcaccccucaccucuccaacccgcggcgcccgaggccaugcuucugcgacagcucugggggcccccagggugcgggucccggagucggggcugcgucccaacuggguccccagggcucgggccgcgcacggcuuugacgggacuucuccaaggcucuuuguucggaugcgcgauggcccgcgucccugugucuguccuggcgcuggucucgguccguucucuguucccggcccgcccgacgguccccguuuccucucacgucaccguuccucucccugugccuguccccgccucggucccgcgaccgcucgacgugguggucucgguccgggugcgggcgccgguccgggucucuuucucuaggacggguccggggcucacggugccccgaaguauuuuucauggccggauuccuguccccgcccggaaacgauccgagggcgacaaccaaccauaaguuucccaggcagguggccaagcucaaggacggggcgguacagcu

SEQ ID NO: 4775 - RNA, 777 nt, Mus musculus
uaauaaaucuuaauauauauauauauauaugaaaaugcccacaaacaugucccaugggucacccuugccugagaccgucccuccccaaaugugucuagguuuguguccaaugaguuuuguguuucacaaaaauuuaaccagaacacccugcccuuaagaguaagugaagcaggcccgugagguggcgcagcgggcaacaaaguucgcugucauaguugaugggugacuugaguucggccccuggaaccugcaugguagaaggagagagcuggcucuauccucugcauguccccaacaccaaccggaaauuaauaaggacauuagaaaccuaacacaguuggguuugaguuuuacaucacugugguuuuuguucagauuaucccgagguuaaagguagaugggccagauauggugaagccaguuaagaggguguggagaacucggacauuggugaacagggaaggaggggccggaucuaagggauauuugggaggcuugacuuggaaacagggaggagugggggggggggggugcuggccaaucacugagaaggggaggguucaccggaagaagacuggacgugggcggcuccauugugaguagaaccucaaaagccauagccuggugaugcuuucugaaaucuccauguggaggacuggggggagagucagcugugcaggucagaaauucaggagagcggucuagccuggagauaaacauuugagaggcgucagccuguggaugaggcagaaccccugggacucaaguguuucuuca

SEQ ID NO: 4776 - RNA, 13021 nt, Mus musculus
cggaccgugcugcgcaggugagugcggacccauugcgguucgcggugugucuuggcggacagcacgcaggggcucccgcagccagccucgcgggccaccaagucuccguguccacagcggugacgcuugaguggcgaccauugucagacccagaaaacucagcagguggcggaucggggaagcugugucacuucacagagggguagcugcgugcgggggcgaagcggcucgaggugacaucgcaggucucuugacccgccgcggcccugcagguguguacugcuugucccgggcuccaggcagggugaagggcgcggggccaccgcagggaaagcagggccacuucucagccguuggggacagagcgagcuuaaggccuggucugcugcaucgacgucaggccccacacaugcacacaagaugacgacauggcaagaguacacacagacuaguuucagaauugcugcuauuucauaccccguagaaggcagugcgacauuuggauggaugcaggucucuuacggcuauaaccguagccaaaacacuuauuuuuccaagguggggagcagggagagacagagacagagauagacacagagaaagaguuuuaagagaaagaaaaguaacggaugcuuaccuaugcgcagccagauaagaacgaaucugguccuuaugcugcauccaucaguguauucguucuucaucugacucucagacucuucccacccucagauguaacaacuauuuugaauuuuguguuuaccacagccuauuuuuuuaaaaguguauacauaugcaacaguuuaagcuuuguuguuguuguuguuuuugaguacuugguuaauuucuaaguagugucuaugucagcuggguaagguccagcuauaaaaacaauacagaagcuguauuuucaggggauggguagguuguuuucaggcugguuaugcaucacaaauagugcugacgauggauacuuugugcaugucuccuacacaugagaauauccauaggaauacauuuuucaagcuuuuuuauucacaggcaauuuucauacaaauguagaaugcauuugauucauuucacacccccccuuccugggcacccccuuuguagacauuuuuaagauuugauguggauauagaguuuuccaaacacauuuggcaucgaguguuccuggucaaggguuaauucugagccagaggaaaauuuacagccugauaguuuuuuaauugccaaauaagucauaaugaaaauggcuggggaaacuccugcaauuugaagagguagaaacauuuaaaaauccuuuuguagucuagguuuuucaagauguagaacguaggacaaaggguuuuguuuuguuuuguuugugggaauuuagcuaugaguagaauauagucgccuggacagagugaaggacaaagauagcaaaauagaaaaaaaauauagacaaauuaaauauaacaguucaguugggcaaagaaugauugacaccacaacaacuuguaagacuggggaugccauggggcuggguauuuauagacaggagaagaccuguacugaagagcuagcucaguuggcuugugccuggagcuugccuuauuugaaccuaguuugaucagccuggccacuaugauuggcugagacucaguucugaaguuagguuuugaauguguuuauauacugaguuagguugcaauucucuacaggucaggacucugguauaugagucagaaggcuuucuuaggccaauuuaguuugcuuuaauaaagugcauacaagguugccuuaccagcuuuggcccucaacagguucugucuugcagggucucugaggagccuuggaaucucaaaagauguccuucuaggguuaaugggaaaagcacuuaccuaucaaauccugcccccugauggucaagggcggccucauagauguuuauuugccugcagucugcuacaacaggcaucuuagaauaugggagaagccagacagcaggaaugauguagaugugguauaaguccuugugaagguugcuuacagcuuuguaaagcuggucucugccuaggagaacugcagaaagccuccacuuggcauagcugauccaaaguggacagguuagcucgagaacugaaaggcagccugauaccucucuuauuuuagccaagcuuucucaagguuagcuuaggccauggaugagaccugcacaaaagccuuaggguucauuuguuucuuugugugcaucccccccccccuccuucccccaugguuuguugagacaggauuccugugugguucaaaguagccuugaacuuugaauuccggagcuuucugcccuggccuccugagugccgggguuacaaguaggcacuguuaugcccuggauucaucaggguccuucuguuguuuuggggcagggucuuuugcagcccaggcuggccuccaccucugauccucgccccccagcuccaucccuccuggcaagcgugaggauucuugacaccaagaaggcucgaacuggcaggcagaggggcagccgccuccuaucuaugugguauuccugcagccugacucccagaccugacccagccggccuguccugcgcugucauugcaaaugaugcucaguugcagacagagaaaugaguuaggguugauaauguucucccuagaacugaauccucucguccuggucuguuauccuuuaggcucugccuaaguuuuauaaauacuuuuauaugaugcuuguaagaacugccaaaucacaggcuucuuggcagccaacuugagagcaucaguguccuaccugggaaggacaccuggaaccagugaggggucgcuccaucuucuuuggcagcuccuguuccugucugggaaccaacucagaucuuaacuaugcuccugauugggauggcucaccuuacaccccucccccacccuguuucuucucagcuccaguccuuccuugagagggagaccaggugacagcagccaugaucccaucgguuuggccccaggugagccgggggacccucauccuuucuucugggcaguucagauugagagcugggagcuggcgagacuuggaaggaaaagcgcuucuaccugccggccggaucucaugagaaagagggcagacagguggcagagacuuggagagugaccagcgaagguggcaggacagugaacucagcagacggagucacacaagggucugcauggcacugcacuugagcacccuggcagagggcgucuggaaaaaauguugccauggaaaccacccaugugguacuuugaggaguugcagagguuuaggguaauugauagcugggguggaaagaagagcugcaguccaguaagaaggacgcugugccucugacuaggagggaugagguccaugguagaaagugggagcaggcaagggagagacagcagagcugugaguccugggugggggucuauguggggagucagguggcagauggguuagaagccaggcuacccuuagaaggaugaggggcauguguuuugccauaugaggaugggagucgugggacuggggccuaaggcaaaccaaagaggugccgagaccuggcagggaugcagugggagcugcagaugcucccagcagcucccagccagugagggacagccagccugucuaaggguacaauuguguagucgaauuugcucacggggguucuuuuucuuucagccgagugugaaaguggcacgcgguuucucugcuguaagaggaggaggauaucccauaguuuacuuccccggugucuuuuuuucuccacuuucccuuguuacuaacuuugugcuccucgcaagcccccucuccaagcccuuacuuugcccucugccccuuuacuuagggccugagccauggaauuggcccuagggcagcaagaaccuguuguuucagaagucggugaccuuugaggacguggcuguguacuucacccagacggaaugggauggucugucuccugggcagagagcgcuguacagggaugucaugcuggagaacuauaggaaccuggccucuguagguaaggcgucucucccugggacuuagacugcaauuuuggauuucuuagcgccuuucuuccuaagaagugguggguggggguuugguaauucuuuaugagugggcuguuucuaaucucuuauguauagauugcuggaagagcaaaucucaagcuggcuggggccaacacagaacuuugcuaagacucaggcuugcuucuggggaagccuagagaagcuguauauuggacauaguuugcaaaauagaaacuugcuguucuacagaggccccuucaaauugccccucaccuuacucucuugagucuuuuuaagaauuucaauaaacucuggguauuucaggcuaagaucaagaagugguaucccuuugggcagacucucccagcuuucucugcacauggucccuggcucccauucugacccuucucaucccuauccacccccuuucugaggaucuuaccuucuucccccuguggccgggccagccucaggagaaguugggagaaguuaggaguguacgugugggagaguuuucauucucuucuguuuccuuuccccgaaucaggauuuccacuucucaaaccugcugugaucucacagcuagaggaacgaaaggaucuggaaaaccuguuucagcuggccacuggaacggacucccagggccucuggacugguaagggaggcccgcacugccagguuucugcaggauggcagugcauuuucccagaugcccuauucugucucugacccuaccauuuucaaacaagaauguagaauucgugguuugggggguggaaguccuuaauauuuuugagcauugccucuaaaaguggaggauagagccuuaaccuuuuuacacagaggcagaaauagcuaaagcuucaggcuuugcugugguaugauaccgucuguguuugugaggaaacuguuuuuuucuagcuaugugacggagcaggucaguuauuugaggugucuaguguccagugaacucaccucugaaacuguggcaauaaaguagagcaguggugccugccacuccguggguucaaggccagcugugaugacuuacauuaaggcucuagcuuaguuagauuguaauuaucuguucacugagaguauaaauaaacgugccccuauccaugcaucuugaaugcuauguacacucagugaugcauacaugauuacucgggauuccuggagguacacagacugucagugggucuugggcccaggcaagugucugcauuuacauucccacuguguggcccuuaaucaaagguguucaggucucauucugugugucacaguuaaucucauuugucggcaaaaaaugagacaggcucugugugggcagagggagaaggugggcacauaagaacugugguaguggugaaacuauacagcacagaacaaaaggcccuuuucuuaaccggugauuucugugaagucuuacuugcuggaccuuagauccuuuaugaaagagaagcuggaaaauaagauuugggugggcagcucaguacaucaaaaguuaaauggaaggcacguuaguaaagaugaaacagacauggagaguaacauccgccaugccauagggcuuggaaggucacuaaucaaagcugguaaagaggaaguuguugaucuccaugacacguacagauauuaaucaaucuaaaaaaugucuauccuuagaaaccaaagacaagcaaggccuagggaugcagcauaggagaagaacguuuccuuagaaugcacgaggcccugcaguugaucuucacugugcaaaagcugugguggugugagauaacuuagcuaucagagaccccagugcugucagauguuagcgagguagcaggacagagacaggacuuguggagccggggugaauuguuagucucucuggaagaaaaguugguacuugguaaccuggaugcugucuucuagagcugaagacugguaaguaaugagccgcucucuucgugccuugaugcaccugagcaucaggcagugggaacaacccgaguucucuguauagaggaugacuaagcugaggugccucugcaggcuggagggguuuuuagcgauuaagcuauuauauuuuugcagacuuuaaaaauauuagaaauguuuaucauuaaaggaaggaauaaaaucuaguuuugaaaaagaaaaguuauuuaaaagauuaguauaaguucauuuuauauaccugguaacucauuuuuuuuuggauaaauggauuuuaaagucuguuacuauggaugccuuaaucuuuuugaauuauuggaacagaguauagauugguucauaaacaacauaauuugcaucuuucauaugccuuagugugggcugcuauaacagaguacccuggaugguuuuuaagaacacgaauuuguucuuccaguuuuggaggugggaaguccgagauccaggugagguggaugugagcuugacaagggccuguuugcagaucaguaggcagcuauuugucuucuugcuaagccccucacaugcuagaagggaaaagaaccuuaccagaguccaucaugagcauucugccaaagguucuccugcuaaucgugacagguagggauggacagcaaggagcacuggaucuguagcaacauucugguuaacuuugaaaaggcucauuuguuuuaaaguccucucuagaggagcccagguuacucgugcuacugagaauuuuaaugaggaaguaaggcaggagcauuaucccuuuuuucuuuuuacuuauucuccucuuacacaguacaucccgacggcagccugcccucccuccgcuccucccaggcuccucccccagauccauugcccccuuguuucucuucagaaaagagcaggccucccagugauggcaagcaaacauggcauagcaagaugcagcaagaguaaacuagaugaaacaacccaguaggaggaaaaggguccuaagagcaagcaaaagagucagggacacccccguccccacuguuaggagccccacaaaaaccccaagcuaagcaacuacagcauguaugcagaggaccuagcgcagacccaggcaggcucugugaaugccacuuuagccucugagcuccuaggagcccugcacagcugauuuugugggcuguguucugguguccucaaccccccuggcuccuauaauucuccuccccuucuacuggguuucccaggcucugccuaauguuuggcuaugggucugcaucugccagaggaagccucucugaugcugauggggcugggcaccaccuaugaguaucgcagcagaguauuagaacccuaggucucugagccauccacaaacucugagucaccauugccccaguagaucuuacaggcaggacagaugugggucgaagguuuuguggcuggguugguuuccagucccacugcuggaagccuugccugguuacagacaauggaagggcauauuuuaugugguuggggggaaaugagagaugaaaaaauaaaggaagcuuuuugugggggagggauuugagaaguggagaggucaggacuauaaaauuaugauuuaaaaagaauguucagagaugauugguuuuuaggaucgauggaaagacauuuuguacaacaguauuuuaggagagauaggaagagguguggccaggugggccuuacaaagcuuugcaggaaggcucgaaugaaguucuagggaaacaaaacccaguucuucugcuuucucugcugaugucugucagacccgguuucgcagcauguccuuagguccucuaccuuuccuuuguuagucauuuccugcuuuuauaaggagcuugaucuauagggacaaccaagaaggaacuggagaguguaggaaggugcgagaugaugggagcacacugauccgauggacaagaccgggaguuugcuucacugcugccaccuuuguucaaccuuuguuaccauggucaccuuugcagugcccuuguccuucgagagagugaauggggucgcuugagugaggcggucucacagagcuguauuuauucagacguuuucugacacagagauacauguucuguccacucuucucacucuucacaguuggaauaugcuuugcuugcuugcuuuucuuuucuuuucuuuucuuuucuuuucuuuucuuuucuuuucuucuccucuccucuccucuccucuccucuccucuccucuccucuccucuccucuccucuccucuccucuccucuccucuccucuccucuccucuccucuccucuccucuccucuccucuccucucuucucucucucucucucucucucucucucucucucuuucuuucuuucaccuuaaaguauaucuugggcaucuucucauggaccacauaucuggaucuauuuccuuccuuuaccaauggcaauuauaccuuagggaugagccuuggguuauuugaccuagucuagugauuuuuaaagacacuuuagagcugggcauguugauacacacguguaauucuagccuuuacaaaguaggugcaggggagucaguucaaagccagccuaggcaacacauugagacccuauauauaauaaauagcuuucuaauugccauauucucuuccaccacgguuaugugaccucucuuguuauuuucgacuucuuuugguagaauguacugcuguccaguccggcaauaaucugacaaaagaagugcaugaagaagaaaagaguacauuauuugaacuucagaaggacuuuucucaggaaacaaacuuuucaaaaacguauauuuugggccaacaacaggaaauccggucagcaggaagugagagggggagugccagugccaccgauggaagagcuaaggcgagcucuguggaaggguguuuguuuagucagacuccacaauugucccaggaucauaccagcuccacuggagagcuauauucugauaccaaacuuaguaagagugaaagaaucacuacagaggaaagaccucugaaacccagagaauuagcagaggcuucucaaggcagcccucaaguuaaucagcuuccagagaucugugauguggagaagcccuaccagugugcagaauguggcaaagccuucaguguuaaagccaaguucgucuggcaucagagacuucauaauggagagaaaccuuucaaauguguggaaugugggaagugcuucagcuacaguucccacuacaucacacaucagacaauccacaguggagagaagccuuaucaguguaagguaugcggcaaggccuucaguguuaauggaagucucguuagacaccagaggauccacacaggagagaagccguaucagugcaaggacugcggggcuggcuucggcugcaguucugcguacauuacucaucagagaacccacacuggagagaagccuuacgaguguagugacugugggaaagccuucaauguuaacgcaaaacugauucagcaucaaagaauucacacuggagagaagccuuaugagugcgaugugugcgggaagggcuuccggugcagcacccagcuuaggcagcaucagaguauacacacuggggaaaagccgcaucgcugcagcgagugugggaaaggcuucacuaaaaaugcaaagcucauucaacaucagcgagugcacacgggggagaagcccuacgccugcagugacugcggaaagacuuucagugccaaagggaagcugauccagcaccagaggauccacacgggcgagcggccguaugaaugcagugagugugggaagucuuucagguguaacucccagcuucggcagcaucugagaauccauacuggggagaagccauauaagugcagugaguguggcaaggccuucaacgucaaugcgaagcugaugcagcaccggagaacccacaccggggagaagcccuucgaaugcaaggagugcgggaaaugcuuuacuucuaaaagaaaccugcuggaucaccagcgagcccacaccggagaaaagccguaucaauguagcgagugugggaaagcuuucaguaucaaugccaaguuaaccagacaucagcaaauacauaccagggagaagccuuucaaguguauggaaugcgagaaagcguucagcuguagcucugacuauauugugcaccagaggauccacacuggagagaaacccuuucaguguggcgaguguggcaaagccuuccacgucaaugcucacuuaauuagacaccagagaagccauacuggggagaaaccuuuccggugcacagaauguggcaagggcuucagccuuaguucugacuguauuauacaucagacuguccauacuuggaagaaacccuauguauguaacguaugugggaaaacuuucagguuuagcuuccaacuaagccagcaccaagauguucacaaugaagacaaauccuaaugaagaaaaaaaaaacuaaaaaaacaaaaaaaccccaacccaccaaccaaacaaacaaaaaaacaccccaaaaacaacaacaacaacaaacccacacagauacacaaaauaauaccaacaaacaagccaaaaccaaaccaaccaaccaaaccuauguuuaauaagaaacggauuguggcucaucaauuauuacuuggaggaaaaccauuagagggaaaugauuguggcagucuucauuuggaaacaauuuuucucuuuuauuuuuaaucaggaugagcagcuggaaaaauauaucaaaaauaacguuuuuuaaaaauguauauuuguuuuucaagacaggguuucccuguguagcuuuggcuauccuggagcuggcuguguagaccaggcuggccuccaacucagaugcaccugccucugccuccugagugcugauguuaaaggugugcaucaccaccacccaacuaauaacuugauuuauagcaguaaccagucaggaaauauaaugaaagaaaacauccuauucccagcagcaccacgaaaaguagauuuucuaggaauuuuguggggcugaagaaaaugagggauucucaacugagggagaccaaaggaaacaaauacaagaaggcggagagaaaugaauguauugcugcuucauuuugacaacaagaaugcauuacacuuucuuuaaaagggggaaaagcaaacauuaaaauaaaaauuguucaaagaagccuuuaaaaacaucagauccaaaguggagaugaacaagaaggaaaauguuggcaaaugaccacucaaaaauaaacaaaccuguguguuugguuguaaauacuuccaaauaaguuugaguuguaaaacacagacauacacacacacacaaauggaaagaccuuuguaaaaucugugauauaaaguguaauaucuagugcucagauuuuaacaaaagauaacuuaaaaaucaauagugacauuaacagacaguauucuagagucacaagaguucuaaagaaccccaaggagugcaaauuagugaagacuugcaugcaugucacauugaguauaugauaugcuuaccccccaauccucugcagcccucagugaauguagaugcuguauuugcuaucgaugccugccauacaagcauacacuauauuaacagcauguuagaguuccuacuuuguauugacugaacucuucaaacauagcuacgcccugaaggaagguauccugcuuugauuuugaugcuuugugaauugggcuccaugaagauguuggaauucuugagauacccuuugaaaucucuuacccccuuuaagaaaaauguaagccauuaguaagagcacuugagcugcccagaagcugagaaacagcuguuguuucucuguugucaacugguaauaguuaagaaaaguuuucuuacuuaaaacaccucuaguaccaaauauucauguuuccacaccaguucaauuguuugaagacaccaacuggauguccuccaaucuauaucaauuuagucucuacccauaauauccugcuagugagaugggcuuagucugagaagacugucucuccccacccuccccacauucagacauuaaugaggaguccuacauuacugauuuggcuacagauugaacccucuggguucaguaauuugcuaugguaacucaccaaacauaaauuguuuaaaguuaccauuuacucuauauugugaaugucacaggagcagccagaugaagagauggaacaagauccaaaggguucccacgugaagguguguuugucuuuauagaguuggagugccuuacccuauugagccuuguuuagugcuuuuauggagauuacacugugugcccaugauugaugaaguccuuggcuguuacauaaguuuccccugccagaagucaacagggguugcugaaaguuccaacucuguuagcacauaguuggcuccuuugacaaucagcccuaauccuggaguuagugacacugagucuagcaacaagucacuuuagcauaaacagauggcuguaagagaccuuaggaguaacaaaaggcuuuauaauauuuuucugcuggaaacaagagagaccaaacauacuuaagucacagacagaaacccauuuacuugguucacauccccuuaugucugucugggcaauuuggggauuuguuugucuuugguucaguaguuaagugggauaaaaugaaaaugcagcacucuggaagcugucaaucuaggaacacacacgaacauuagacagugcagaauauuaguguuuuuccauaaagcaguucuuuccaaaaugucuucauuuaaaaguauguaauggcuagugacauggcucagcagguaaaggcgaagcccaaccugaguuucaaccucuagagcccacauggugggaaggacagacugacacacaguuguccucuggucucugugcaugcaugaaaacaaugucauucuuaaaaacuaaaauaccuauacugaaauuaagcauuuugaucaucuugaagugugcaacuugucuauucaaauaaaucuaauaaaacugcagaauugcugaga

SEQ ID NO: 4777 - RNA, 2217 nt, Mus musculus
aagaaaauugaagauugguuuuaauaacaaaacguccaaccuagcauaucuaaaacuucgucauuucaaugugaaaucaauauuuuuuaaauuagcaaagagguauuuuuuucauucuucuuuuccucaaagucuuuaugacacaaguucacaucuaucccaccuucuaguuaggagcagacacaaggcaagaacucaguggccaucggaggccauagauugccaccagugucaacugagcugggcauacuguccacagggcauaagcuccucagacagaguugaugucugucuugauggcuccuuaucagugguugguauacaggagguauuuuacaugugcaaccuugaauugagaugcaauagaaagaauaaaggaacuuuugggggggguugcagaaugacuucccauaacacucagaaaugaaaccacccaguucugcacauggcuugccaguacaguuuguaauucauuucuuccacaggcauccaaagucccugaagacagaagcuuuucugucuuaacucucuuucacacccccacaguuaccccugguuccugguauugcggugugccacuucaugcagccaacaaguauuuaugcgguguucgucucagaccgguuacuauuuuaagugcagggauggaaauaaugcagucuguguugauggagcccacagggcgaaaagaagcuaacgaaggucugugaaggaaauaaauugggugacaugauagggugugacaggggacaggagcacuggguacuggaggaggaggggccaguucugcaaagagccaucuccuuauaucucaucacaguccuccccgcccccucugcugaagggacuaacucaaucucagcucugcccuuaacuuccuguuucugcugugcccugcucucucuuuggcccgccagucacuuuuaucuuccaguguuucagcuucugggcugucuucucaaaagagccaucccugacaacccuguccagcuccacgucccccucucccccgccauaacucuguugacaacaugcauaacaccaucuaugaccgugugcauaccggagguaaacucuuggugaagcccucuuggcaguuggaaucuuuuagugccuagaauauucccuuggugacuaauauuuggccaauaaucacugaucauuagcuauguggguuuuuuuuuuuuaauuuuuaaauuuuuuuuccgaaugaguaaagaaagaucacuaguaaaaaucuuugggagguguuuuaagggcugauuuaaauacuuguaaacgaacucugggaagaacaccacuuuauuuucugucuccuaaaagaaagacgggcuaauccaucuaaaaguuacucuuuggggaugcuaugggcauccaguguccuaggaauugcuuucaguuccuucagcacuuaacugaagggcauuucuggaccccuggaggaagucaaaggaccacaggcuaaacauuccuguggaaauggggaucccgauugaaucaccaagaggcagguguucgcggagaucaugugugaaguggcuuugaagacccaggaaaggucuggcuaaggaaggcguuggggugggagagaagcuugugggucaggaaacuguaaaggaaaucuguugguucauuaccuggcgguugcuagggacgcccgccuccuccaaucaucguuccucuuacuagagugugagccacacucugcgguugcuguggcaacagaugguaacaagauggacucggcagugcagcaaaaaguggcgcgcaaaaagugcagagacugugaguugaaacccaguuucgucagggagcgcgguguggaguuugcccugggauucugaguguacagagguuaccggaucucucaauggucucagggugaaagagugagcuuauggggacugaugagauggccccuacuguucaccccacugaauuuaggggaucuuggauuucuguacuugggauucccgccuggaagcucgcuucuaacuucagcuuugggcaaaucgcuuucagucuucccuaggaaaauggauggcaggucccaugcccuuccuucagcuguuccugccccguucucaaaaugacccugaagaucaaauguguggcuaauuauauaaaggaaaaaaucccaaacgugcucuucuuaugcgacccugaagcaagacugcaacaguuaaccgccucugugccucucugugagugugcgca

SEQ ID NO: 4778 - RNA, 7728 nt, Mus musculus
ugcccugcccgguccugcccgccccgcccugccuuacuucagcggucuccuccucugggaguuccucagccaucaccucauauugaucgacagccucauauuuaguguacucuuuuucuacguuuuucuuugcuuguuccaagaaguguucauacuuuucauugccuguggaggauggguggaggggagagaagcaaccuggucagacacagagaugaguuuggcuucaaaccucgacucucagcucaggggggagcgaggaggagacggaauguuuugacaguucaccuagcauauuuucuuucccuuuggagggacaggucauuugugugugaguagaacucgcaccugagaccucacugaguuuaaugacacagcacgugagcuacaaacugguccucaggagcacaaggcauuaacaggcuccugcaggaaacugcagcuacagagagccacaugugagggucaggaaggagaccuuugccucaugguugaaaaucgggaucccuugcagguucgggauguauuggaacucugcucaguucuuaauucuaaaccuucuacuccugacaguccccuuuggugcugaacgaacugagauagcuggucaguggcuuuucacaugcuaaguaccucccaguuaacagaggguguguuggggucaagucacuuuaagucaagugagucacaauacccuucaugaagguggguagacaguuggcagggggaauuucagaugcuuggauuggccaaaagucacugcaaauucaaaugcuucaaagguaaaggugggcaaagaguuaaaaagcuugcuaugaaaaaaaugagaaaugcugcaacuagucaacacccgugcagaccaaaugauguucagaucugaguaacugagaaaucucccugguaaccgcauccucuaucucaggaugcugacugggaucgugcuggguuucaacugugaggcacagggcuccccuuccugaccgacccucacagcugucucucucuaccuguagguucaggaccuucaaauucaaacacuuauggauggcaaguguuuggaaaaaacagugcaucugugcugaagcuguacagaucuuuuuuaaaauuuauuuuuauuuauuuauuuauuuuuuuuaugucuuggcaguugagugcaaucgcuguuuauacaccacugcuauuguauugggcacuaugagucuaggagugguggguugagguacaugggaggauguguguagguuccaggcaaauaccacgauauuuucugugugggucuugcacauguguggauuucaguagccgagggccuggagucagccuccagcagguccugaugacugaaggcagcauguguggagcuggguuacccuccuuugacugacguacuaauguuagaguauaauguggucuuaucucuauucacaaucaugucauauggaauacaauauaacaugauaguuauaauuuaauggaugcugcucagugggugaguuugugacuuuaggaggaggagaagaccugggaagugagcuuucaugugaaacccugucgggaaagcagaacuaagaaaugcaaagaggagggaggccaugaagagcaagagguuuccaccgauccgguggguaagcuauuugguccugcccuuugggaccuaccaagccagaguuaccagccuggcacaggaagauggcucugggaccacauggggcuaggcacacaggcaaauagcuaauaauaucuaauuuucagccuuuaggcauauaacccuggaguaaaguucuaacggcuagggcugcuuuccugcaaagguuauauuuugagauuucuacaccugacaguacaccagacuccagcuccaaaaugaagaugccgaacauguuauuaggagaggagacugggagagacacuuuggcuaaaggaauacacacuuggcccaaaugucaccacauugguguuggugggagcuaauugauggcaaaauuggccagcagucuuaguuugcaaugaccacaguuugagucaaaucuaacucuuguccccaaccccuggcaacugaggcacaacauagaauaauacuagagaaguuuuuuuuuuuuuuuuuuuuuucaggcaaauaaaaugacuaaacaaagcgagcagccacugaucuucaaagaugaacaucaaagaaaacacuagaagauuuuguccuccacgccccgccccccagggguggaugaguaaguuauugcauuggggguggguaagcuauuggagaggguggcaguaccuuggagguuccuguguaggucaaggcugauucguggaaagaugcccucuccguacagggugauguuuucugggaccaggugggcgaucuguaucuggaaguuucuuugaaagaccucagguauuccaggcaaguaguaaacuuucaauaccugcuccuuauucgacuggauaaaacccugcaugauagcgagaccagagagggcgugauggugugccccggguucaugcuucugaugggugguuagaccaugguuacauggugcuguaagaaaaaacuccagggaagcaggcagccuaggggcgggcacugguagccuaggggcggagacagccuaggggcggggauugacagccuaggggcgggcacugguagccuagggguggggacagccuaggggcagacacuggcagccuagggguggggacugacagccuaugggagagcacugacagccuaagggcgggcacugccuaaaggaggaauucgaggaacaaauaaaacauuucuaaaguagcucgauucuuucuuaaugccuaguuuuuuuuuguuuguuuuuuuuuuuuuuguuuuuuuuuguuuguuuuuuuaguucuuuguauauucuauacccuaguccucuaugggaacgagucacuagcagggaugucuucccacucugugggcuggccauccaauuacuucacauuuucuuucuacauacagaaacuuguaagauucagaaagcccguuugcccacggaugcuuuuacuuccugugcuacuggggucuuacucagaaagcucucaccuguacccauaagcugaaaugagcuuuuuccuuuagcaauuuaacaguaccgggauggccuugaacucacagagaucugcccgccucugucucccagugcugggaucaaaagugugagccacugcccccugccagacacuagcaaguuguauguugaggucuuugauccauuuaggguugaguuuugugaagggugagagguaaggaucugguuuuauuuuucuaccuauugaaauccagcuuucuucauaccaguuguugaaggcacuaucuuuccucucaugguuuuuuguuuuuuuuuuuuuggcaucuuuguauuaaaaagaaucaaguaacuguauuuguguggauuuauaccuuggcuaucaauucuauucugcugaucucuguuucuguuguaauuuuuuuuuuguccccaugccguauugcuucuaucccucugacucuguaguauaauuugaaaucagguuuggugauaccaccuguaggauuauuuugguucaggacuaaaacagggaaaguucuuaccuuuguaggucacaaaggaagagcagacuaagaagacacacaauuuuuccuucuuaaccacagggcugguaaaguuuaccaaguuuuggugagacccugccucauaggaaaugcuuauacacuucugcugggacuuuaagaucagugcgcagacagggaaacuggagaggucgguguaauggcacaguaacagaaucccagcccucaguggagacaggaagauuuuaugaucaaggccauccugggccaccugaaaagacuaaacccagcacaaggaaacagaacaacacauuuuauauccuuacauaaagcagaccguaacauagccugugaccuagcaacucuuggcagaagucccuaggaaaacaucuaccacugauuguucaagggaaaaugcauagcagaauuguuucuauugagaaacuacugccuaacucacuuucuauaagcaaaugugguuucugaccugggcggguucaccccuccuuaggcaaccugguggucccccgcuccugggaggucaccauauugaucuaaacuuagugcggacaccggaucggcagagcacacuacagcccagaacucaagugauccuccagucucagccucccgaguaggugggacuacaggcgugugccaucaugcccagcauaaaugugguuucaaugggagaugggaaacugcuuuuaauauggcuggaaaaggaacauuauucaguagugaaaaugaauggacugugguuaaggugcaagaauagagauggaucuuaaagaucauaaugcuggguauaaaagcaagcugcauagacuacaucuaacuguacauuuacauugcuuuaugugcacuguagguaugccucaugcugguggagacuagaaggcugcaacagaguccuuggggcaggaauugcagaugguugugagccaccauguggaugcuggcacucaaaacuagguccucuggaagagcagccaguucucuuaaccccugagccaccucucuagccacaauugugcuguuuuaaaauaaaguuugggagagagcaaacgguccaggagagacgccccaggggcauuuuauauaguuggcugcauacaucccaaaccauggauccggacaaauguauuagcuacgguccagauuuaacaaugguagcucacaguuguugugcuucuagaguccaacgcuugcuucacagauucauuuugugcacauaagacaguuacugaagcauuaggauugugggcaaggugaaaauaaaccaguagguuagcagucagaaaguggguaugagugccgcauagcuauaaauaacagcccagaugauguuacaaaggugaguggaaccucacacaggaaaguccuacuggccacauucuagccacagaaguguuuaugauuccuucugcuucaucucuucuuauuuauuuuuuguuuuuguuuuuaauuuucgagauaggguuucuuuguguagcccuggcugucuuggaacuccggauguagaccaggcuggccuugaacucagaaaucugccugccucugcucccaagugcuggaauuaaaggcgugcgccaccacuguccaacucuucuuaauuuuuuaucucccccucucuuuuuuucuaucucuucugucucuguuucucucucucucucucucucucucucucucucucucucucucucucucucucucgcucacucucccucucucaguauguguguguguguguauguguguaaguguguaagagggcaaccuggggugucauuccucacagcaugcauguugguuuuugaggcuuggucucucacuggccuagaacucaucaaguaggcuaagccggcuggccaggaagcacuagggaucugccggucuccauuccccagagcuaggauuaaaguguguacaccaccuugcuugugccccgcccccaaccccuguaugucaaagcccagccagcuacaaagggcaccaugggcagucuacaauauucuccuguuuccccacugagccauucuuccugugcucagugacuggggugaggggagccuuagcaucuaucuccauugcuuagcaauguauuuucccaguaaaaacaguucucacgcaaucgugagccucaugccgggcaaauguccuuauuuuguucuacacuaaauacgcacggccaauucugcauucagcaaacauuuguuuucaugauaagaauuuggcuucauaauaggauagcuggaauacagggaaagaaaaccauacagagaaaaucccauucagacaugaagagaaguccgagcuagaagggggugggugggugggucagcauagcagcuucaaggcccuggaucccaggaaguccucuugcaaggcugacuuuugguuaguaucugggagccaaaguucuggaagguucuugcccauucccuaauggggcuuucuuaccuugccuuacuuguguaaacaguacaguuuaugucaacuccuugcuugcuuucugagggaauuuugugauaugacaggcagaagcaucuaucugacaaacuuccaauaaaaucuuccagcagucucuagugagucucccuggcuugucucagguuggcagaguuuauuacuagggguggagacugggaggugggggcugagaugauuaaucuucaucgucuacuugacuggcuuuagagucacuguggaaaaaagcccgccuugugugucuguggagguguuuucagaauggacacagcuugaaugugggcaacaaaugccuuacaggcuggagugccagacagaauaaaaaggagaaggcaagguuaguaacagacagccaucucuccgaugcuuguugaccguggacacaauguuaccagcugccucaggcuacugcugcaauguggagaaucagaggccaucuuacaccaugacggacuacauucuuaaauaagcccuuccuuccauccuucuguccuuccucccucuaucccucacucgcuccugcccuugaccuucugccugcuucauucccuugcugcuuuugcuuuguguccuuuggugguaaugaaucacagcgagggaauggcucucuggcugaguccaaggcauuauagaaggugucugcgggauuuggacagguuuggcuggucguucaggaggcagucacuuuagcugacaaaccaucccaggugacagaaaggagagaaacgcacucacaucuuacacgagucuuacacuagugaagcauagcaugaagagggaggguuaugagccaauuuucaugugcuaacaaacaaacaaacaaacaaacaaacaagaagagcucuagcugauauuuacgagcugaccagauccagauuaugcacucacaugguuauauuuuaagguguagacagcagcauauaaugcaguguccccucauuuccuuuucucuuauacccaguagguauuagaaucaacaccgcauuagcgcaucuagaauugcagcgucccuuguaacugcuguauguuauucugccacacuguuuuaauaccuuaguauauucagucuuaauaccuugggagauguuuagcuuguuucuguuucuauauuggcaucacagucuaugcagacaacagucuuauucacacuucaucuuguaaaucugggagcguguacuuaugauaaucagaugaggaaaaguuaaccaaagaguaauccuaauagauuucgacaauauuuucuccacaggguugcaucaguucacacuaacaacggcuuuguaaacccaaaugcugacaaaggggagcggaagaacgagacaagaaaguaauuagaaaaagauagaaaaaccaucuggcaaacuuuuauagagaaaacacgaggaaggcaacgaucccacagaucccaguuuguaaacuccgacgaugcuuugugagcgagcaaccuacaaagaggcuauggcauaagggaaggcgagcagaaagcguaauggugagacccugaagugcguucaaagcagaagccauuaaagaugagaaggagaccacuuaaaaugggcaaaauguggccugugaagaacauuuaaugggaguaaggucuuacgugucaacccagaaaugcacguguacacagcaaaaaguuuccguauuuauaaauauuuaaaaccaau

SEQ ID NO: 4779 - RNA, 101836 nt, Mus musculus
ugauuaaggauucugugauuucuuuauuggggcagggauggacaucauucuguagaggucuuugugcuggccugugugcauuuccacacagauguacauaugcacacacaccaugccagugcucuggggccaaggucaagcucuucucacagacagggauuagaaagaggcugcuucuggauucugaggcuguagucccgacucaggagagaauccaucggucccaggacagaguguagcugacagugcugggguccaggugcucugcugggaggagcugaggcugacagagccaauaccaucccccucccuacccuggcuggugguuggguccagcccugcuggaggcagguucuuaggcuccuuguggccucagcuuagagacccugagugcuucuuaggccacuagggcccuuuuccaugcuaggcacaucagaggauaacucugcgguccaggugauccccucgcccacugcgcuggugucuuacuuccaggugcuguuucuggacuuuuucaaagugcugcagcagcucuguguagucgaugcugggggagucaccuuucugggacuugggggccgcuuucagacagucucugggaagauggacagaagucagagucagugucugcaucaugguaggugcuggugggguucagucucugggcaccugugggucccugcccaagacaucuucccagcagccagacccauagugcuuagggucccauguccacccccuuuccugcagcuggugggaacagccaacccgcugcuuggaugucugucggccugugggcuguugauggcgcccggagcguugcaugggggagcacuuccuguuuaccaguggcucccuuuagggugagagccagggccagcagccagccaggaaggcagcuggggccuggaacagggucuggggagaagggggaggcgguagcccagccuuuucucugugguauggcugagacugcagacagcugggaucggugaagucucucuguuggaccuauaacuuggcaggccuugggucccaaggccugugaucacuaccugcucccagagaagagcuugucuuaccacaggacaugcugacccaccuacacuccuuccaauugacggaccaauccuguagccucucaucagcuggguuuagcuugccacccaggguccagucccauuccuaacuguccuuauucuguuccccacacuccauucugccucacuggcuuagagcccuggcaaaggguuucaugaaggcugugaccaacucggcugagcggacucccuggggccucugggugggugaagaggcugacugaagcagaggaaauaggauagcagaccuggccuagacaucugaccuuacacacaaaccuccauccuagucuguaagagguugccacaggagacaugucacguccccgaguauaagguucccucccgcugugacaugacagaaacuugccuguguccagccccagcucagguaugagauggguagcuacauacagcucuaccacuccucgagcaggcagcccagggccugguacacuuggcugcucugucuagagcucccacgauggcaccuuccccagugagguuggccaagugagaaaaaccaauggcuuuaagccugaaggcacugcuguggccuguugaauuucaggcuaggagcagggcacaacuacucccagaugcagcuuugggaaccugagucuaccucccacacccuggcccacacugcuccuuuccucucuugaggagaacacacacugccugaaaacaucuuagauagcaucuguggccaauguuuuccugggccuccagccacugccuccugagccagggcuugaucacuguuggcuggagagugaaaguggccuggugaugcccacuugguugucauuuggggcuucugcugcuggcugacucccuugggaaugagggaagggaccucucuggcccagcagcuacugguagaggugccgcuguccuggagaacaaccagagggggcagagggacuuagagcagguaguccuaggucccggguguggcuagcuguuauccaagucauuuaaccugggacggggugggaugugugcccaagagucuacaugcugccauaacaccagcauuagcgaguguggggacaaagguccagaagggcuauuacgaggaacugagggauguucucauuaguuuugcuaacuuggcacaaaugaguuacuugggaagagggaaccucaauuaaggaacugccucuagcagucuggccuauaggugugcacguggggcacuggccuauaggugugcauguggggcacuuuuugauuaaugauugauguccauaggcaggugguccuggggcaggcaggcaggcaggcaagcaagcaaaacaaaccuacagagcaaauaaguaagcuacaauggccuucuuuacuucagucccugcccugacuucccucaguggcuggaccauuaccuggaaguguaagaugaaauaaacuccuuucuucccaaguugcuuuugguuaguguuuugucauagccauagaaagcaaauuagaacaaaaagauaccgaggcuggggaaacagcuguaucuugcucucuggaaccuccuccaugguagggggauccuuccuagccaucgugaccagccuugcugcuugcucaagucagcaucucauguaccucaggcuggcuuuuauagccaagagcacccuaacugaugguucuccugccuucaccucuccagugcugggacuacaagcaucaucuccucccccaccacaauggcgugcuuucucccccacgcuacucagguacugggugacagggauaccuggcggcaggguggaagguggcacuccccugccauuuccuguccaucuaccaugagcuuuucuuucagaggcuccuucucuccgcacucaggaugguuagaaagccugagaguggcccauggccccaacccuuaguaagaacgcagagggacgggucgugaauguggaaaccuccccagcuguucugcuugcaggcgacugccugccugccagcugccugccccacccggggcuggggcugcccacaaccccuuuccagagugugagcuggcccucugcaccccaaccccccugaaaccugacuccuccuccagcugucugaugucccuucccuccuacuguauccauggccgagucuacauucaacuuucucaggucccugcagaagccagaaagcugggaccccccaacaccuccugccuauuuaguacacauaugcacagaccaagaaacugggagcccagagaggguauugaaucugugugaggccacauagcagaucucauuuuaggccugcaaccauccacugacccacauuagagccuucuacauagaagacucacuccuuggacucaagauuuucccgaggaaacccuuuuaccuaguuucuuucuggggauuuaucuugccuugacucggacagccuucccuaccuuccucagacaagauauugccagaagagcccugagaaacagcucugggaagcugcaggguuucuggccuggccggaggccugccccagggcaguguccuuccaggugccuucuaccuuccuccucgccucagugccuccuuggauauuguagggucaauguacaaaucaggcugaggagguguaaugccaccuuaagaucuuccuacuuucagaagcaggauauaauccauucgggagggauccagacaccagcccaaccccacaguggugucccugaacccuggguguauucaacccaccaaacacuucagaguucacuugguugacacccagagcugacaagacacagucagcacaaggcugacugggaaagcggcaggaagggguggacugggcagcaggcagggcagccuauaagguugguuuggaagacacagggucacagagaccugaguacagcaggcugauccugaggcugucugcaucuacccuaaaggcaaaugcccaaggccuucgcugcagugaggcgccaggccugcugaguggcuucaguggccuaggagggaauucuagacacacagggcagcugaugcaagcugggugcacuccauucagcguaaaucuucucaguggcucugcuuguuuccauggugaccugacaagugaaauuuuccaucuccgaugccaaaugccuguggaugaggcaaagccuccaaggguuaccaaauauagacacagcccaacaggcuguggggccagggccagcagaggguucagggugggagcuuggaaccccuugcuuagagggugccagcuugggcaacucaugcucuuccugagagcagguuccugguggaguagagcagguauauucuuguuuccuaauccuuuggaaugauggugggcagguccugaugaugugggagcucucagagggccaaguuugagcaucucauagaauggaauagcaaggcaucuaagccugugaggugcccaacucugggcucuaucuggcugucugggcucccgacuuacuugucaucccuagagcuccucucuccagggacuucugcuggggaaaagaucucacacuuaggccuggucucucuaagcucccccagccugcuugggaaaacaugccuauauauuucugcccuuuaaacacucccagaaccuccauuuugggaucugcuguggauuugaagauaagagaaagaacuuguggagugaacaagguuaaacgacagagagguaaaguagggcccuggaucucccauggaacgggccuggagggcagugccugaggcccagcacucacucagucugcagcagcucaggguugggcacacacuggagccggugagagagcagcuggaaggcacugcucuggggcaacagcaugagcaggccguacagggccuugaucagguauggguuguucuucacguccagcaguugcaggcguagaucugcagcagggcagaagucaggggucaggaauccugggccugcucuagaacacacuagcccagaucccuuccucagccgagcugcgaaagcacuggaagcaccuggaccaagcacugcuaggcggagacacagcugccuacgagcuaagcaguugcuccuccacaggcagccaggccuggggcccuucucucagagaauuuuagccauuuuuaugccccaauuuccuccuacccauccauuugacugacguaccuagcagccccucagccugacgucccugaaccugcugcuggguuaagccuaccuuccccaggcucagcugcuuccuuauaaugagggcugggggcuugcagaguaacagauuccccaguuggcgcugcacgugccagcacgugagcuauaaauaggaugagcuagagagaaagaguggauuagggcuuugcuaacggaggguggaugggaaaaugccuuuguguguagugaggcgcacaccaaagcucagaguguccaggagauuugaauauccaaguuagacguagccacuuaccaccucagcccuucaagggcaggacacucucauucucugcccagcaucuaugucaauccuagaagucugaaccugcuucuggccagcugcaccucaucguggcuacggccugcccaaggccggguagggagaccggauugcagagaggcucuccuuccccuccugggccucgguaguagcucugcccacaucuuaaaccuuggcagacauuauuuguagacaaugaggcagagaguagaccuuucagagaggagaccugcaucuuggagccuggucuugccucccaguaggacaaggaugaugcugggagccugagcagccaggccuuggugccagguggcagagaacucgguggcuucuuagugcccccucuuaucccaagaggcagaagucauagcaccuaugaaacuguaacauucauaucugauauugacccaaguuucccagcauagaacuccuacaguccucagagucucuaaaauagccuuucaugcugauugccaauggccaagguaaaucaaccaugcuuuaguaacgaagcuuccauaaaaacucaggauuacguuagaaguacacucuucucuuccuccauuuccaccguaguguaucuuaacaauugcgcuuccuagagcucugugagacacucaagcaaaguaaucaaaccuaaggucgugugugagcccugauguauauagcugggugcucagaagcccagggccggugagauuggaugcuggcuccaggugggcucugaagacuugcacuggaggaugcucagccagcuggaggaacaaggagaagcaucugcugggguuacagacgaguucaucugcaagugugugcauagggagacuuuuuguuuuguuguucaagauaagguuucucuguguagccuugggucuguagaacaggcuagccucaaacucagagauauaucugucucugccuccugagugcugggauuaaaggugugugucuccacugcccggcuaggaaaacuuuuuaccauguacacagcuguggagaagccugaaccuacuugcaguucuuucuucccgcugggccuugaggaagcuugguuugcuuagcaucuuugcugucgucggugccuccuccaucuuauuccugaggaugagcugcuuagggcuucuucuugacuagcuuagaccugccuucaagugaauccuucuacccugaggggcucucaggcagugacacacuaggcaagguaggcuuuggacaggcugaggucuuucuccuguucugcugucuccagggccugagccauggcagcaccaguaggugcuuagaacagcugguccuuuaaaugugagggagcuggggaagggggaaauucuugagccccugcauuuguuuuugggucccaagguaaaggcucaucacucaggucagagaugcugccaaggagcaaaggcccagguggccaucuaggcuaggaagguggcuagagccagggcugccucuggcuucuccacuacacuguaaacacacguguguuaucuggagugcugccugcuuugaggagcaggcgcugcauguguggaggcgccaagugcugugcuugcccaggcagccgcugcuucugcacauuuagccuggguguuacucaccaggcaguacucgcccaguggcuccuggcacauggcggcuccugggcaagccccagagggucagggcagaggcagcaggcuggggagggcaucgagggacagcccauggcaggcucugguuuaacauucugauggguuucaugucagcacuggccuguguguaugugacccauuuugaggaaacagacaaaacuaaguucugaugccacggcccugucccacugcagcuggcccuuuaucaccaauugccaccuucucugauacugcauucuugacauucuagaagacuucugggugcaucgcccucuuccccucuccgagcugaguuaagagugguauccgaaacuggcuccauaccucccccucugccuccaggccagcagaaggcaagguagaucuauggcccugacaggaucuuacauguaaagauggggcacucaauuagcugcacgaguuuguccaccucugugaggaaauccacugugacuuccagguccccacugagugggcagucaaggaaagucuccuuauugggagugucuuugcccaaggaguggcaaaggacggauuccagggagucuauuugagcuugggcucagaauuccacgugucccuucuccagaccugguuuccagucuugcaaaguuggauuuagcacaugaaggacauagauccucuaacugggguguggcccaacugcuccuuuugcaugggugcuuggauucugccccugaaguggaccucugucuaccugggcccaggaagacacuuacuguggcccugcagcuugguuucugccugagaggacagcccagggaagcuuagaacuggccagugggcucuuaguaucugggucacacaaguggccaagacaaacagccucaggcugugaaagggugccaggcaagaacacuuaacccuuuccugaagccuuccuggcccuagcuucuaucucaucacagcaggaaggaagucuuacuuccugaacacuguucugacccuaggucauaaacagguucaaaggugagguuguucugacucccagcaguagauuaaaagaccccucugacuauggaugccuuuuggugaggcaggucauuaugcauccuguguauguguggugggcuccuguuccuucuucaaguuuccaaaguuaagacaugugaaccagcccugccugcagguuuccccaguauauucuuauaccgaggccuuuuccauccaaaaagaaaaaaaaagaguugugguggaggggcuagcaagagagaccugucucuuuccuaaggcaggaggugggccgcaccucagccggucuccacuccaggccuaccuccccuucacgaggucuaaaagggucuuuaggaggaguugaugacagcuccuuccugaacacgcaccgcaccgcaccgcaccacacugcacagcacuccuggugggaggccuuggugaugucccaagcccuggagguggccacaggaaauggcagcaaggccacucuuggcccucccugggggauggaugacaaugagaggauacaacuucuggaugaggucauaggcguggcgguaguucugggugaggaagcagagggacacgguggugacuggguuguggcaccaggagcgguacaggcagcagaagagguucuggcuuuccugagggagaggcaaaguaguuagaaggcuuggcucccugucacugcgucuacacaggaccugaggaggaaggaccuugaggggcugugacauggggcucuuggggccgcugggcugccagcucagcacugggcuguguuuggcagcccagcugggaacgagcugucacaaaggaaaugcugacagcuccuuagacccugucauuaccuccuggccucacagagccacgugguaguggcagcaagggccuagucaaaagugagcccacccuuuguaagcugccacuggcaaaaugacagugauugucucuuggaacucuguggucccagcgcccaggcuccucucuuaaaccccagcuuccccuccuucccaccaaaguccaccccaugcucucaguaccaggaaacccguccugcagaccagcccacacugagggagccccugagccugaggaaaauucuuacggcuucuguaaaugucugcagggaaccacaggaggaaggcagggcuguggccugaucacugcaaaccacuuggccucagauguccuuacagacaugggcuuaaaugcccucgagacucccagaaagagguugagguagggucaugcuaggcagggggcagagggagagugacccacgccaugacuggaaaguaagccccuggcaccaugauggcgcuagucccuguaagcugagggaagcccagaguauuggcuuucuggcaauugcucugcucuuucugaccaaccuuugggcacccuuacccaaagccugggacaggaagcaaugaggugucaugcauuuugaugcacuuaugaugacaggcauuuuaugagacagaugcguccagcuggaagaggggccagagcagggaggaacacaaggagagcaauuaacccuuuguuuuccaggaauauuucaauuuuuaccaugagaaagggacuuugcuguuuccaaagggacagugaauggugggggaggaacugggaagacccuguggagcuggccuugggcugugaagauucccuguuuacccgucuccuccugggagcggcugaggggugagcuggcugccuagugcugggucagagggaguaccggggucugcagguccuugagcugguuccucagcuggaagagcucgguggaggugagcaggaugguguugagggugugcaccaugguggacgcgaacuugagguccuccucccgaagcaggaugucugccauugaauggaagauguucucugcauucagcaggaggcagagcugccuggaaaacaagccagcaaagguuacacccuggaggcucuucaggguccuagaggaaccugagcuuuaccaggacuauagggggccucauggcuaggguaugcaugggaaaaggaccccccagggguugcggcggcacacugaagaccccuuuacuucccaauaucaccuaccuugaccuagaaaccauggcacacaagcucuauuugugccccuccuccaucagaaaacugucaggccucuggauaggaggaaugccuuccugggauuucacauacagcaacaagucuguaaguuauaucauaggugucucccguauauaucaacaaugccuccccacaccaaggugguucugcccaucuuggaucuuaauucucucuagacuccaucuucaucugagaaugucuccacacacaaggaagucucuugggcuaagaaugcgcugaucacuucuggccuagcuugaagggauaugugcagguuguugggcccagcggcacuugugggcuaaagugacccuaugucaaccaaguggcauagggagguaaaacaaccggaccauagaggugccuggcuccaccggccucacacauuucguaguaagagccuugggguaagaauugggcuuuaagaaugaggcucuguuacagagagguuccuagagaaugaggaaaagcagguuucccagggucccuggggcaaagugaaauaacagcagauugaacacauccuggggucagacugugaggggccuguugguagagcaggggugggcaaggggcagugagcagcuaagugugucugcuuauuggauagacuaguggucaagguaacuuguccccauggucuuuggugugaggcugauaucuucugccugccugccugccugccugccugcccuuguaccagggaagcaacaccacagaacuagacaaggggcagaggcuucaaggugcuguguacugagcgccaugaacacccuaugaggcaccacccugugagacaccaugccucagagcuaccucuugugugggacuugaucaaggcugauuucuuguuucacugugaacaccagccauggcuuugcaaguagacuugagacaacucugccauaccccccagcugcagccccagccccaaaccccagagcacuugguaacagagagacaaaaccaugaauaccaaauguguucagccuagaucccauggacccagcaggcuugaccaugaaagacagcuaaaugagguggggauggaggugggaggagccaugaacaagggguuacugaaucuccacugcacagccacccaggugugcauccauggccacuccuauguggaugggcaaaggccuugaagcccuguagucucaaacauagccaggugaccccuaugucagcuuagcaauuuauuccuuaaaugggggcaauaccugucuaaaauggggggagcagccagaaggcagcaguccgauguuugguguauggcaccuggggagaagagccucugugguacagaugacagccagcaggcaggugggagccucuuguaggacucagacagcacuuccuauccccguccaccccuggaggagccccgucuccaaggccaugggacagaaauguucaaaaagggcaggcugggagggaguacugacaaaugacugcaaguguccaucgcccacagcugccgccgccguuuccaugacagagagcagcagcugaauggcugccaggcagugcuucccaaggaccccaggucagccuggcugggaugugcagaagccggaguccgggguggcacucaugugugcauagguuagggaugguuuggacaggcaggcaccguggucuccugcugucccagagaaccugagaaugcugacggucgguuggucgguucuauaggucacggggagaguuuucuuguugucacuuguuccucccuaccucacccaacagccacaucccucuuccucuggucuuugucuuccagcgggcuccagucccaugaauauauguucaaaguggcuuagagucagugacuuccacaugagccucauugaagggacuccagaggggacagucccuguggaugucucccaggcauuuggagcuucacagggccacagugcaacucuuggugucccugcagaucugccucccugcagcaguaaacaccauuacacugcugacccggcuucauggucaccagcuuuacggucaccagcuccucacccccgucuggccaugcacuuggggcuuugcuuugguaucccaccucagucucaucuccucugggaaugggccacugcccagggaaaaagucagccaugucuugcuggcucaauccuaucacaccccucaguccgacuuccugcucauuuaaaaaaaauuaauuuuaaaaauacuuuauuuuuauuauuuuuauugaugugucugucugugacuuauuauagaugcccauggaggcuggggaccucagacuccccuaggguugcagaugguugugagaugccuggugugggugcugggaaccaagcuuggguccucuggaaaagcaguaugaacucccuuggcuaagccuucucucucuagcuccucccacaucagcucugacaaaucuaaaaggcacacccaagccagccuguccacuucuuagggccucaucuauggcuucuggcuggaucuacugugaagccuagcucuugcugcuaagcacaaaaucucuccagccucagccugaacauccuuugcuagggacaccucagccucugggcuggcuuucugaugcggaccucaccaccucuguuaugcugacugcuggccacagaggucucaaguccauuuugcacuccggggaagccugggugugauuucuuucagcgcgcuggucacugugacugugcuuuugcuaggcugcugucucucacacuagaauacgagcuacaaaggcaaggucuugccaacuaagaaggccugacucacagcaccugcuccaucaccauggcuggacuuuacugcacaaagggaccgugcucuuuuugcucaaagucuuccuguacagaggcugggauauggcucagugguuacaguauccgcuaugcagguaaggaccugaauuuggauucccaaaaugcaugaaaaugccagguguguguaauagccucagaagauggaaaugaaauccugagaguaccuuggcuagacuagccauaucuguaagcucuggguuugaucaaaaaaugugccuuaaugagucugauggaagagcuacugaggacaguacccaacaucaaccuuggacucuacacacaugugugcacacaugcacacccacauaugaaaaacaagcccccucuacacaugaaaaauggaaaaaagaauaaaaggcucacagacaggccuguggagacuacuguccccacuugugacacuucucggcucacucacaggcaggucgaaacaugcuguaaaugcucuggcuggcagagaacagacaucuagacuugaacuuaacccuucaccaagcaugccaacccagagcugccccacccugucuccugacuccccugggaggccaguccauccuaggaugucuccagagccuguacuuccauggcacccccccacccgcuuugcuaauguaaugaaacauccaaaucuauagcaagagguuucuuuggcucaugauucuggggggcccagugcaagccugaaggcucccugcuguugggucuuugucaaggauggacucccauguugggagcacgggggguggggugguggugguggagcaaaaacacuuccaucagaagccaggaagcagagagagacugaggucccacaauccccuccaagggcauguucccagugaccuuccaacaguaccacccuggggaccaagucuuugucucugggagguacuaccucuguucuaacuacaguaucuucucaccagguguguccuuugugaaaggccauaguggggaaugggaagcugggaaguggucccuagagggcaacaguggaaguccugccaagaccugacuuucagcccuccugaugcucugggcaucugaugauaaccugggggacucucuggccagcagcucccaggacuccugcugggguuguuucuaguccuucagcuaggacucgugauaaggggaaggaagccgagguggagccacugugucagaaaggcacagacggcaggcaggacccuacagggcagugcagggcagggcaagaggagcagcucguguaguccacagugcucaaaugguaaagugcuuuacuuaggaagcaaaugcuacaggaggcaagccugcacaggagagaacagaacacacacugagacacugagagcuuuaaggcagaacaggaugcuuguagcgccuguuaggaaggagaggacggauaaccuaucacaggacggcacucacagccacagauuccaugugccuagccauggagugugagcaaggucuuccuguguggguuuuuuuuuuuuuuuuugcaguuugcagagaagaguugucuaaagggaggacccacgcugcuagugacacacaugauggggagggggaauggagacuuuagaagcaggacccagcuuucugcccugaguguguccccaucacucggccucuugugugccugucccugcccacgggcggccuggcagauggcugccuugcagggcugcugcgucaucacuucucugcugagucccagcccggcuugagcugccugcuuggcucucaagcauagcgccaauaauggaacacagcuugcaagcauuacacauuugcccauauuuuuuaauacccauauuaaagugcuauucaucaugagacaauggccuggaaagugcuuggggacaaggcagagagggggcaggagggaaccuaaauaggaguguggaggccuccuaugcucaaccagacauggguccaugucucugucuaucaguaagaagccauucguguggggcuaugaccuaggaaauggcaggagguaaauggcuagugugugugugugugugugugguuugggaaggaacucacuuggaggcaaugggcuguugguucccacuggggcucuaugccuaucaggcacagcccagaaccuuguggaugugguuuuccccucaccauuuagugucucugggugcucucuaggugggugauggcugcuuccugcuccuccauuggaagucucuagggcuuucaagggagcaacugaacaccucugagacccaugagaggggcugucacuuuccggucagaguugagacaauacugcuuuguccagagaucucuggagggcuggcgucugauggaggugcuguagcauaccugccuggcugcuugugagccuguuuaucauauucauuuaaaccaccaccuuggucaaacacuugagggaagcuccauccuuggacucugguggaagcuugggugccccaacaccccuacccucggggacucacucacuagcuccaacacuagggaauccugccccacggcagcugggagaggucucgcuggcuuuguagugccuugagcccuugggugacucuagagccaucaguuacucuauguggcuaggacagacaggagaaagcuugaucuagagcuagagaggagccaggcagcaacagugguuuuccuccagugugccuuccuccugcagaguccucccaggcaagcugaacuccgcauguggcgucagaaauguccugaagggccccacuccugucuauccuuccaguacaagcuagcauaguugcaaggucaaaugagcccuccugcucuguguugucacauauccuucccaggugccuuggccucaugcuccagacacucaugucggccccuucuuggauucuucuggcuuuggcucugagucuuguaagggcauguugcuaccccaugguuccuguggccugauuuguuuuaucacagcgugagggggugguggcacugacauaugaccugagggcagcuggggaggggguuaugccaaucacugggcaagcagacugcuguccaccucucuccagucucacccugcuucuucaggccuggccucugaccuccagcagggauauuugguguguguggggugcucugccugggaggaagggagaggcuccagucaauguucucccagcagcugggcagaaggugcgaaccugcagggcauugucaggagccaagccugggcgagugggcacagguagggaaggguacccaagauggguaaagggaguuuggggaugacugaucuccaggcaggagucucagauacucagauauacucagauacugucucaaugucaccauacuaaaauggccacuggcagagugcugacagcuggccugugggggacacacucaacuacaaaccugcugagcaacgagacagcagcugggcgcccaccguccuuccaccacagccucccccaauggcuauuaauaacaugcauuccugcucccacucucaccugccuccaugcuggccggccagugacaggcagaacacucagaguaaccuucagcuggcaggucucagguggaggaggaugucccagcucuuggagaucuccccuaacccuguccuggcuccugagugccuucccucuguuacacgaggaccaggcuuuagauaauuucauuggguacuuccuguuacgaacggcucugcuuggcacaucucauaccuaagcggaaauccccagcucagagcaccgccugguuugguucuugugccuauuuuuauagucuggcaucagggcuguggauucuuucugccucucaccuagguccagagaucucuaguaggugcccucaaagauaaccugggcucaaagugauaccuucaagccugccucugcaagaugggcaagggcacaagcuccggggucagugcucucacccgagggcagggcagagcccuccaucucucccuucaguucagccuccuguucagugcuuuccuucucugggccuucauucccacccacagcagaaccacacauggaggggauucuugcuucuucucuacauuggccacuaccugauuuucaucuuccuuuaauagcuugaggccagggagacuggggggucuggauacuuuccuccagagucuccaagccaacaaaccugggugcaaccuagcagcaaggcuagaaaacgcagaggccagagccauccccagagagcagggccuauucucucccugccuaacagcuggguuccuucagaguuuaaagagaaagcgacuucuagucagaagccagaagcuugggugggaggagugggcucucagccgagguucagaaggcucuagagucccagugcucccugcuccucccccauucccuuccaaccccccuccccccacuccccaaguaugaaaacuguaaaucuguuuuauuuccaucaguccuaggcagugugccccucagggcaaagggagccgcgguaacucugccaacucaugccuuaaaaaucuaucggguuuaaugcaguugaugugucugauacacuuaaguuucucaggcggggaaggaggaggcagcagcaugagggcuuguuuuucugggucuugcugggaguugauggaaaggggacagaagaugaagugagaggaagaaaggggccuuuuguccuccgugcuguuugucccucaguucaauagaagcuccugccaggcuggaggaagaguugucauagacaccugggugggcuuaccccaggauggucucaugagggugggagcugucacauggaagcugaccuuuugcugaggcagcagguccuuacucugagccugcucuaggcacugaaguuacagggaacagugggagaggugacuucuguuucuuccacagcccagguggaguucaggaggcucugcccuaggaaaagcuccccagaacagaaguuaucuugugauggccagggaccugcugggucuuauuuuccacauuuauuaaaugcuuuucaaggcacacccacagguacuaccugagccuccuuugggcuuuauucaagcauccgcuuccuuguuagguuagcuucgcgcucuucuugucguguuaccagccuguuccuaguaucccuucccagagcugugguuggcccuucaagaucaguucuagcuccuucuugggcauacagauuucucagucaagggaggagacuggaaugaaggaaaggauacuugcugguguggaauucagccugccuguggagcuccaugcugagaggcugucucagcuggaguuucuacugccaugaccauaaacagcgcaggcaggaaacgguuaauuuuuuccuacagcuuguaguuacuaaccagggaauucagggcaggaacugaaagcaggaaccuacccagaggcugggauguggaggccauggaggagaaccacuuacuggcuuguuccugguuuaaucugcuucuuauaccaccuagaaguaccagcucaugaguggcacugcccccggugagcugggcccucccacaucaaucaccagucaggaaaaugcaccacaggcuugccaaccuggcagggggcauuuucucaagcgagguuccuacuugcaaaaugucaaguugacauaaagcagccagcacaggggccuagggguaaaauggauccggagugugcucagggaguuugugagguacuugguuuugguggcuauacuuucagaggcugcauaggugucugauucagcuagguuugcguuacugucccagauaagguaguaccuuaucucuuauauaaagauaucccucagaauacagauggaugcaggucacaaaguaggggccugaggcagggagagaugggagauacccugggccugggcugagggagugccuugguguugaagacagaggcagcacacagaggacaaggcuggugagcaaggagaggaaaugagggcagcucuggcuccugccugaagaccagucuucuuaacuccugccuucugccacugugggcauuuucucugccgcguccuccauuucuuucucaguggccauaaacaaaggacagcugguauguucuugacaucaggcagucuuugugugaaaaugcuuuuccauguacacaggugucacugcuacacugcccuuucuacacguggauacagauguggcacagagcagaggucucacccucauccagguccagguggccauucugcccagcaccaguucucucagcugcuaccucacuacacagccaacccacaggcccagauggcacaaggcacaaccuggaacuugguuuacaaggagauacuaaggauaguucugcuguaggagccacuggagcccuuuuaauuaacuaacuaacuaacuaacuaacuaacuaauuaauuucaggacacgcuaggcaagagcucuaccacuaaucugccagcccacugaggccuucugagcccuugcuucccagaagcuccugccccacagucccaaggccguguagcugugagccacccuguacugaggaccuccccuguggcagugaccacauccaguugcagcaauguuggcuuggaauccauacuuagcaucaguugcuggggcaauggcuuguguucaggggccaggaaaggagcagggccuagaaacugugugcacagcucacagccaggcuugaacucagaucacaggagagguuaacagaagugacuccaacagcagguucccagaaaccucugucaggggucccaggccagcugcugccuaagguccagagugggggauuuuagaauauuaacuucugguccccagggagauauggucaaaguugccauucugcauccagggcugguacugccagggaaacggcacccugaguccuaaguucccuggagucuccuuggugauuauccgagagccauugacacaacugcuuucccucugaagcccucugggcucugaccuucuuaagcaagacuuuguccugagaacaugcuaugccuuccccacagaggugcuugccugugaagaggcuacccagucuggcaugcugcuucuggccucagaccuuccugcugaauauaucucugucacucuccagccuagcacacacgcuccaacccuuacaggacagaagaaacuuaagucuaggaccacagcgggaucagaaucuggucucuguuuggccagacaguguauggcagcaguagaaagaaccaggccaccucucuucuccaccuaagggcuccauuccuacaucuugaaagccagggcagagauggcucuucccuccaucugcaucgcuuccucucuaagcucaggagcaggcucugggaagcaggaacugcagugcccagggcccaguggggcugugccacgauccccuugaacgacugacuggggugucccuugcccaacagcauuucuguucccgcauuguucugcucaguuucucuuucuucaucuaaucauucccaagugaggccuuuguucuaggccaagggacggcucgccauuacuguuuauagauccccagcguuuacagauggguagcacucccuuccuucuaccuugcagugugcagccagacaccgagcccuuggcaggguuucccuggcuccucugcucuacagucugagcugguguggguauagcagcuccagugugcaugugaucauggccugaggugacaacgcuucccuucaaacacuggccuuguagcuguggguccaggccagggauccugacaauugcucugaaugucuccauaugauucaauguauuccgagaguucuaaccugggccugccauucugauuucuggagguccccaucagugaccucaccuauccaugugggcuccccuagaguuagggagacgccccacuugaggagcuccuggaucuauguaugugacguuggguccugcacugagacccuuucucugcagaguaguguuuuaccuucccaagcuucuuccagcacaggccugagagguccuguccaaccugcccauuaggguggcugcuccaggcccuggcaaugacaccuugggagaauaugggagagaauuuaccagcaccuucaggagcugugcagcuauagagucugggcucugacuugagauuugggcagaaggcuccaccuuuaccucccuagauccuuugucuucauuucugccuguauuauacccuucucuucccugcuggucucugccugcuguguauaguccuaacuuucucuauucacaaagaaggaaaaagagacccaggacucucccuggcauccucaucucagacagcagcuuccucuggcagccuagugacuagucucuccuccuuaggcaucagcuuuccuggaggaugaagagcagcuaccagccacugcacuggcauaugcuacuccugccuuucugacugcaucugacauucacagacgaugacagugcuucguucaggagcugaaacaaccagagcaugucuggucuucacaucuuuauugagauuuuaugaacugagauggcuuucuguggcucuuuacaaguguccacuuaaagagcacugagcuaagcagugggaaacagaagaggaaguuaaaugcuacuacccacuccuggcaucaaagaacaaacaucagagcagcagcacugcagagcuuucugaaaaacgguaacaaguucagggucuacagggcagauauggugagagaagacggcacagggagaacuaggugucuggaggcaaacagaaagagguuuuguuuuguaccccuucuuacuacuaacccagaaggcuguaaauauuccuucugugaucaucuuuucagggaauuuuaagauauaugaaguaggcuuugguacaaaucuuucuuucccaggaaaccuucacuggauuaaaugcauaaaaauaaggaagagccuuagucacgagguguccuugagagucacccuggagggugcaucuguccuaggacauggcugcagcucaggcucccugugagcagggcuugugucagugacccuccuccccucaggaucccaugguaacacacuugagcagagaccagucauccacacaccaagaaaugaaggauuuuaacacccacauguucuggccuuugcagagaagagcuccucuggccccaaaccacugugcuccagcuuagaguucagggccaugucuaauaaguucaaggcugccugggauccauaguucaaagcuagcucaggcaacuuagggagaacuuguaaaaugaagacaguuuagugguagaggucuuacaaggcaugaguuugaaggcuagugugguaguaggcaggggagaagccguagagcaagacucagggaaggugguaccucaucaguggauggcaggacccuggcugggagacaugguggcagugaaggcagggcauagggacggcugcacauuuaacaauggaaacaugcauuuuacaaaugagaggaucaacagccgggaaaugguauuuuuagcuacuguggcucuuugcuucaaaggcguauguuucaucuaaaaccaggcaaaccuccuacaaagucugccuguuugcaaggagugauuagcauaauacgagugggaaaaaaggcugggcuccucauggaggcaagagagcuacuauaggggaagcuuucuccugaaauagaauuuaacaagugacacaguuucaucaauggagcugaagcccccucuucacuuggagcacucacccggccucacacaaauguccugguugguaccaugugugaugcuuaaaugcagucagagcuuggccuggcagguuccccuuaugggugcuauuuaaauaccauuuuugggcuggugagagggcucagcagguggggugcucauugccugaacugacaaccugagaucugucuccuggacuuacacaguggaggcggagaacugauuccuguagcuguucucugaccucuacaccccaugccuaacauauauaguauaugaacauaauaaacaacugugaaaaacuuaauagugcuuuugucuuguucaauuuccucuaauauuaagccucaggggucuuggguugcccauccagauguccuuuuugaggggguugcuaagagucaagucaaggguaaccaagaaugguuggcaggcaggauaaucacgaggucacacuuagugacaccugagggaggcaguucacuaaggucacaaaccauggguuagacagaguugccucucaucuuuuugcucaaccuauggcuacaucuuuaaugucugucuuuccuuagcuggacacuggucagcagccuaguuauacacugugaaaacccuaagacgguucucagaacaccacaggaaugagacaggcugugaccuaccuucccagagcuuuaacuacagagacagggaacacuugacagcugucccacaggccucucucuggcugugacccugggcuguuccacuguucugaggggcugggcuucagguggcagcuuugcuuuguacauuacacagagcugaugaugagaaugagacagaauggagggcagucauuucucuuccuugggcuucccccagggacaggauagacaggcuuuccuguggaggguccagaaggugcaagaagucaauuuccauacucccggggaucagaagcagucugacuuggggcagccacacaggcuucaaggacaggugggaggaaggggacucugggacuugccaacugugagggccaggcuuccgacagagacaggagggagggaggggucuccuucaggaaaggagaggcaggcaaggaagggcucagcccauggcagaggaaggaaaugggccuccucaggagagaugacugggugaagaaagucuaaauucagagggaucugaagagaacugagggaagcagcaucccugaacagucagucacuugacaggggcacauaggucuauaacuuaguucauaugaucugguuacauugccucucccaagagcacagaacuggcuacagugcagcaagauuucuugucaagcaagcuggcugcgucaccuuccugaauaaccucuggaguuuucugaccauagcagcaggaguggggugaaaggcuacagcugucacuguggaugagugagucccucgauuucuuuccacuuucucugggcaggcucugggccccauaugccuucugauccacuggaaguucuagaagcguggaugagccaaguuuucauuucaccucaugcauaccuguaacucagagcggcugugacaagacagguucuccuggggacucaggcaccccaugagccagcucuggcccuuuaguggcucacuggguacugcagaaucaccugugaagcaggcagccuguguuccccuucacuucugggucccugccccucucagucuuucagcccguggacucggagcagggucagaagcacucugcucucccacucccacugggcuuaaccaaccuuucaugccucagcuuagacaaaguuuuuuucuggaaguuuuccuggguucuuccacccccugggcacccuacccccaccccaucuguucccacauagcacuaucaugcugugaugcuacugcuugugaccaugacgaacccugcugggcagggccuagcugcucacugcugugggcaccaggccugacacagugaguacccaggcaggcuugcuaagugaugaauggcugcuuggugcuuugugggcuagcagcagccgccucaccccgcccaguacuguacaccagguagauucucauccacccucauagcuggggagccgaugacaccugcucccagcagcuuccuucucagaucgagggcucuugccuggcuugacagcuguggccuaauuuccagggcuaucgcagggcuccuuauuuuuacccacuugguauuuuucauuacugaugcaugggggguggugagggauuagaggugggggaaggguguagaugaaugagagacauggcugcuggggggcuggagucaauagucaggugggauaggagguggggauaggaaugggaguggguuuggaccaaaugauuuuccuuuaaauuuauuaaagcaaugccccaccaucacguuccuagauucuccccaguaagcacuuucaacaaggucacaaaugcacuggcucuauagauuuuuggcuccaaaccacauuucaggcagccuuuaaaagccaaucuuggcacagcuucaccgaagccugaagagagaaacuagggcacuuuuaugcuuugagaaaacaucagauccaggucacagcuuccuggcuuuguggaagcuguggggcacccuuuuccuacuggccugaaauugcgcacccugucaccaccucuguaccagagaaggaucacacacuggauggcacuucuuucuugccgcuugucuaccuaugcuauagggcuaccuuggagcaggcaggcacuacaguucagaguuggucuggggccugggguauucacagaacauacugcuacacuaagggaaucucugauccggccuccagcuagguuugcacucuucaacgcuccaggcucucugacucccuggaugcugcacacaucuuucuugggacuaugggcugugugcguccaucccagcuacuacacaaaggcagcacagguaauugguuacuuaaaauauaacuguaaucucagcccuccuauggugagagagaaaaacggagacaggagaauccccagaagcucacaugucagucagcuuggcuuaagaagcacgguggaaagcaaggacugauacccaggguugaccucugaccuccacagacaccaugggaugcaugcacuugcacacacacagauuuacaaacaagaacccaguugaccuuuuaggacucucuggcugcugcuugggacuugacugcuaggaccaguuccuccgucucuccggguguagagcugcuaggaaaagggaggcaccagccuugcaugugugcugcccacaggcccuggcuaccuccucccaugcugugccugcuuggcguggggugggggugucucuggguccuacacauugcuuugcuccacuuugcucucuuggagggguauucaagcauagcuguugggaguaagggaaagcccuuccagccaguaccaugguggucuugcuucuacuccccuaaaguuggcauuugaaucuagaucacggggucuguuggggaagccuccucagggucuacuguuuuagauucugguuucauaaagagcuccucaccugugcccaggauggucacacagccuccuacacccaagggugggcaaaggaaccugccaggauaguaagguucugacguucucuggucacauuggucugauggaacucaagccuaggacaguugcugauggcuuugguacugagaggauaggagugaaccauucugccaugcagcuggugccugacaggaggaagaugagccagcugugaagaugggaggcagacccaguucuggggcuaggaugugacucuagucuuugaggcuuuuaauaagccaacuuuguuccuacuugcacacuaacuuuauuuagaaaaauguuuagggguggggcuauaguuuuucuuuguagccagguugucuuugaacucaugauccucuucugucagucuccugagugggauuacagguguguaccacuguaccccaugccuuuauuauuauuguguguguauaugugugagcgcaugugccacggcacauguaugaaagucuaccuuucuguggcuuucagagauugaacucagaucaccugguuucuauagcaaacaccuuuaccugccuagcuaucuucuggccgucuuuuuauuuuucaaaaaucuuuuuuauuaccauuguauguguauaugagggagagagagagggaaagggagggauagagauagauaagauauauauagagggauagagagggagggagguagggaaggagggagggagcaugugaauggauguccaugugcagucccacuauuucuagguguaaaccuaacaagaaguauguguguguguguguaccccaaaagacauaagacaugcuuauggaaaagugaacaacugcuauagccaacagguaccgcacaaaaagaagccaguaugaccaaaagaagccaggcuuucuaagagaauacaaacuguaagugaugguuagaaccuccaggagguugggaggggcuacuugggggagagcagggagguagauacuugugaaacacaugaaaggacuggucagugcuagaggguucuauuucucauuucaaugcuaaugccaugcacaggacaguuagugaaaauuagcuaagccacaacacucuccucauuuauauacuuuuguguuugagacuuuugugucucuauguagcccagguuggccuugaacucaaaauccuccugucagccuccuaaguaccacauuacagccaugugucacaugucuggcuccuguacuuuuuagugguauguuugucuuaacauuuauacucaccuguaaggacccagauauagcugucucuugugaggcaaugccagugccuggcaaacacagaaguggaugcucacagucagcuauuggauggaacacagggcccccaauagaggagcuagagaaaguacccaaggagcuaaaggggucugcaacccuauaguuggaacaacaauaugaacuaaccagaacccccagagcucgugucucuagcuguauauguaacagaagauggccuagucggccaucauugggaagagaggccccuuggucuugcaaacuuuauaugccucaggacaggggaacaccagggccaagaagugggaguggguggguagaggagguggggaggguaugggggacuuuugggauagcauuugaauguaaaugaagaaaauaccuaauuaaaaaauguaaaaaaaauuauacucacaaaaggcaucauagaauagagggagggaaggcuguaaugcaggcaggagagggaagaaagaccaacccaugaaacugaggcaaaaguaugguuaagaaaaggagguggcuuuaccagaaauagcaaaaucaagcugaaaucaaguuggaauuucuuggcauaggauggagucuccaaauccuauucuuuggggcagccagagugcugggcauucucaggacuggcuagguauacaguggucuagcauaaggagaaccugcccaagggcacggauuuaccaauaacaaggcugaagcaaagcagacacacgugugcauggagcucuggaugugccuguggcugggcucggggugcagagcccuuuuggaggguguggagaaagagacaaacacuuugcucuugaaaaggcagcaucugcaaaguaggagugagagcccaggcucaaagcacaccucacauguaauugaugggaaccuagaaaacaaaaacaagagcugaccuaacucuccuugaaucuaccucaaaaagagaggggccagggcuggugagauggcucaguggguaagagcacugacugcucuucugaagguccugaguucaaaucccagcaaccacaugguggcucacaaccacugguaaugagaucugacacccuuuuuugauguaucagaacacagcuacaguguauuuauuaauaauuauaaauacaucuuugggcaggagggagcagggacugagcagguggaguugacuggagugagcagagguccuaaauucaauucccaacaaccacaugaaggcuuacaacaguaucuguacagcuacaauguaaucauauacauaaaauaaauaaauaaaucuuaaaaaaaaaagagagagaggggccaauguggagggcucaacuaacugauaagccaggggaagauaaaugaugugggaagaugugagauguguucccucgagacagggagugggauggggcaguguggauggccaggggucuagaagacagacugggaaagacacauagaucaacugagcauuuauuucugccugaaaggauggcagcuaauagagccaagcaagauaaugaagaaucugaagaugucaugucaggaggucuuuauguggaugcucuaugggcugacaaccugaaugaaagggagaugcuaccagggcagagagcacaguugcuuuugaaaagaguuaagauccucccaggauccugguggaguucagugccaugguuccuccaggucaggcccaccaaaggucacugucagccauucuccaagaagccucugcucugugaaaaggggaaccaauccagcugauauggagucugguccugguguggaaauggugaggugugggcuuucagacccgcuuugcuuaccaugugggagagccacuacacuucucagggaggaacaacaggaacuaccuggcucccuccaugugugccuccuuggaagagcacugaggcagcacagucuuuaagcuugccugcgaguguucauggcuggugcaugcagauaucccgcucguuauccugacaaucacuuucccuuucuuguacacaaguucccacaucucggaagaaaccucagcucugggguuuauacuccugcagaucauacucaaagucugagagugaaggaaguggggucaaugucuuacugucacagggacauuaaaauaagaugcugacaguaauaacagaccaaagccuacaauguccucagggcugaggcagucaacucuacagaaaguuccauuguccacuucagauuccaaggaccucuuugguggguuuucucaccuugcauuaugaagaggcacuuggccugacccucccuguggacugccuucuauggccacugucuccacagggucuggcacggcaguucccccaggccaagcccuuucaagggcuaucgucacuuauauucuaagauggggccucuccuuuucugcagaggcagcuggucuagaggucucucucucucggucucucucggucucucucucucucucucucucucucucucucucucucacacacacacacacucacggcguagggggcucugugauaacccuaagagcuaagaacaaucaugagaaggacgagaagagcgagcuucauaaggaucucaaaggcagccccaggaaaugugugcaguccugauagcaggagcaaaggaaggcaucuuaaggaacacaccacacaauggacaggauguauccggaccugucuuuccaagaguuuacaagcacuuggaaacuaaggaccccacuuaucuguucaggcucucaugcagaggaaggcagaaggaugcaacauggcuuccggcggccaacuccaaaccugcuguuaauuuuuuuuuaaaagguucuauauaagaguauacuuuuagcugguugcuaauucaccaagcuaucuguguuaucaaugucaaaacucuguaaguuuccugguauacuuaggcaacgucuaaacagacccagagaauuucuaaguccaucuggaagcaagcucacaagcuucagacugaaugcguuaucacguuuucagccccugaaaaccuuucucuauaaucaccccccagucugccagcugucugggcuauggggcugagaucucagguguauaggcuuuaaaguagguacugugugagaggcuggaugggggccaaacagguaccacuuccugugguaaggagcuuaauacuacacacagugggcugagcaauuucccaccuaucuguugcugaaucuuccuucccuccagugcuuccuggaaucugcagcaugcaaguuggcuuacggggagcuucgaagugugggcuguuuuaaccagggcuacccucaaggacacauggcucccucugccuguacaccugugcucuuuaacacagccuuguucagaguguaugggggugcugcucuggacagugcucugcuccucccacaggccucaggaggaccuaaucaaccccagcuuaaccugacaaggcccaucacaugugguuuccauuuccaaagacaagacagccuucucagagggaagccagugcaugaguaugcuggguauggggacugcaaggaggaggauggcgggccccagcucuagagaguucuaggcugggaugcugauuucuuguccuggcucaggguaccugcauuuuguccugugccagacuggacuccuaggucuguguaccccuucuacuaccacagaguugucuccaguuagagcugaagugagggcuggucaugcaaaguagcuucugccacaccccagggccgggggcggcacauaggaaagucuacaagauucauacaaggggcuagacagacuuuaauuaaagcuggcuagagaugucucuucugagcagguguuggccauuacaagguuuccuacuguuuuggccaaagucuccuucccucagcugggaacccacucaauauggcugcaaacuaagaaaagaucaaauuccacuugcagucccaguaagacuaucaggaucguuccucccagaccgauucagauuggugugugcuugcuggggcaauuuauuuguuuucagcaaaugaaggcaaucccuuaaaggugaccaggaagagagcugaccaaagucccuuacaccacucuuggaagcagggaccugagagccaagcauggguuucugaaaugacagcauaacccucugcuuucuucagcacagcacaauguuggcuuuugggggccugcucccuaacaggugaggugauaacuacaaagauuuacaggccagagaggaggguguccccaggaaaggggacugcagagacugggggagugcuuggaggauccuaaggguaugagggaacugagccuggagggguggggugcuuguggaauuucucaaucauggaacuaaagagugacuucuccugacacucuccuuccuugcucuaccacuuaccucaguggccaauucuacccaugccagucuuuaugacacagagcuuauaugcaaacccagggcacuaggaaggcagugguaauucguaggaacuuguauuagaucccuaauacauguuugggaggggcuaccaugccugugugcauagggucgggagagcaggaccagaaugaggccucagacugggugucucuggcuggggucuaggaagccccaugacucuguuccuuuccuacuugggucauggcucauucucucaggacacccaccucauccuagaagugcgccugccccuggaaggguacuugagacucaucuaccaucaacugggcugucaagcugcagaccuugcauucacaguacacaguggcuuguuaaaaaugaaagcauucucuggcaagugcucuuugcaaggcagcagggaggaagaggaggggaaaacgcaguugauggagccaaaggacgcuggccagaggcccuguuggcaggcagaguggagugucuucagacuugcuacuucccagcacagaagcgggcuuguaaagaucacagcuguuggguuacgccaggguucauaucacagcuuaucaaagaggcuagcuuuucucccuccuuuccuuuucuccuguguauaaguggggugguucacaggcagacaaggccugggcuuguucagcuagcauuagcaugaagggugggaagagaccggaggagggcaaugcacaccaacaccuacuuuagacagaguugguuuaguggggccgggcugggugcuggugggugcccugggcacuggggugggugacaaagcuggcuuuaggacacaagguucaauuauccauccucccaugaagccuguucccauucuccacggaccacagggcaaguggaggccaagcucacaucaggggcugaagagcggcuuccuuucaucucagaauggcuagacaggcacuaauaacauuuguguuuuagcugguuggugguggcacaugccccuaaaaaucccagcacucaggaggcagaggcagguagaucucugagaguacaaggccagccuggucuacagagugaguuccaggacagccagggcuacacaggaaaacccugucuugaaaaaccaaaccaaaccaaaccaaaccaaaaaccaaacauuuuuucuuuuauggacaaagcaaaaaagacuuggaaguaugucguauguuacaacugagagaaauugggauuugaaccugcgcuagcaggcuaguuuuuaugucaacuuaacacaagccaguagggcauuuucuuagugauugauguaggaggguccagcccauuauggguaagccacccugggcuugugguccuggguuccauaagaaagcaggugagcaagccauaaggaauaagccaguaagcagcaccccaccauggccucugcaucggcuccuguuccaucucucugaccugugugaauuccuacucugacugcuucaaaugaugaacagugaugugggaguguaaaccgaaauaagccccuuccucccuaguugcuuuuggcuaagugcuucaucacagugauagcaacccuaagacagaaccuaagccuuacuccaaaagccacuuccuuaggcuuugaaccguggggacguuuggggcaccuuuucucauuuguaccaucuucuucaaacugggcugcgccuuaacuucccuacaaccaaaccaacagaagggccucgaccucgauucgggccugugaggcuggcuggaauaugagaguuuggcaccauccucaucucaauucguggucuaaaugccuaugcccacaagguaaggggcuggguggacaugaggccaagcuggaguccuggccuuccacuccugacucugguuccacaucaagaugguguuucccacucugggaaacaguauggagugaggagauggaagaaaaugguuccucucuguggugagaauccaccagaauuuguuuucaagagcucuaguugccguugucuucccacacgaauggcagcugcccugggcccuaaacacaucacugcaccaauaauggcuucuaacuuguucacaggaacaaccauuuaucuuucucaguggacagaauuagggaccaagaggagcaacuaagcagccaaaggaggggguugaaaaccaucuacuguguuccucaucaggccuguggcuccauuagugugugcaccauuagaugcccuucaugcuguuuuucuucgccaugaagaggcccaagcuuagugucuacuaucuuuucuugagugcuuuccagauuuauuuauuuauuuaucuaucuauuggcaccagguuucucauugaaacagaagcugaucaauucauccaggcuagauagucagugaguuucagggaucuacccaugccccacugcaaaugcuagaguaacauugccaggcccugauuucauucaagucagcuuuggggauaugaauaaguacuuguguuuguguagcauguacuugacugacugagcuaguguagcucaggcuugcuugguucacuacauagccuaggcuggccuugaacucacagcaauccuuuuaccucgguuucuccaaugcugggauaacagcugugaaucacaauaccuaguucuaguguguucccucuuuagaguaaacagcagaaaagaauucuguaagugaaggugcaggacagcagcuaaccaccgcaccgcacuaaagccuucaucucuugugcaguuaugaagcugugcaccugugaugccugaccuugaccuggggacccucagagcccacagagacagacuagggagcuggcaguggcuggggacccucagagcccacagagacagacuagggagcuggcaguggcuggggacccucagagcccacacugagacagacuagggagcuggcaguggcuggggacccucagagcccgcacugagacagacuagggagcuggcaguggcuggggacccucagagcccacagagacagacuagggagcuggcaguggcuggggacccucagagcccgcacugagacagacuagggagcuggcaguggcuggggacccucagagcccgcacugagacagacuagggagcuggcaguggcuggggacccucagagcccgcacugagacagacuagggagcuggcaguggcuggggacccucagagcccgcacugagacagacuagggagcuggcaguggcugggcacuggcuuggaaggcagcaggcucucaggguacugaaggcuguuuuuuggguauguggcagacaagcggauggcuagaguaaaggccaaggggagacuguagcgaaggauaguugugcuagucagggcuaacagacccucugggguugugcuggguagggugaggccuggccugcaggcugggcuuaaugccuucucagagggaauucuugagggaauucagcucuggaacagcaagugauugucaugcuggaugaagagaugaaggacaaagggaugaccuuugggaccugcucuugagccguuugaggagcaggguccagguaguccuggccccaguucccuaccuguucaggaguccuugagguuccauguugucggaugcuaacuuagcagagugaggagucugcagcccagcuccaagcaauccuaguuggcacacugcuacuaaagcacacucuccuuaagcaaaaaugagaauucuuaucauccccagacacuaaggggauacugagaagacagcaaagucuuacuggccugaaaucuguaaauagaaacauggcaguggccugguuaccagcuucauggaguaucaaguagggaggaggcccaagcaugucugugccaccugcuuuccugcucuguacagucuggggaugcuggguaccaucuugagcucccaaggaucugggcugcagcuggcuacuucuaccuuuuccaaagcccccucucuccacugguucauucuaccagaggaggacugcucaucaagagugcugacaccuuuguagucuggaaaaccaccugaaguuaccugucacucaugugcgggcauucuauuguuuucauguaugugggggucucuugugcuguaucugaugucugcuuccaucucuuaacuggaacugugcagcuccaugggaagaaaaccguagugauuuuccucucauagccaaugagcucaaggauccauuuguacugugcacucacugacugcugccguugccacuugagccauuucuagacuacagugguucucaaaugguacgcucuugggucuccagcacacuggacagaugcucuacagcugagcugccugcccagccccugaauauuguugauuguccaaaacaggugggggcaggugcuacuugcaccugguggguaucggucagggaugcuguuuaagcauccuagagcuccaccacaaagaauuaccuggcuucaaaugucagagugcugagacaccagaagccccuuccuccugcugcucugucccuuuucaugggucaguucuuuggcccaguuccagggugucuucaacuccacucucugacuguaacauagccuguguuuucuccaucaaguucccugucucuuccuauccugucuccaucuccaggguucacucugaggcugagcaggcuucugugucagcucccagaucuucuuuaggcuucauuuucccuccucccagcuucucucccuuccccucccuuccaccuuucugguucuucucagccuccucaacuagcaaauacgaagcuucuuagggcucaacccuaagggauuccuuacucccuaagaaugaaagcauagagcagaagcaaccaaaaacacacuuggcacagggcuggugcugagcagcuaucuguugacugccugccugcaucauccauuuccagacucugcaucuuggaacuagguuucucucugaagcaucagacugcugcaucaacauuuacuuuugauguucucaaagcaacucaaauucaagcaugugaaugucuuuacucucugacaacucacuugcucagggcucaggaccugcauguuguccggacucuccuuuccuuugucccuucugcaguccaugcacuugacaaucagccagucucacuaaacuacagucucccgacugucuauccaucuuggcccuuucuaaccuguucucccaacacaacaaucucuuaaaucaggagucuggucacaucacuuccccagcauguagcuccucacugaccucggaguaugguuaagaagccacucaacugggcucuuugugccauacaagguuaagagauccucucuggcuguguuggguggaguaaggacuggucuggaggcuggucucgauaccagcucaaacagauagcacaguucuugaggagacucagcucugaacaacaacagcucaccacgcugaauaugcugaauccccagagagcaaagaggaaggguccacgagccugcucaacuuuggguucaggucacagggaaaugaacucuucacguauguuccugccuucaaguucucuguguagacugcggcucugcuggaaccacucagcuccuccacccuugcugccacaccaauacagucugacccccuagcaccuucagccauuuaagaaccccacuaccuugaggcuuugauuccacuguucaagagggaagccaggaaauggggagagaaagaaagcaggugacugcuuugucacaauauacagcgggggagucaaagcuguggcacacagcacugaccugaugaugaacgggccucuggccuccaggagcuuccguucacugcugaacgucuguagaagguugaucaugaacuuguaaaaguaggaguucauggugggaguggagggggagccuucuaagccuuugguaccuguagagaaagaaacagccaagauuuaaucugacugugugucuacagguaaugagacagaauacaacuguaaaugccagagggcuuuucuccccccacccaugugugugugugugcguguguguguguguguguguguguguguguguguguguguguauguguguaaagagaugagagaaaagucuccaaucaagggucacagacuggaagcacggauuuuaugcccaagcacauacaauuuauugguuuacuccuaaugaacaucucauguguaagaccuccauuaggcgcuacaauaaaagugaaguggagccuggagggauggcuucgugguuacaggcauguauuacagacuugaguuugauuuuuagcaccggcaucuggcagcucaagaccaccugcaacuccaagggaucugacaccaucuucuagcccccaugggagucuguacucaugcacauauacccacacaugguuacacacauauaauucacaauaaaauacaucuuaaaaauaaaaacaaauggacacaauucuccccauuauccaaacaaauuagauaucugugggguuuacuuugcacaauuaaggacaauggccagucagagcauaaaaagguuagacagacagcuaggcaugguaguguaugccuuuaaucucaacccuugggaggcaagagcagggcaggcggaucucuauaugaguuugaggcuagccuggucuauguaguaaguucuaggacagagcuauguagagagacccuuucucaagaaaccaaaacgacaaaaaaaaaaaaaaaaaaaaacaaaaaacaaaaaaaaaaaccaaaagagagguuagacaggugcaacuacuacauggucaacaaagcuggcagccccucgggcauaagacaaaaucccuucccuagugcugagaaaagaacuaaacggugcacacagugacugggcuaaggacaacagacacaaagcagacagggugacaauuuggagccucgccuagcacugggaacuaggugaagguguucucagguggaacuccuccagccugcagagcccuggcuggcugugugauacagccucagcugaaagccucauaccaacccucccuccuucagccugcucuugcguaugugcccuuagugaagcuuuuagcacugugggaacaaggggaaggcugacgggauggaugcuggcuuauucuggugugggcuacucacaugucccacaggaucagccuuccuuuuugcugaagugucaaggauggggggggggguucucagucugcccaaugcaauauugggacaucuuugucaaaaaauaacagcuuuauuaaagccucauucuugccccauaaaguuugccuuuuacagauucucagaauauucuuaaagucauacagaaucuacugcuaacuguagaauaccuuaauuaccccucuacuagaaucuguaccuguuacuuucacucccagucucuccuccaagcccugagaacaaauccuucucucuauggacugcucuauucuggacauuuugcauggauaaaaggaaccuaauaauggcuucuuucaugcagcauacauucaaggcucaguuuggcuguauauauuuauucuucauuauuucuuaucacugaacaauggacacaccauauugcauuuguuaauucauuaagugucaaguacuugguggcuucuacucugugucuuuaugaaugaugcugguguaaacagccaugaguucuguguggacuggcuuccuuucucuuggcuacaccuaggaauaaaacuguucggguccugggggaucccucaccaggccacuuuccgcacuggcugaacuggaguucuaccuucuuggcauucucucgggcauguuacccgucuuucacuauagccuuccuaguggauggaaggugguguuacacuguggcuuuguaguucucuggugauacuaucugucugucugucugucugucuguauauaucuauauaucuguauguguguguguguguguauauauauauugccuauguuuaucuuauaaauucagcuacucaauuccuuugccuauuuucaaaauugaauuacuugucuuuuuauuguuauuagaguucuucauacaugagguucuuaucagguagaugguuuagaaacauuuuuuccuauuuugcggguuucuucccucuucuugucaggaacgugcuccacuacaaggcuacaucuccagucuacguucuugauacuauccucugaaacaaaacuguuugggcugggauacauuucagugguaagagcauuugccuacugaguucaagauccuggcuuaaauugcaaaacaaaauaaaacaaaaccucuuguggugcugcacagccccgugcaugcacgcuaggggcuucugccacugagauacacugccagucccacaagacugguuaaguccaguaccaucuuuucccuuuggcugcucaagcuuuugagaccauaggguuaaacagggccaacugaggcagcacaugccguccauuucugaucuggccucucugguucggaagccucuuuuccugaaagggcaggcaggcacucgcacaagguagguggaugcaagucccuuggagaucacgcuuggcugugggaacacaugaggccccagaagcaucaggcuaagugcauaaaaacauguaaaaaacacccagggcauggcauuaugagccucccaaaggaaucucacgguugccaguggccacaguggcacugaaccccaggaguccugcauucuguuuucucuucaccuuuagagggaaguggcugggaaucagaaggcauuuuucguuuuuucuuccccuuuccccagcugcagcugcugcauccuucaaaccugucauucucacuaguaccuccaaacccugcuaccuucaaucccaagcuuucuauauaacccugcacccuuccaaauccugccauugugaaucccaagacuuuucuagacaacacccucccagacaacugcuccggaagccuggaaugaaaagccagcuuaaggacaggcugcauccaauuuucugcuguuuguucugcacuguccuggguccuguugaaggcagccuggcuguccugguccugagugacuuugaaauggcaaacagucucugcucccuggcccagaggggcuguuugcagaauugugucaaauucuuacacauaagaaacuucaggcccagcuggggcugaucuuagaagagguggcugaagagacagcuguuguggcagcccugcuucccauccucacccacaggagauaaacuaagcgucaugccugccugccuaccccacacccccagggacacguggacaggaauccagcagacaguaagcuuguccugggugugcaucucugcaucaucugggucucuguuuccuuccugcuucucuauugaguacuccggggucaucccacuuccaggccuaaggccacuaggcuucaaaguacuuaaaaggacaaaaggaccaaugaauggaguaaccauaaauaaguccucccuggcuguggccaccugggagcccuaaggagcuaaguucucugggaacacugcgucacagagccauggaaagucaagcaccaagcauggugcccggucucaguuucuuaaucuauaauaggggcaguaagagugcccagcaacgcaugccacaugcccugcucaauaaauggagugugugugacaucagcaaaugucucuggccuggagcacuacguggagcagauugcuuucauuccuuguagaacaggcuggacaugcagggagaauuaggaucucaaacucacagaacucugcuggggugcucagggagaaagagaaggaguuaucuguggccugcuccaucucagcuaacagacuggccgaaggcaacaggagagauggcuuggaguuacccuggacacauuucugcucuucuuaggaagggcucucauugguccaaauggacucagugccuaggcuaaaugguagugaccguuaguggagagauagaaaagcacaugggacaagugacucuaguucuuaggagcaguguccucugggacaccugugaacucaguccuucaaggaagcccauuguucaaagaccacagacaggaaaaauccaaugauccccaacuggagccaugcaccuuccccaagauucagcugaugggaagcuuagguacagcacguuagaggaagccacccaaagccccagcggacuucugacuuuagaaccucacuugcaguaagacagugcacccaugcaaggcacgagucccaggcaagaaagucgagcuguuaguguucacuggugacagcggcagggucugugagagcuuccuccaccuuaguuuuaccuuuuugcccaaucuccucugaccucagcagccuucaggccugcugucuggaggacccaagaaagaaggcuccauaagcccgguagacucugggcucuguucaggccuucccuuugagauacaacagacuugagaugggacacugugcuuccagcaagccgaccugcccaugccaucacaucucaccuggaaagugaguuuagaucaaagagaagccacacccugcucugcacagcuucccugcugcugucugggaagccgaagagcucgggugcagacucuugggguaaacuugucccccauccuaaaaaggcauaaaaagagucucccucuucugccaugugaacaucaacuuucuuuagagagccugccaugcugucucccucugaugcugggucuugcucucucgccauggagcacccaccauguuguugccuuuucugccucuuuugucuuuuguguuuaagaaacagcuaauacauuuuucaguugccaguaaucuggcucaguguccuuuugagucaccuguccuauccagaacuuaagguucuuggccagggcugugggcuugggaggggauguggaaagaacaaacuggcccaggagugcacugauuuccgccucacucagccugcaccucccaggggacagcgcaagcgccuccaccagccucaucugcccaccccuggcucuugcucaucugguuggcagucuguaguggcucugucuccacaacaguuggugcgcuccaugccugaggauagguagagcugggccugguucaguagccugauuuagggcaugccuuccagaucugcacccagacagagguguacuagcaaacuucucccucaccauuaccaacagugcaauuuuguaggucuacucaaaugguggacaaauugcuuuggugagaaccagcaagcccggaaggaaagaagagggcuguguguuucaggagcucuuccugaagggcugacccaaagaugacaggaaugugagggagagugcagucucuuagccacacagaucugccuuguaguucugguuugggcaaggaagaagccuguggggcucuggaaagaagcucaugugacugacugacugcucaggggcagacagaugcuguggggagcccucuguauacaaagacaggccagugugugguggcuggggagccagcccugcacauguugcuaagugaaaccugauguggcgacaugagaaucugcagagcgucucacaaacaaccuucccugggauguuuuggauugauugaguuuuguggcuaugacgugaaggagccucacaugucaggauaaaaauagcucuggccucaauagacagcccgaguuacagugcaacagaaccagaugcgaaaacauuagccacuaagcucagacucuacuuacaagguuccagcuuccuucucuaccccauucccuguuguccaacugaagauuugcugccuggaggaggcaggaauggccagaaggguaaggaaacagaucagaccugaacucucgcugauuuagccaggccauggagacagcuggccugucaucugugucaggggaaagggauaccguccacucuuggcacagaaagugcuucaugaagccggguguggaggugcacacccuaaaucucagcauucugaaugcagaggcaggaggaucucuugagaguuccaggccacucuggucuauagagggagcucuaagacagccagggcuaccuagggaaacccugucucaaacaaaacaagcaaacaacaauaacaacaaaaagaaaguacuucauggaaggggaaucgauugggaagcugaccuaggucaaaggggauggaggggaaggagcaacuuccccacagaauuaagugcuugaaagagaaggaagccaagguagguuuucuuuuuccuuuuuuaagagggaguuguggaauuggaggcagcaccccuuccauggcuucacggaugaaaggacaugacaccaaccccugcaaccugguccuggaaguaaccgcccaagacaggagcuggaaccucacccauaucugggagguuuucugcuguuuggcucauaagacaagauaaugggucaaagagggaagggcucagguaauuuccagcuuuuaggguaguggugaguccacacugccaccugcucucaggaaggggcuggcacuaaagcaagggcuaaggccaaggguggugcuaaagggagagggcuaggacugacaagaccaaccaauaaggagucuuguugcaggaccaagggacauccuuccuggacaaugggccuggggaacaucagcucacucuugguaaccuguucccagccauccuuuauuuugaucaucucucauccuugauggguaccugcuguuagggacucauacgugaauaaaaccuaggucuuguagccugagauguacacagcgcauacaagacauuugguaauccugauaaaaucugagucuagaagcggggaugaucugugugcuuguauuucuaugaccugggcaauuucaaauuucagcuuuggaaccucugcaccuugagccaagguuuccucacagccaagaggagacaggccaguuccaccauccacccugacgagcuggaggggguaaagggaaggcagcuugcagaggaugucaccagaacugaccagagggauccagugauacuaaggauggguaucagagcaguuucucacugcagaguguugauugaucuuagcccugccuauggaguagcuucuggagcccccaagcacuccagccugguuuagaagauaaggagguagugccugaagcaagaacccacuacagggcacagguggcagauguuucugcugccuccuagaaggugaaagauguauaggccuuugagguucaaagagcaagaggcaaggcuccuggagaagcugugauacggucaaaugugguuauaguaaguggaagggaggacaggaaaugaggcucuauguagcgagaggccagaaugggguccuuggaaucacugugaagaacuacuucucugggaauucuagagcagguuggggccacagcugggaagaccagcucggacugcuagcuaggcuccuuugcuccuccccuuaggagaagaaaccuucaagggcuguaaaugggacuaggcagguacaaaugugugucaccacccuccaucaagggacuaaagcaugcucuccucucacuggauggagcuggggugauucaggugaacaggccuagagagggguuagcauagugccaguuucaaucagcacauggccaauguuggcagcuauugugaccacuguuacuacagggagaaauggccuaguucccgaaagccuccuggguuucuuacaggucuugcuugucuggugacaggaagauacugcugacaucuggucauacuggccugggaugcagggaaugaaauggaauugaaaauucuaccuuugcccuuuucagaccuagagguggagacauuucagacaagugaccccugcaggguauguuaccaugguuaguuuuuagccaucagugguguugggugcuugccgagccuguacaaaaccaucccuaguuccucccuagugcuggugcauaccugaaauccuagcacaggggagguggagguuggaugguuuaaaaauuaagauuacucuugccuaccugaugaauuuaagucuagccuggaauacaugagaccccgcuuaaaaaagaaaagaaaaaggaaagaaaagaaaagaaaugaaaugaauaggcaacaacaaggcggcaggucauggcagccuggaauuucaggccaacuuucagaccugccuugacccuuggcugaggauccagaggacagacaccugggucuccccaggccugauacauaccugagagcagaacugucuaaggccuugggagaaaaagagaugcaugcugggagcuccuggguccuacuaacuguuuugugaaugaucugggucagagugggcccacagaggcuugcuuacugccccuucuucccacagccuagcaauacaccugcagauuucuugagucagguagagaugguauacagugagcugagccuaggagccccccggguaggugcuggcuuugcucagaggcccuugcucuggagguaguuccuuucuggucacgaaugaaggagguggggcccagaccugggucucugugcuggagggagagagauguuuauacuaagucaggcaugaggaaaaaucccaugugggcaacucugucuccuccagcacccuagggaccacuguaguggugcaucugggccaacacagcacucacccaggugugugaugggucuuuucccccaccacugugugguaucuguaccauuugaguuuacagaucuaaugugaaggaggagccauugauuucccuguagaugcccugacguugccuucuagaaaguuccugcauggaagagaguggagugacuuccucuuacgggacauagcacugcugucucauguucucagaguuguguccuagagagguauaagacuugaggcaggaaggagggcuggccuugcauccucuguccaugugcaugggugcacaggaggagacagaaccacacugaaugccugggaaguacucugggaagcauggccagcagaaaaaugaggacacuuccugcaugcuuucugaccucaacaacaccccauaaggcagcugugccaggagagggcagaggacagacugguuuccugcauuccuuuauuacugauuugaucccgaccuuccagagccaggaacauacuuguaaacucugaugccagcugcagaugugcauguaugaacgcaucugcccagggggucucauagcucugaguuccacaaauggcucaggcuaacuuuguggcucacaguauaauggguuugugaaagaaaucacaggacuggauauaggcucuuccccaggagucuucccaggacugacuuuuuuaccaucugggauuuuuguuguuguuuuuccuaugauuucucagugucucuggcugaggugagccauucugauaguuucugcaggccaggguaagagucucaccccuucagccucauuagccuccuacccauuuugguggggugaggagcucagauucagaguucucugcaggguaaauguccucagcucuugucucuaagcaguggcugaucuugauuaucccagugccccaaggaaucuugcaggaccccaacucuaaggugggugcccaaaacaguuucuugguucauacccucaguagcaugaacccacauuucagcuaucaacuucuuuaugcuugggagggagagaaaacaugcuaacagaugaagggaaggaccccugaggguucugggagcacuagguaucacagucugcucaaggauccugcugaugucacucugaggauagagaagaugguagcaugcuguuuccuggcgaggaaggacugagggccacugcaggacuccucucuucuggguucccuguccccaucucuccuaucugaggaaaagccucucucuaccucacuuagcucccacuguucugcaccaccacacuugaucucuaucaucuguccccagucuuggggcuggccccuauaugcugacuuagagacagaggguacacagugaacuccucugcugagggacaggaggugggagccacagcauggguccuggcaucaggauaugggggcuguuuccuugaccacagcuaaugacugcccaggggaagcuggucuccugagugaggaagugauggcauccuggggaaacggaagggaggaagccaggcugggcuagaguucaucacuguaacccagcagggagaacauguagcaggagagccugaggccugggcuccagaauuuaccacuguaacccaguagggagagugugcggcagcagagccugaggccugggcucccauguguuuccugcuacagggcuugagugacccauggcuuucuuugucauggauacguguccucagcacauggccuucugugaucugacuuggcauauccaggggugcaccaaagccuguggagcucugaaaaauacugcgaacuucucagacacugggcauagugucuggccaaacaucagggagcuucuaguggagcagugcagguauaauaugggccuggcuggggcuagggcccaaagugcuacagagcugcaggaggaacaaugucaccgaaagguugugagucuaugagaagcuaaugagguccuggugucuggacggcaugagggguuugagggacaaagaccuggcaaacauccaagacccaccagguaauuuccuacuaaccuguguccuugggccuuuuuaaggcucacauggcugagggagguggucucugccugagaagaggagcgggugggcagcguggccagggagaagagcuaccugacaucccgaaggaacccgaagaacaagcacuuggcuaccuuugcuugcaaggacagcccggaaacagcauguuugaauuauccugucucuugccugggcugccugccaugcugagcuauucugagcuucagugaagaggaaauggcugccuagcuuucuuccaccugugagaccuaagacugaaggcccuggcuggcugccugccuguggagagaaauugucucagaggguuuugugcuuagucagugguuuaaaaacaucaaaagagcugaagaugagggcugugagggucucuucagggggcgaauggaguaugagccaggaggcagaggcugccucuugugguagaagaccacggguaggcaagccacugacucucauaaauggcagaacacauuuauaagugacuuccugggcuagaauaagacucagugcuccuuaggccagacacuucagggaaauacuuacugggaggguuuaguagguuggcucugccggaggugggcaccugaagcuccgagugguugacucggaggucagggccaucaggugcaccugggucauccgucuggccugcaggggaggaagcaauuucugccaacacuuccagauccuucaagacaaccuggggagacaagcggaggauaaaggacaaacucccuacuaugagcugagcugaugugguagaggugaagucagugaugagggguggcucacagggcaggaggcucuguagacuugugcugcuugccugucacgagagccacagagaucguagcugucagagugcuugggaaaaugcggugaaggucuggauuaagaggccacugauggcaaugccuagagaaggaagcugaccagggugacgagucuuccucccgaagcucuccucucuguaucugaacaaggacugcagggggcuccuugagaugcagguccugggcaguaaggugagccguacauaggaugcaucucaguuucuguauuguaugaggccuuggcccuguccauagaacagcugucacugcagaggugacaucaggccacacagaguccaaagggcccucuaugcuuugggugcaauucuggccuccucugcuaaaaggcuuccuaacacccagucaggacucucucaaguguuuccacuuagccuuggauggacuaggaaaggucucuucagcugccuaccugccuacugcacucuucuaaagagaggcauguuauucugggccgggcgguguguuccucuuuccucuauggcugcccuuaaagggccaguagcccuggaaacuacacuaucuucacuugacaaagcucaucccacuguggcacuaaacagugggcacuagagagaggucagugacacgcccuguugggaaggcaucaccguggaugcaaaccccuuuguuuaagugucaucagucccaagaccugcagucuacacucccuccacagggagucccucccacugcagguccuucaagcacuuucugcucccuauucuucaguucucaagaacgccugccucugccucacccacagguauagcccuaggacuaacccuggcacccagcacaugaucagcaaacaucaggugacaauagggacaacugugccuuuuacugggcugcucuaaacccagaucaagaaagaauuaaccgcugggggcgaggggggugagggggggugggcgggaagaaccacaguagguaagggaccaguggaaaagcugcagagcucuguggguggggcugacagguuagcuaguggaauaugguaaauacaaggucaagauaaggcuaagcugagguuccuuuugagggugaugaaauauucuggaaucagugacaauggcuacuaaacccuguaaguacaaauguuccccaagugaagacaggguuauauccuaauauacaaacugcaauuugaaaauaucaugaaugcacuccacacacccaaucuaugaauacuggaguucagcagaacaguacacugcagaggacaaacugcuuucuuucaagaucacaaggcuaagugggaacugccuggcaucaaagagucuaaagaaugguguauaccagugaccucggcacuugggagauacaggucggaucaguuugggguucggcagagggcuccguggauacaaugcuugccaugcaagcaagagguccugaguuuggaucucuagcauucauguaaagucaggcacaguggcguccuaugcuacaguagagagaggagacaggcaaauccaggggccuuguaggccagucaguccagcuaaaauggugagcucuggguucagggcaggcgagaugccuucugagcagauaaaaccacuugccaucaaaccugccaacuugagaucaguuuccagaacucacaagguggaaggaaaggcccagccaccgcuguuguccucugaccuucaguagauacacaugccauggcacgcaugcaugcauguaacaaugggaaggaucuggugucugaguacaaccgugguccuaucaguuccgguaacaagccagugccguauccuaugcaacuggguugucacuuuuguuaguuucugcuggccugcuuuccuguacccuuguugaggaucccuuugcaugcugacccuaucuggccucuggucuucucuaagcuauaucacauuuggcacacgaucuuaacacgaucuuggccuccuccaggaugguccugacaucacucacacagaugucauccccacuguucccucauuacaggcacugaaacacucucuagcccuuccugagcuucuacccugcugcaccagagcugagcugcaggaggcacugggcugucggagggagucaaaggcacccucgccuaugacuggguacaagaagcaacaaagcuuugccagaagcuuaucgcugacugcccuuccaugcacugggauuuggguuuuaguugcuuuuggaaugaguucuauuugcugaguugugggaaauggaccuguaguggcuggaaaacaugaccccacauagcccugucagauggcaggaguaaaaguuggccccaugucaggccaagaaccagaggacccuagguggguuuggguugcaggccuagggcucugcucccugaagggaggaguaucuggcagguucacugcuccaggaauggaagagacauagggaagagggcgugguggggaagcagauggcacaguuauguagaguuuuaacuccccccuccaauucacaaguaagucacaggucagggaugguaaacuagaucuaggacuuggaguugggggacaguauggggugacucaccccaaaauaaacagcacggcaagaaugaagccaagaguucuacaauaacuaagcagaguuuccaucggggugcuccuacuccuagguguuaccaagagaacugcaugugaacauucacacuagcugaacaaugcaaaggucccucugcugauaaauagaaugugguacauccacuccacagaauaugaccggucauaaaaacaaaugaggaagggggacaaggcucccucaguggguaaaaguacuggcuguacaaacaugcuaagcuguaggacacauuuguaaugccagugcuccuacagugagaugggagacagacagccuggcauaagcaguauaucagagauaacagaggccccgacucaauaaggcagaagggaagaacugacuucucaaagucacccuugaugugcacacaucauacacacagauagguaaaaaacgacacuggacucugcagucguccuugauaauggcaugugcacacaucauacacacagauagguaaaaaacgacacuggacccugcagucguccuugauaauggcaugugcacacaucauacacacagauagguaaaaaacgacacuggacucugcagucguccuugauaauggcaugugcacacaucauacacacagauagauuaaaaaaaaggacacuggacucuguagcaacaggaagaggcuuauaaacucuuguaagucaaagaaggcuacaaaccacaaugauuacaugaaaugucuacaagagacaaaucugaaaagaugaagguacauuugugguugccaguaguuagggacgagacuucuaaugggcagaguuauuuucuuggggggaaggguauggagaugaaaugucuugggacuaggcagcagugaugguugugcaaccuuauaaaaacauauuaaaaaacugcugaguuuugguauauguacgaaaaaaaauuuaagaacuaaggcaaaguuucaaauugguaaccuaacucccauucaguguugcuugcaccauugcccaagugaucguucuuucuaugaucugacaaaggauucagacucaggagagaugaugaugaagaaaaggucacccuggucuccuagaacucuguuucuuccagucaugcuguccuucucagaucugucugugcaaguguacagggucauaugcccccugaacaacaaauccuucuggucaaaugcuccaagugagaaaaguaugacccagcaaggcuaacuggggcauggcacacauuauaccagaucagcucuugcaagaacccuggcaccaguacaggcacauaagacacuacauauccaaaaggcaccucuuuccagcugaagugaugaugccuaggaagacccaguagcaugcaagaagaauggccuguacaagaacggagcagcucaggaaccaggcuauaagggacaaggagcccagaggagcaagcuauaguugagaacuaacacucucaaucaccgucagugucaccucacacuccacccaaggaaucugagacuuguacagucaccagcucaacaaaaaugcagugucugcuucauacacagcucugcuucagaaacccaagccugccaaucaaacuacucagggcuuugugcucagacuugcauccaguuaaugccguugaacaucuuccuaacaccuacugagcagcucccaugguucagcuuugacuauaggagacacagggcuacacaggacagacucugccagagccucaagcuauaggaugcaaaaacauuuacuugaaagagaaccuuugggcuucaggaaccagcaacuuggucugaggggagccaagagccuguggaagcacuugauagaguggccaccaagggcauguguuugcgugcuuacacacacacacacacacacacacacacacacacacacacacacucgcucgcgcacauacacuguggaguauacaucugaagcauucucuuaacuagcauaagcugcuuauggauacagagaauaaggcaguacauucuuggggugguuuagcuccagagaaggaugugggguggagggauauguagucagaaaucaggcucaagugguagcuagguugggugucccaagcuuaugacccauacacaagaaucuggguuccauagcagguaauagcaucuguuucccuguauguacaaauggaagcuugauaaugcaaggcugcccugaaggcugugaggcaagcuagcccucugugccaaaggagucaaccaacugucaacggaaaguauuaggugaugugcaccuacacaggacauauaaaggucuuucccuuguuuuauuuucuaaacauugaagcguuaacaguuauugccauacguuuaauuguauuagguauaauauauaacugagagaugauuuaaagugcaugggauaauuauguagguuauaugcaaauacuggcccauuuuauagaaacaauaugagcauuuucagauucuggaauccagagggucucuggagcaaucccccauggauaccaaagaagaaggggacuucagugcacagcaagcacaaaguguccaacaucccacucuuuguugguuuuuuuguuuuguuuuguuuucuugagacaggguuucucuguauagcccuggcuguucuggaacucacuuuguagaccaggcuggccucgaacucagaaaucugccugccucugccuccugagugcugggauuaaaggcaugcgccaccacugcccagccaacaucccacucuuauuacaagauuuuuaaucccaauaccaggcuguuaauggcccuggguuggugaugagauggaauagccauucauacugagggcuuuucaugagaaugugcagcauccauuucuccacugcugcuuccugcccacuacuggacaggagagcagagccaggaaggcggcacuuuuugcauucagaauucucuuauucuagaaagucuaauaucaaauggcaaaugaaugcaaauuacacuucaauugcacaauuaaagccggaaaugcugucuacagguuccuuuggugaucccagccacucuuccugugcuuacaaagcaaaugauuuguuucuaguccuagggauuggcaaaaagcccacagcccugccuggggcaccauacauacacaggugcacacacaaugaacugacccuuccugccccuuaaauaguuagaccagaauugaaggagggaggggacugcuugagugaagggcaggaaugcuauaugguggauacuguguacggaaggcauuauggggcuguaguaguucucugacauuaguucaagcgaucaaaucccauugcuagcuguuucucaacugcccauaacccagcugggauccugagccuuuugaagcaacaaucaaaaugaagaucuggcccagggaggagagcuaucgcagagaaaggucuaguuaacagagcacugagauagaugagcagagacuuggcuuugagucucuaugcccaggccaaggcuguggugcucuacauuucccuggagacccuacaguguggguaggaagcuaugggacaaagaucccugcucaaggaucccacaaggccagaaggaaaugccccagaaccacagacauguggccagccuugcuccacccccagaaacccaaaucuaguuccucugccaaugagcaggcugucugggcccaugcccgaggcuggccuggaguccuggcuccaaggauggggacuagcucaaagaaagcaggaggaagccacaccaauuaguaugcacuacacagcauuuuugcaaaaugaauauaaaacacuugugcuuucuuuuugugugagagaaagaagaggggagggggaaggagguuacaagaaagcaauauucugcaggaacgggagcgccugcuguuuccauggcaguggguggggguggggagggcucaucagcuggucccugguucugcagugcaaugugcugccuugacuccuugcuggacuguaagggucaaggcugaagaccgcgaguacagacagaaucugccaaggugucuccaaggggagccucgggaguuggcggaaaagggcuucauauuucccaugggguagacagcagagaaaaaccagggauuccucagaugauccccuuuguuggagacaacuuuauaguaucaauuggcuuuuuccuuaggauaaacguagauaaugacaucugucauacucauuuucuagcaaccaagggguggcucucuccuggacagugcuguucucuuucacugaucuaaugggcauucacuacccuaauaccugcccucugcccuuccauggcacugugguuguuccucugucccaguugauacugcuacagccugcagacaaacacuacaaguucaaguccccacacaggggagccugaccuugccucuaaccaacacucuggcucugaaggcccaggcaaucacuuagcagauagaggaagaucugcagcauaggggaagaaaauaaaagaugcauaguuuggaauagcugcugccaaaggaauagauggacaaacaucccacuuuaaggucccacugauccuuaggaagcccuagguuuacacagcaagcacuagcuaaggcuuucgaugucaacugguagagcaauccagcuccuuugaaggggacucuuucuuucuauugucaggacauucccagacugugcucucccuagcgcuggcugggaguaagcugcaagaauguucccaagaggcauacuuuguauuggugaaagagauggaugcugcuccagacucuggaggcugcacucuggccagugucagccaaugccaaggaauaucugaagucucugugcagaacagcugacugucgugcccuguaggugaucugggucgggucaggcugccccucaggcugugaagcaaaucugacaggaagggcaaaggcacgaggcuuggcuucuacaggauccuuggguuuucugcuucugcccacauagaaacuaguuccuuuuguuauaaaggguauagcucaguggccaggccuccuccaucccugaccacauauaacuuggcucuugcugcccuggggcuuggggaaucagccagagaauucaccauagaagccagaaugaaggccaagagcagugggaaaugcacccacagcagcuggcacuggggcugaggccucagccuuagacacaagguaaacaggagcugcggaaggcagcaggcaggcuggcauucugagcagagcuguggucuacauggcaugagaacccugccuucugcaacuagaugagcagugccccaaggagaaaggccagaguuugggaggugagcagcucuguucagguguggacacauuuuccugcccauucgaagggcacucagguugcuuuuagguguccuggcaaagcaaaguaaguucuagcuauacgcauacucagcacacagguaauguuggcugacacugagcaccuguccuaggggauuuaggcaacuccacgcccccaaaauggacuuuggagaucuuuucuaugggauugcacgaaggcccauuacuuaauccuguugucauuuccaccaaguaaucauguagauuaaugaggaugaugcugguggugcccccuucaggguacagagagaagaaaagacagccuaggcuaggaucaacggagagaccagacugcuguucuccagccccuaaccccauaggcuuuccuuccugcugacccagccauuccacguguacugcccugaguuccuggcucuuagaguugcaaauucugagugcacacacauauacauccuuagaguucuagcaccaggugaugaguuccaacacuguguaaccaggagaggggaauguuuccugacuaccucccagagcucugcuuaacccuggcuuccugguaagcuucccacagcaccuggccugagagauggggacagggcugggugggaacagcacacucugugccaacuugguuguucaccuucuuguaaaauauuucugagucuagacagaauucucuuaaagcccacacuaaccugccauuauaaagagugauaagggcuauguggggauggauauaaagacagauagauggguucuggcccaguuuuaauguacagaagaagguagacuggggacagagacagucagaaagaggacagagagagagggagagaaguaaagacggaggagagaagagaggagagaaagacagaggagaggagaggaaagagaaagauggaggaggcgaggagaggcgggcaaggugaggucauacauuggcuucugagugauucaggaagccaucuagagaucuugaccaaauuccuuaacuucucuggguucuuuagaauaauuguccucuugggagaaaugcaaacaccgaguccuauugugaggcugucggaaggaugaagauaggugcugaguucaggguccaugagagagccaaugagaggaucgaccucugucaccuguggggagugguccccuucuggccugagagcugggggggcuagcucccacagaucucaugcugguccacaguuguagcucccaaucagacauauaugcaccacagucuccugggauuuugugaaaaaaauuccagugcccaggcagcauggccucgcuugaggguacagcugggagagccugggguaaggcccaagcagcugccucugaacacugcagaggguucugacuguacccuggcuuggauggugcugcagggcuuugaugacaaauggccucugagggugaucacuaugaagauucaaggagagaugggcacuggggccugcagugugagcagggaguuuacccaggcguuuaaacaacucagucccuauucuaggaggaagcggaaccaacagagcccucaguuuaugucuuccugcugcuagcaggccugcuuuuuggcuguccuucucagccuacccuagccugauggagaccuuccaucaggagccaggcuucggccuucuuuuccacugcacucauggcagugacugcccucaggucugucccacggaagugucuagacagacauaagcaugcaaacccucggggcccacagagcuggcuuugugcagggggugacuacaugcucuguggugacugcguccccucagucuaggguggcugagagcugagaacgugaaaucuagaaugagaagcagagguccucuagacagacacaacuauuauuggccugucuuuggcaaggacuuguugacaaggacucaccugagaagugcuacaaucucccuaggugcccagcaguggcuucugguacucuugcuggguugugguguauguacaguugcugaggcguugggccagggguccuggcugucccuaggaggaagaugcugggacuaggacagggcuccagugucuucuuguuggcuguuaccauuugggagaagaggggaguaggaagcugcagggucagcuguggcagaguagggacacacagcauacagugcuauggacaaggccccuguggcacugugggagagaacccaggaccuccaucuucucacauggagcaggcuccuggcuguaagaacgaagcuccuggcuacugauguuaccuuaguauuauggauggagauucuaaccuuacuggaugaucugacuuuaaagaaaccuguggacuugaggcaggagggagggguuguuuuuguuuguuuuggagaguagacagaaugaaaacuggagugaaauaaaaagcgaggcaaggaaccgagaaggaaaacaagccccauucuuagggaagccucuacuuuagagcgcacaguauuaguauuccagggaguggagucaggaccacacagucagagcuggaaagaaccaaggacaauccaguccaacuucagcaucuuagagaaggaaacugguccuguagagagcuggguggcauaagaccagaggccuccugaacucugagaccucugugaucucagccauuggccucagcuauuuagaagaccagauggaggacagagaaggcuucuggucugggccuggaaugcugacucccugucccaucugugaguagucuagaggcagccaacuaagugaaggggcaaggaagcaagguuaaggucaaaugcucagaggaagagggcacauucauaacugaaggccagccaaggauaaaauucuauuaggguaacaugagaccaggccugcaugaagcuguaucccaaugugagauggcccccuguucacggcagagccuguguagauuuuagagcaccuggaaucagaucgacccaggucuccauucuagcucuuggcuacaugaccuuggguaaguuaucuuccaucugcacaaaccuccucauaagucaugcugggagaauuuaaacuauccuagcacuauugggcagauuuucugagacaacagauguuguauguuacugacaaaccuagcaucacuugggauacaggccuuuaggguaggcuuacaggagauuaucuugcuuguacuaauugaguugggaagagcagcccauuguggguaccauuccuugggcagcagacccccccacuguacagugcguaaggaaaaugcagcaugcauuugcuuaucccuuucugcuuucugauuguggauguauuacugauugcuuaaggguucugcuugacuuaucccacuuggaugggcuguauguacagcugaauguuugagugaacucuuucucccuuaaguugccuuugccagaguauuuuaccacagcaaaguucacaggaaaaggaacgaagccguaagauagaugcaguggaacaggcccuucucacaggcacacuguggcaugguucucgaagagcuugccagugaggcuaucaggagggcuaucacuggcuccuaaagcugccuuuaauagaagugccucuaucuaaguacaaguccccauauggaggcagauccugagauggccaaucuucaacugaaggcccucccucuagggacagaaaaacucugucaccugggaaucuacaaagaccacagccuucugauacuauucaucauagcuguugguuguggggcuuccguuugagggagacuucauguuaacgucucucuuaccacuauacagaguaggaacccccaagcucaguuggccaacucagcagacugagguggcaagacuccuugacaauggggaaaucaagguggugcucaggacugugacuaggucacugagaagagacucagugggaugacagggcugccuggccuugagacugggucaaagguagccccagcuggugcucacugcauuauaaaggggggagggggacuuucugccaggucagaugaccuauauuugaucucuggaacccauuugauagaggaaaaaacugauuccuacaagcuaugcucugacaacacacacacacacacacacacacacacacacacacacacacacccgcgggguaggguggggaauagguguaaaaucaaaauguaaaaaacaaagguggccuuuuccuaaccuacuuggggaccuaaagggggcgccugccuggagagaggccucauuuguaggguugcuccuucaguuacaaaugagcccugagggggccuuuuggcaguuugacuaggccgagaaaugcccucucucuugagggccaagaauuucuucagcuuuucuguuccuuucucuagaguucugcaccaugaaaacagguuuaacuuccuaacuccuaccagggcaaacccuuucucaggugaagcccagggcauagcaggcucacccauggagccucauccuauuggugaggaaucaagaggcccagaguuggagacuagugggagaggcagaguacaccagugagaagagccagcugcucgaggaugcccaauuuuguuucccucugggcucagucuaggcagugggugcucauaggucuggguacuucugagacaucccauugggcugaggacaggaaaggcaauggucugucacuguacuuucagggaacucugagugucuuuaucaaaaguccuuucuuaggugcccuaagcuaucccuuagaccuaccccauggcugcaucuaaugcccauggacugcaccgaagcugugaacaacacuccagaaugcuaccuggcaaacuugcuaggaggguggagcucauucuuuuugcugcuucugcaccacucaugucaggcuauagucagccagcaacuucucaugacagugacuuugaaguuaaacgaggggaaaagcaaggagcguuuccuggguugguaaucuuuggagaccugagaugcugaggcagggucugcucaacaggccccacugcugagaagacaaaguaaugugggauccagcagggccuacuuacuggucucaaggguuugauucugagagaaagacauggcugcugugguccugaugucucugccaaugaugauguucuuucugcuucucucgcuggaccugaggcagccagcuggaauccuuccucagcuaguaugagggaugaugcuucaacacuguggaacaugcugacgacagggcucuaaggagcaaggcuggcacugaaugucagcuucaauccagggcuucuggggagguugagggagaggaagaacaugcagaggcacucuccacuuucccacuacccacugccuggcuuccuaggacauauagaagacaggcuccuuagccugcucuguccagaggcggaugggagacagaaacaagaauauccgauguuuagguguuggcuggagaaacugaggggauaggguuguggcagacaugaggcucaucuugcugauguguaucucugaggucuucuacagaaaugaccuccagaaucugaggagccaguguacuagaguccuccuguguacuggguuccgugcugagcgccaugugaggagacuguguacuagaguucuccugcguacuggguuccgugcugagcgccaugugaggagacuguguacuagaguucuccugcguacuggguuccgugcucagcgccaugugaagagacuguguacuagaguucuccugcguacuggguuccgugcugagcgccaugugaggagacuguguacuagaguucuccugcguacuggguuccaugcugagcgccaugugaagagacuguuuacuagaguccuccuguguacugaggagcucauucugaggagcucauuuaaccuuuacgacaagccuagugugaggagccuuuguuauuucucccuuaagggaggaggcuagcugacuugcuccaggucauccaacuauuagguggcagaaccuggacggacugaucuuuaaggcccguguacuuagccacuaaggugcacugucacccaggaagaaaacauuaccaggaaggguugccauucuagaucacaacaaaauaaaaauguugucacuuucacugauugugaauaccauccucauauaaaagccugagguguuacugaaggacaagaugacuuccuggguauaaagccuugcucccacgcagagaagucaacauuuugaaaaaguuaauuucucaauagaugaacuuaggacaggaagguggcuguggggcaggguguagggagagccaugucucugcacucugucuguaagguaagugugggugguacgagccucagcugauggguucaggaagguucuuaugcaaggccaucacgcaggauagcccagagguaggauucugaccugaggcuggaggccaacuguccaggcuguccacauucacucagagggaacguauguccuuccaagcccuucugagacugaggggucccuacucccaugagaauucuaaaugguggcugggaauaccuaugcacaggagggaagagucaucugacgucucuggacacagcucaucaagaagguagagaggcuccugucuuaaggcagagcucucucaagaaacuagcagcugacacuugacaccuucugggcaaaggaggcagcaaacccuaacauggagguccaucaggaagcucugggcacauggccuguuggggaaaucagggucacauuccucauaaaaaagagguuacuggaucuauagcuaaagggaggauuccuacuucagugccaagaauauuaaucugacaccugcaaacuguuucugacaaaaaaggauucaaauaaugucuacaaagagcagacuguagggaggaaacagccacuuauucugaauaaaggaagaauagacaaggauuuuagaaggguguggccuaccaaucugucacuuuggcagagcugaggaacaaaggcagacaagacauccuagugaggcuacaggcuaaaaagacugcagauacaguguaugggagugagccaggucucuaagcuccgucuuccccaugcuuggcucuugcaucaucaacaccugguauacacugucuccugggguuaguggcucuaagccacagugaggaauauauggauuuaucacaguaguacugagagagaaaaacauuuguaacauauguaacaaauagaaguccuaaauauacaaagaguuuccucauaucaauaagaaacguggacaaaggauuuaggguugaagugggagggacuuuuucaaaauauaaaaacauuccauacugaaccgagaaucugcacagaacaaagggccagugacccuucuggagaacucgggaugagugggaugacaccacuaacccagugcccaccucuccaggggcucuuuaugugauggggcacaggaguuaaacagcugaggagaugggucuuagcuuaguuguggguaaguaacagcuuuaguuuuguguguguuaaaaaauggaaauaacagacuacuuccucucuccccaaaggauucucuaauucuaagaccagaguccagcaugguuugugaaccccagggagcuccaggaagaucagagaaagcuuuuguaaaauucacaaaaaacccaccagggaacacuuccucgauacccuacagaggacccaggaguggacuuccauggccaagugcacaguguguccucaaggucaaacagaacgggcuggggacacucaggagcaggaucccagugaauaaugaaaguguggcauaaaccugacucaccagugauuaucaagguacccagguccaaaaggcaggaaagggaagccauucucucauagcaccccucccccucauccaccacaaaacuguccccaagaucagcuuuaaucuguccucaugaggcccacaagaugugccccaaagcccugacaacauuuagcacuucagcaaaucgaguuuccauagccgcaaccugaacagagcaguuuaauggacugcaucuccugugcucccgcuaaacacacacacaaaagccaauuccaagcaaaggaggcuggaugggauuaaacaacucaauuuaaaggacugaagacucagcugcuuccagugaagccccacagaaagagccaaucagcagagucuucccuuucuucuugcucugaauugugggcccagcucccuggugagucacucccagcucacaggcagaacggggccacacauccaccuggguuucaaaccgcaagggguuguggggguaagggggguagguuguaugugugcaugaggagccaaggguaugcacagaccaccgguuugggauuuucuggaaagguagagaaccugacagguccaggagggugaucccuguuuguuggcuucucucaucagcucagguucaagaaagcaaguucaggaugcagggcaguugccagggcccuaagugagccucauaccagcccaggaaagaccaagcuguaucauuccaaggaaguuaagcaaugcccuuuucucccaaccccaacccugucugcccccaugcucccauuggguaagucauaggcaacugcuaugugaauacaaggcucuacucaucccucauagugacuccccagaaaagggagaggguuacaccauggcuuagaccaccaauuagcauuuaauacacagccagaaggcuccgucuggacgguggaggacuguaucccugcaaacaggcacgcccugccucuuggcugggaggcagggaagcccuggcaagaaccuucuguucaaacucuggggcaagugaugcugagaaugaaggcagagggauggugagcuggagagccccaucuccacccaggccacccucuccuuuucacacuagcagcuugugagcaccucaauaaagcaaggcuuugggaccaauuuuaaguugguggcccaagcgggcugcagcugaaacaaugcaaccacauagcccuuuccacauguccacuucaucccaaaacgcagacauuacugcuguccucagcagacagagggaaccgaggcugaggagucugggcaggaaggcggggcuauacuuuguccuuaagcaggcugaccacacucucaacuaccugccagggacaacaaacucagacacaguuuguuauaaacucauguccugucacaaguauuccagaaggaccuacagaagaaacauccuuccucagaaugcuacaugcaguuuugguuaagaacacagcaccaaacagucaagcauaucuaagcagugaaaacugccauggcucacuaaaaggaaggcuggauaacugguauuucauacagaaggcugggaucggggaccuaccucaucagauucgucagauaaugucugaaguaagauggggaagaggcugucugugugccggaacaucuggagagcagagaaggggcacucaugaguucccugacucagacugggcucaguaagcuacuggucugucauuccccugcucccucccuggccccccgagcaccugauacucuucugcuugccaggcuuucccuagcuggccauaaucccaauacugagccuggacaggaccuagaaacccaagguggaccuuuagaugcccacuggcccucugcggagcuggguccaagcucaccuuucgaggaguuuugauguagagaugguagagccacuucagaacagcaauccuggucaucaucccaaugguugugucacuaaggugacaguucaggacuugaacaaucccguccaggugcagggucacuggagcccuaucagugcuauaguuaagaucaaaaugaagccuugagucacucugugcccaugagccacaggacccugggucugcacacucagaaccacacgucuacccuggggacuggcaagcagcuaaguagauggcagucacuuggcucaguccaguggcuccaaggagggcuugcuucucugcuuccuuuugcccuuugaaggagcacaguuuggugcagcuaugcuguccuuguguggggaggaggaagccaugcagcuggacuccucgucacgucacucuccuggaccagcacagcuugacucacgggcagagcuggcccacaucggaccucugaccguaacauucuagacacuuagcauccucagggcaccaagccugaugaaacccaacuaaugcccaacggcacaaggacaggucccugaaauacucuauggcauccaagaccacucacaagcaagugaagaacacuggcucgucauuuugccaccccugcacccggcccaggaccuguccuagagaagcuggaggguugccuuccaaguagaacuacucuuugggacagggcaugagguaggagccugccugagagagcacaagccuguucaggcagugcaguagugcagccaggcuuggagcucccaaaagcugaagcucucuggucucuccgaacagauagggugcaagaaaccuggggaaggccaagugcuugcucagugacugagaagcucugaccaaaucugcucuccuggaacucaagagauccugcuucugcccaagugcugggauuagaggcacucaggugaggccagguuccaaggcaggggcagcacaggcaggagacuuuaggagcuagaagcuccucuucuaacaucacacugcauccccucaaggugacagcagugcaggcuguauuuucugaguacuguugucaggcagcuccacugugcggcugugcacaauggucuuccuuggccuuuccagcuacucaauuauucaucugaccaagaacuugauggccgugcuuuccucaugcaccugcagacucucugaagcucaugacuucuaaggggcguggcucuauuacuacgaggcagaauugcuguuuaauacacacugguauuucucuggugccuguuucaggguugagugugggcauuccauucucaggggaucggaugaucucaguaugugacacagugacagaacccagaauagagccuuugcacagaggaaggcagccacugugcuauuccaggagucacauggcuaggaguuccugauggauuuugaacauuucaaacugucaaggcuuuggcagcaaaugauaggcagagccaggguggcagaaacaguggccauucaagcccuuuauccuguucucuguccaacagaaacacaguugaagcacggaugggcuucgacaauuuuuaguuuccaagccgaaguuagcuuucauguuuuaacuaagccacggcauuagcauaucaacauacaaucuuauggcuagaacagcugucucagugguaaaguggaugcuugccacaguccagggccuuaacgaagcagguggauacugaaggguaacugcccuuucucagccacucuuugauagccccaugcccuagggucuacaguagguccauuuuccagcaggagucacagggcagucggaaugcugugugugugcgugugcgagugugugugcgugcguguuccugaagaccacugcuacacuucagcugaaccagcccuggccaucccuucagguuguuggugccaugucaagaccacauaguaaagaaagcaagcuggcagcgcuguagaugaugacacucuucaaugacacuucuucccccaaucccuagcaagguguuagcuucaaccaacaaucaugaggucauggaaggaacuucaaguuucaggccaucugccaaugcacagaggaggaguccugggcccagaggcagagugagaugcacccaagucaagaggccaagggcuaagaacucacucucuuagcuggagacaugcuccugaguuguuuucccucggcuaguucaaggugaaggucacgggaagagggaagcagcugcacacuuaucucuguggccagcacagugagcuccggaucccaccugcccuugagcaggcggcucugguggguggugcuggcugcugagcucugcccgugcuuguggagaaccggagcugugagaccuucccagaguggggugugcuugcccaaaguggucggcuucccucuacugggccaagccugagaugcauguccuugguucuggcuaagcuaucaugaacagaauaguacucacaggagguuuaaaauacauuucuauaccgguuccaauaugucuagacaagucacuccuaagagauuccgaguuauuucaaggcaucuucagcaaaaaaugagucuuacaugaacauauacuacaauauccacguguacugcacugcugccgcuuaaagcacaggaucgcccagccaugcuucugacgccacagcacccagugagcgggucuuucugggaggcagcacuguauuucugaagugcauaacuuucuuuuccacucacauuauagcugacaucaaacugaagaaagguaacugugaagagagagcuuaggaauccagugcugccuuucuaagacaucaggucagugcagccuuuuuuuuuaacuggcagugucauucaaaguugggcagcaucagcuucuagacuuuucugcagguuguggcacagggaagacaaccacaccaggacaauaguccugaauggucauuggugacaccauggcucuuggcaaggcccuaggugucaggggggaggucugcacagugacaccuguccaaaaaccugccaaaugugucagagaggccaaugagcacccuccuagagcuauccagcaauaauccggcaagcuaaaugcuggugauauggagccagaaaggcuuggaccuucacuucaucacuaguuagcgggguggcuuccaacaaaaauuuaaccucucuguccccucuccucguuuugauuaugaggauaaggagguucuugugauaaccaagguagccagugcaaccaagugugugcuguccgccaggcacugcuccaggcuuuucacauauguaacuaacucauugacaucccauuccucucuggggucaaugcugucacuaccccaacaguuuacacacagcccacaggaugagaaccccagagggcuucucuccaaaggagaggugcaccuggcauacagacagacagcaguggugaaauccucccucagcuuugucuugcuuucuaccacacuuucuccauucugcugucuucaaccucccauacagcuccagcacuguggaggggagaggagguuggaccccuuugacggggguugcuugacugucuauccacugagacagagauguuaccuguuuacucaguggcucucuuaguggccgagccugggccccagaccggggcagaaggcaucuguggcuuuagugcauugacuccccgacugucuauggauucggaauuuuguguggguguguacuuuccuacacagcugucauuagacuuucuaaaggcuggugaccacuaagaggccagugaccaggaacaaccuucccucuaaccacugcucguacuuggcuaucuggguagugcucuggauaagcaacacaugagaagaugggagggcagcuuguuuugugacacccugaacgaugccaucugugggagcucaguggcccuggagggagcuggccagaggcucugaauguccgaucuguucucauaauuccuguggcugcugcuucuaagcacaggcagggcugcacucgacgaugcugccacaagauggucuuccugcaccaguggagcacaugguguguuguuucccugcguguguucuuaaaagguuagguuuagcauugucuccugagugacagguauggugaauuaaacuagcuccagcucgcugguuugaccuguagagaagaaaucaagucucuguaggccuguccagcugagcauguuuucaaacugaaagagaagugguagaagguugugccaccccugcaguccaucagucacaccguauauguuccuccauuucacugucacccccugaagcaugacagucucugcagcccagaguacagugcuaaguaagucagacaggguuuuuuuuuggcuauaagugggagcucauaaauccccuuacagacuccaccauucuuccgagcccagugcucagaccucccggacucacguaugcccuauaugccugcccauuccuccaacccugaguuccaaaacccaguguccacacugagcuuccucccugaggaugccuugcaugacuggguggagucuagauagucugagucacacuuuuuuucuccuugcaguccaacuuaggaaugagccagcacaaucugguuuagcauuagcuaacaccuagaggccgcccuucccaucccucucaucugcuccauccuguccaucagaaaagcugccaaaacugcaugguacugguacagugacaaacagguagaucaauggaaaugaauacacacaccuaagguuacuugaucuuugacaagggagcuaaaaaucauccaauggaaaaaagacagcauuuucaacaaauggugcuggcacaacuggcaguuaucauguagaagaauucgaauugauccauucuuaucuucuuguacaaagcucaagucuaaguggaucaaagaccuccacauaagaccagagacacugaaauuaauagaggagaaaguaaggaaaagcaucgaagauauaggcacaggggaaaaauuccuaaacagaacagcaauggcuugugcuguaagaucaagaauugacaaaugggaccucauaaaauugcaaagcaucuguaaggcaaaggacacugucaauaagacaaaaaggccaccaacagauugagaaagauuuuuuaccaauccuaaaucagauaggggacuaauauucaauauauucaaagagcucaagaagcugaacuccagaaauucaaauaacccuauuaaaaaugggguucagagcuaaacaaagaauucucaacugaggaauaccgaauggcugagaagcaucugaaaaaauguucaacauccuuaaucauuagggaaaugcaaaucaaaacaaccuugagauuccaccucacaccagucagaauggcuaagaucaaaaauucacgugacagcagaugcuggcaaggauguggagaaagaggaacacuccuccacugcuggugggauugcaagcuuguacaaccacucuggaagucagucuggagguuccucagaaaauuggacauaauacuaccagaagauccagcaauaccccuccugggcauauauccagaagaaguuucaacugguaauaagaacacaugcuccacuauguucauagcagccuuauuuauaauagccagaagcuggaaagaacccagaugucccucaauagaagaaugaauacagaaaaugugguacauuuacacaauggaguacuacucagcuauuaaaaacaauggauucaugaaauucuuggacaaauggauguaucuggaggauaucauccuucaugagguaacccaaucacaaaagaagucacuugauaugcacucacugauaaguggaauuagcccagaaacauagaacacccaagauacaauuugcaaaacacaagaaaaucaagaaaaggaaagaucaauggguggauacuuuguuccuccuuagaauagggaacaaaauaccugugaaaggaguuacagagacaaaguucugagcugagaugaaagaauggacuauccagagacuaacccaccuggggauccaucccauaaucagccaccaaacccagacacuauugcauaugucagaaagauuugcugaagggacccuguuauagcuaucucauaugaggcuaugccagugccuggcaaauacagaaguggaugcucacagucaucuauaagacagaacacagggcccccaauggaggagcuagagaaagcacccaaagagcugaagggggucugcaacccuauagguggaacaacaugaacuaaccaguaccccccagagcuccugucucuagcugcauauguagcagaagauggccuagucggccaucauugggaagagaggccccuugguauugcaaacuuuauaugccccagugcaggggaaugccagggccaagaagcgggaguggguggguagggaagcagggcagagggaggguauagggaauuuucgggauagcauuugaaauguauauaaagaaaauaucuaauaaaaauaaauaaauaaaaagacacgagaaaacaaacaaaaaacaaaacaaauaggaaaagcugccaagccuccuucucaaacacaucuuccauccugccagcuucucagucuaagcuguugucccuucuccccagccacacgaccuuccccuaaaaccauucuguauagaguagccuauuuccucaaucuucuucaucccuaaaauagauauaaugguucugucaaccccaggacuagcagacccaauggucugaccaagguaagcacagagcccggcugugggagcacuucaccauucacaguggcuugguccccuaccccuuuacaguucuccugucuccuagaaaucugcugguuacuguguugucugccauuaaaguguauugaagucaggaucauauuuaagggcugacuuuuuacauuuucuccauuggcuccccaggcaauggcucaacguugaguucagaggaaaucacuguagaaaugucauccaccuuaggcacaggugcuaaugcuucaaagaagcagcuccagcaggcaggucagcagacacagcccacgggagaaccaugacaguucucucccaagggguuggcaaggcaggcuaugacuuugcucccuggccugcacugcccccccguggaagccuguccuaugacaccuauccugggagaaggugggaccguucuggugccugugccuggaucacucucucgccugcugugcccuuccuuccuucuucuucuccaugccuccccugcccagagucggccuugccuuggauaaagaaaagauguuggcaaagggaacugcagccccaaagccaucaccacacacggcuggguuucuaggaugugcaucuacagaccuccaguggcuucccaucuuucccaaaggccuucuguccagaggcaccggggagagggugccuguggcccuucagguuuccucaaguaucuccucuguguaucagaaacucccccaagaguggccucagacaguuuccuugggucucugcugcaaucucuugcacccagaaagacuuagaccacuggcuuuucacaaagcacuuacuuggcugaggugaagacauugaugccacuuccaaagcuggagucacaggaaccuggaccuccugugggaagaagagggacaaggugaugcuuccugaagccugccuacuugucuguagagacaagacccuguucucuccuccucagcacccacuccuccacugaggcuccugagaaggaagccaaggauccagcacuuuuacaggccccagugcucagcuaggcucagggcucucacaagcuggggacacacucaugcugaauacaaaugggacauuucagaaaggucugaagguccaagggcaguggcuguacaugacuuagguuauguaacaucguggccagcagggaaugcaggucaaguucacaauaugaugcuauuucucauccacaaggagggcuaaugacgaaaugcaagaaaaugcgaguguuggcuagguacacaucacugguggaaaugugaagugguguugccacaggcuguacaacaggcuggaagcuccucagaaguuagacacaggugcccagcagcugugggcaccugugugcccucuaagagccccacccaagagcaaugcaagucuguauccuguaucuuaugcuagugugaccaccuaccauagucaaaaggugggcagagcccacaugccuaugcauggauaaacaaacuaaaauauuauuuagcaauaaagagcaacagguuauauaauggaugaacuuugacaugcugagucaaagaagccaauuccaaaacuacauagcaagauuccauucacuggaaacgauuagaauagacgagucuggagacagaagguagguuagagguuacagagugcuggagaauuuugggaguauggggugugaugggcaaggacuuuagguuguugaugauguccuaaaauuggcugugauaauuauacaacucagugaaugaacaaaaguugcuaauuguacauguucagcuggguauguagagucuacaaaaccucaauaaaaggguuaaaaugauucugggaaagaauuguaaccuugaacucugcacaagucccuuagcauguggccaauucaaaaccuuuacuauacuuagcuuucugcugcaaaacucaagcaggacaggacugagauaaucccaaccuuuuucuuuggcgcuuaauuaaguuaucuaaagagccaagacuuugcgcaucuggaaggcugccagugggcucucuucuaaccccaguacuggccaggcaauggccacagcucagagcaugaaggaaaggaggaggggucagcagcgugaggugcucagauaaggggucaguaccaccauucagugcugagccaaugcagccccaacaggaugcacugcagacaaaguacuucgauugcaucuuucccaagugcuuaacuucaggaugcaugagagaaaugugaguccaacucauguggagagguggucagcaaagugaccagccagcccuucauaauugucaagauuagaggugauucagaggacagcaauugguguaauguggaguuuuaccuacaaagggacaggaagggacaaauggggucagcaguguccuaacauauuuccagacagcucagagaauauacauaaggaucucuuuauucauuuucuguacacuuaaagugaucuucuaaacugaggagaauauauagacuauggcguggcagucguguggggcugagaaacugaggauaccuccaugacugcucuaaaccagacaauagcaggagccugugauuuucccagagucacacacacacugagaaagaacaagaggaggcagggggcagacagagacggagaaaaaauugucauaguuucugccugggauuuuugucacaguuaccugcccccuguauucuaaauuuucagugcuucucagucaggcuugaguucaaaauuucuugacaagggugcauggugacaauuucucaaccaggccaacaggcaaaaauuauaaaggaaaagaccugagaagcuaauggaaauugaaaccugauuuuaaaguugcugggagaauacauuuauaaugcuuucacugucagaaccaacacagaaucaacacagcaaacaauuucuccaagucaagccaagaaaagucacucagggaugcaucugccuaacaugaaugaagccaaggguuugguuucuguugcacacccauguguacacauguaacacacacacacacacacacacacacacacacacgcaaauaaaauaaaauaaaggaaagcagcugaaaggugaauguucaaguucuugacaaagcagcuuauucauuucuguagcaaaugcuuccauggcuguugggaugcauugaggaacacuuguaaacaggcaacagauguuagcucacuuacugugacaggcugacggugccaggacugucagaauagaggugaagaaggcaggcaaggucagaagauuugcucuaacaggcccagggcugggugucacugugcagcauucugaggagggcaagcugcucuaagaggccaggaacugcaggaaaucgucugacugcagaguaagauguuuucgcucacucaccagggccugaacauuuaagagaugccucacugccauggaaggcugggagggagcucaggcgucuccacacuggaagugcuuuugcagccacuggcccucccagggucaguucagcacuauggacucacgugggaagugccccauucuacagguuccugcacaugcuaagcaagugcgccaugacuagagccacaccuccagucacucuuccugcuuuuagcuggaauuuucuauaaggaggagcuguccuuucuuugucacucauucauucauucagccauuuauaucaaacauuagggagccauagauauuucuuaugugagguuuuguuucuuuuauucugacuuuuuaaagacaaggucucauguagcccaggcuggccuugaauucuccauguagggaggaucaaccuugauuucuuaauccuccugccuccauagcccaaggauuacagugcagcaucaauccagcuguucuguuacagaugaugacuaacauugucccuacugucauucaaaaguuuuaaaguuuacaaauaaaauauuuucuaaaaauaacaaaccaaguuuuuagccuauuccaaaaauagccuauggucuuucuuccuccugguaaaggggaucuuuauuucuguguuaaguaagaggcccacacugccaccugccuucucuagucacaggaguggaggagggaaggcuauggcagcaggccaagccuguuguggcauucacccuacuuaugucauggugcgcagggccuggaggcagguggaaagaggaugcagcgagugaugggaaaggcaggcugacccacgguuaggguccguaccccugaaguccacccuccuucucuuauaggaagcuacauaucuguggauaaaaugucaggauaccaagccugaaucuccaaucgccucagccagagccucuguuuccacccaguccccuuccaugagcaacacagagcagacagacacgacucggcaggaauggcgcucccuccugcaacucuggcacugcagaggcugacaugggaggaugcagaguugaauccuggcuugggugacacagcaaaggccugucucaagaagaaagaagacaggugcagguagaaacucaccgugaggcaguuugccacaggauuaucugcucuaccaacggaugcuuuggcuagucacuuacuggggaggugguuuguggaggaaaacaggaccuuugugugauuuccaguaucuuccucaguauaauuuuuugcauaaguauguguguguugugugaauacaugugugaaaguccacuuuuguggacgacccuauguuugcauguggaggccagaugcagaugucagguguccuccuuuucauuuucuguacugagauauguuuucugcugaauauggagccugcugauuagacauggcuagcuagccacuucuucuggggauccuguuucuaccucccuagaacugaugugugccaccaugucuaccuuuuaugucaguccuggggauccaaacucuaggccucacgcuuuaccuacugagccaucucuucagcuccgauccagucucuuaacauuuugaggaaggaaagaagacagacagaauauaaugaccauucagucaagugaacuauauguacuuuguuccuggcucuaaguggagaaaaaaacaaaacaaaacaaauccaaaaguccaacaaaauaaaucacaaguccacggggaacuauaagcccugaauggacacuggaucacauuagggcagggguucucagccuucauguugcugggguuagagccuggcauucagcagcaagccuuaaaaauuuacaaauguaucuuuaagaaacaaccacagauguuuguaaaaacauuuucuucugcgugaaaguucuuuuuagcaaggauuauaggauuaagauggaauuagaaguagcuaagugauuuaugauagauugguuaaacagauuagagcuuuaucuaucugauguaaugacacaaggucagugcauuaauaggaagcacaguuuaaugaacugggagaugaugaacuacauccucaaagacaaaagacguauuugaauuaccaguccagagacuggcuuuauuaauauaccuaauuauacaaugcuggcuaagagggaaagucagcauauauugugauuuuaaaaaacuguacagaaacagccccaaauauccacacaguggaagaaauaacucuaauaucuacucacacaauggaacaguguucaucuauaaaaagaagugaaguacuaauguaugcuagcauggagaaaccuugaaaagugaagugaaggaagcuagauaugaucaggcacauauuguacgauuccguuauauggaaugcucacaacaggcaggccaggcccacagggcugaaggcagcacagagcuggggaggguaugaggaucucacuggggcaugguagaaauguuuuggaaauggauaugucaaaagauauuaaaacaaguaaguuguacacuuuaaaauaaugucaauuaaaaaaauaaauuagugcagauuagugcugacuaaccuggaaagauguguacuauuggugaaaaaauucaagcuuguaaggacuccauuuguguguguguguaaaaacaaaauacaagagauacaaguguauauuuauacaucaaaacaaaacaaaaacaccaagaaacaacccauuuacaguccacuugcacacuguagcuagcaguggggaguccugggugaugcacuucaagugcaguccuucuaccaccucuucaggaacaugcauuuccuuuacaguccgaagguuugaaacaaacacacuguuucaagaccucugggaagcugcgccugcacacugcccaugcucccucuccuuuguccagguacaggcccuugcgaccaucccccagugucaguguaacccugcucuguagcuguucucacaggcagaucugcaucugauuugucuguacuugcagcacccauagauagagcugacaaauccugccagagucagauuugccaacagguggauuuuacuacaagcacccuggagcugccacuagcucucuacuggaauccucuguauagccucccuucucacuugcuacuuacucauuuagaauucaaugaagagaaacaagacugcagaaggcccagcaagaggguuuugcuaugggaacacauauuuaugcucugacuuacaaugguucuugauguccuaggacuuaacuaccucaugcugcaaaggagguauucuuagaacaacuguguuuugcuuucaauacagaguuuacaaaacuccacauaaugccuccaacaggcuuugagauggcuuuggcuagcuguaagugcucuaaagguguucaaaugcauugacucccaguauuuucagccaaaggguuuguggauuacaauuuaagucaacgagcacccauguuuaaaaaaauacuacagcauuuguugugaagaguauuuguuauacaagcaaacaucuauuuuggaacucacagccacccuucaaauuaggugacaaggguuaccccacucaacaaguaaggaaacuaagcuuuggaaaggcuaagcaucaaggccaaguguggaagcuaggaaggcugagaucaaaggaggccaagcaguuuaagggccaaacaugccagaaucagugcugcaacagccaagacaaguagcagaugacagagcuggcuggguggguaggugagguggugguggagugggaucaggccaggcacauugaauaccacaaggacagugucagggaaaggacuuugcacugcaaucccauaauggcagggcaauggggagcugcagguggacauggcuggggcagagagugcagaggaggagcucugugcuuuggcaggaagaaucagcucuggaggguuaggacugcacauguauguuuggaggguuagaacugcacauguauguuuggaggguuagaacuguacauguauguuuggaggguuagaacuguacauguauguuuggaggguuagaacuguacauguauguuuggaggguuagaacuguacauguauguuuggaggguuagaacuguacauguauguuuggauacaugcagacacacagaggaacaggcugcaucagcaucagcugagcaugcaagagacucaaagaggaagaccagacaggaggcaccugugacagagaggugguccugggcagaauagaaggagcagacaaggaugggcuaaacuugcccauuucuuggcugaaucaucugucuacuagcaugcuaggacucuguccuagaaaagaaugugauuagcuauaaggugagcaaggcugagaauaaauguaaagcuucaaaugggauguucccauuucuagaaacuacuauaaaguuugcuguucaucucuuucaaugcuguuuaugagguaguaaaauccagggcaaacugcugaaauguacucugguuuaggguaauguucuccucagcagacagcuacuugaagguggcuuugaagagcugguuaaaaggauaaggacacuguacuggcugguaaucaaacccagggcucccacgugccaguggagaauucucccguuaaacuaccaacgcaccagcucacagggcacucuagagcugcugccacgccccagaguggaucagcuccucuccagagaguucacugcugccucagaagcaaaaaggaaggggcaggacugccaccucugcauauauauuaacugaaauacaauuuacaccacaaaauuuugauuaacacaacuuuaccacugugaaguauauaaaugggugguucuaaguacaaucacaaaggauuugcucuauucaguucuagaguauuuccaccgucucccagagcaaccaggaucugucccaggcccacugucccuucagcccaggcaacuacucuucuacuugcugaugggaguucagagacaccaaccuucaugucaagacaaagucggaaggaaaccaagcaaaaacaagaagagaaaguuuuccgacacagaaaaucaagaugugggauugacgcaucauuucaauuguguaauguuaaaaaugugacacugcucaucgucggcgcaggcaauccugcugcuuuguaacuuuucccuucugugcaacauuucuaaaaugagaaccaucaacaaaaagcucacauaccagcacaagcucacaaacugucuauuacugagacuucuagcuuauccuagaaagagagcuuuuccugugcaaggccuacauuaaccuaccgaaauuuucucuuuccaggaguugucaaaaaguacacaagcuacugcucuggccacgucucccucuugcuggugagaaaucuaccacagaaccaacagugcuccaccaaugcuccugccaugugcucuucugucuccagguguuuuauugcucuggcucuggcacagcuguaaccugguacccaacauagguccagcaagguagcucauuuucucuucuaccagccaaacccacaggaggcggcccugugaccuggcagaaggcugucugcuaacccgucaaggagucagcaagcacaguaagcacgugccauggcuauggcguuucucuggcccaaauguagguuccagacccugcucugucacccucagccaucugcacagggugugcauccauuuacucucugacuaacugaaaaggaggacucccccugaggcugucagagacacugaggcagagguccaggagauaagaccagcagggcuuuagaggcaaagucuaucuccaaucagcauaaaagaaaaccaugucaaaaagcauuggaaggacuguuuaaaggcaaugacuuaugcaguagaaauuuccaguacuuaauaaacuagcauuuuccugaccuauccucccugagaaagggccagaugcuaagaaucaaaccaacugugcagcucggugcucuuauguucuuaccauguucccaauaaugacuugaugguggcugaucccaguuggagaucaagggcaaugugucaugucuuuugagguggcaagggugaagagcaugggcucugggugcagcugccagacacuagucagcugucagagccugcaggagugggcuaacaacuaaacgagucaacauauguaaaugauacuuuagguuuagucccgggaccucugucuucccagcagcagaaacggggacucugacucuggucaggguacucaccacuggcuguccccuccugcuuuggcagggaauccucaggguuggguucggucugcuucugugcuacugacuuuggcucaucggguucaucauccucaggggugaccagcuucaucaagcucugguuacacacauuggccaccuccuugauaccugucuacugauguaaggaucaccccuaugcaaagaccuccuaaagcccaaggccaccaggcucccuggucacauagacuuaguccucccuaagucucguucuuguuacaugcacccuugugagauaguccucuuucuucucacaggugguuccuccuccauuuggauauuucucacccaagacacagagggaugagcucagaaggguagaaccuuggcacaugagauugcugcuccauaucuggaaguaagccagugaggacuggggacagccagcguuagucuugcaccucuggcuuucccaauccacauucagcuucaucucuugcuucccaggagugaaggagccuaagggcguccuucccauucacagacccaccacuucaaccuccucuacagagggaaggauacuuuucuugcggucaucauaggccaagcauggcaggacagcagucaggaucccagaggaauagggcagcauuacccggcccgccagcuggaugaauucccgcauccagcacauagccgucagcugaaucaggucaucuggaagagaaauugguggcuucugguggggcuggcacauacacugagagcuccuccuaccucccaagcacagaggcuaggccuggaggcuugacugcuucuagcuauaugaauacaacauuuccugggcucccugcucucuacagggcuguaaggauagguuaagagugaaaaucuugcgcuggauuucgaaaacagcagcgauacccuugccuguuguaauaugacacacuuccuuucuaaguggaauucauuuuccuaucauuggacccagaaaacuugcuacucuggccaacagcauguaguugugucucugguuuaagcauaggaaucaagaguccugacaaugucuguguccugugucucuuggaacccugcuaaggccauccaaccuacuggauacugagcucccaugucagaugugggucacugcacaccacaccuagcuccaacuaagccugaaaucauuaugaccagccuggacaugggagcaaagucaccuagcugaccuggagguucuuggccaguaacaagcagccauugcugugacuguuucaugugguuugacagccaauagaugcugcgggaaaggcaauucugaccuccacacguccuaucuuuaccuaaggcaaagcacauccacaaggucuucaggccaggugaaaguguaugcuuaucagaggagaacauagaucucuucucacacccaccacccuacugcuuccagauccagagucacaugugguggcuagcccacaugggucccccuucugccccauacugaagucuagauaugagagacaggggcuucugaggcagcaguuguagcuacagggccuccacacacucaccuguggucuggcaguggaucaccaggauguuggccaucucagcaaacuucacacuggauggguucuucuuaauuucuuucaagaacucuccaagaaccaccucacaccuaccagugagaaaaggaagcauaagcuagcaugaaagcccauuucugcucugggucaacccuauacucgucaggaggacacugagcaggggcugggaaggugagcguucuacuccuccauggggaaggauauaggaagaaguucccauagacacucgagcgaguggcagcugccugccguuucccacaacucacauuuuccgaaucuccuugccauugucacccaggaucuggaagagcccaucuaggaucucuggcagguaauccagcagguuaaugucuggcaccgacaccagaaccaggaucugauggaggggaguaggagagggagagcugagagcuggcccagguguagccuggucuccuacucuucccuugggaccagcagcagaaggacuaggguccugugucacagcauuguaguaucuacauugcagugcugcaggaauuuuucuguucaaugugcaaggaagugggaguuugacuccaggaggauuugggugcuagaggagagggcgacuaaucgagagggcuggaugaagcuagacgguucacagagguggagcugcuggauguggcaccaggggcuuccgagauccugggcaguuucaggacaaggaaagaaucacaccccuucagggcaaacaggacgugcaguaagacuacucuagacagagugcuuuuccagacaaggucucacuguguggucuuaacuggccuggaacuugcuuuauugacaaagcuggccuugaacucacagagcucugccuguuucugcuucccaagugcuaugaauaaaggcaugugccacuaugcccaacccacaguguuuuuggugaugagguguuugaagguuauuaagagguagagacaaagaggugucuuuuagucaaaauaaucacuguguguccccuaguggaguccacaugauuccacuagaaacucuugguuguuggaagaaucuaccaaggacugggccauacccaggagaugaugaacugucgggcguauugguuguuggaguaaauccucucccgcaaaagggggaugaagcucaccaggucaaacuugcugcuuucugucacaauguccuguggauugaagagugagguuaugaaaagccagcaguggguuugcugugcugcuggcccugggcucacuugagggucagguaaccauggagagaaauggcagagccuaagccagguaggagaggucccuggagaaccggcauugugauaggcccaaagccuaacaaaauaauggauggccagcagagaagucaauagaccuaaaugaauggcaaaacccuacucugaagucugggccaaggcuuggcacccugucuuggaaggcugggucgaaguucaauuucaucauucugagugggguaugaaaacaagauucuuaauugcuggcucagcaguuacgggcacuagcugcuauucuugaggaucuggguuagauucucagcaccccagagacucacaaccagcuggaacucuaguucuaggggauaugacaucccuuuaucaccucugcagugaccaggcacacaggucauagacauagacauagacauagacauagacaugcaagcaggcaaagcaccuauauacauaaaauauccaauccccaccccaaacagaagaucuucacuuagggggacagcccaguucuguacuuugacagugguaguaacacagcuuuacauaugucacagaaacugcauaccaagcagugagcuuuaauaugugugugcuauauagaaaaacaacuuacaugaggaaaaccaccagaauuucuacucuacacgcagagggaauaaagucuaaaauacaagaagguuggagugggguaccuuuaagaggcgguccaggagcucagauccacuuuucacauuggggucugggucagcagccaacuaugaggcaccaaaacagagaaacagaggcaauguucagucacagugagacguaagccuagagaccgaaugcaaagcaacagccaaggccaugaugcagaucagcacaccacguggugucuuucccagugucugacugagaaagguaguuacaaccaguuacaggagaguucccauuuguucagggguaacccaagaucugcugggguucccaggccaugcuggaacugggucacacgguuguucccacuggcugcucccagggcacgcuuaucuuaaaaggcuugguucucucaugggcccccgagacagccgugaggguggcauugagaaauggucauguuguucauucuacaggggccacucugcacaacugaguagggugacugccccaggcugaggagagagcauccccaccagggugaggggaaaggcaacccaccagacugagagccaagaaggacagcaauagggacccuaaaggucuauaggggaucacucuuuagcacagggagcuugucaugacuguccuucaaagggacagccuguacuguggagucaucauuguuaccuuugccugggagguuagugcuucucaaacuaugagccuuuccgauaauguguacagcaggcagacauuuccacagaguggaaugagggugaacgggacuuaacgauacacugauacaggucuaugaaaaaucagaccugggcauuaaguguccccugcagcagugucugcuccugcucugccugcaucugucccaagcucucucucaggguccuagaaagucaagucagguaggugggcuguucuuagcugaaucagaaguuaccuuacucaguccaucgaagagaacauugaagugcggcagcacggcaccucgggccacuuugacgauauuguagagggccucacaagcguaguagcgcagccugcugucugcgucauuaaagcaggucagcacuggcucuaucagcuccuucagguagagcccugaguccuguaacgagcagccaggacuagucagaaggguuaguccccucccuuggagacgcucaggccucugugagagcugagcuaaaaacacucaucccaagccaaccuuccagaaguagaaccacacuauggggacauggcugccaggccacacggugauauuugcuaguaguccuaaaugcagaagucuugauaaaauacacaucuguaaugguccugcugaggcucagguaggaagguauuuggucaccucaaucagaaugaagacauaccuugccuagggcaauagagcaggcugccagaccgaugaggcccccuuuccggcugugggggugcugggacagggcaaacuccugagacagggucuggaucacgugcuugauuugcaugguguuguucugggccacaaagucccgcaccagccuggaaagaggaaagagaaagcaugggacacacaaacccgggcuacuucugcugucugggcuccagggcagguccucucgguucugcugcuggguagguccuaaccauugcccugcucagcguucagugaggaguaguggggccaguuuacuucugggaaucugagagaauguaaauuacugucuuaaaaaaagcuaauacccauuuuuaucaaacacuugcucaguucugcacucaugcaucugaggacuccucuguaucuauguugggacacauggcaaaaucaaaucacaaacacaaaauuguagcaaaauagaguagugaugucacagaaacagaauacgcuaucucuguccaggagacuggcgacagggcagucccaucugagguauuacuuuagaaacauuaacagacaaugcccagggaaaggaagguggguguauugcuccauuugccuacugaaaagaaaugggaaggcaggaucauguacaguaggaaaggacaucauuauggguuacagaugacucaagggcuuuuaagugggaggagcugucagaucauaggcccugacuucagaagcuuauaagaagguugggaaagaaccaauccugugcgguuucccaaacaggacaaaccagccaggugaagcccaguguuucuucaaugaaacagcccugagaagagcucuacagacaccacaccaaacagcuggagcauuggugguucagugguagaauucucgccugccacgcgggaggcccggguucgauucccggccaaugcagagcuuguuuucuuuucuuaaaaaaaaauuauguuuuaaaauuuauuugcuuuauuacuguuuauuuguuuggggggugugugggucccuuucuggucaguuuccucacagaacucaugccagaggagccuggucccucaaccaaacaaggccugaggcagcccaaggacuacagauuucugcucagaguucauagggaguugcugggcucuuugacaagugugacuggcugcaggagucuggcuuccucaucuccaccugaaagaacuccacagugcugcccuuggucugggccagucgccagcagaacgcagugugaaaacugagagcagcacaccagcuccacggcagaggggaggcucgcccacagucucuguguuuugcugcugacugaggagggaguggagcucucuuuccugucucaaagcccaaaggcaaauuuacuucacaugcacacagaccuacacucaccccucacuuccuucuggcucuggagcuugcugcucuucuugaagcuaagcugauguggcaguaucauaaacugggcuaugacucaacauauacacauggaggcccagggaugagguuauagggaggugccacacagcugcucacagcuggagcauuggugguucagugguagaauucucgccugccacgcgggaggcccggguucgauucccggccaaugcaguagcaauccuuuuaauucuaagagaugaaaauuucacacugccuaauaaauuuuuaaguauauuaaaagaaaaaaaaggaaaugacuugguuuuggccuguuuuuaaauguuccucauggaaaagcauuuucuaaauuccacagagauccagaacccgugagucuucuugaaggaucaagaacauggggcuauaccacacacaguuacugagagugaguaacugugccucccacuccugcccagaagcugaguucugcuuuugccugcacaaggcgcagcagcaccuggaauguggauaccguccaggcuaggccaggacucaagaggagagccagucucccucccagucaucccugagacaugcuccucuccuguccuuuacagauuccuggacauucauggagcagcuggggagcacuccucccagaugucagcccugcacagacucauucucuggcucugaaggaugcucugcugggguagguggaggaugacaguacaaacccaucaagaguggacagcaaggugaggaaggcaggaaagcuggggucuaaucggcgaguuauguugugguccuaugugaguaugccugggagaggguucggaagugugaggagguguucaucugggcugaggcaagaugggcaaacagcuggcaauccugaaggcuuggcaaagcaaucccucccaucucccucugguggccaugaggagccauggaaaguggccugcagcggcuggaugggauccugaagaaugaucuguaguuggggggcgggggaugaauuugagaggcaguaaggaagcucugaagacagcacaggcucccacaaagaucuacagggaaggggagaaggcauguggccuuggugccagagccacuacuuucaauaacaggagguuuuaaagaagauggauggugggggcaauucaugagcucaguggcaccuuucucccaccaacuuggaaacuuaucagggcuuaauucagucaccccaggucacaacaaaggccauuaaagacccaugaccacagggaccauuacauuaaguauaaguuucgguaucuucugggaaaacaagugcaaagcaauugcgcccccuggaggggaaacuacuuuagcaccuucucaucaguauuacgagcucaaacagcacaagggcaacccuugggccaaucuuguuucaugaaucaaggccacccuuagcagucaaaacaggccgcaugacuuucuagccugcccacuuucccucucccacuuccaccagcugcagcuuccuagggggccugcuccucucacauucaggccuguccuccucagaugcccugccucuacaccuuccugcacuuucauggugugcgguguuaguccuccuuggcacucagaagcacuuagugcccagaaguguacugauuggugccaccaucuaccaccuucuaccuccauaaagcuugaucagggcuuugggcacugcccacuuugcaauucuaguaccagcggucuccagaccaauuuuuugcauccaacagcuggccaaucaguaaacacccgccaguggagucagucuucgaaggcuggcagagaugaugagggcacagcuguagggcaaauaugggugaagccuugugcugccauguugcuugcaugggaaaacaugaccuggggguuaacugauguagcuucugacagugcugaggcccuucuaaccuuaccacaaguuagcacgagcaacggcaccuuuccugcaaacucaaaacgcacacugagaagagcccaguccucuauagccacggcugcugacuguagagacgugcaugcacuugcucgcgcgcgcgcauacacacagacacacacccacaccauggacuugaagugcuccugcugagggucagcugcacucuaaaacugugcccucagccagccagugccuuggucucaugacuucacagggacagugcagagaagaaaagcaaccccaaggggagcagaguaagugaaguucaacagcagguuccccagcuucaggcuuagucuucuucaaagacaacaggcugccucggcuuucaucuacugcuugggagauagaaguggggggucuuuggcugaacucauuuuugaaguuaauaucuggccuagaaacucuccuaucccugggguccuucaaugacacaaaggacucaggauuuacuguucuauacuccaaagaagagaugcugcuacugccugguuucccuacaaaguauugggaaaaaaaagguucaacaagccgauucccugguagcaccauguccuuuaguggcuuaagagcuucugcuugcaauuggcuggagguauaggagucugguagagacgcccaaaagacauaagcaucagggugggcuagcacugaguuuaacaacugccuaugauaucaaagaagcugcuauacugauugcucccuuggcagagggaacuacagcuccauaggauauuuuuggauugcuaucagccaagaaaaaaccuggagccacacugugugcuacauagucccagccugcacugauaccuccaggcucuggaacacaguauggugacaucacaggcuauacaaggcuugguaagucagcaagcacucucguuaugcugcagacuucccuggucaguuacuguagcuacaucauccucaacuucaagaucugaacaaccuuagggagaguaaguccacuucucaggaucacagguuugaacccuugacaucaacaagguauuauguccuuuaaacuguaacacaguuuccuccuccucucuccagaggcccuuuuagcuggaaagugaccacauucuauaacaauucuuguguagacucagcccgucaggugacccagucaaaggacucaggauuuacuguucuauacuccaaagaagagaugcugcuacugccugguuucccuacauauugggaaaaaaugguccaacaagcccuuucuguaggccauccaccugcugcucaguguuuagacaucuccccuccacacacacagcgagugcagacaagcuacauccucaagacauucugaauuaagccuucuacuguggagauaaagaauuuacugcccaccaggcaagcacuggcuguuuacacuaguguacuggcuacuuuuaugucaacuugacacaagcuuagagucaucugagaggagggaaccuuaguugagaaaauaccuucagaugaucaggcagaaagggaccagcccauuguggguggggacgccccaccccaccccuggugguccuggguacuagaacaaagcaggcugaacaagccccuaggagcaauccuguaugcagcaccccuccauggucugagucagcuccagguuccugcccuguuugaguuccuguucuuacuucuuuugacgacaaacagugacguggaaacuaagccaaauaaacccuuuccuccccaagcugcuuuggccaugguguuucaccacagcaaaugauaauccuaagauaauggguacucaaacugaaaccuaaaagcugccgcccagucuggcacuuacucuaguuuacagaugaagaagcuaagcaacccaaggccacacagcuuugggaaagaaucacaaggacuucacuuuuaaaaagagaauuggauaaggaguagcacauauucugcacugcaggugcucaagucagaaccaggagauaaugcgcucuacgcacgccaccaagacacugcucacucagcacgcuggcugaggagccuggcucccucuggcuccgaggaggagaaagguaagccagagcugacacucaugccuuuguugugaagcuugcagccuaugccuggggcaaauacaauucucugucucagcucccccugugacugacauccguauucagauggcacauccaugcagugauuucccaaagagaaucuggguaaguaugucuccaucugcuccaccgagugccagaguaaguugguuuccauuugcucacacaucaccagaaaacugaauggaaaugagcacaggccucugaggccaggccaacugucuucugacaaggccugggauuuaacucacagaacacacacugaguuaggggacaaagccagggaugaguagaguaaaaauacaugguacacaugcaugacauuaucaaggaauaaaaauauugcauuaaagaaaccuaagggcuggagggauggcucagcaguuaagagcaguugcugcucuuccggaggacauggguuagagucccauacucaaauggcagcacacaacuguaacuccaguuccaggcuaucuuauggccuccaugggcacuacacacacacggugcagacaugcaggggaaacacucauucacauaauaaacaaaaagucugauauugcucccuaaccaaaaaccauacugagcacucacuggcuauggcugggacaaaaggggaccugacuguaggugacaacugugaccauuaguaagugcccucucccaaugauguaccgucuaucuucuuacuuucaaagaugagauaugaucuacaagccgccagucuuacuugcaaguacacagcccagugauuuuuaucacguguagacuuguagagcuccaucacuuuaaggcauuuccauaagcucuaaagaaacccugugccucugagcugucacuccaucucuagcuuuuucuucucaaccucuggcaaccacaaucugcugucgcuagagacacaguacuucuggccuuucauagcugccugcuucucucacccagcauaauguuuucaaggcacauuaaaaauaaauaaauaaauaaacaguaagccaaggcacagagacauucaaccagaagucauacauguaaucuuugcuggguggcaagagugcacacuuuuaaucccagcacuugggaagcagaggcaggcagaucucuaaguuugaggccagccuggucuacagaaugaguuccaggacagucagagcuacacagaguaacccuguuucgaaaaaacaaaaacaaaaggcaaucuucacaguggguagacaggggagucaaacaaagccaguggggguacuggugugggaagccuuggugagcaugccagcaggaugguggggagggguuggcucuuguugaacaggaauguggcacccccagccauaacucuacagaaacucaaauuucaucgugaacuugcucugagauucagaccagaacagucuguaggcagaacguagcaagcaccagccucugaccccaggucuaagcaaucugcuuaugaacagcaggacugagcccaaacuccaaacuccacaaauugccucaaaccacucuaggccaugcccaggaacuccaauuaugugaguagcacucagagcucugguaccuaacuuugccuggguucucaaagggcaccacauugauaggcuuuuagaauuccaagugcauggaguacuacucagcuauuaaaaaugaugacuucaagaaauucuuaggcaaauggauggaacuagaagauaucauccugagugagguaacccagucacaaaagaacacacaugguaugcacucacugauaaguggauauuagcccagaagcucggaauacucaagauacaauucacagaccacaugaagcucaugaaggaggaccaaaguguagaugcuuuaguccuucugagaagggagaacaaaauacucaugggaggaaauacagagacaaaguguggagcauagccugaggaaaggccauccagagacugccccacauggggauccaucccauauucagacaccaaacccagacacuacuguggaugccaagaagugcuugcagacaggagccugauauaguugucuccugagaggcucugccagagccugacaaauacagaggcugaugcucacagccaaccauuggacugagcacgggauccccaauggaggacuuagagaaaggacugaaggggcugaagggguuuacaaccccauaggaagaacagcaauauuaaccaaccagacaccccagagcucugagggacuaaaccaccaaucaaggaaaaaucuugagugccuucgccuuugugaaauuguggcaccaugcugacagaggcaguggcagaaaguucuucaggucuagugcccagcgggcacuccacguguacuauuagagguggucacaccaugcuagcagaguggaaccacacaugccuuuccuuggacauuuagcaucugaggaccugcaauaacuauaagacaucuuacuucccacaggaauaccaaaugcaguacuggcugucguaugagaagauggcuuuguagaacugaaagcagcaacuaauaucacuacagagauguccaaggaugaaauucauuauacacacauuuccccccacuuugggucggggaacccacuaacaggagugggguuucuugucuggagauaggguuaacauacccagcuaguggggaugcccuuuaggacagauacacccagcuguaaaucuuggaaagaugauuuaagaggucuccacuuccucuucugugaaauggguuagcaucaucugcuucauagggcagugagaggcaggguggguaaacaauggcuaaccacagggaugcuucucuccaucccucugcaucccacuucuaccccaggggauggggcagauggaacuuuacauacucaugaucauagugacugaguacccuuuaggcuccauacucacaugaugaggcgcuagccacacccuucccccaccccccaccucccugcaaauaccuaugaaaaggccaggcaggccccuagaacugugagcaauaaauggauauuacugaagccacuagcuugugguauuuuguuagagcagcaggggcagacugcacguaacagggguugagaaaagcucacaauacacuuaauaucccucagcuuuucuccacccaauggggaguuccagccagaacuaaggaagccugagacaccagccuccuugaaaaccacaaagcacacuccuguucugccucugagauuugaaucuuauucacuggagguguacuuaaaugggcuccuaaucauaucucacucugacgacuaggcucagcugucuaugaggcugagggcuuccugcuugguuugggaaagccagagacaagcuacugucagccaggccuucagccucuuacuaagagacagcaugguaugaagcugaguuccugcuuccacagagcucaaggccucagacaggcagcagaucuagaacaacagaguggucuggaguucuagacaaacauuguaccacucagaguuuaucacuagucucucccagaguuguaccaguuuucuacuggcuccuguuacaaauggccacaaacuuagaggcuuaggacacaacuuaugggccuuacugaacuaaucagggugugagcaaguugcuguaauuuggaagcuguacagcagugugaguggacaggccuuuggggguugcauaucagauaaccugcacaucagacacuuacauuaugauucauaacagucaaacuuacuguuaugaaguagcaaugaaacaauuuuaugguugggguugcuacaacaugaggaacugcauuagaaagguugguuuuccuggagagcaggaaaaccuugccagcuuacagaugaugcccacauucucuuacuagcugcuccuuacaacuucaaggcuaauguaaugauggcugcuggagacucugauacucuccuugcuucccucuuucacacuaaaggaugcuuagggcuacaccagguccaccuggguaaucuaggcuaaucucccauuuuaaaaucacccgauauaaaaacaggucaccugggaaauuagauuuuauagauuacaagaauugaaugccuaaguucuacuuaaugagcauaauuuuuuuaaaagaaaacucuuuggaaacgauuggucuaucaguuucaucauuuuuuuucuauauaaguccacagcaugaugcaauuaaauucuaaauaaauaauaugaacuuuaaaaaaaauaaaaauaaauaaaaucacccgauuagcaacuuuguaccugcuaugcuucucccuucuuugucucugugauguagaguaggagccugcgcagcuguacuuguguacaugagugcaugugcaggccagaagccaacaccugucuccuccacaggaaagguaaguagaacuuuacuuuuugagacaggguuucucacugaaccugcacuucacuguuuaguuacaaugacugacuuaaguccaggcacuuggauuucuaggugcaggcugccaagcccagguuuuacauaugagccuggggauccaaauucagguucucaugcugguguagcgaggauauuugaaugcgaaacaucucccauaagcuugcauaccgaaaacauuugguugccaacugguggcacuguuugggaggaagcucuggaaccuuuaggggauggaguguugcuggcggaagcaugucacuggaggaagacacagucuccccccacuugcaguuugcucuucugcuuuauauaagugaguggacagaaaugagcucucggcuucuucuaagcugagggcugcugugcauccacugccaauaugggcuugcucucugaaaccauaaacuaagacaacucuuuuccuccauaaguugauuguggcuuaugggcuuuuacuguagcaacagaaaaauaacuaauauucccacugagccaucuccucaagcucauaccugcuaucuuaaauucaaacauucacagguuccagggauuaagauaucuuuaggaggccauuauucugauaaccaaagagugucaagagaaguacugauauaaaacaauuauaaauauuuaaaaauaauuauguaacagcuguuugcacauuacauaacaguugcgaugugucuagggcugcauuagccacgucugcauuagcucccggaauaaaacgcacaccaggccccagugaauacuguuguuagucuguggaugaggacacugggguuaauuagcuugcucaggcgcaccucacuagcgacuaggaggagcuggaaucccagcucccaggcuuuagugcucaacaccaacacuccauguggccucuuaacuaagaacaggcgucuuggagggguucgcucaacuaagaacagggcaagcauguucacuuuugcagcacacgagcugucacacgccacacgcaacagucaaugcucuaacuuuucuuugaugggguaucuguggggaccgauuaauaggcuacuugaccaaggguuagucugaugaagaauauaugcaaauaucgaauauucuaugcacagaacagaaggucuuugaaguuagcacuugccaagcuuuaacauguacaacagucaugcaggaaucuuguucgagggccaauucuaacucacacaaggaugaagccagcgucucucuucaguagcugucugcaggccacuuuugagaagcaaguuccuuaggcuacaauguuacucuccuaucaaaacugcaaaacuauuguuccuguguacaagugucaaaugccacuaggcacucacuguguuaagagaagaggauaaaucaaauguuuuuucucuuaaggaggccauagucccuuaccacccuaggaauuuucucugaauuuuacaaaucaagggcaaugucuaauacaaaacaaacuggguuaacaacuaagccccuacacgaccaccugcagagaagucuuccacagacugaccggaagcagcuaugcugugaacaccucuguucaaggaccuaacagaugacucaagccaggauaaaagcagauacuucugugacgcugaguggguggcaaaaaacuggugucagugugccacugucugaaucuuaaccguuucucaaaggcccguguaugcacgguguagguagcccucugucugguucauucggaguugacagaguuugagaguuaggcuuauugagagcuccuuuuggugugugcccuugaagggcuucaucaugcccaaaagcuacagguccaacugaccacauacuacccuguccauuuaaaucucgaguguuugauacagcaaugaaaaccuaauauacacugcaacuucacaaaaccaacagaacucacggacacacaaucauaccuagacacuaucuuugggucacacuauucggcaugacaacagaacugugcuaagcacugcaaugcaaggcaguaaacagaaaagaggggaaaaaaaggcggcggcugaggaaagaaaccgcuagcgugaguacugcaaacaaauggaagggucuucuuaccuaagcccaaagccauuagucuagggcaaagcaauuguucucaacuagugugauuuugauucuuuaagggacauuuggcaaagucugaugacaauuuggguugucacaacugauggaguacuacuggcaucuaguggguaaagggcagagguacuacuaaaaaaaaaaaaaaaaaucacacaagcuacagaacugcccaucacaaccaaguauugugcuucccaaauaucaacagcaccgagguuaaaaaacuuugaguaaagagucuauccuagucaaugagugagcaccacuccauagcuuagggcuggccaugugaccauuguacaaugacugaaauguucucuagucugcacugugcagcuguagugguuggcuccugaacacccagauuauggguagugaaacugacgugcugaauuuacaauuuguacugauucauuacuuuguuguuguuguugagacuggaucuagccccgugaccaaugcuaaucucaaacgaguacaguauuucugcccgagccuuccaagugccaaaucucaagccugugucacuacucugguuaacuuaaauuuacauagacacauaugguccgcuguuaccaaguuggaugucuuaacuccuaauguuuuucuaguuuuacaggcugcugcuuucuacucuucugaaaccaccuacucaacugacuguuacuaagauuuggcugggggaaaaacacgugcucucucacauacucagcaaaacauuaccgaauuaaacauucccuauuucgaacaccuggaaacaccagugcacuauuacacacacguauacuauugcagaagcggggaagggcaaaucuucccauuuucacuugcaagggaggguggccugacaaucuucugagcauuggaucacgugcuuugaccuauuucuacacuuggccacuucagaagcugcaaagagaaggcgggacaccauaagcaaauucuccaccuccucagagaggccacucuccgaucuagcuggcuuuugacugaggccacacugaaugugucagguacugcgcuagguucugcacauaccuuaagucaauucauuuucacugcuaucugggagcaccaggagguuaagacuagcaaagauagggcucuuggauuucccgcucuaaagcaaugugcuaagagcugaaaccggagaggucaauaccgaacccucgccgcgggcaagcagaaccgcuaggcgcugcaaagccagggcggggucccaggagcucuuacuucucgaucuccagcgcugcaaccuuccgcuuuucguagaguuuaucauucagggcccuuacgauguugggagugagcggcgcaaaauccuucucuggguucaugguggcagcucgcgcugcgccugggagccuccagacaccuuagcccgagguugccugggccgugccagggccgggggagugugcggcuccgcgcggacaccggagccugcucaugggcuaugccgcccagggcccgccugccucgucccgccgccacgcgccgccucgggucccccugcuccgacccugcucucccacgcgcgacccgguccgccccacggcucacgcgaccagcucccgccaggaaccggcaacgcucacugggccgcggccauguuacucaggucacgugacgccgcgagcacuuccgccuuccgccgaccg

SEQ ID NO: 4780 - RNA, 20866 nt, Mus musculus
cucggcagacccccaccucccugcccggauccccaagcucaagccauggcucguugcccugagcaaucuauguauugacccugggucgggccacuggaugcauuucagaaacuggccuggaucugagaccuuccuggaugguggguagguagccccuuuaggaaaggccuucagggaaaggccuccugccuucucuuccacacccaggcuuccugccuucuggugguaucacggagccucaggggagggauguggaggggagggcugguugcuaucccuuacagccaccucugcuuguggcccgguccgaaaucugcaaacacuguugccccacaggcggguggccaagaacgacggggugccuccuaggaucccaggacuuacuggggcuuuucaguugugcugacuguggggugcugggccgaggaccaaccaaaugccguaucuugccaugacgaugcucuucugguuccuuuuucuauuaaauggccauuuauuugguuuggcuugcaucucugauggugaaccuggagggucugaguucuggagauggaagggugggcuucuggagcccacagugggcagucuuacugggguggggguggggguugaguacuuggcucuuccggcccuguuuagcucgcguugucucagcaggcccaaguaaugucugcucagguguccaggugccucuugaccauauuucuauuuguucgcuuccucuggcuuuccccacaguccccgugggagcacaucaaagaccaaccuagguccuugcccaaguugucccucaccccccaaccccccgccccugaacuuaaaucaaugacaccuggcuuggaguuccaggccagggaugaugacaaagguauggcgcagggguaggaagcagaggugagcgaagccggcagcccaggggagccaggaggaagccggggcguuaacuacaguacugcuuuauuaauacugggaucuucacagugcauuuguuacuuuguagcagugacuauuuaaaucaaggagaggauggaaaccggggugggcgggagaauuuaucccaaacuuggcagaaagaacagaauaaaagugaugggcuggggcuggggguuaggggagggugaguaggaacaaggaggggcggcaaaauaaauuaaaaaaaaaaaauacaaguuaacagcaccagaaaaguuacuucagucaaaagacacauuugaaaagaauguuuugcuguacaaaugaaaugaaauaaaauaaaauaaaauguacgugaagaagcccccaaaccagucugugaugcaggaugguuggcucggaucccgagggcgggccuaugagagaggugagcacuagaggaaguggugguugguggaggaggauacuugugggucagacaaggggauggaauauguacagcccugggggggaggggaaggcuaaaacugggggugggcaugccaccccauccucuuccugggaagucccuggccucccuucccaucagggccuggaguccucagauggcagugagcccauccucuuggacccccuucucuaggacccaaccacacccuggguauagggaccacaucugcccacuugacauccugcaucccuuuccaucagccuugacagcucuuuuggggaagaugcagccaaaauaugccucaggguuccacaucuggccauuuguuuuccuggacucuauacucggggcucuggugacaacugaguuuggugggccaggucucagacccuggagauaacucgcuaagcagccucggggagcccugugguaacuccauccacauacaggaaucccugcuuuaccagaccuacugggcugcccugcacuggagcacccaugaccuugggcccaggucagccccaacuccauuccuucaagaccaagguacgcucucuggacucccugugggggucgggcagaaugcuaccuuggagucugcugccugcucuaccucccgaaucucuccucuggcuuacacuuacgugcuuagucuugcucagacuugggcugacagggaggcaggacccacucuuccucuggucccugcugccagccccagcuaggccuguaggcauagacuuucuugggaugguguugccucuggcaacagaaagucaaaccaaccuucuaauacuugcuccaagccgggccugcagcuugcucagaucucaacagacuggccagagucccuggccuacccucaccagccuuauucuaccgacacuucagacacuggcgagaagagcagcuucccccgguuuggggggagugauucuacccuucucuggccucgagcccacugagggcucccacaccccucucucaggcacucagacguacacccuguaccaccagcuugccccacauaguucuuugucuagggucagcuccauuuuauuacagucauaaaauaacccccacaccaucuaaugcuccagcccuuaucuccagcaacaggugacacuguaacccgaaggcgccccuagaguaaaagcuccaaaguguccagacaagaacagggcauccaaaacaccugguaccucuggacucauucccugucugccuugccucaccccacuaguuacucuucacagggaacuggaggguccccugagacaaggccccuacguucccucccuccagggcucuuucccaugagcaagccuggcuucccaaugccugacugucccuaaacccagucacacaaagauccucagcugauuggguaccuggccccuccgugaccacccugugccccaaagagaggagccugggagaggcagggcaaaggcaagaggaaaugggacaggguccaggcagggagaagagggagccagcauucaaggaaagagcugggcauauggccccggaggacagccgggccagaggaagagaguuguggaccccaggccagguagggccccauguagcaggcccagcccuugguuaugggcucugggguuuggauguagcagggccuggaggaaggaagaggagguuugaguagguaaggaaaguauaaaacaggcucuguccuggcgaggugugugagggaagucgcuucccgcgagaugcugggauccagccugguugucuuuccguaaaguggcugugccucacuccugacgcuuugcuuucugucuucuggcugggccgccacucagaguggcuggccgcugcucacagauccggucaccuccuugugccaggcccagacggggaggggugggcggcaccaucauaagaugcggggcgccgaccugucguuggugacgguccugcgcagccggaccccgcgacgaauggccaccagcaugucuucggccggggggucacugguggcagcaggggguggagugggcguuuccuccgaaggaguggcugacagggcgguagggaaggggaacuggcccucacccagggcgugggcaccggccaccagcuccccaagcuucucuacuaggcugugccuguuggcagccaguugcugcucuucguccucgguggccagcccgaccgcagccccgccgccguagcuagcuaccucuggggacuggcugccccaggcuguguuaggcaggcugagccucuuuggggaggcuuuggccaggucuggagccaaaggugaggccacuucgucuguguagaagacgcacuccucacugccugcccgugugggccccacauagccaggggagucgggcacggugggugucuucacagggacgaugggugggcggauggggauggggccagcgcuggagagggcgcggcgcacagugggcuugguagagggugugcggcggaugguggccacaccgggaggugcaccggagggcagccccauggcugugggcagcccugccgugggcagcccggcgguggaggcugggcgcuuggucuggaucaggcggcgguaguucugggcuauguugcuguuucgaggaaugguagaugauuugucgaacucaggggggccuucacugucugcauccccauucacagaguagcagucguagucugagccuggagacacacaggggguggugagcccagggccaaguuugucccugaaccccauaccuacucaagggagacagagagggaaguaagucucuuaguuauggcccuccuccccgcugccgugguggggcgggucccggggcugugaaggccuagcaaacacacccagccuguggcaucccucccuccaggcccaccuugggaggggaugguguccucggagcaggaaggugugguggucugugugcuguagccacuggaauacugcagcgagucucggcugcucuucugguguuccaggcucaguccgcgggucagcaccauggcuaggucgcuggcagcaggggauaccuccucaccaugcugaggauagggaaaauggugggcuaaaaagccucacucuccaugucuacccucuucugggacucuagauaguuccauaaggguggacggaguaggccccgaaggccagcugcugggaggccuggcauugacccuggagugaagacggggguggggaauagccagggagcgguccacuuacuuuggcugcuaugguggcaggagacauccggguucguggcaccuccucuccacuggagcccacagugccuccaccaguagggccuggcucagugucucggagguguuccacacgauccuuccuccgcugcagggugguggcugaggguuguucguggggaccagccuugguccaguccugcgggguguggcaagcacccuuagccuuacugcacaugacuaggaaaggccccucugucacuggggcucagggggugcacaccagugaggagccucuggcuugcgaggccagaaucuggcgggcagcagugauagcuccauccaagcaguucagggauggggcaggguguuccaagaaagguacaggcuuggccgggcucggcaagugggugguggaugcuucagagacaagagccaguauacgcagcuuucuugcugaauuugacuccccgccccccaaaccccaccgcucuggugaccgccccagaucaggagggaguggggugggcccggggcaugggguacugaccgagguuggggagcugcacucgcuaacugacugacagguuucugaggccucggaggacgcagagcuggaggauuucugcugugcagaggugagccagcggccacagauggggagagcccccgcgggcagacaggccaagaaggcaggcaagagaaaagaguucuggucaccgugguggcacgcagugggcaguuugauccagcaccucacccuguacuccccuccugguguuacagccacuaagaccaccauaggaggccgcaucucagggcacauccuacagacacugaccugcccacgacccaacccaggagccacauauuuuaaggcuucaauguaggauucacgguugacggcuuaugugucgagauaagugaagauguaacacggagaacucagguuugguuugagcauccgggguugacugucagaaagggaugcccuggggggaagggaugauggaggcccgagugcuauccugggaacagucagccgagcugcccauuaguucucugugcagagacacguguauaaccuggaguaagggaggggcuggggcuggggcuggggcuaggcacucgguagcaguugggcaggaugaggcuggccagagaugagguucacaaguguuugggggugcugacucagucccucaagcagacagcaagagcaccaaugaccuuuagaacagauaaaacggacugaccguaaaacuaggaaccucuaguccuuaauaguacucaugggcuggagacauagcccaacuguuaagaguacuugcuguucuuguagaagaccucgguucgguucccagaacccacaugguggcucacaaccaguucuaacuccaguuucgggggcucugaugcccccuucagguuucccuaggcucugcgugaugcacguagaugugggaaaauaguccuuacacacgaaauaaaaauauuaaaaauagauaccaaaaaggcaguaagagcauacucagaagaauauuucugaugaaggacauguaucuacaauauauguagaguucuaaaaaaaaaaaaaucaaugcauacacacuuucuuucucucaugaaaaaugggcaaaugacaugaauaggcccuacaugaaagaagacacucaaauggacuuuaaaguaugcaaauauauugggucuaguagcauacaacuuuaaucccagcacucaggaggcagaggcaggcagaucucuugaguuugaguccagccuggucuacugaguauguucuaggauagcugagguuacauaguaagacccugucucaaaagaaaaaaaaauaugaaaaaacuucugccauguccuaaggaacauucaaaugcuacuauuauauacaucucaaaaacaguuaaaguggaaaagccauaaaauaccagggcugguauggacacagcauggacaacaacugucaugacccuguugauaagaaucaaccccaauggacuggagagauggcucagugguuaagagcacugacugcucuuucagagguccugaguucaauucccaggacacaugguggcucacaaccaccuguaaugggauccgaugcccuccucugcugugucgggagagagugacaguguacucacauacauaaaauaaauaaaucuuaaagaaaaaaaauagaauucugcuccuacucacauugcaauaggaccauguacuaggaucugcucagcagucuaugaguagccaaggccccuagauaagugccgcgcuuagcuuuggcaauuugacacaauguagcaucaauugagaagagagucuuacuaagaagccguccgcauuggaugggccugugggcaugacuauugggguugacaugaguuaacugguccugcccacugaggguggcaccauuuccuaggcugggguccuuccuauuccguauaagaguggagaaaucaaacugagagcagcaagcaaacaaguauggauccaucuauuucucucuccucucaagugucaguaggauuagcuguuugaaguuccuacccuggcuuccccagagagaugggcuagaaucuggauuauaaaaugaguaaacccccuucucuucuaaggugcuuuuuguuaggauauuuuuaucacagcaacaaaagugaaucuagaaaaccagggaacuaucuaaauguccccaaaacacagaauaccaaaauaaauuuacauacuaauucaauggacuguuauacaucgaugaaaacgaugccuguuuccauguaaaacagaugaaucucaucuauuuuaaacaugcggaaagcagaagucaaauacacaugaaaccaugaaacauccucuaugauuucguauaaaucauauauggaacaucuuugugguacugggauuaaacccaaggcuucaugcaugcuguguaagugcuugacaaauaaacuacacucccagccuaguaaguuauaguuauauaugcauauauuuacacacacacacacacacacacacacacuauaaccagcaauuacacuuggagugggaacagcaaugaaggaacgcagggauuuuagggucaagcugugucuuguuuuugguacuggcugagccaguguguucaauuugcagacuuauucagauacacuguugcgauacauuugcuucucuguauggguggguaguauguaucaauuaaaagauucucgagacucagugguaauggauuuuaacccauagagucaaagaacaauuuaggaguccacuauggcauaauaaauaauugucuacauaaauaaacgggagaagggcccagauaaaaggacaguuagagaaaacuagcuaaauguggggggugggguggggguggggguggggcagccaaagcaaaacuaaacacuguagagcuugugauacuauagaucaguuugguuucccuggucuugaacauuguuugggggcucgagggacagcucggugguagccugcuugccuagcaugcauuucacgguuguauuuaaggggugugguggcucagaucuauaaucacagcauuacgaaggcugaagacaugaagacaugaagauugagaguuuggggucagucugaguggcauagugagacacucuuaaaaaaaagggaccccccaaaaccccaaaaccaggagguaaaaauaaacaaaaaauuguuuggugguuacauaagauguuaacuuugagguaagaguguaggcaggguaacuagggacucuugaauucuuuuugcaacuuuccuacaagcauaaaaugaaaugagucagacauggagguacaccccuaagaauccuagccuuugguaggaugaagcagggaguguugcuaguuugaggucagucuguaauacacaggaaaaacuugccccugguuuaaaaaaaaaaguuggggcuggaagaauuggcucagugguuaugaguacuggcugcucuuccaaaugaccgggguuuaauucccagcacccacaugguagcucacaacugucuguaacuccaguuccaggggaucugacacccucacacagacauacaagcgggcagaacaccaaugugcauaaaauaaaaauaaauaaaucauuaaaaaauguuaaagagccagguggugguggcagugcacgccuuuaaucccagcacuugggagcugaggcagguggauuucugaguuugaggccagccuggucuacagagugaguuccaggauagccagggcuacacagagaaacccugucucgaaaaacaaacaaacaaacaaacaaacaaacaaacaaacaaguuaaagagucaauugaacaaaagagcuuuaaucccucuuggguaguaguuaaaaaaagaaaaaaaaagaaaaaagaaaaaaaaaagagacacagagagacagaagacgacgugacauucuuuuaauuauaaccccagcaggagaacagaaggaacgaaagcagagguaauaacugggcacugagugauggcucuuggcaaagggccugcuuugcaagagugaggaccuagaacccauacggaggagccaagccaugggcuagagagauggcucagugguuaggaguaccacuugcugcuuuuccagaggacccgaguuugguuuccagcacccacaucagggagcucacagcuggcugugaccgcagcuggagaaucuacaaugccucugaccgccaagggcgccugcacuccuacacacauacccaugugcagacacaggagccuacccacaacuuaaaauaauaaaaauaaacauuaaaaaaaaaaaagccaagcaaggcuaugcaugcaugcuuguaaucccagcacuggggaagcacagauauguggagccagccagccuagucuacuugguaaguucuaugcagugagacccuaucuuaaaaaauaagguggauaguuacuaaggaauaauaucuaagguugaccucuggucuccacauacaugugcagauaugugcacuuacacacacacagacacagacagacagacacacacauauaucccaaccugugcaaacuaagacccuggcucaaaaguaucauaggcacaggagccgcagagauggcucagugguuaagagcacuggcuacucuuccagagguccugaguucaaaucccagcacccacauggcaguucacgacugucuguaacuccagucugggacaucaggucugugcguagugcagacauacaugcagacaaaacauccccccaccucccaucccauaaaguaauaauaaaacuuucucagaaagcuaaggcuggagguguagcucagugacagguuuuucuaguuuguaugaugcccuggauuuuggauaaaccaaugagacucagguauauguuauuuaugaaacucaucugaaacacggggauacauguuuaagcauggaguuggagaucaaucauagaaccguggaaaagcaggaaggccauguggccagucuccacucccuaacugcuuccccucucaaggauggccggaggucagcaugaggcucccuccugcuccccaaccccguggucuucccgauguucucucaccuggcuggugaugucggaaggcaugggcgaagggggcuuggaguaggugggguccugggagacgaagccagagucgugggaggagacacuggagaggcgggugguggccggcugugccaggcugcgguagcgacagguggaacugggugaguauguuugggcacccccaggccacggggcuccgccacccuuggcacugccacugcugcugggggcacugagggagugaaggaggagggcacaguagccggaaaggaagacacagagguguauacaaagagggaagggugacagaggagggaggguaagagaugcggagcaaagggaggaaaagauagugucagacuacgaggucccgaggcccuggcacgacugaggaguucuggcauggcaugucucagugcuggggagucccugucaggguauacccgaaguggguacacucagagggaggcagagguauacccugccucccacagcaucauuagccugguuguucuuaggcuugugaugggcaagcugagucaccaggcauugaaaagugaaaagccuggcaguuucuaaacugccuccucgcagucugcuguuggcugucugaucacacucgaguaccuggcacaugcugagaugacggucuggaaauggcuguugcuugccagguggguccuaccccaccgucaccuugucccuccuucaggagcauggcuuucuggggcucagccuuggcccagcauucuaccuguggcuagcacucuccuggguauuccccuugggucucccaagccccaccccuaaauaucuccuuuauaaucacauuccuccuagcaaccauugccucucaaggucugaagaugccccagacagagguuauggguucaccucucccacugaucacuggguccagcuucucucgagcucccagugcccagacagagagaauucugggaagaaggguaccugggacagggucucccuaaucuguaagcugcucugaguucaugacucucccuacccgaggucccuggaaccaugaccaucuccuucaaaucuagacggauggaugagcaagaugucuacccucuccccaucucuguaagacucuaagugcugacgccuggggcaacugccugggaucaauuugagacaagcacaggcuggagugucccuuauccugaagcccaaacacuuauuccuggaaaccaccacaccacuucuuggucuuaggcuccuuuuuaguuuuacuuguuaaggcagggucucauauagccuuggccggccuccaacucgauauauaauugugauugaauucugcuugaauucuugaauucugcucccuccaacccaccagaggauggaauuucagacaugugucaucccaccugccuucuuuuuucccucccucccuucuucucuuccuccuucccuccuuuuuuuuuuuuuuuuuuaagacaggguuucucuauauagcccuggcuguccuggaacucacucuauagauagaccaggcuacccuugaacucacagagaucuuucugucucugcuuccaagugcugggauuaagggcaugcacuaccaugaccgacacuccgccuaacuucuaaaaguguauuuuuugagacagggucuuagaaagcagcucaggcuggcuuugaacccuuggcccuccugcuuucacuuuccaagugcuaaaaugacuggcuugcaucgccgugcccagguugaccucaccuucuuacuugaagacccuauugucccaggccuggccaagacccaccguuaaaucacgacucaaguaucuugguuccccuccugacacaacggugccaggauucacuguagaaaaaaaccuuggcgccgggcacacaacgaugcgccaucaaugaagcugcuacccgccucuccugccaaccaaugugugcacccguaucuccuauaugugagaaguccuuggaugcuuagaugcugugugaguucuggggcgcugaagccaccgccuccacagcuuugcugggacucccccacccuccugggauccccuccgagagccuggcacccaccugcacaugcuggacuuccgggaguuggagcugcugggugacgaggguggggucugguacgaccagcuauagucagaacccuucaggucuuugaucaccuggagaagagcaugggggcggucacuagaggcagcuccuaaccuguggaguaccucaccaugcugcagagagcugauagggcagugcaccuuccccucugucuguccccaguggugaacuaaaccucaggagaugaaccucacacccccaagcccaacuucagccuucuuuuaaacaugggcuucuuccugagccccaacuggcuccaggccggagacaagggucaaacagguccuucuggggacacauggcugggaauaucaugacacuggggggccgugacauuaggggcugaaacugucucgggagcuuccugaggcguguucucuccugugaacuggagccagcuuagacuaccauugagagaacucaguguggugaccugaggggauaugcuacagauugugggguacacaggaaguacccaaccacaggggcugcccaguacaguguguagaucucuguguaggguggguuggguucuagguuuggaagggccaagccccagggaccuggcuucuguccaucuguguuggucugagcccuauuggguucugagcauuucaucugucacugggucaggugcucccagaaaucccacagggcuuuuggauacuaucuggucuucuucccacaaggaccuccccacaaagcuccccucuuuuuucuacugugcccacacgagggcaggaccaucucuucacugguccuggucuuggcccuugacgucagggcuggccgcaccugcucacuggcgggaggcaguuuguggggaucugcagucagcacuaccaggucgucaaugaugcccugcaggugagugaucucucccagcauggucagcucgccguucuaaggaagcagccagucagugucuaaagccccuacaccugcccacccgcucuggagaaacaaacaggccuguuaggccucuccucuuucccccuucccugauauucaaugcugacacgggcugggccagugcaaucaagguaacuguccgucuagauucagccagagugucacaagcuacgaggccugauuuuuaggccaggugcacaggggguuaagaggucuauccugggucuguccccugcuccuccccaggaggggcuccacaucaucaagagacccaccaccaccggcuggaggaaggugauaaaggugcagaaacggccccgcuccucaaucagcgcacggcgcacagccugcuucuccgucucuuccaguagcaaguacaugucguugacgucuugaagggcacuguccagcuggggcugcaggucuccuuucccugcagggguugggaagagaggccgcgcuggggacgccggccugguuggcuguacccacggcuuaggccccugugguaguguucuuggcugugggguuggggacaagggagccagggagcauggagcagacucuaagguuuguggaggggcuggucccaccagagcaggcagagaagacagacagacagacagacagacagacagacauagcaacaccaagcugcacagccacccaggaucugagguaggcuagaccauggggaggccagcuggagaccucuaucacucaggaugucauuacugccccagcauaacccugaccucaagagguagagagaggggaauagcugaaggcaggacagacagcagggugggggcucugcucagcuucaggccaggccacuaagaggugcaggggucaggagagcuauggcugggccuagggaguaaagaggagugugucucagcaugggucacagcucagcucggggaccaaugcacaaggacagcaacagcagcacacaggagcagugagagagacagagagaggugagaguuggacguggaggagauggugacagggacggagcuggugacagggaaggaccuggcuggccaggucguaauugggcagccagggccugagacccccacccugcccagccagugaaccccuccuggccuggcagacugacccagcaguuguuugggacucuuaugccccaggccccucccuugguggagcaaccgccuuucuuguuccuucuuggauuggagagguucuuuccaauggcccugagcugggggggggggggggggugugggggcggaggcagacaaaugcaacaaggagguucggagcagcuggagggacggacauuugacuuaccaaguagcucuacaggacggaugugggaggaggagaggagacagagaaagaaagaaugugugaaagacaggcggaugagccacuccuggggaggggugggggccugggcagucuggggugcugggugcucccucagucccacccgacauguuggaguguccuguguuggaggacagggucuccccggccagggugaugcucggggggaggggugccucauaggguggcuggggcuacagaauggggcccgcggggcugggccucaguggggcgcugugcgcucuaccuuugcgugcuuucuucuguagcuucagcgugucggaugacuucuuuuugauuucaugccuggcucguuuauacucugcgcaggggcaagaggggagcuaugguaaggggucccgguggguagguucgggaaccccacugcgaaggcccauccuaccuuucgcaugguccuuguccaguugguuggcugacuucuuccagucuucgaugcgcuccugcaguggauugaugaggcucuccagcagcgcgcugcgggagaaagcugugggugaggccuaggggggcccccccagucagggcaaggauggccucucuagacuuaggauauccccuguagucugcugugcccacucacuuggugaacugccgcagcuuggucucgaugcugcgguggcgcaugcacaugcgcgugagcgcugagccaaugucccgcguggccccuggcaaggaagcaagcugcaugggaagcggccgggcugggggcuucugcagucccggccucgggccacuaggcggcgcgcuguuccacaaaggccgccccugccccgcccccaucaccagcaauccuguagccauggggacaugggggcuauccuagccuuuggugggcuuugggugccuugcuggccaacccuggagccuucucucuuucuuagcugggacaaagaccagucacucaaggaaaagacagcaaaguuuccgauuggaucuacugagaccaaggcauuuguagauuccagaggauaaggcuuggguugugauuuuaucacucaaaaguacagaagcucaggugcuugcuagauggaugaaucgggaggaagaaaggccuugcaaguccccaaggacuauucaccugucccauauaacuugcagaaggcauguggaugaggaaucacagaauugcuaacuaccacugaaggguuugcccacagcaugagggugaccuccuggucucaucccugucacugcucaccugccccaugacaucacagcagaagccaaguucuccauucaggcccuguauccuucccauggcccauaucccuuuccagccucccggcccacugggcucaucccccaccucugaccacgcccccuccccaccucugguguugguggccaugucagcuacuuucuggaaggcaucgaggaaggccacagcagccagcacagugguccuggggagauacacaguggaguguguggucaccgggugcgaggccauccucccucccucccucccucccucccucccucccucccuccacagcacaggaacaacccugcgcugccucaccucagcugagaguggagcuucgcagccuuggaguugaaguccucccagaugggguaggagcucugcggugaggaggugggagaggaagaaagaauugugagauggagcuacagggcuccccacauacuguccaauuuccgggcaguuucuuagaugguccuguccccauagagaggagguagccugagcccuauugggcaagagagggcccaggacaaaggauggcaugaagucuuucuuaccugucaguaguugguucccagguggcacccaugcucccuugggggagauggaggagaaaauggauggcagauaguuuccuugggggcuuucucauaaggcucugggcacucaaucccuaucacaugugguggaaaguggagguuggcagaaucaaugccacacaaggucuaauggggcccggaagcugcuuccguuaggccagucaucucuggccagcacugguggcucacagacccagggaggccauggcugcuacacaggcuggucagcuugccugggacaacuaggccccaggcugaauggggccuuguguggccaacagagccaccuuuuuccagucccuccucuccccuccaggggaacaguguggccuuuauccuagccuggccagaggcucucuauuaggaggggguuucccaauagggagguugggcuccuggugacugaguuguccagucugauuaaggggcuuuucuggcucaugcacuggcccuggagaaaggucagcccuagccugggggggaacccugagggagaccuugcucuuugaaggguagcccagggcuagcaaaggcccuagucccugucccacaugagcugacugggacggaggcuucucaguaccaagguaaaggggacagaagagccucagcuucugggauucugggagggcugugcuuggcuggaaccccaggguaggucuagccagcuucuccagggacagcaagggggcgggcugcuucaccgacccucaaaaacgcccucuuccugcccagucaagucagugucagggaaagcaaauauuugagaagccguagcaaggcuggaacaagaagaggaggcugugggugggcucucccccacccacacagcucugaauaaaaaaagcccaccagguugugagguugucccuggcaguccugaggagcuaacccaggcacuggccucuagggguuuuucaagauggggcacccucacaccucuuaaaugcuacuuggcagggaagcccgcuaagaccucacuccagagugugagaaacugcugggagcaggguguccaaaguuaguucuccuggaccccaggaaagcuuggcccccucagcaagcccuugguugucugagagaguaaggacucccccagugguaggccaaguccacuuuacccucuguagauagaucugcacaccccagucuuuaagagccuggcuucuuuuccccaucccccuaugccugacugacaggugccccagggagaguguucgcuucaccuggcccaggcucuaagccccgaugucaucacagucacaggaacugcaccugcuggccagguguucugggccaagcacugccucaugcaucacucaccaccuccugagugacuccuggaaugcagcucgcuauugccccauuuucuugaugggagaacuggaggcucagggagguugacugauuugucugaggcccuagggauuggggucaaggucugauccuauagcugacauaucaggauguaggugcccuguuuucagagaagcggggcgaggaacaacuacauucacuucuaugugggaaggugacagggacugagagaaagggggagacuccaggucugucacaagcauggccaccgcucuggagcagagggaaggugcucaccaggaugagacugguguggcuguggugugucugggggcaacccaggcucuagucucagaaaagacuuuugggggcacccccagccccagauuuccucagcuguagaaucagggccuguguguagacuucagggggucacuugcugugggaacugcuuaagagggcaaaagccccagcucucugucaggagccuuucccuguggccagagccugugucugugugacacuucuuagucuggauuaggaugaacccacuuucaggguagcaugggauggggaccccauuuccucugcugacuaggccuagggccccaggcaagaucaagucucuggguucaguuggccugagagagaggagacagggcaagcuaaccagcucuccagggcccuuucaagccccuggguuugcacccacccuccucugucuguguaguugaagaucugaguggggacccuuccucccacaccaucccucagugcaggguuggggccuucuaguggcuccagagagaguccugggcaacucacuaggaaucagccccaggcaaucugagucuccuugaacuucuugaugguggccacugagcaagacagccagaagcagcuuuuuaaguccagccaaucagugcagguggccggccccuucagggucccuaauccaugcaugucauugauaggggcauaguauacaugaucugauggugcuugguaaagucucuuccaucuuggccccacguaucuagaaaucuugccugccacuaaguucuuugcugagacuggacccgugucucaacugaguuccuugcaacuggcaggaauggaggauacuauccugcugucucgucugggcagaaguggcugcuugcugcaguguuugcagugggaggcaguguggguggcucccacccucugccagcccaggagugucagcuaggggagguggucuggguuacacaguuucagagaggagcugguaccaaaaugcugagggcuagugaugaggcccucagguggaguugccagaggagcugguaccaagaugcugagggcuagugaugaggcccucagguggaguugccagggguguguguguguguguguguguguguguguguuguggcgagggaggaaccccagggaaaaguauagaacuaugggaaggcgcugacgugcugcuaacuuguaagucccaggccagugugguuucaggccucuuuuuagggggcaaguaucugacagaugccuucccuuacuggggguguuucuuggcaguacuaggaggggagccccaacuucuugccucucugcaaggcaucacuuuccuaaagcauuuuucuggagcccuuggguaggguguaccuguacguggguuccacagcccccagggucuagcaggauucugauuuguucuugcuaagugcgagccuaggguaaggaugugaggaggcucagcacagggccuaguuucuuccguuuuccaucguguuccuagaccaagggguacagugcaggacaggaacacuggcacucgaugcccaccuugccacugaagcuuucccugccuagucaauucggaucagccucgucaaacacuggccucugggggucagggagaauucaguaaauuaccagauggauaauaauggcugaggucccgaagcaggauccaauggucuccuuaugaccuugagccauucgcaggccucaguuuccccaucugaacagggugccugcucagucugaccuugagugaucaggaaggggggguugcugaaagcgcuccccagguugcuuagccaacacacagccuaccuccuccccaagguggauucaguccuacccuugggcugcagggaggaccccacccgaggauuggaguaauggagcuugcuggaucuguugguguguguguguguguguguguguguguguguguguguguguagguggggcugcauccaugcagaggcccgaggcuggcggggcaagaguuaacaguucuuugcuuuauuauuuuuuuccugcuuuggcggugacagcauugucugggcuucggggcgucggggguaugugugugugugugugugggggggcacuguggugaaagggggcggaggcccgagagaccuuggauccguuaaagggccuuaaaggucgguccuaaagauaaacccaauucauaguuugggggucugggguaccgaguguuugcggacgcucagcuuuggaucgggauccuacggggcgaccucucggacaucccaaccugcgagcacucacucccacccuucggacccagacaggcauugggcgcaaggcgggcgcaggaggacaggcucagaugaaacacacacacacacacacacacacacacacacacacacacacacacacacacacacacacacacugcccgcacacacacacacacacacacacugcccgcacacacacacacacacacugcccgcgcgcacacacacacacacacacacacacacacacacacacugcccgccacgcgucccucagaggagacccguaugcccggagcuugcccgggguaccuucaugucguugacgauggccuggaagagcccgcccaaggcgccacacuccuucuccgccgucuccaugcuggggccgggcgcgcggcggcagggcgcgcaaggggcgcggggagccgugcaggggaggggccggaccgccgcgggcgcugcuccgaggccgcgccggggcucccugccucggggccgcgcucucagcggccggccgcgccgcgcuccgggguugcgggccgugggccggcagcgcgggccauggcucgguggggcugggggcgcggcgcgggcaguucgcggcgcagccucggcgcgggcacug

SEQ ID NO: 4781 - RNA, 4485 nt, Mus musculus
cacucagcucauaccucugagccugaggucagaagcaggcagagcagaggguggccguggaaccccacccccgccccccaucccugaggcugccugcaacccuucugggaagcauuucaaccucuuaccagcaagaucugcccugguugccaugguuacaguagaaccacucacccacccacccaccaaggccucccaggacaggauccccagguacaacuccccaugcccaguacucacaguauagccaggcgaguccccagggcaugguggugcacugggugcccccugagagcagaggcacuguccccagaaguguguccagaggccugagccagggacuacauggccuuaggucagcaaagguggccaccaaguccagaaagggcugguccaggcugagagggggcagauacuccugggguagcuaccgcccuaucugcuuggcagggcggaggacagccagggggcaguggcugccagucccauugcagcucaggaacuggugugagacagugacuuugagggucucaggaggaggaagaggaggaggaggaagaagagaagggaguccccagcaggcaggccucuuggaaucuggggcuggguggcgcuuucucugguuucuucggcugcagcugcucagcgugaagucuagcucuggaaaaagaaggaggagagagagacugauuauguaagagcauccgcugccacucagccaccagccaggaaaggaagacccaccgugcccacggagacacccaacccugucuucacgcacaagaaaggacuccaaggcaccucgguggcugccuggagccaaggagugagugagucucccaagucagccuggcagccuugagcugggacuaaaaggagaagcagcagagcccacaagcuaggacggcugccuggaggaggugaagugccaggucaaauccaaguccuacaugcuucaggggaggcuauggaguggaagguguuccaccuugugucacugccguuuaguuccuuccugucacccaucuguguccccagccagggaagagcugauggggccgguuuaaucugaauuccagauaaacgaacacucuuucuagugaaguauuugaugugcaauauuguaggcacccaauauugcaugggguggggcacgcuugugccaauaaacaagcgaacgaaugaagaaauaaauaucauagccagguguagcacacagcggaguaaucgcagcacccuagagaucgaagcaggaggauggagaagccagacagagccacauagcaagauucugucucuaaaaaaacagacaaaagacuggguguggugauggauagcuuuuaauccuagcaaaggcagagggagauagauuccugaguuggaggccagccugaucuaguuccaggacagccagggcuacacugggggagugggugagggaagggggcggugauggggugggggaguguguguaaggaauucaaaccuggccugcuggugaucagcccagaaagucacaccccacccccaaggcccagcagauugagggcugugguucauuuuacaguugagguggagguggccuucggcagagccagcuuaaagacucaguuucucaccgugugauuugcccucccuuaggucagaagaaaugaccacaaucugagggcaugaugggagcagguguaguugggggacaccuucucuauccuuccauccgugacacacaaacccacagaauguaucaaacugacccucaggcuccgggugcagcuuagugaucggacucuugcuggguagccaggagguccugaggucaagcccgggcagagaugacgaagcuaggaagcagggagaccaaggccagucuggccugcccacggaacuccuggccaaggcuagccugggcuacaucaugaguuucagagaagcaugggcuacauaguaagacccugucugaaacaaaacagcaaagcagacaugcuagcucucaugcucaaauccucuaaagcaggcagggccacauacaauaaagcgcauuauucaaauuuacccuggguaaagacccuggaccucagccauguccccucccaccucccuguucucccccaccccacccccugucccgucccacccuggugaucuuccuauuguagggucaugauagauacuaacuaugcccccuccccccuccccccacccccacccccgccccaggacauagucucauauaagcucuaguugacuucaaacucacuggcuauacacccaaggguggccuugaacuucuaacuccccaucuguuccuccuccacagcuggacuuucaccaaacuccauuugcacagugacagagcugggacccaggacuucaagcaagccagacaaacacucuaccaacaagucccuuccccggccccagugauaucuuuucauuguuauuuugugcgugccagcacauccuucacccccagacaccccaccucuguugcucuguaggggaucccaccuccacagcaguacuacugcaacccaccuguucuccccaacccccuaaugucacacccggaugcaaucuugaaguguagauuuagcaucucaucccuuucauucaccgcguugauuuuuggggugcugucacguugacaugcgugugaacaguuuccucuuuuuucccuugcucaguaauagucccgucuguccacacgucaccgugugucuacccacccauaaagaagcaucuagguugaucuggucuuugaugaguaugaagaaggcuacaugccucaguggacaggcuuugguguggagaagacuuccuucucaucugagucccgcuguccuucagaccauuggggcucugcauaccagccacagagccugggcuguccaccgccaucagcucgccaugcuuccucacaaagccacacacaaccaagagguucuucaccacguccaaauagaagaaacccuguugugccuccucugugugugcgcaggugcaucccuguaggcacacacagaggacacaggaggaugcuggguguccaacucugucacucuccaccuuauuucucugaggcaggguuucuggcugaaccugcaccuaggcuggcugccagaacaccacagcuauccucuugucuacaucugacacagcugugggauuuguguagcugagccugcuuuucuguuaguuugguuugcuuugguuuuuauuuuuuguuuuugcuugggugcuacgaauucaaacgcaggcccucaugugugcacuucggaaagcucuuaccugcugagccaugcccccaggcccuguugcagcuucuucauucagaagggacucuaacauugaaccccaccaugcaucccggucugccuguucccaauggggaagucaggugggaaaaagaggcacagccaaccucauggaucaaccacguggcacacgugaaugagucucauugaaaugagaaagcagaaaggacccuaaggaagcugccaagaggaagauaucugaugaaaagcuuugaucuggaguagaggcucugagggagucaggcuucuggcugugguaguuugaaagagauguuccagauauuaggauaccugguaccaguugguaguauuguuuguguguguguggggggggguuucuuauguguggcuuuguuggaggaagugugucacuggaagaagccugccucuacuccacuaucauggacucucucuuuccuuuuucuuuuuuagauuuauuuauuuauuuuauguauaugcauacacacugccacucuucagacaggccagaagagggcgucggaucccauuacagauggcugugagccaccauguggcugcugggaauugaacucaggaccucugaaagagcagugucagugcucuuaaccgcugagccaucucuccaguccuaucuuagacucuuaacucuuugaaccauaaguucuaauaaauucuuucuucuguaaguugccuuggucauggugguuuuuucacagcaacgaaaaguacugucugguaauagaaggaaguccuucuuuagagaccccaaccaggccuugcccacccuggcaaugcgaucuaacccgugauuccugaguccucagcaaugacuuccucagcucccaggagggcagggccugccuggauuucucuaucucucucucugucucugucucagggugaggauggagguagaugacgaauguucgccuuucccgguccaccccacucccacccccaccccuggggcucacagcauuauugggaaacucguggagagaaaggacaaaaacuagaggaggguggagcggucaacauaguuccucgaugaagaagagcgguuucaaagucacaggagcaggaagcaaauaacagcaaauaacagacucacuaagucaugacuccaggguccuggguugggggcagggucagagagagggcaggugccggggucagggguggggaagaa

SEQ ID NO: 4782 - RNA, 1842 nt, Mus musculus
gcagcaaguucguuuacuggcugcaucaucucgccagcccaagaguuggucuuugauaagguuuaggaagaguuucauagacuccuuuugaaaggccggaguaacgugugugaaugggacaagugcuaauauuuacuacgggcuucagggacuggugcuguccgagagacacacuggggacucuggccuuuagguaggccaggcuguaacuagagaaggcagcuuugcucgugaagcuuggagaaacaucugcaagaggccauguggcaaagaaaucuguggaaaagcaguugacaguggagucugaugacuuacuugaguguggcugugguaacaggaggguuggcuguccugagcucugcaagaccugaugccaucuucauccugaaucagcagccuauaaauugagcacuuggaggaaagaaaggacagcacaccagguccagaggcucugaagaguggcaucuuguggcuguguccccaucucuaccucuucugucugacaggauagccuugacagagcuuuuguggagggccuuugugguguggucccaguagccacugcaaggggggauggagaguuagcugggugcauaccagugugggcacauugucuuccugcaaguucagggaauccaguucucucaaucuaauuaagaacgccuuucuugaacaacaccauucauuagcauuuagaauagggcaagcccuuguguccagaucagcauucccagacuaagcuguguggagucccuugaguggcccuuuacugagagaggcuguguuuaaguugaggaaagcuagucuuccucccuuguugauaacgaugccuucaaaacaccaccacuaccauugcuaugucuagguggaagagcugaaggaucuuucaggggauggaagucaccaccuguaacuacuccaaagacagucauaaaauuagggaagagugguggcacaagccuauaaucauagcacuauaaagucaaucucuagacuaauuugaagcuagccugggcuauacugggauacuaaaagguuggcaaagaaagagauguugucccagcugcacagggccuugucacuauuaccaggaaagcaaaaguggcuaugucugcagguguggcucagagucuucagagguucccaugaggguugucucaggcuuugguguuagaccucaguaagcagcuguguguguucuuggguaaacuaccucccugcgcucaggucuugucuguagacagguuaacaagccaaacaaacaaaccaaaaaaacaacaaaaaaaaccucuccuaggucccaucagcuguacucaauuuuguaaugaaagagguauuccagguauuaaagagaggaccuggaauuuuccccuaaaaaccaguucaaucuacauagaaacuaaagauaccccagauucuagagacaccccauauucacccucagggcuguccccuugccuugacugacugugcuugaugcucccuccuacuccacacuccaagacaggcuggggccauguggccccgccccacccugcccuuguuagcuccgguucuagaaacaaaucugagcugcuguagcgugugucccccgcccuccgagaagacuguaggcugaacacacaacagccugucccacacagcauuuacugccacagcccccaaggcaccugcuccaggccuugagcugcucaaagcuuccggcgacggcgacuguagaagcccacauccuggcaggugagcagguaagcagaauggauggguuucuuucacaaggcugcucccuccccgucgcagucucugagggccgauuuaacaggcagagagacuugagccccaguc

SEQ ID NO: 4783 - RNA, 20761 nt, Mus musculus
cagggugcgccgcgcugcaugcgcagccgcguuaaagagccggcucugcgagcgcugggcggacgcagguauguggguccgcggggucuucaguuccacuguaguuuggggcgccuuccugcggguuucccagaucucugccgucgcccccagcgcuaguuagcugcaggggaccucuguagugcagucuucucuugaucuggguuuucagagggaacccccacgacuugcggacaccuggcacaccgagcgacauucccuugagccagggagcucuagaugccagcgcugcucugauuuugauuugagucguuuuccugccucaguuuaccccacuggguacacauuguaugaacguauuguuuacuaucugguuuuacuuccagccaacuucuuucugccucuuguucuucaaaaagcugcaaauuagagucuccugggccugccucucucucucucucucucucucucucucucucucucucucucucccucucucucucucucucucucucucucacucacucacacacacacauacauucaacuuuuaaaguuuuuaaaaugcugaaaugugcguagucccuaccuauaccaucuuuguucaaugagcagauuaugagcuggcauaguggcccaggccuguaaaccuaguauugggaaguggaggcaagaagauggaaaguuugaggccaacuaaggcugcauaauaugagccugucuuaaaaauauguacuuggagugugcgugcguguaugcauaaggggccuuauuuuaucaucccuggguaugcucacucuccugcaauuuuccugagguuuccuagcacuggaaagcaaacagaacuaaaaaaaaaaucaaccaaccaaaaauccuugacuagaugaauugguguaagcuuuuagccagguuugcuuuguaggacuaugucguaacuaaaaaagaaaagaaaaaaaaaaaaaaaagacauaaaaaguuccaguccucaaaacuccaacuuggauugagcaaaugaagcucugugaaaaugggcagagugcugcuauaauuucuucucuguauucuaagaucacugugcaaaugccacgugugacaacccaggaccauuccucccugugacugagaacauagacacggggacacacccagcuauuuaugcuagcucuaccugaccuuaggcagccugcuuauucuuuaagccaggcuuccuuuaugccuguggugugauaagaucaccuauuaggacuggugaauggcuccugugagcugucacuacaaugccguuggcuaggugccugagaaacacuccuuaaguguuaguuacucuccuggcugaucugacugggaaaacuccauagccuugcuugacuucuugagacuuuuccagaucuuccccuacccucacccagcaaccccauauuauucagaguugucuaaauuugcuuuucuaucgcugugauaaaacuaccaaaagcaaccuggcggggagaagggaggguauauguuuuauacuucccggucaggaaccccaggcagguauuuggagcaggaaucguggagacaugcugcuuacugguuugcuuucuugcuugcucagcccuuucuuauaugacccaggggcucucuuagaugccucgggauggggcccgcacacaguggcguaggcccccuacaucagccaucaaucaccacagccucucaaagacaagcccaaggggauuugauugaggcagaccuucagcugaggagcuuucuucagaggugaccuuauguuauaucagggugacaauuaaagccagcacuauggucuuugaccuggaaucuauuucagagccuucauuuccucccaaacagggcuaggcuaaaacuuucuuacuccacugccaccuuggaaaggugugucauucacucagccacugucgggcaccacauauuguuuugcggaggggaacauuacaagucaugcuuuuuuuaaaaaaaaaaaaaaacuuauucuucuuuuauuugcauugguguuuuaacuguauguauguaugugugaagauaucaagauccccuggaaccggaguuacagacaguugugagcugccauguguguacugggaauugaacuuaggaccucuggaagaacagccaguguucuuaacugcugagccaacucucuagcccuuaaaggcaugcuuuuuauuuuaaaaguccagugaaccgaguuaaggauaaggaggggcuggagagauggcucacugguuaagaacaccuacuguucuugcagaggucuugaguucaauucccaggauauacgugauaacugauagcuaucuguaacuccagucacaggggaacuggcacccaccucucaccuccgaaggcucuuggcacugcacucauguguuauaaugcacauacgcaggcaaaacacuuacacacaaaauacaauaaaauuaaaaaagaacccaugcuuguguuagaauucauaaaauuauaccagaacgagucacacuaacguaugaccaucagaaacauucacguaugcuuauacauugcuguuucaggaagccccuccauuuuggccagaauggagcagucagagggagucaauuggacugucauuauccugacaugccaguacaaggacaguguccaggucuuucagagagguaggugacacaccgucccccauuuucuuuauauuaggaacucucucuucucuuccuuaccagaccccugcugcacugggggccugguagaccuggguugaaacacagacuuucuuccuagucuugauaccugauauacacgucacguccuuggcccugagagagagagagagagagagagagagagagcgcuaaaucaaaguaaucaaaugaguguuccagucauuugguucagggcagacuaguggugacugugcgugucccccaacauuuauuuugcucccagagcuggagguaaggcagagacgggagcagauuccugcggggacgauguuacuggcuguggaggauccccagacucgagucggcagcggaggagccacccucaacgcacugcugguggcugcugaacacuugagugcccgagcuggcuucacugugagugcuucugagccgcgcugccccucuggcccauguucccguugaaacucaaauagugucgacgacuucuagaccuucggggguuuguucugugagucugacaggcucaucucugccccauugucucuccugcucuuggcagguggucacguccgauguccugcacucugccuggauccucaucuugcacaugguaagcaggauuccgaaugugcgugcggagggucagaaucuugguucgagcgauuggaugacacuguagggguguucuaccauggugcaugugcaagguguucauuguguaaauccagagggaugaaugaaaggaacugucuagacguugggagcugguuaggaauguacuuuacacaaaucaaaacguccaucuggagauggagagaggguucaguggguaagagcauuuacuguguaaauaugaaggccuggguucaaauccccaauaccauguacaaucugaauauggcuuugugugucuauaaucccaggaucagaggacaugcaccugcacacgugugugcaugcagcacacacacacacacacacacacacauacacacacacacauacaugcauauagacacauacauguacaggcaacauauaugcauacaacacacaugugcaugcaacacauaugcauacaacacacacaaauacaugaacacacaaaugugcaugcaacacacacacaaauaauaauaaaagaaagagguccaucuggggcaggcaagauggcucagugagcuaaggcuccuagugccaaaccagacaaccugaauuuaguccugaggagucaauucuaauuggaaaguuuaucaagauaaaagcuaauacagagguuuuuuuguuuuauguauguauauacguauguauguauguauguauguauguauuuuugcccagauucccccagugguaauuuguaaacagccaggauauugucauugcuauagaugcccgucuuacucuccaguguuaaaccuucuggaccuauguggcuuucugcuguugucucugcccuuccuucccuauuuuuauuuacgcuugcauguguguguuucuacuuguuugcauguacaccaugugcauacccugcucacagaggucagaacaggguacagaggguagaagagggcaucggguucccacagaaccagaguuacaggagguugugggccgcccagugugggugcucugaagugaaccuggguccuuucuaagagcagcaaguacucucaaccaaugagccaucucuccaacccaggucccaccucuucagcacagucugugcuuuuuggagauuauuauuauguauguaaaguucuuguuauauuuauuauguguaugugcauguguguaugcacguggaggucagaggacaacuuuugggauuaguucuuuccuucuacgaugugaguuuaaggacucugagucgccuuucaggcuuaguggcaaguucccuuauccacugaaccggcaucauacuggcccagaucccauuauuaggucuuuagaucaggaccucauggggucggagagauggcuuagugauuaagaguguuugaugcuccugcaaaggauccagguucaguuccuaacaccuacauuggaccgcucacacccacugauaguuccaguuucgaggauuugaugcccucuuuuggccuccgcaggcaccugcaugaacacgaaacacaugcagauaaguagguacacacuuuuuuuuuuuuuuuuuuuuaaaaaaaaaggagggccucauguagccguggcuugcuccaaacuugcuguggagcugagaacagacuugaacuucagauucuccaccuccaagggcugggaucaugggcaugugucaccaugucccaugcuaggcaagcacacugccaaccgagucgcauuuccaguuuauugagcguaugcuuuuuuuuuguuuguuuguuuguacccuggggcccagaguacaagccauguagcccuggcugaccuggagcucauuauguagaccaggcuggccucagacucacagagauccaccugccucugccucucaagcccugggacugauggcaccuucaugccuuaucagcuuacauuuguuaaaauugaaaaaaaaaaacaaaauuuagagaaaguaugaaugaaaguugggcaaaauggcugggggccgggggggaggugccuucugccaaaccuaaguuugacccucaagaccaacguggucgaagcagagacccagguccuuuuguuuuuggacuucuauuuccugucccgcaguaccugcaugugcacauauacagacgcuuaaaacaugcaaaagaaauguuaaugaaaaucuaaagggaaauaccucaaaaugaaggccacacuuagugccccuggggauguucuuuuccuuucgaugugugcugcgcuuuguaauucugcacaguaauccugugagcuguaaaaauucaaacaagaaccaucaauacaacacuuucuuucuuucuuuuuuuuuuuuuugguuuuucgagacaggguuucucuguauagcccuggcuguccuggaacucacucuguagaccagacuggccucgaacucagaaauucgcuugccucugccucccaagugcugagauuaaaggcaugcgccaccaccgccuggcuaacacuuucuuuuuuaaaaaauauuauuauuaagauuuauuugggggcuggugagauggcucaguggguaagagcacccgacugcucuuucgaaggucaggaguucaaaucccagcaaccacaugguggcucacaaccauccguaacaagaucugacucccucuucuggagugucugaagacagcuacaguguacuuacauauaaucaauaaauaaaucuuaaaaaaaagauuuauuuauuuauuuauuuauuuauuauaagugcacuguagcugucuucagauacuccagaagagggcgucagaucucacuacagauuguuguggaccaccacgugguugcuggaauuugaacucaggcucuccagaagagcagucggugcucuuaaccgcugacccaucucuccagcccaauauaccgcuuuuuuuuuuuucuuuucuuuuuuguuuuuuguuuuuucgagacaaaguuucucuguagcccuggcuguccuggaacucacuuuguagaccaggcuggccucgaacucagaaauucgccugccucugccucccgacugcugagauuaaaggcgugcgccaccacgcccggcuaauacaaugcuuucuuaaaaccucuuuuacuuaaugccuuuugcccucguacaguggaggugucccugcuucccuguagcaaggacucccucaugagguucugcuccccccacucuccccagggccgagacuuccccuucgaugacuguggcagggccuucacuugccucccuguggagaacccacaggccccuguggaggccuugguaugcaaccuggacugccuguuggauaucaugacccaccggguaaggccagguagucaacccagagugggcccucccagaugaaccaguuugcacguacugagccacccgggagggucuaugaggcucggauggggaaccccaggaagaaggguuuguagugagcacacuagagcuucaagcaguuaguuuuggggccagguguggugacgaacaccuuuaaucucagcacucaggagcagagucaguugggucucugaguuccagcucagcugagucuacauagugagacucugccucaaacaaacaaacaauaaguaugggaggagguugagugagagguugaaugucgguuaacacugacaucguggcaccugauaggcccugaugcuucaguggcagacgcuuuucaguuuuaaguggcuggaacacacgggggggggggggggggugagguggaguggggcggggcguaggggauggugaaagaguggaggaugauggugaaagaguggaggaugggcugggccaggccacuagcuaaauucccuggucuuucaucucuuuccccgguccccugcagcuggguccagguuccccaccaggugugugggucugcagcaccgacaugcuucugucuguuccuccaaacccuggugagcaugcguggcccgcgaccgccuucccucgccaagucugucccagcagcuauuuauaaaggaagcaugggcccggccauuggucuguugagccucagucugcccuuccgcagacuugguagcugguuguggugcuucaugccuguauaauucuugcacucgggagggcaagcagcagugaguucuagaccaacuuacacccccacgcccacgggggcggaguuaaaugggaauaaccaggacugccccgccccuuuggcucacauugacuugugaaagaauuuuaaggggagaaggggguugccauuuuuccagaggaauguccauuuggccuuggaaacuguauuucccuuccagagcucccaaacgcugcugcucugggcuuguuuccuccugucuggggcucccuaccuugccacccugauugugccaucccauagggaucaguugggauggcuuccggggagccagagugaucgccuuuccugggagccuggccuaugcguugaaccacggugucuaccucacugacucacagguauuacuccugguacagcuaagccgcccuggggucggggugcuuuuccgguccugugcucugggaccugcgguucuugauaucugucauccacguggucucgagccugaguucugaugcugcucacuugccuagaugucaggcugugugcucaggggcugaggcugugacagugacuaaagccugccgccgcccgccugcggcccccucucccuuauacagauagaagucagcugcuuuguccccucaaacgcaccgguaccugcccgccugccugacucgcaccuacucacugggagaccguuugcugacucucacagcugugccuacuuccugguccuuucuuguuccuggugcucauucaguuccucccuccccacagggcuugguuuuggacauuuacuaccagggcacuaaggcggagauacaacguugugucggaccugaugggcugguaccauugguaugguuagcugggcuugggacaagggguccuggggacuuuugggaauaggggaggacaguuucccuuucugggggagagacccacucuuuuuuagaggauccgaggccaagcuagaaccagaaccuaaagagacaugcagcagggcagaugaggccagaguccauggagcagguagauguggaagcucagggucuugccuugguccagauagcuaccagauucgagcaagguagggaauguaguaggagauuagaggcagccugguggauguggguaggauguuggguguagagcugaguuuggcagaccugaaaguugaggggguucuauaaggugcuuuuguagaagcugaccaaaccuggaauaugggggcuggggugaucccaaaagcccaugccuuuuaugauaccacaccacauucggcucaucugugugugcccuccucaauucaugccugagcuuggcaccaggguuccuccacgugagccuugugggucccuccaggucuccggggucgucuucuucucuguggagacugcugagcaccuccuagccacccaugugagcccaccgcuggaugccugcaccuauaugggcuuggacucuggagcccagccugugcaggugacuaaaggaagcaaccggggucccccggcuggggggugagaggcugagugaccucgggccagucuuuuccccuuucuggguuagccucugcagaugggacuagcccagcccagccaugggauuguggggcccagccacugcccugccaauagccacgcuucucccccucacccagcugucucuguuuuucgacauccugcucugcauggcucggaauaugagcagggagaacuuccuggcugggcggcccccggaguuggggcaaggugacauggauguagcaaguuaccugaagggagcccgggcccagcuguggagggagcuucgagaucagccccucacaauggguggguaucucuuauuagcccuuggguagaaagagagagagcugccuccugcacuguggacuaggcaagccuagcccaugaacuggacaguuaugcucuccccauccagaacuuuccugccaagguacuucccuucccagcccuccuguugucuccauuuuggcuccuuucccacuguguccaccugguagcuaugggccugaggcagguugcauagacucugaagcucagcuuuaucauuggcccaaguggcucacccccaaugccugccucucuagugucuggcgaggauguuugcuggcagccaacugacccuguacuggagcugcagcaggcauaggguuggagucagugcuuuuaagaaagauuucucuuuuaauuuaagaacuauauguggguuuuggagagauggcucagggauuaagagcacccacugcucuuccagaggucccaaguucaauucccagcaaccagacgguggcucacaaccaucuguaaugggaucugaugcccucuucuggugugucugaaccagaacacaacaguguacucacauacauaaaauagauacaucuuuuuuguuuuaaagauuuauuuuauguauaugaguauaccauagcuguacagaugguugugagccuuuaugugguuguugggaguugaauuuuuaggauuucugcuugcuuuggucaacccugcucacucagucccugcucgcucuggcccaaagauuuauuuauuauuauauauaaguacacuguagcuuucuccagacccaacagaagaaguuguuguuguguguaagccaccauguaguugcugggauuugaacucaggaacuuuggaagagcagucagugcucuuaccugcugagccaucucaccagcccagauacaucuuuuuuaaaaucccccaaaaccuauauguuugugugucugccuguugguaugcacaugggugcagguuccuuaagaggccaaaagagggcgcuggaucccuuggaguuggugguugugagccaccugaugugugugggugcugggaauugaacuuugguccucugcaagagcaccugggccaucucucgaaccccugggguccauucucaugucuuuauaguguaugucccugacggcggcuacagcuacaugacgacugaugccaccgaguuccugcacagacucacgaugccuggaguagcuguggcacagauuguucacucccagguggaggugagacuugucugccccuccccucccuuuuuucaaagauuuauuuauuuauuuauuuauuuauuuauuuauuuucaugcauaugaguacacuguagcuguacagaugguugugagccuucaugugguuguugggaauugaacucaggacuuucagaacagcagucagugcucuuaccugcugagcugucucaccagcccuugucugccccuuaauaggcgcauacugaguacuugaggucagugagaggugggcuccagagauagaaauucccugugcuuggaacaguuuaccuaugaguuaagguacuaucagcucucuuuuuuucuuuuuucuuuuuuuggagacagggucucacguagcuggaggcugacucaaacuugauagaucuccaaggauguccuuaaguuuucuccacccccuacccccuguccccgacccaccagacuggguuuguguagcccugucugucuguagaccaggcuggucuugaucucagagaucugccuugccucugcccacugcuuggcugaccuugaaauuuuuauuuaagacuuauuuauuuuuuacauuuuauuuacuugcgugugcgugugcauguacaugccuucauguguguacaugugcacaugcuauagcacguauagaagucagaggacaacuuacaagagucauuuuucuccauuguuugaguucagggaucauacucaguuuuucacacuuggcaacacaugccuuuaucccuugggcaaccuagcggucagacuuugaacuugcuuuuguuuuguuuacuuuuuuucuuuuuuuuuuuuuuuuuaaagauuuauuuauuuauuauauguauauuacacuguagcuguccucagacacuccagaagagggagucagaucucauuacaggugguugugagccaccaugugguugcugggauuugaacuccugaccuucggaagagcagucgggugcucuuacccacugagccaucucaccagcccuuguuuuguuuucuuaagacaaggguuucuuuguguaguccuggcugaccuugaggucacagagauccuccugccucugccucccaaauucugggauuaaagcacacagcaccacauuuugauaucccagagacacuggaggugcagagaagccaaagcugcuuacucaaggcuacagaguggccaguuaauggcuaguuagaagcuaggaaggaccuuucugcagguucuuuggggagacaggaugcugaggacuggacagauggcauucagagguggccuucggguaggagugcuggauagaccagaugggauggaguaaaguucuuuggcuugggccaggacaggucuagagcaggaucuggcugguugaaguuccuggaguguagugggucuuuauacuuuccaccuaggaauuuguuuccaaguaagaauugaggggccuagccucuggcuuucagcuuuaccgguuuucuucccuggcuucacaggagccacagcugcuagaggcuacgugcucgguggucagcugccugcucgagggcccugugcaccuggggccucgaaguguccugcagcacugucaccugagggugagcccugacagcaugggcagggggggaagcagacggggugggggugccauugcucagcacuuguuggggccccguguaccugccccucaccucaagauaccugccugcuuccuuucagggccccauucgcaucggcgcuggcugcuuugugaguggucuggauacagcccacucggaggcacugcauggccuggagcuccaugaugucauccugcagggacaccaugugcggcugcauggcucccugagccguguauuuacucuugcuggccgucuggacagcugggaaguaggcaucuacuucacauuccuuugucuccaucuuucaacacuggggaccccccaggggucugccucuguccuaucacaggguuucugagcacuggccugagggauagacugggggcggggugaccagacgucacauuggacuuugaggacuuuauccccgugcuagaggcuggugguugagguuuagaggguagcuugcuuugggucucuuggcuaguaauggcccccaucaggaguagaccucaggauugugcucuaaauccuaggcauuuggguggaaguguuaaaaguggcuuaaaagaaccuguuccuguaugugugucucucucuuccaguccccuuuggagcaucuguuccccagucucucgccugguguccccuagucccuuucaaaggccccugcauuccugacugcuucuuccucuucccccagagacagggggcaggcauguaucucaacauguccuggaaugaguucuucaagaagacaggcauucgguaaguaagcugcuugcuccagcaggccucugugggccuaggcagccgguguagcugcugcuuuguagcuuugcccugggcggcccuguccgguccucucaccacccugcuaggcccacuacagcuggaacagcuggauucuccccaggacuuuuucccuagcagcucugcaguccuggcuaugcugugucuacacuuugggauuuuuuaauuauucaguaucuuaggcaaguugacagggcagcauagccucccuccccuagugacagacauacuagugacgcccaugggggaguauguccugucccuaugaguugaccaauaggcuuggaaagaaggcagggcccuuagcuuucuuccuacuaaugcaccuuucugcaccccagagacugggaccugugggacccagauacaccccccucagaucgaugccuccucacugcccgccuuuucccugugcuccaccccacgagggcccuggggccccaggaugugcuguggaugcugcacccccgcaaacacagaggugaggcccuucgggccuggcgagccuccuggcgucuguccugggagcagcugcaaccuuguguggaccgggcugccacacuggacuuccgccgagaucuguucuucugccaggccuugcagaaggcaaggcauguguuagaggcgcggcaggaccucugccuacguccacugauccgggccgcugucggggaagguugcucugggccccugcuggccacacuugacaagggugaguguucuggguguuaauaguaaggaguuaggcugugauggccugcccugccugcccugccugcccucugggcugucaauggaaaggacuaggaagccaugcgauucuaaaguggaagaaacgcuagaguuuuguuuucuagcaaccuucauccuuguuagcaaggcuuuuagugggagguuggcgcccgguugcugagacucuggguccuuacagcaucuacaggccuguguguucuguacugagugccaggaugagggcgcaaagcuccagcugggaccuggcauguaggcagcucucccacacgguagcuggaccauauggccugguggcuaagagucuuagccucauagaaaguggcucauuaguggcccugagaagagcggaaucuuguuccaguucaaaucacucgcccaaagcuagcugaggugaagacuugaacccagguaguuugaucccucaacucuuuuuuaaaaaguauuuauuuaagccaggcagugguggugcaugccuuuaaucccagaacucuggaggcagagaggcaggcagaucucucuugaguuugaggcuagccuggucuacagagcaaguuccaagacagccagggcuacacuuaagaaccccccuuucuugaaaaaccaaaccaaaccgaaccaaauccauuguguguguguguauguguguguguguauacguguauguguauguguaggauuagaagacagcuuguucucuucuuuccccauaugagugucagagauugaauucagguugucagguuuggcagcaagugaguuugcccugagguuucucacugacucaagccugaauaaugccucagguagcagugggagaugcguuugcauuggagcuagcagaauaaaaccuuugcuagggugcauucacaggcaggggcacaccuugacgaaaguuuguagcagugaggagcccggaguaucuggggacgauugagccucggguagaguauuagaggccagagccuucucuucuggaaccccuaacuccuggccccucaguugcagcuggggcagaagauccuggcguggcagcccgggcucuggcuuguguggccgaugugcugggcugcauggcagagggccgaggaggcuugcgcagugggccagcugccaacccugaguggauucagccuuucucauacuuggaguguggagaccugaugagggguguggaggcgcuugcccaggagagagagaaguggcugaccaggugggugugaaucaaacuagaaucugucaaggagccaucugugaaaggaucuccugauaguggaugcucagagaggacguucagauugaccauggcaagucuauucccagcucggggcuccaugagacuaucuucccuccugucaggccugccuugcugguucgagcugcccgccauuacgagggggccgagcagauccugauccgccaggcugugaugacagcccggcacuucgucuccacccagcccguggagcugcccgcacccgggcaguggguggugacugagugcccagcccguguggauuucucuggugaguuccucgggcuagguauggguauccuccucagagucaggcuggcaggcucugugaccacuuuguugaacugcacuagggggcuggagugacacaccgcccauugccuaugagcuugguggagcaguguugggccuggcugugcggguggauggccgccggcccaucggggccaaagcacgccgcaucccggagccugagcucuggcuggcagugggaccucggcaggaugagaugaccaugaggauagugugccggagccuggaugaccugcgggauuacugccagccucaugccccaggucaggacaauuagaacaucauccaggagggauggcagccagagccagcugggaugggggcagaccuuggauauccauccacagaggacuguagacuauuggggagcuagggcucgccaguaugucugaggagcucugaaagacuagaaaaggcugacaguuacccuucuuaggcaccagcugucgcagaacacauuugccugugguagagagccuagaugcccuuuuauggcuugaggauguggccugcacuguccuaccagaggaacuccaucuuggguuggggaauugcgggguuggauguuaagugauaggcugagaugggccuaggaguagaauuccucccuuugugcucauuccucaggggccuugcugaaggcagccuuuaucugugcuggcauugugcaucuccacucagagcucccucugcuugaacaguuguuacacuccuuuaaugguggcuuugagcugcacacguggucagagcugccgcacggcucuggucuugguaagccuugguucccuguugauacccugugguccugcucccuggccugcgugcagcaccgagagugggugggacugguuggaucagacagaagugucucaugacuggugcccuccucuguguucugcaggcaccagcagcauccuggcaggggcugcccuggcugccuuacagcgggcugcaggccgggcagugggcacggaggcucucauccacgcagugcugcaccuggagcaggugcucaccacagguacacagugggccugggugguggaggcugggguccccuagauucaucaguugccauauaacuguaaaaugguuguaguuuccuuaccacuuggauuucugaugcuuuucaacuugaaauauuuuaccucaaaggagcuaagguccuacucugaggacuggacuugagggcgggaagcuauugcuccuuuugauuuguguguaugagcguuggccuggauauauguaagugcaccuugucuggggcccacagagggcagaagagggugcugcauucucugcagcuggugauaacagguggaaaugagccacccuaugggugauggggacuggguaccugugguccauauggugguccucaugacuacccacuccaggcuguccuucagaaacuaugaggcagaccugcguuuggaacggaggauggacuuggcacuuucugggcuauaaagguuuuugccccuuugcugucuguauggcggaacaaugauggcccagcuaagacuauacucugaggugguuuggucaccagaccgccuucuggcuauuaugguacaugaagcugagcauaauguaaagcagccacgcauuuguuugguccuagaucucagaccguuuuguucacccaggaggucucaucucugguauaguuugaaggaaacugccucaaagaugcacgaauaccugaucgcagggucuccuccagucccccugauguaugggcaccugaccacagggucuccuccaguuccucugaagcccugccuuuguguugacccaaauccuauaguaggcaguacauaagcaaaaguuagcuaugcuuucaguguccuuuugagaccauucgaguucauuuggucaacugacauuuauugauaacuuuauuggggccuagggacgaaaugagcaaaaacaugucuuugaucucaaaagucaugggauauaaggaacauaggcacucaucaguagccacuagagcgcucugaagaaggguauagucgaguucuugguauuuucugcacucucucuccauccucauucuguacuuuagauucuuaacuaccgagggacugaaaguuagagagagagcuugguggguaaagcgcuugcugugcaaacaugaggaccugaccuuagauccccagcacuaaccaguacaaaagucuaggugugaaauuauguguguauaaacccuguacuaggugugcaaaaggaguucgcagggcccaguggccagccaguguagcuaauuggugaccuccagguggcggaggggcuggagaguuccuagcucauagccaccuguaaauccagcuucaagggaucugacccucucuggguacugcguucgugagcacauaccuacacacaccaaugcuuuuuucaagauagagucuuacuauguagcccuagcuguccugaaacucacucuguagaccaggcuggucuugagaucacagaaaucugccugccucugccucccaagugcugggauuaaaggugucugccacagcuaccugacuuuuauuuuuagguuucuuauuuuauauauguguguguuuugugcuuuuucuuaaaaagacauuuuucuauauguguaucuccuuauggguauguguacauggacccauaaggagauauggaggccagaagguauuuaauccccccgugcuggaguuucaggugguugugagcugccagauguagguucuggaaaccaccugcuggucuucugcaaaagcaguaagaacuuucaguuacuaagccaucuuuuugcuucuaugaacuuauuuuucaaggacucuuagaagacagauuguccggguacuggcagauuacgugaagucuaacuucugaugugucuugugccaauucuaauuacaugauuaaccugcaacaaaacugucccuuucugggacuggccugcugucguggcuuacucgucucagcuagaguugggacugggacaagcuuauucccauucugguuccaguuagagauucagggccaugaaacaaggcugggugagguugggucacuuagguuccaacagugacaggacuuuggguucauaggagguggcuggcaggaccaagucaguggccuaaugccuggcaucaaaguggggcgcucccgggcccagcugccccucaagguggagguggaggaaaucacugugccugagggcuuuguccagaagaucaaugaccaucugcuccugguuuauaccggcaagacccgauuggcccggaaucugcugcaggugagcucagccccugacuaaggaaggcaguuuccuggcuggccuuggcuggagcugauucucauggcaccguccgugucccgccugcaggacgugcugaggaacugguacgcucgguugcccguugugguacagaaugcccgcagacuggugcgacagaccgagaagugcgcugaagcuuuccgccaaggugagcuuguuuaucgguucagagguaacucuugccucaggccagacacaaccccacacauuagguccuuggggaucuccuuguguuuucuccuuguggagcccuaucucaguauagaacuugucucaugggaauagcccucugauccuaguuaccaggaaacaggaggaagaggcucugcccugacugaguugcagggaagugggggcugcuuaagccccaaugaugaggcuauagaacacuggcugggcaccaugcuggcugcuccgugcugugcccgcaaccuugugcaguugaagucaugccuuuugacacucccuuccuucccucugcaaaaguuaccaccggagaaucuggcccaggcaaaccauccccucuccuaaccccaggaaaccugccucugcugggacaguaccugaccucauacugggagcagaagaagcuuauggccccaggcugcgagccgcuggccgugcagcgaaugauggauguccuggccccguaugcguauggccaaagccuggcaggggcagguggugggggcuuucucuaucuauugaccaaggaaccccggcagaaagagacucuggaagcuguccuggccaaggcugagguaugugcugguauaaugguuggaaguugguuggagugaaauaacccaacuguggcccaccaaaucaugguccuccuggccccguaucaguccaaaaggccugggaauguuuaagcucucaacaccuucugucccacccagggccuuggcaacuacaguguccaccugguggaaguggauccucagggccugagccugcagcugcugggacacgacacccgucuuuguggggccgggcccucugaagugggcaccaccuagagcugcagcugcgcgucccuucaguggggcucacuuuguuaucccuuaccuaccucuucaagucugcugcuaaggaaggaagcaagacuuggacagaagaggcaguguuugcaaacaguacugugcuucauggugggcaguggcugagacuuggccucuaucucaucuggauuaagggaggucuuagucacagugucucaugugcacucuacaaauuccauggcccaguguaggccuccuagggcccugcaaaggaugacaaucagaccaacucuaaagauagacuuucaggcauucccauaccaacucugauucuacagcaggggccagggaagagugaagguguguucucaggucugugguagugaaccacucucugccacagucuacagcaagcuuuugauaaccuaagccuuucuaacaacacuacagugucaaaggaaccuggggguaguggguucucaacacccgcauccuuggaauaaauucuaauuuucaaguuugucuucagaaaacuguuuuuuugcugggagaaauuccuacuucuggcauugugggaagcugcuauaccuggauugauccagccccuggugcugaaagcccaagaaaggguugaaguccaggacuggaugaggguuccugcuguuaggugacuagauggggggagacuugacugcaggccacuaguggaauggccuuguccaagcaaccaacccuuccuggacccaacacaauggcaugucuccagguagugucuuuauuugugaacaucauagccuugccguuaaguccccagguaccuccaaccucccugcugucaugggcauguguguuguagugugcgggcgagagaguaacagauggccaggcauaugcugcccacuuaguccccaccucucuguuggaaaagcucucccuuuuagccuccagccguaacugcuccugggaagaacuuugcagugagugcacuccuugcuuccugguuuccaugcagugguguagccuggaccuuuggcugacccaagccagacaguuuugcauagcucuuuggcuguaacugcuuagaaaacagguccugaagucuggcgggccacauggcagcuauaggcgcagccucuugauauccucauugcggaagucuaugcgcagagccagcaccugucgcacuucagcaggggugaggcgccaugucaaagggccagaguuagcaccccaguaaucuaguaucucagucaccu

SEQ ID NO: 4784 - RNA, 2829 nt, Mus musculus
gacacaccagaagaggguaugucauuacagaugguggugagccaccaugugguugcugggaauugaacucaggaccuucagaagagcagucacugcucuuaaccauuuaaaagggaggggggcuggggccaucucaguagcccccaccccccucccuuuuaaaacuuuacauguguugguguuuugccugcaugugucagauccccugaaacugaaguuacaguucugggcugccaugugagugcugggacuugaccccagacccucuggaagagcaacuacuggugucaggcacugagcucucuccagcccuuucugccuuguuuuuaagagauguucacuuucagugucaccauuuaggugagugcagguaguaacuauugcuccaucuuguuuugugccuucucacuucucuugcccuucuuugaaacuuccccacagcacucaaacaccugcacacucacaggcaaaccuugaugucuucugcacuacccauucuaggcagaccgugauuuucaaucucauaccugcucucccguguucaccaucauucaagggcugaaacucuagccuacauacacaucuaucugguacuucucuucuguggaaccaaaauauuucagauccaaaagagucuaaacauguuuuguuugaucuuuguccuuuccuauuguuguauaggcuaaaucccugaauucugggcucaguugauauuuauuucacugucgagguucacaggugagcaccaauacaacaucuuaagaucuaaaugaacauaaaaaugacucccaagaaagaugguuuuaauucuguuuuugagccauguucucuuaauauaacuccggauauucaggaacuacugaucuugucaccagagcacugggauugaaaguaacuuacaucucugggaguggaguauacaugacugccaggugcccaaggacagcagagguaccagcuuccucugaagcaaaggaaguaccaggcaguugugaaugaccugacaugaugugggcacugggacucaaacaaagguccuuuauaagggcagcaagugcuccugacuauugagucuucucuccagcuccuagauuggcaaaguuuuaaaaacugauaauauaaaggcugcagagauggcucagagguuaaaagcaugggcugcucugacccagaguccugaguucaauucucagcaaccacauggauucauagccaucuguaaugaaaucuaaugcccucuuuuagcaugcauacagccaguacaaacacuauacauaauuuuuuaaaauuugauaauauaaacccauuuaauccaagcauuuaggaggcagaggcaggcagauuuccgaguucaaagacaauuagggcuacacagugagaacuuaucucaaacaacaaaaaaaguaggagaauacuacagaguuggugaauuaugacuucaaauguuccaacucugacccaagaauucuacccccugugguccaagacagggacugagccagucacugucacuguagguaacaacaugcuagaaacccucaacaccuaccacugaggaaaccugggccaggguggcuacacaugagggugacagcuacuuuccagagggagaugggcauacaagugaaccaucagcuuacaaacuagugugaaguguucacacuuguggaagagagagggacaugccgaguaggcugguagcuauggugccucaaguguacacaaacauucuuauacacauuuuuaaugagcauauauuagucuaguaagcagaaaaauacaaauaacaaaucaugauuagcaaaauuucucauaauuaaaguuucuaagaaugacguguuaccacugauuuauaaaccuuauucauacaauguaugaaguaacccauaagucugcucauagcauaauucagaguuuuugcuuggucauaacuuccuuucuaaguuguuacguggcaugaagucccauggauuggaacaaacaauggagccaggcacagacuagauguacaggaggaaagacaccuccaucuucaaugggauugucuaugacccucgagucugagauuugcugacuuccauuuuuucugccaaucugaagaauaaagacauaaccaaggcauuacaccagggaagcggggguggggugggguggggggugggugguuguugagugggggugaauggagaacagagugucucuacugguucuaugagaggcaggugagcuauagcaaugucucuccugaccucuaugaacugccuuuuccucucauuuauucaagguugaggauuggucaaaacagagggagccagccagugggcaacaaggccugcagcccaagcauuagcaaccauauuaccauacaagaaaaacuguggcuuuaaaggggaauagugccgagaacucaguucuuuccucaagacaggggcucacuacauagcucuggcuguccuagagcucauuaaguaaaacaggcuggucuguaauucauggagauccuccugucucuacccuccaagugcugggaccaaaagugugcaccaccacaccaagccagggcuauauucuaaauuguaaauuuucuuagauuucccccuacuauuugcagaaauuugucaaguccaaacguaauuccgaaugagguagguagucucuacucagcccguggucucugaggggcccgucaggccuaugccaugaaagcacuagacucccaggcagggagcgcugaggguggcgccagcccauggagaagcgagcgccucaguuggcgauuuucucaaucucguccaaaucaucuguguccagucuuucuaucuucuuauc

SEQ ID NO: 4785 - RNA, 2829 nt, Mus musculus
gauaagaagauagaaagacuggacacagaugauuuggacgagauugagaaaaucgccaacugaggcgcucgcuucuccaugggcuggcgccacccucagcgcucccugccugggagucuagugcuuucauggcauaggccugacgggccccucagagaccacgggcugaguagagacuaccuaccucauucggaauuacguuuggacuugacaaauuucugcaaauaguagggggaaaucuaagaaaauuuacaauuuagaauauagcccuggcuuggugugguggugcacacuuuuggucccagcacuuggaggguagagacaggaggaucuccaugaauuacagaccagccuguuuuacuuaaugagcucuaggacagccagagcuauguagugagccccugucuugaggaaagaacugaguucucggcacuauuccccuuuaaagccacaguuuuucuuguaugguaauaugguugcuaaugcuugggcugcaggccuuguugcccacuggcuggcucccucuguuuugaccaauccucaaccuugaauaaaugagaggaaaaggcaguucauagaggucaggagagacauugcuauagcucaccugccucucauagaaccaguagagacacucuguucuccauucacccccacucaacaaccacccaccccccaccccaccccacccccgcuucccugguguaaugccuugguuaugucuuuauucuucagauuggcagaaaaaauggaagucagcaaaucucagacucgagggucauagacaaucccauugaagauggaggugucuuuccuccuguacaucuagucugugccuggcuccauuguuuguuccaauccaugggacuucaugccacguaacaacuuagaaaggaaguuaugaccaagcaaaaacucugaauuaugcuaugagcagacuuauggguuacuucauacauuguaugaauaagguuuauaaaucagugguaacacgucauucuuagaaacuuuaauuaugagaaauuuugcuaaucaugauuuguuauuuguauuuuucugcuuacuagacuaauauaugcucauuaaaaauguguauaagaauguuuguguacacuugaggcaccauagcuaccagccuacucggcaugucccucucucuuccacaagugugaacacuucacacuaguuuguaagcugaugguucacuuguaugcccaucucccucuggaaaguagcugucacccucauguguagccacccuggcccagguuuccucagugguagguguugaggguuucuagcauguuguuaccuacagugacagugacuggcucagucccugucuuggaccacaggggguagaauucuugggucagaguuggaacauuugaagucauaauucaccaacucuguaguauucuccuacuuuuuuuguuguuugagauaaguucucacuguguagcccuaauugucuuugaacucggaaaucugccugccucugccuccuaaaugcuuggauuaaauggguuuauauuaucaaauuuuaaaaaauuauguauaguguuuguacuggcuguaugcaugcuaaaagagggcauuagauuucauuacagauggcuaugaauccaugugguugcugagaauugaacucaggacucugggucagagcagcccaugcuuuuaaccucugagccaucucugcagccuuuauauuaucaguuuuuaaaacuuugccaaucuaggagcuggagagaagacucaauagucaggagcacuugcugcccuuauaaaggaccuuuguuugagucccagugcccacaucaugucaggucauucacaacugccugguacuuccuuugcuucagaggaagcugguaccucugcuguccuugggcaccuggcagucauguauacuccacucccagagauguaaguuacuuucaaucccagugcucuggugacaagaucaguaguuccugaauauccggaguuauauuaagagaacauggcucaaaaacagaauuaaaaccaucuuucuugggagucauuuuuauguucauuuagaucuuaagauguuguauuggugcucaccugugaaccucgacagugaaauaaauaucaacugagcccagaauucagggauuuagccuauacaacaauaggaaaggacaaagaucaaacaaaacauguuuagacucuuuuggaucugaaauauuuugguuccacagaagagaaguaccagauagauguguauguaggcuagaguuucagcccuugaaugauggugaacacgggagagcagguaugagauugaaaaucacggucugccuagaauggguagugcagaagacaucaagguuugccugugagugugcagguguuugagugcuguggggaaguuucaaagaagggcaagagaagugagaaggcacaaaacaagauggagcaauaguuacuaccugcacucaccuaaauggugacacugaaagugaacaucucuuaaaaacaaggcagaaagggcuggagagagcucagugccugacaccaguaguugcucuuccagagggucuggggucaagucccagcacucacauggcagcccagaacuguaacuucaguuucaggggaucugacacaugcaggcaaaacaccaacacauguaaaguuuuaaaagggaggggggugggggcuacugagauggccccagccccccucccuuuuaaaugguuaagagcagugacugcucuucugaagguccugaguucaauucccagcaaccacaugguggcucaccaccaucuguaaugacauacccucuucugguguguc

SEQ ID NO: 4786 - RNA, 22837 nt, Mus musculus
auucuuauacacauuuuuaaugagcauauauuagucuaguaagcagaaaaauacaaauaacaaaucaugauuagcaaaauuucucauaauuaaaguuucuaagaaugacguguuaccacugauuuauaaaccuuauucauacaauguaugaaguaacccauaagucugcucauagcauaauucagaguuuuugcuuggucauaacuuccuuucuaaguuguuacguggcaugaagucccauggauuggaacaaacaauggagccaggcacagacuagauguacaggaggaaagacaccuccaucuucaaugggauugucuaugacccucgagucugagauuugcugacuuccauuuuuucugccaaucugaagaauaaagacauaaccaaggcauuacaccagggaagcggggguggggugggguggggggugggugguuguugagugggggugaauggagaacagagugucucuacugguucuaugagaggcaggugagcuauagcaaugucucuccugaccucuaugaacugccuuuuccucucauuuauucaagguugaggauuggucaaaacagagggagccagccagugggcaacaaggccugcagcccaagcauuagcaaccauauuaccauacaagaaaaacuguggcuuuaaaggggaauagugccgagaacucaguucuuuccucaagacaggggcucacuacauagcucuggcuguccuagagcucauuaaguaaaacaggcuggucuguaauucauggagauccuccugucucuacccuccaagugcugggaccaaaagugugcaccaccacaccaagccagggcuauauucuaaauuguaaauuuucuuagauuucccccuacuauuugcagaaauuugucaaguccaaacguaauuccgaaugagguagguagucucuacucagcccguggucucugaggggcccgucaggccuaugccaugaaagcacuagacucccaggcagggagcgcugaggguggcgccagcccauggagaagcgagcgccucaguuggcgauuuucucaaucucguccaaaucaucuguguccagucuuucuaucuucuuaucugagggggaaagagaagacgggaggacaucucaccaugaucuaccgaggacacgcagcaggagucacccaggacaggguggcagucugccgaggcaccucccugagggacagugaugcuuccucuagccacaagcaggcuuccugagccugagcagauagcaccagggcuaucuaugaucauagcuaccaacuucccaggaagucagguucucccagccuggucccagggcacugauauugcagucccugagccccggauaugcagggaccacgaaaaccugcccucucccacacccccucugaaagggauccaggcagagccaacccggcacucacuaaaaugcuccuggauccuguugaggauauucaugcugugcuugcuguccaccauguucaccgccagaccccucuugccaaagcggccagugcgcccaaugcggugcagguaggucucauugucuggguucccauccuuguccacagggaggucaaaauugaugacgacagacaccuguucaacaucgauaccuguacagagggggugggggaggcaggcaggagacagaggggcaccaucagccacacguacccaguugggcugaagacaugccugggacaggucacaucuggcauguggccacuaaagcgcacaucacuaaagagggucugucuguagcugaggacgcaggacacaaguccacaagacagggagcaccuggaaacaaaccuucccaccaaggcagacugcgggcuucccuuccaccaucuccuaggaaggaaugucccucaaacccuccgccuccacgagacaagaacucuucuugcucacagggccugggcccccagccuggugaacggggccagucucugcucaccacgggcacacacguugguggucaccagaaccuucucuuugccuucucggaagcgcucgaucaccgcagcccucugcuccaccaucaucucuccacucagcagggccaccugguggcccucuuuugagagcucugcugccagccagcuagcuguuuugcgggucuggaaaaacaagcaaacaaauauguaagaaauauuagcaccuauagagacugauguggaucuacccuguaaccaguuaaacauuaaacgcaguaaaauugccaaccugauaguacaauaguaagcaaaagugucacaagggaaacaauuuuacaaaauuuucacuacaacacuacacuggggucugcugaaauggugcagugggcuccgacucacugucaagcuugcugacuagaguuugaauccagagacucacauggcggaugaagagaacugaguccucagauauacugacguacugugccacguccacacacacaauauguaaauguaacaaaaaaaacucagguagaagagauuuaaguuggcuagucugagcuacacagugagccauuuaccucaaaaucaaaucugaaagccgggcggugguggcacaguccuuuaaucccagcacuuggaaggcagaggcagguggauuucugaguucgaggccagcuuggucuacaaagugaguuccaggacaaccagggcuacacagagaaacccugucucaaaaaaacaaaaacaaaaacaaaaacaaccaaaaccaaaacccacaaaccugaaugggucacaaaaggaguuggggaaaucagagaaguucuacaauucaugaccccauuagcugcauucauucucugagaugucaugaagaaaaaaagucagacaugcaaugucagagacaugaagggaugguucuagguagaggagucuugagacagaacuacuaaaugcagugagcaaucauugguuggcucaacuuuaagcuaacaugagcaaugaugccuccguagcucaaaaaauauacugcaacuuuaaucccagcacucaggggucugagagugaggccagccugguuugaaaagagcuccaggacagccagggcuccacagagaaacccugacuugaaaaacaacauaaagaaaacuaacaaaauuccccagcaaaugaacgcacaggggaauguuuguacugacagagaggaugugucucuugucuccuaacacuacuuucaagggcuuccuccugggacaagagccagcuuguuccguagcuuucuuuucccuaggagucugcagcagcuugcuuuggauuuuccaggaacauaucccuacaaauagacacccaucuaggaaugcuguguuaaacuuacagaaccccuacaacaugaccacuaaagaaaccauuuucuccauuccuacaagcuaguuccuagcuacagagaauuuggucccuuugagugacaggcugaacgaucuagggacugugcaucugaguaggccgggacagcuacucacauggcagaagaucauggcuugggcgauggugauggccccauacagguugcacagggccuggaacuucuccucucuguuauugcagaggacguaguacuguuugaugguguccagagucuccuccucacgcuuuagcuugaugauguuggggucugggaccaccuucugggcaaacuuccacaccgagucuucaaagguggccgagaaaagcagcaucuggcaguuucugggcagcauccugcaaguggaggcccgggcacuuugcaacauuccaaggcgguagagccagagggaaggcucacaagcucagccuccccauucuagaugggcugcagccgcagcaggcugaggugagcagagagcauccuggcacggaggagcagacccagcagggcacuggggcugagugagggacccaggccucucuccccaacccacgcuggcaguauggugacagcugcugugcaaauggcccaccagaccaaugcagcugcacagagcagagcaaagaacucaaagaugcaagaggagcucuggccaguuccuccuggcucucucuaguuccuaccucuggaugcggaugcucuggucuugguggcccugagucgcuaucaucacaucagccucguccagaacaaacaccuugaucuucuuggggucaaugaacuucagcuuggagcaccaguccaagacggucccgggggugccaaugacaaucugcucacucaccuucugaccucucuccacuguggaaaagguaaguuuucuuuacauguuccaaagagaaagccaguucuggaaauaaaaaucuucuacauugucuuagaagugucagaacaagucacuuucagauuucacaucacaugggauagcugguaagauggcuuagugugcuaaggcuccugucagauccuaagaacuauguucacucucugaaaaccacauagugaaaagaacugaccugagauuacccucucacccccacagcccaauaaauaacccacgagggucguccucaagccucgcuucuucaacagugacgugaacacugugugcugcacuguggacacaaaacgugcauguuucuacuuucuccuaaaaaccuaaaaaaguucauucguuuaucuguggauaaaggguagaguucugugccugcagagucuagacggcauuggcagauccucugauuggaguuaccaaguuaugagcugccauguggacacuagaaaauugaaccuggguccuucuagaagagcagugagugcucuuaaccacugccccaucucuccagcccucuccacaguugaugucaugaaacuucucuuuaacuguguuuuuucauucauauauauaugaaaagacauauauauauauauacacauauacauauaugugaguguguaaauacacauacagguguguauguauguauacauauauaacacauacauacacacacauauggcuguccucucuguagaccaggcuggccucacacucagaaaucugccugccucugccucccaagggcugggaguaaaggcgugugccaccaccacccgguuauauguauguuuuuaaaaaaagauucacuuauuuuauguaugugaguauacuguagcugucuucagacacaccacaaaagggaaucagaucccauuacagaugguugugagccaccaugugguugcugggauuugaacccaggaccucuggaagagcagucagugcucuuaaccgcugagccaucucucuggccccugugugucuuuucauaucaucuauucucucauguaguucacucaauuccuccuaugcugguaguugagucaaggauccuggccacguuuuuguucuguuuucuggucuaugaagauucuacuuguauagguaguuuuccuaggauaaaucucuuuaguuuacaacacacaagcccaugacacacagucucugaaauuuaagcuaggucaaguuuauucauguucacuuuaacauuccauuguaagaaauuaagccagugguggucaggcaugagcccaaguuuacaaauuccaucucuguuuaggccuccucccuuauacuuacauuuauugccucgaacagcauaagcuagcuucaauucugggugaaacuugcccaucugcucaaucacuuuuccaguuuguaaugccagcucauauguuggggacaggcacaaacacuagcagagaaaucacaaaaggcgaguucagugacagacaacgggccuccugaaauacugcagggaccuacuccucaagcaggaccuguugaacaaaugccaucaguaagggacccggcaucagugguucaguauugguggaggccauagaaaucacugccuaaagccgaggucuccaaaagaauccuccccugucaaggcauggcgcacuaacugcuuugagaugucaaagacuaaggugccaacacaaguuacaccucaucagauggcucuacugggacucagggcaggcaagcaacagcccccaggcuucuaacacucaccugaggauaucugucugcugguuccacucugcugagcauagcuaggacaaaggcagcuguuuucccaguaccagacugggacugugcaaucagguucugugggcugcaaugacaaagaacagaaauaaaauauuggagcaagguguggugaucuacacuuuuaaucccagcacuuagaaggcagacacaggcagaucuaagugugagagcagucugguuuacauaccaaauuccuggacagucaauucuacaugaugagaucuugucucaaaaaaaaaaaaaaaaaauccacuuauguuucuuuuuauuaccuauguuucugcacugaacagaaaauaacuuucacacaguauuucauuugguaaugugccaccagcuucauuucaaccccuacauuuuaaaaaugcuuugauucauuuauguaugcacgccuauauaucuguguauagaaugccauguaugugcagcugaguacacacagagaccagaagagggaaucagaugucagaucuccuagaacuugagucacaggaaguugugguccaccugacaggguaauaggaacccaagcuggguccuguggaagagcaggaagugcuuaucaccacugaggcaucucuccagcuccuuucaaagauuuacaaauuauguuucugugcuuugugcuuuggggaguggagcuaagugagugugaacgaagaggacagucuuuaggaguugguuuuuuccuuuuaccacacggucccagggauccaucuaacaggugucaauuauuggaaugugcauuuacucugagcuaccucauagcuccauuuuauucuauguuaguuuuuucuuaaaggauauuauuauuuaguauuauuauuagauggguucacacuaacaaaauccucauuccagauucugaaauauucuaauuuaaaugcccaaaguaucccagagagaucaagacugcggaguaagaucuaggccacagaagcccucaugguguucucugcugagcuauaccaugcccgagugcagcucucuggauauucucucuucccaccuacacagcugacuuaagacucuuauucaguuggcuaauucuccuuucuuucuucaaggucuuauuauguauguagcucaggguguuggccucaaauucaugauccaugaccuuacuucugcauacugaguuuauaacuaggucuacuggguauuuuagaaggaaccuuuacaaucuacaucaccugacccaauaccaugguguuuugucacuaaaaauaguugaagccagguguggugguugcaugccuuuaauuucaguacucaggaggcagaagcaaguggauuucugugauuucaggcuucucuauagagugaguuccagaacaaccaaagcuacauagugauaucuauuucaaaaaaacaaaaaucaaaagcagacaaacaagcaaaaauaaaaguugagauuaaaaaaacuucuacagccaggcagugguggcgcaugcuuuuaaucccagcacuugggaggcagaggcaggcggauuucugaguuccaggccagccuggucuacagaggaaaaggaaaagaaaugaaaggaaggaagaaagaaaaaaaaaauucuacaaaaugcaauaucacuuaucuagguuuuaaaaauaugcaagcuacccuucagagcauuagacaccuaugaacacagcgaaaguauuuaaagacacacaggagauaacccaugucaggaaggcauuugcuucaagugggguagacaagggaugggaagagccuaugggagguuccacuugcaaauagauuaauguuauaucuuuauuuuuuuuuuuccccgagacaggguuucucuguauaacccuggcuguccuggaacuuacuuuguagaccaggcuagccucgaacucagaaaucuaccugccucugccucccgagugcugggauuaaaggcgugcgacaccacgcccggcuuuaauguuauaucuuacaugcugaacaaagcuagagagauauuccugguuaucucucuguauacuuuuuuguuguagagcuaaaaaauuucaauguauuauuuuuaaaaaauuauuuuaugugcguggaucuuuagccuacgcaucugugaagcauuuguaugccuggugcccucagagguuagaagagggcaucagauccucuagaacuagaguuagauacaugguugugaacccaugaugugguuacugggaauuaaaccugggucuucuggcagagugcucuuaacugcugagcccaugugaaggccaggaguguuaguuagcacaugccuuuaaccccuccacugggaggcagaggcaggcagaucugaguuugagacuauccuggucuauagaucaaguuuaaggauagccagaacuacacaagaaacccugucucaacguuccucucccccaagaaguauguucaaaucccccugauucucuuugcacauuugaagcucuuuuucugaggaagcaggaugucccagacagcccauuuugugcccagcaacaaugacagucauuugugaaacacuuagcuaagccaccugugaagaggugcagccgggucgguacucacgguucagcaagcaucaugggcagagcauucuccuggaucuuggacggucgauugaagcccauggcguagacuccuuggagaagcugagguuuccuagggggaaggguagagauaagauggcuuuccagcaauuaaaauguuuuuagagacuuaucaccuucccuagauauaucuaccuagguaugaugcucaucucagucaaacuacuauucuaaaauucacauuugguuauucucuauguaugucuguaugugagcaugugccauggguguacagguggaggucagagggcaacuugcacaggucagcguucucccuucacuaugaagguacuaggguuugaacucagcuuauugggcuugguggcaagugccuuuacccaauuaaccaccucaccaccuccaacuaugguuuguuuguuuuuugagacaggauuucucuguauagcccugguuguccuggaacucacucuguagaccagaaaucugccugccucugcccuccaaauguugggauuaaaggcaugugccaccacugcccgacucaaacuauuuuuuaagaagauuuauuuuuaucuauguguaugaauucauauguguaugcauagggguguguguguauguguguguuugcacacacauacaugcgccuauagaagacaggaaacucgaagcuagaguuacaagcagccaugcacugcuggccgugggugcggggaaucaagcugcagucuaaugcaccagcagcaaccaguuuuaauccacagccauuuccagcucucacaccacccauacccaccuaaaaacaaagucucaucuuacccuauuaaaugcuacucugagacuacuacaguuucucagauaaauggaagaauccacgcuuucagcaggcccaccuauguguucagacagaucuggaugacaaguguuccauggaugcagcaaaagugauaaauucauaccaugaaauaaguuauaaaggaaauuucuaaaauaaacacugcuuuuuuuuuaaaggauuuauuuuuauguauacgaguacacuuuugcuaucuccagaaacaccagaagaggguaucagaucuaguuacagauggcugugagccaccaugugguugcugagaauugaacucaggaccucuggaagagcagucagugccaccucuccaggccccaaauaaacacugcuuguuauacuguugcaauguagaauuucuuuagaaaaauggaauuuucagagguuuuuuuuuuugccagugucucagguauccaaaguuauccuuaauucugaucaucuauauuuugugaaacuguuuuucuuucugagagaugaggucucucuaugaagccgagacuguucugaaacuugguagaccucacacccugacuuggcauacucccaagugugccagcacacuucacgcauuauagggacuguacucagggcuuccugcaugcggggccaacacuauagcaacugagaugcaguccuggcaacuaguuuucaaguaacuacuuaacaaauaucaauuaguauuacacuuauaaguucucuacuaccccuauauucacagaguauuuaacuauuauuacugugcagaugugcaugauguaucugugaguacagguuucaccugcugugucccgugcucauguggaaguuacauuuucaagaguuguucuaagauugaacuaagguugucagcuugcacagcaaugguuuuuacccaaagagccaucugucaggccagguggcuuuaaauuuuguuguuguuguuguuguuaaaggaaagaguugacauaacccaguuugacuugaacucacuauguugcugagggucaccuugcauuccugaccacuuuaccucugccucugccuugagugcugggaucgcaguauuuccuacuaugcucagcuuucacagaaaagcugauagcagggcaugaugucucaaaccuguaaccacaauacucagaaagcuguaauaaaauaauugccuugagcauacuauccugggcuacagugaguuccaggucagccugagcuacggagugagacuuuaaaaggggguugggggagggaagacuagcaauaugucuaugaguaaaaccaucugcuaccaagccuagugauccaaguuugaucugucaaauggaauccagagauagaauaggggaacugacucccgcaaguuauacucuagccucugugcaauuuguacucaugcacacauagagauauaugcaauaaaaaaagaaagaaagaauggggggugggugggugggaaaaaaagaaagaaagaaagacaaaaggacuagagauggcucaguaguuaaagagcacuagcuguagccaggcaugguggugcacgccuuuaaucccagcacuggggaggcagaggcagguggauuucugaguucgauaccagccuggucuacaaagugaguuccaggacacccagggcuauacagagaaacccugucucgaaaaaaccaaaaagaaaaaagaaaaaaaagaaguugguuagauucucagcacccauguggcagcucacaauuguuuguaauucuauuucuaugggaucuuauuggcugcccucuucuggccucuaauguaggcaaaacauauacugugaaacauauacaauaaaaauuucauacuaaauaagauaaaaauaguaaauuuuaaaauauuaaauguuuaaaagaugaaggaaucugagaaguaaacucuucuggcauauguaggugcucauacacagcuaauuuucaaaacaaaacccuuugguauucucaauuggguaauaaagguagccucugacgugcuuguuaaaaacagucacuaccuagucaguauucaccaacccaaggaguuccacugguucagucuuuugcaugccagaucuguaaguauacaacaacccaggcugagcaugguggcgugugucugcaacccuaguguauggaaauggggagugggaucuggauccccagcuugcucggcagccagucuaaccaaagguaagaugugaguucagugagaggcaggaaacggcacagcaagauacccaacaucaaucucuggcccaaguguguucacauacauuuccaugcacagguacacaaaaccccaacagugaucuacguucugucuauuuauuguccaacaacuaaauaagagaaaaccuaccuaagaggacaauucaagcucuaacugguaguucagcucuguaagugaagcaguuggcuggucaaggcaagaggaucucugcaaguucaggccagccauggcuacauagcuaaguucuuucagacagacacccauccaucagagcugaacugacagugcaagucuuuccaaggaaaggaguuagaacucaauaagacacaggaucaucaaauaagacacacugagaucaucaaaccuccugaugcaguugagacaacuggcucccaucuguaauccuagcacuuaggagucugaggcaggaggcuaacugugaguccuagacuaacguacaccacccagccaguccuaguuaccuuaugcuauguaguaagaccuuaagaaggaggagugauguggagagaugguucagugaugaagagcacuggcuguucuuccagaggaccugaguucuguucccagcauccacgugguggcucacagcccucuguuacuacaguuucaggaggucugaugccuucucuaaccuccaccugagccaggcacacaaauggugcacauacauacgugcaggcaaaagcacucaugcaaaaauaucuaaauuaaaaaauauaauuuugucaggcagugauggcacaugccuuuaaucucagcacucgggaggcagaggcagguggauuucagugagacuagccuggucuacagagccaguuucaggacagucagggcugcacaaagaaaccuugucuuaaaaaaccuaaaccccaaaccaaccaacugcccaaccaaaaaaccaaaccaaaaggauugugauagaaacauuugauaugaauggggcugcugagacagcucagcugguaacgcacugucacagaagcaugacggccuggguuuagauggccagcgcucacauaaaagcguaguagugguacaugccuguaacaucagggauagcaggaccguaguagagacaggaagaucccugggauauccagcugcauggaugugcuccagguuagagaaaaaucuguuucucucucacacacagucuuugcuacaagcacuccauccauccuacauuuucaaguggucaguauggcaguguugacuauagacacagugcuauacagcccagccucauuucaaauaauuaaacaagaaaacugcuucugagaacuauuggguauauuuuauuacuaggcacucccuucuuucagagccuggccuaucaaagguugcacugcauucucaguacugaagagccuagagcaacuccaagcauggggccacugcccccauuuuacugcauguaauugccuuacaucucuucaguuacaguaaaaaccaucuagccugcaucagccccauaaaguugaaauaagaccaaugccuuauuaaaaagccuugagccuguauaaacauccuacgaucagccacauucugggacagguuguuacucaaggacuaacccccaacuagcaaguuccuucucuaucaucgucugaacaucugcuugugguuuuaugcuuucacacgagccugcucccucccuucagggaagcaguucagcaccgagccugacugcaccgcuagccaccgcagaagugcuucccacagugaagaaaguguucuggcuuuuucugacuuugaagguucugucuucauuaucugagcaaccccagaccccaacaguaccagaauccaggcucuuaagacacuuucuaaaagcagauaaaaauguuuguaaacccuguagucuuccaaagggcuuaccuaauuagacauguuccugacauccagaaaucaccugucagccaauauuuuauucaaaguucuaagaguauaaaagaaaaacaagaagaaaagacuuucagcuauguugaauaaaucuguagcauuucagucucuacuaagaaaaucaggugcacgugcacacuuguagucccagcuacccacgagguucaggugggaggauccuugagcccagguguccaaggccagcaaggacaacauagugagaucccacaugcacucuguagcccaggcacauccugaacuucaagcuggauaaugggccugcacuaccaccagaccacucagagacccagugccuaagaagaaaagaaagcuaaauuggaagaaaaaggguaaucaggagaacuguagaagacuaucacuguagacacauguauguagccucaugugucugaggcuggccucaaaccugcuguguagccuagaaugaccuugagguuuugaccucuagccugcaagaucucugaaaugcugggauuauaggcaugccaccuaacgcuuguuuugugcagugccaagggaucagcacaagaccucagguuugcuaagcaagcacucuaccacuaccugagccacaaaccacagcccucccacacucacuuuuuaguuauguggauuaucacccacucaaagacauaaauauaauguuuuuaaaaauuuaaagccaaaauaaaaaucuagaaaaaucuaaaaagcuggaguuuuguuuuguuuuguuuuugguuguuuuugagauagggucucucuauguagucuuggcuagaaugaacucaagagauccccugccucugccuacuaagugcugggauuaaaggcgugugcuaccagaccaaguucugagaacugauuuguugggacugaggaaaaacuguucaaauugaugacuacucacaggcgaagcucuucgaaggacuucacugaguagagcggggagcuugggucccucugcaggacuuccacuugguugguguuauccacaagauugcuucugaucagcuuguugaguaaagacugagcagcucuguccucugucaggaagagagcaaauuuucuucauccacuggagacaauucccaucuuugaggaaaugcucuuuccccgucucugcacgagacuuuggcaagcauucacaguuggagaagccaaucccuguacauuuuaaguuacuagagacagggucuuacuugaacucauagcauccuccuacuguggggucuaaguacuuggauuccuaucccugcacugacuaagcuauuuuguguuuuaagcuucauuugccuuagccucucccauagcugaggccacaagcacacgaugcuuccuuucucaaucaccucauuaguuaucgugacucccuuuuguuuuuccagugauggggauaaagcucauggucuaacacacacuagacaaguguuuugcccuugagguacacguccagcccgauacacacacacacacacacacacacacacacacacacaccuguucugcauaucugugugugugugugauggaugcguuuaaagugcacacacaugugaaggucagagauggagguugugcaccuucuccaccuccugucugagacggcgucucagugagccugcagcugacuguuuagacuggcugggcagagagcugagggucacccugcugcgucacagcacuccucccugugccaggcuuacagacaugcugcugcucagcuucagcuuucacggaggcccuuuacugaaugagccauuucccagacccgacacgauacucugaagacauuuucucacagccucagggacagcacacucuucaccuccccucacuucccuguccccguaaguuaagagugccucuagcuccacagaagucucuugaaacucacuucaaagacucauuaccuuucuccucuuccucugucuuuucugcaguggugcugguuuugauaacaccuacacaagaaaacaaccgucauuagaaagccaaccacuaaacccaccuaaaggcugggacaauauaagcacuaaaaccuauugaagugaacaaauauaaggagcuggcauuucuucauguuuaguggaguuuaugucuacaaaauauguaaguacauaagaaaaacuuaauuugaacauagaaucagaaaccuauguaguuauucuaaaauacagcauagcauuacauagugauuuuuuuuaaauuagguauuuuccucauuuauauuuccaaugcuaucucaaaaguccccccuacccucccccacuccccuacccgcccacuccauagugaacucuauucucuauuuuuaacuccauagugaacucuauucucuauuuuuaacuccauagugaacucuauucucuauuuuuaacuccauagugaacucuauucucuauuuuuaacuccauagugaacucuauucucuauuuuuaacuccauagugaacucuauucucuauuuuuaacuccauagugaacucuauucucuauuuuuaacuccauagugaacucuauucucuauuuuuaacuccauagugaacucuauucucuauuuuuaaccuaugagauuagaaaacucuuaaucccuggcucagcauuuuaugaugagacucuacggaaacugcaggcucugaggaaacauaaaaucgcagaauccucacaggaguguuguacaggagugaacgucuguaaucccaagaccaggggagcagaaucaagcucacccagaauuugaggcuagccuggucuacauauaaauuccaagccagucaaggauauauagagacccuguuccaaaacacuaaaaauaaaacaguuuuacagaggguacuuuguuuuguuuuugagacaggcucucucucucucucugauguagcccaggcuggccuggaguuggcuaugcagcaggggaugaugcugaaccucuaacccuccugcuuccacuuccacguauuuagauuacaaaacggcaacagcaugacuggcuuauaugguacuaaggcuugaucuggauuccugcaugcuacaauauccucaccccuacuuugaaaauauuuguaaaaauugugaaugauuagauaaagguauuugcugucaugaaaaaaaucaaguauccugggcaugacuuugucaccucccagagguaggaagugacagggaaagacaaccaggagaccagaaagaaugaagcgugaaucccuguuuugauccaugccuuauauaaagaaacccuggaagacaaaaaacacuuuggaauaacauuaaaaaauucagagccaggcaugguaccacaaauguguaauccuggcccuuaggaugccgaggcuagaggaaugcuaugcauucaaguccagccucagucaugaggcaagacccugcaaacaaaaacaaacaaacaaaugaaugaaugaccaaccuaagagaaauuaaccuaaaguaaaaugucacuagcagucaucacuccuaugucauggacugaauccaguacuccuaaagucaucuauccuuguccugauccccagcaccucagaaaggggucuuaucugaaaauggaguuacugcagauaccacuucaguguacccuaauccaauguuacugggcccauauaaaaaggggguacccagggcuaagagugacagagcauuugccucaaguguuuauggcugugagauagauccccagcaauuucaaucaaucagucaaucaaucaaucaaucaguggaagaaggaaugcuauauaggagaaugccaugugaagugagggcagagaucuggguaaaauuguuaaaacucaagaaauaccaaaaauugccaagcaaaccacuaggcguccggggagaaaucuggaauaaggucuuucuacaagcucccagaagcaacacuugaucuucuccaaucuccugagccuugaagcaauaagcagcuguggauuggauuauguuuuuuugagaaacggucucacuuuguagcucuagcuggucucugccucuccugggagcacaggccuacgcaccuggcagcuauuaugacuaaacaguaaaccuuuguggugcuucguuagaagcuagaggagaccagcaaauggacaccuuggcgugagagcacuauaacagcguggaggagggccuugugcuuuuuuauacuuugaguuguugauuuuuguuuguuuguuucugagauaagguucugcuauguccuagaggaggaggaaucuaaaaaaccaacacuccuccugaccauuggaaucacagaugggagccacaaugccugaacccagucauaguucaaaagauccaagcaucaaacaggagaacaauagugauuuuuguuuuuaaggcaucagaagccuggaaaacauuccuucuucagaaauguacccccaauuucuaauuccagggcugacaugugccgcaggacucuagcaugacagucccacugcucgcugccgugacgaggaaccuagucuguaguuaccagugacucaccauuggugucugcuuugacuuucucuuccuugaucugcaaacugcucaucugaguaagaauaaaagaaaacaguaagccaaagacccaaccaaggaaggcagccggaugccugguaagagguuagcgacacuacugcagagcuggcugggagcggguucguuguacucaauacagaagcacuaagggccgggcauaaccaucucauguuuccuuccucagcagcagaagcagaggaggugggcauggguuaaccaugaugcuauggggacacaaacuucaaaaaaacuucaaacauuugcuuuucuucuaacuuacacuuuuucuagaaggucuccaagguucuguuugcuugucuggguuugugaaaccagggucaaacccuggacacaaaacaaacuggguaacugugcugccacuaugccauguuccaaccucuuuaaccccaaacuuaaauaacagcaaguuaucuauccugccuacccaaccaaacaccugcauguaaguuagguuaaaaugcaucauaauaagcugagggcagcuaaacaggccuuuaucgauaacaguacuugagagauggaggcaggaagaucagaaguugaggaucaggaugagacuuacgaauuucacagucauagucauagguauuuuaauaacauauaauugcucagaguguggucugaaggugguaugacaaucuugauugucaacuugaugguacguacaauggaagacaaacuccugaaagguuaacccgagguaggaagaccuacacuguaauuugggcagcaccuuucccaguccaggacugaaugaggacugaaugaagcagcaccagcagcucuccuccugacuugaggauacggcgugcuuuccagcaccaugccuuccaccauuacagaccaugugcccuucuuaaaaugggagccaaaaauacuauggggggggggcgggggggguuccuaugacagggcucucuguauagccuuggguguucuagaacucaccagguagaccaggcugaccucaaacucagauauccaccugccucugccuccugagugcuggacuaaaggcgugcaccaccacucuuaaacucuuguucuugucauggauuuguaucuugcaucaacaaagacaaaugcaacuacgacaaaugauuuauguucccagagcccugggucugucccccagaucccuaaguuaacaucguggguuacugguuuagagacagggucuuguacauagcccuggcuguccuugaacucagagauccaccugcuucagcuucccaagugcugaaauuaagugugaaccaacacaccuguacuggugugcugguacucuuccuagaggcacuguacugaucucgcuuguacuugacagugguauuguccccccaacuugcccucucugacugaccuacuguaggucuuugagaaauggagaugcacacucucauguguauuacugacuuccuauugcugugacgaaacagcauaaccaggacaacuuacagaagacuucacuugggcuugugguucuacaguuauucuagggauaagaguccacgauggcagagcaaaggcacagcaacugagaucagacgcugaaggcucgaaucuuuaacuguaucgaaauaaggcaauuucuguucacaaggccugccucuagggacauacuuccuccagcaaagccaaagcuccuaagacuccccaaacagcagcaccaacuggggaccaaguguuaaaaugucuaagucuacggggaacaucucaucuagaccaccacaacaguaaaagaguuuaggaggggcuggugagauggcucagcagguaagagcacccgacuguucuucugaagguccugaguucggaucccagcaaccacaugguggcucacaaccaucccuaaugagaucugacucccucuucuggugugucugaagacagcuacaguguacuugcauauaauaaauaaauaaaucuuuaaaaaaaaaaaaaaaagaguuuaggaaccagguuuucuagagaaaaagcaggugaacacacuuucuccuuuaauggcagagaggucaugagaaagcaagcagaccuggggaugcaucacacagcagaacuuuucauugguugguuaguccucauuuaugcacauggaucagcagaaauauacauuggaauggucugaacauuuaagaccaucuggaguuuccuaauucaaccacauuaaaguagccuccagaaggccugaugaaagaaaacaaaacaaaacaaaaaaaccaaaaaaaaaacgaagcaaguccauuaaaccaugauugguuacaaauguguuaacacacagcucucucgagagugaagaguaacccauagcuaggaacggccagucaauaaacagccuggcauccuuuguucuggauucacuggccacacacagacccugaugauuaauccugccucucugaacaggaaauguucacaacucuguguggugaaugguaugugugcaugcuggggggguaugugcaugcugggggguaugugcaugcuggggggguaugugcaugcugggggguaugugcaugcugggggguaugugcaugcuggggggguggggugguggcgaggcuuaucucaaggagguuacgucagcuuccugauaagcagaaugguuugaacaaaucaaggauguuuaaguaguuguggugacaguccucucauaaugagauuaggggcauacauuuuuuuaaaccccuguagugcuaggguuuccaacccaggaccuuauucaggcuaggcaagggugauuuacaaaacuaacuccccaguuuuugauaguacauuuuuaaaagccaaacaugugaguauggugguccuuuccugcaauuccagguaagacaggaagauuacuggauuccagggguuugaagccagucuggacaucaaagugagauccucuucucaaaacauguaauuacaccaggcaugguggcacacaccuguagucccagcacucaggaggcagaggcaggugcgucucugagucuacagagcaaauuccaagauacccagggcuacacacagaauuaaauugaagaaaaaaaauucagucacuaugucuuaggaauaaucacuagauuugaaacuucagaugggguucauaagauggccugacaaacuggaggaagagaaccuacccucacaagcuaccuccugaccuccacacaugaaugcggcacauccauguucaaaauacgaggauauacacaaagcaaauccaaauaacuuuuaaaaacaaagaauaaggagagcuucuuaagaaaaucaacugcuggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaaaaaaaagaaaaucaacugcucauucuucagcugaauugguuuaagaguuaagagagcucgcugcuguugcggaagggccaggguuugguucuuagcgccacaugguggcucacaacaguuuguaaaucccaguuccaaggggaucuaaaacccucuucuaacauauguaggcucaaguguggugcauagauacgaacaggcaaaacacccauacacacacauagaaaacauaagauauuaaaagaaaguauuugaggcgaccccgagguaaauagugaagccaguugggcugugucaaaaacacaggcagcaaagcuguaacucauacacuuaagaggaggcggagggauagggaugcaagagcucucaaggccagucucagcuaauuagcaagucagaggccaaccugggcuacaccgucucgaacccaccaacgcaccccuccaaaaacacaaaaacaaucuaacaaaaacuauacgacacuuaaaauagcaacuagacaguuugcauuuguugcuaagugaagcauuaacacaaacaaaacccguuauucuggcgagcuacaaacugccgcuuggcgguuaagcaugaauguggggcuguuaggggaaaggcagcauaaacucacucaaaaacuaccccucaacaacgaaaaaaagagagaauuuuauguugccauuucuuguaagaggucaagagaagggccaguuuggggccucacacacuuaauaaagacaaugucaccaugggagcaacuuuucaguccaaacucggauaagaagcucgcugcggguuuucuucgcugucggagcaaauccgccgcgcuaagugaucgcccacagcaaacuccagcgagcgcgggcuggcccggcucugagguccccgugcuggaaaccauguccgccucaguccccuaauccccaccaggccacugaccgacuugacagcggcuuccugcucguccaccgccagcgcccaugagucgguggccauggucccgacgcgagccgaccugcagagaugcuccgcgccccgccaacaccagcgccgaacgcaagcccgcgccaagugccacucacacggagcggaaaaagac

SEQ ID NO: 4787 - RNA, 28568 nt, Mus musculus
ugaguggccguuggggaagccuaaccgccauguugcgccgcgauggccggagcugcuggccgggucgaggucgagcccgagcccgagcccaagcccaagcucggaauccacuuucccugccccugacuggugugaguaucugugcggguagcuuuccuuccguaccuuuaggcgcuuuucucgcugcuagaaagaaggcaggggaauaaaugaacgaguaaaagcuaaggagacagcggggcagugguggcgcaacgccuuuaaucccagcacuugggaggcagaggcagguggauuucugaguucaaggccagccaggucuacagagugaguuccaggacugcacagagaaacccugucucaaaaacccaaaaaaaaaaaaaaaaaaaaaaaaaagcuaaggagacuuaaccaccagcaggcacggagccccaggccuuuaauaugucccagaacccaaaugacugccuaccaugaguuagcaaacaggcugaccucggcaacacggaaauaaguacaggagacugaacuaaagugccuaauuggucuuuccucacacaccacuuuggacaucacguucuuucuccuuagaaguccucaacgauguuggggguugagucuugagagucuagaguuuuuuguuugcuuguuuguuuguuuguuuguuuguuuguuuuugaaacaggguucucaguaacagugcugccuggccuggaacuugcucagcaaaccaggcuggccucgaacucagagauccaccugccucuguuuccugagugcugggauuaaaggcgugugccaccaccgcccagcuuuuuuuuuuuuuuuuuuuuuuaaauagaaauaacacacuaaacuuaguucaggauagcaguuccuccugugaugguuacagaggcugcuuuugguauucuuuguuggugcucugaacaaucucacuagcccuaggcuagccuucaacucaguauauagccaacaauaaucuugaacuggaucuuucugcuuuuaccuuccaaaugcaaguauuacagggagaacugccugccuugacuuggagagggcuucagcugaaauuccuuguuuauguuugaguuacuagacauucagggucuggauuagucugcuaggcaagagcaccacuuucaauuccacguuuuauuucuuuauucccgugguagaagccuagguugugugugugaaugugaauguguauggguggggggacgggacugacugacuuuuaaauuacuuuuuggcaauuucauaaagggucuuagcaaucuggucacacacucuuuaaucccccucccauccccuagaaacugagguauuuguuaaauguuauuuccuuuguuguuuaucugaaguaagauuuguuguucuuuuucuggggcgaggccguugagacagggucucacuguuuauuauagucuugcgugguuuggaacugucaaccaagcuggccucagacucauagcgauccaccacccucugcuuccugggugcugggcucauuuauaauggcucacuuuaccacacugaggugugcuuuguuuugguuuugguuuccuuuugaugguauguugcagggaauaauaaauaaaggcaucugcccaugcuauccucagcuacucucaggcccuggggacccugcugcaucccauucccagccauacaccccgcuguggucagcgaucccaaaucccagcaacccaguaaaaccaaaacucuagaggcuuguaauuuauaagucagauuuauaucaguaaauucucaccccacagaaauguccacgcaauuacucagaaccaauugauauugauauaaauugcccaccuagauaagacaaacuguccuguaauuauccauuucuuauaagauauucauaguuaccuguggcuauuuaaagccacauggaaucuugaucgucucucuuccucuaucuucuuccucucuuccugucccggucuuggucucugaaacucuuaacuccgcccccuuuucccuguccaaucacaggcuucuuguauucauauuuaaauuaauuggggaggggauucugauacuguacauacuuacuguacauuuuuaaucccuaagcacucaggaggcagaggcaaguggaucucugugaguuggaggccagccuggucuacagauccaggacaaaggaccuguugaucaccagcucuuauucuccugcuuucagccuaucacugggguuacagguuucaccaccaugcuauuuauuuauuuauuuauuuauuuauuuauuuaugagauucugacucaaaagagcacauggaaauuaacuuccgaggauaaaaugaaauugcagaugguagugaugguucaugcuugcaaucccagcauuuugucggcugaggcaggcaggucacugugaguuagauaaaccccucauaaacagucccuguuaguugaguuucugauaacuuuaauacuguauacacaccuaugugaguuugguuuguuuuuguggaucaaguggaaccuauucuacuguauugcaucuuguguaacuuaauguuucacuucaauaaaaucuauuugaaauuuuauuuauaaucuucuauaguccugaaaaauacaaaauaacuuaauuguuuuuuagcugcuuuuccuugggguuucuucuaacuugaaauaugaucauggccuccuagcuggcuccugccuccaccccacccuuaccuauccaacauuucuugagguuaauuuauuaucaugggguauuaguaaaauguuuuuauaguuccaggaagaugcucaguuucuuucuauggaauacacaggauaaagaccuauuuaauccugguuagggggaagcagguaguuccuucugccuuuauuuuacuauucuaaaacuagagcuauuuccuuuuuaaaauuuccaaaauuaggcagggcgugguggcacacaccuuuaaucccagcacuugggaggcagaggcagguggauuucugaguucgaggccagucuggucuacaaagugaguuccaggacagccaaggcuauacagagaaacccugucucaaaaaaccaaaaaaaaaaaaguucggaaaaaaaauucccaaaaugaaggcugugaaggcuggagagauggagcagagauuaagagcauuuguugcucuugcauaguaccuggguuccauuccagguagccacauuguaaccaucuguaacuccacuuccaggguauccaacacuuucuucugacuagguaccaagcacacauguggugcacauagacaugcaagcaaagcacucauacacauaaaauuaaaugacuaaaucuuuaaaguauucauccaaaaguaauuaaauaaaaugccaacgacacaaccuuuacauaggagaggagagauggccaucugaagaaagcauagauaacgccagaggucauguauuuuguuauuaaacugcuuuuaccauuuccuucaggaacugaauugauuugauugagcaaaccgcuugcucuuucuggucucugauacucuaccaagaauuuuccuuggcaucuuccuuugguguucaaaacucaauuuggggcauaucauugagcaccuguuuguuucacgggacugauugucaaugcuuagacaucuuauuaaauugaaaagaacagauacuauuuugaccuuagcuaagagucugguaaggcacguuuacacagaggcauuuuaaauauccugaaaagguaaaacacuugcuuauguauucuggcuguaauaguuauaccagggccaucuaugccaccaugcugauugaaaaugugacuuuccgccuucgguccaagagcauuuaaugcuggcuaccucaguuggguuguaggacgaucugcagcgaagggugaugggugggaacccgaagaggacaguaguggcgcuggauccccggaccuuaggggcgcggagcugacgcugacucugacgacaccguggcgcgccguuuccggucugagcuuuagugaaugauuucccucggggcggugcuggacuucucugccacccaccugaguccgcggucgcaccgcccaagcgggcaagccugccagcgcugccccggcaccgcgggccauggcuacggauucuugggcccuagcaguagacgaacaggaagccgcagcugagucugugaguugucaccaaccgcuggaggaccaggggccagugccagucaggauaucugccccuuagaaggacagaucuuagguugcuuggaacuggguggaggacccuggcggcaugggccccgaaaccagagcuggcuuugauuacccaagcccuuccaccuuguguaaacucaaguuggaugcuugguugcccauagugcucagccaccugccugucuuccuggaaucagggcugauauucgauugcacucacaaacucggaugguaaucuguagcuugggcuuugaguuuccugggcucagggagguugucuuacucauauuuauuuguaugacuccuccaacuugguuaccucuagcuugguuauugguagugaaugacugguggggccuaucaguaaaucuuuugguuggcuuaacugguuuucugaaccugauacauaguagcaagauuagaguuaaauauggaauuauauaugucuugaauuuuccaagaauuaggaccuuguucuuuuuuuuuuuuuuaacuuugaaaaaauaaagguuugaaccugucacugugauguggcaccucucauccuaucucuuuuuuuuuuaauauuuauuuauuuauuauauguaaguacacuguagcugucuucagacacaccagaagagggagucagaucuuguuacggaugguugugagccaccaugugguugcugggauuugaacucuggaccuucggaagagcagucaggugcucuuacccacugagccaucucaccagcccucauccuaucucuuggagacuuaagacaggagggcugacucaaguaagaggccaaccugggcugcauagugaucuugcuggaaaaaaaauauauguauauauauauauauguauauauauauacacacacacauauacauacacacacacauauauaucaaauacaauaaagaauuaacuauccauuuuggcucaaagccuuuauuauauauaggguuuuaaaaaaagauuuauuuuauguauauaaguacacuguggcuguacagaugguugugagccuucaugugguuguugggaauuguuggccccgcucauucaggcccaaagauuuauuuuuuauuauacauaaguaccgcuguagcugucuuuagaagcaccagaagagggugucagaucucauuacaggugauugugagccaccaugugguuacugggauuugaacucuggacagaagagcagucagugcucuuacccgcugagccaucucgcccacucuuuguauauaguuuaaagagaaauaauauuuuuggcuuugugcauugagggaauuauuuauuuauuuuuguuuuuggagacaggguuucucuguguagcccuggcaguccuggaacucacucuguagaccaggcuagccucgaacucagaaauuugccugccucugccucccaagugcugggauuaaaggugugugccaccaugcccagcauaaaaacuguuuaugucauaaccuuuagucucauucaaacugaugggccauuccaagguuagagcccauuuucugaggggaaggggaaacagcagauuugcuuucaaucucauucagagggauucuuucuuucuuguguuaaauauagucucguuuuccuuuccuuccuuucucuagacacaaggucucauguagcccaagcuacauggcccacaccuguaccucccugcacugggacugaaggugugugcuaccacaccuggcucaguacuuaguagcacugucugucuaucuguaucucucucucucucucucucucucucuuaaucauuuuauucguuugcauuucccuucacaaaucucccaucccauucugucuucccugcucuccuuugccucuaugaggguguuccuccacccaugcacccacuccugcccaaggggcuccccuuccauugaugucagauaaggcauccucugcuacauauguaucuggagucugguuuggucucugggagcucuggguggucucguuagucgauacuguucuuccuaugggguugcaauccccuucaguccuuccccaguggcucucucuuugguuuuuggagacaggguuucucuguguagcccuggcuguccuggaacucacucuguagaccaggcuagcgucaaacucagaaaucugccugccucugccucccaagugcugggauuaaaggcgugcgccaucaugcccagcaguggcucucuuuuuguuuuuuuuuuccauuuuuuauuagguauuucuguggcucucuuuuuaagaugaguacuaccauuagaccauguuccugguaggauacugggagugcuuuagcaauggccccaguguguggauagcugcuaucccgcacaguguacuggaggcuuugcacuuacugccaguuaacguucuugaucccagaaugaauggagucuuuuuacauguuugugauauccuuucugcuaaucccucugcuaguuuccuuugucuacucucucccauauguuuccuuuuguugcucgggaacacuaaagcagacagacuauugguuuuauuuuaguuuccaugaagacaaaugagguuccuccaucugcagcuagccacccauuuaacaacuuuuuucuuuccugcuuccuaaccuuauuccccuugucuuuguuuuuggauuuagugacugagauauagagaaccugucugugguuuaagaacuaaccaucucuuguaaugauuuuguauucuuuucucccuuucccagaugcuaguugagucuucacuuaguauuugaugaucagucuaacugcuuugugcuagaugcagagaugaaguagucccugacauuaaggugguuacauucucaugggcaggcauaaguuauaccaguauauaucuaaauuuauacuguuagacaaaauccugguaauucuugccuugaaacauuucucugaucuguuuccucuuuuuuagccccaccucaacccagugugggcaauuuugguuauguccgguguuggaauacuccaagaugugcccaguuaaacuguccaacugcaacccaaggcagcuugcacgugaggcugcauggaguugugaucugguuggacuuagccagacauaacucucugcccuugauucuucuguccacuguuggcugucuaaaggagacugcgguuguccaaucuucacauuucuuuccuuucaggaccugagaaagugacagcucugaagaaaucccacugagaaagucuuuguaaaucaaaacauuaagaaaacuuacaaauuauaauucuauaauucugucuagaaauuguaauuaggaaaucugaguuuggggcuacuauguaguuuugguuuuuuuuguuucuuucuuuucuuuccuacuacugcuuuuaggggaaauuuuguuauucucuuucacucauuuggaagcaaaaaggaacccaacagagcaaccuaaugagucauuuuacugagugcgccuagggagucuugagaguagcucuucccccuaauuagagaggcucuguuaguuccaaggcuuucauaugauuuuccugacacuuuccauuucccccacauuuaguugagcaacuugcaucuuaaggaggagaaaaucaaaccagaugccaauggugaguagcuaaaguuaguuuauaaacaaauguaauuuuucuuugguauuucuauauugauaaagcaacuaccuggauaauuagugcauuauacuggacaaaggacuagugaauacugauaauuauuugacuuguguaucaauaaacuagguuguuuaguuuaaaauauuuaacagaagccgggcagugguggcgcaugccuuuaaucccagcacuugggaggcagaggcaggcagauuucuggguuugaggccagcauggucuacaaagugaguuucaggacagccagggcuauacagagaaacccuguuucgaaaaaaaacaaaaaaaaacaaaaccaaaauguuuagaaugagaguaccuagcuagcauguaauuauuuaauuuguuacuuaaccauaggacuauauugacagagaugauuuuuuaaaaacuguuuuucaucuucaguuugggguaagaugcauacaguuugagcaccuugucaguuuucauguucuaaauaucauccugaauuuauaucuguuaaaauguguaagaugagggcuggagagauggcuuagcgguuaagagcacugacugcucuuguccugaguucaauucccagcaaccacaugggggcucacaaccaucuguccgaugcccucuucuggugugucugaggacagcuauguuguacucacauacaguaaauaaauaaaucuuuaaaaaaaaaaguguaagguagaggaguggggcuuugccuuagugguaagugcuuacccuugguacacaaauagaaccagcaaaaucagucagucgaguacagagcaaugcuaauuaccucauucugaaaacacuugauaaucuuguguauauauauauauuuuuuguguguauauuuuuacagauuacaauguugcuugaguauauauuucuauucgucaauaauuuacuauauagacuuuuuauggcauuguguucacauugacacaguuguagaugcuuuauugagcacaaagauguuuucuaaugaaugcaguuguaguucucauccuguaucauuucagaaaugucacuacugugacaggagcaugccauugguuuuuuuuuuuuaaagauguuauuuauuuauuauauguaaguacacugucgcugucgcugucuucagacacuccagaagagggagucagauuucguuacggaugguugugagccaccaugugguugcugggauuugaacuccagaccuucggaagagcaguugggugcucuuacccacugagccaucucacuaguccccaugccauuguuuuuaaaccaggguaaggggaucuggaaauaaccacagauaggcagugucucgaagcuuuauguagagagaauaaaguaguuuuaguaguggcuugguuuccucauuuguuuucuugcaaaaauuagaugauuccccccccccccagaauuagaguugucuugauugcuaaaaauaggaugaacuuuugaaugccaucucuccuuuguaucuaaucaaggugcuguuguuaagaccaaugcaaacacagagaagacagaggaagaugagaaagguaacaguguucaaguuauaaaugagguuccauguucuagggaaaagguuauagaggccuuauuuguucacuuauuuauuaagguuuuuuuuuuuuaagacaagacuguguaucccuugcuggccuacaaaucuaugcaguugaguuagccuugaacuuaugguaguuuucuuucuucuauccugagugcugguauugauggccuuugccacaugucgggguggggaugugugaaagggguagggguggguguuugaguguguguguauguguguguguguguguguauguguguguguguguguguauguguguauguguguguguguguguguguguauguguauguguggaguguguguguguguguguguguguguguguguguguguguauguguguguguguguauguuguguguguguacgugaguguguguguguggaguguguguguggcggggcguguggaugugugaguauuggugagaguagagguuugggggugggguguggggguagggauggguguggauguuuagauguuugggucuguggguuugggugugugggugugggaguauagauuuggguauggggugugugguauguggguugggguauaggugugugggguguaugaauauguggguguggguguagaccagagguuaacuacagguauuguguucagucacuuuccaccucuuuuugcucuugagacagugucuaacuauguagcccucucugguuuagaacuuacuaugcacuggcugggaaucauagaucugccuaccucugccucugucuucuuagugccgagauucaaggccaauccuaccaugccugaccuuuccaccuuauuuuuugagauagucucccauugaacuuggagcucacuaauugagcagacugcuggcgagcaagcagguccuaaggacccucuugucuuuuugccagugugaagcuuuacuguuagacucaccuggggugacauugaauagagaaauuauccauuuuuuuauuauauuuuaaauaucaaacuugguauauuaggaacucuaauacauguguauguuauuacuuaaaauaucuguuaaauucauggacuuuuuuuuucuuuugagauaggguuucucugugcagcccuggcuguccuggaacucacucugucucuguagauggccucaaacucacaagagauccaccugcucugccauccaagugcugggguuaauggcgugugccaucaucccuggcaaauucaugaacuuuuaaaaacucuuguguucucucuuccugacagaggacagagcugcucagucuuuacucaacaagcugaucagaagcaaucuuguggauaacaccaaccaaguggaaguccugcagagggacccaagcuccccgcucuacucagugaaguccuucgaagagcuucgccugugaguaguggcuuacuuacauucagacagagaucauggccuggcuacacauuuuucauacagcauuauguuuaccuacacaauagguacacacacacacacacacacauauaauagguuaauaauaugcauguagcugcuuugaguguuauguaaaaacuuuagugguuagguguucucagcuacauccuguguguucuucagucucagugacuuuuaucuuuaaugccuuuuccaggaaaccacagcuucuccagggagucuaugcuauggguuucaaccgcccuuccaaaauacaggaaaaugcauugccuuugaugcuugcugaaccguauguaacucaauauaacuacaucugucauuuacuauuucaauauguuuuuaaaaaauuuaagccuauucaugccuauaaucucagauauuuaggaagcugagucaggagaaugaaaaguugaaggucugcucaagcuauaaauugaagucaaggccagccucaucaauuuuuuaaaaaaugcauacuaacuauuuguccggauuuuaaaaaagacuuucauuacacuuauuugugugugaagagcacauguaugcaccaugguacacuuguggagaugaaaggacauauggagggagacaguucucgauucuaccauaagguccccaggaaucaaacucaggucgucaggcuuggcagcgaacaccuuuacccacugagucaucucaccagccucaaguugcuauuuuuacccugagcauguuguuaggaaaagcuuaggauguucagugaauuugaaaggauuuuauagggaaaugcccuuauaccuacaaccuagauucuaccacuuucguuuuacucuucuuuucauguaucugucuauggaucuuuuugauguuuuuugcuugcuuuugguggcguguaagguuaauuuuuugagauaguaauaguguuguuuugagauagaaucucaguauagcccaggcuggcuucaaauucuuuuauguuguugaagaugacuuuuuuccuuucucccuuccuuuccccuuuccccuuuccccuuuccucuuuucccccuuuccucuuuuuccccuuuucccccuucccucuuuuuccccuuuucccccuuuccucuuuuuccccuucccccuuuccucuuuucccccuucccccuucccccuucccccuucccccuucccccuucccccuucccccuucccccuuccccccuucccccuuccccccuuccccccuucccccuucccccuucccccuuccccuuccccuuccccugucacgucucgucuugucucgucucgucgucuucuccuucuucuucgucuucgacuucuucuucuucuucuaccucucucucucucauuucuuauguguuaacugccaagaaggaagcaaggggagaaaguaaagaacaacaacaguggaacagaaaaggagaaaaggcaggcgugguggcgcacaccuuuaaucccagcacucgggaggcagaggcaggcagauuucugaguuugaggccagacuggucuacacagugagcuccaggacagccagggcuauacagagaaacccugucuugaaaaacaaaacuaaacaacaaaaaaaaagcuuuuacuuauuuuauuuauaugagugcacuguagcuguuuucagaagagggcauaggaucccauuacagaugguuaugagccacuaugugguugcugggaaucgaacucagaaccucaggaagaagaguuaguguucuuaaccacugagccauuucucuagccucccuuuuuuauuuuuaaagaucuauuuauuuuauguaugugaguacaccaucauuuucuucagacaucgcauccuauuacaaagguugugagccaccauaugguugcugggacuugaacucaggaccuuaggaggagcagucagugcucuuaacugcugagccaucuccagcccugacuucuuucuuuuuuaaugucuguuugaguguaugcugcaugugugcagguacccuuagaggucaggagagagagggaguuauaucccuuagagugggaaucacagcuuagccuacugacaaggugcugggaaccaaauugauauccucuggaaaagcagaguuuauaaaugucgagccaucuccagagaugauaauuuugaauuucuaauccuccugccuucaaguuccaaguguuaggauuauaggcaugcacagucaugccaaguuuaugcagugauuggggucuaaggcuuccugcaugcuaggugaacagcugccaacuaagacacauuccagcuccuuaaauuccuuauuucugcuugugaggaacagacacuucccugggcuugacuuguauuuucucaagguuugguuuuuuuuguccuguauuaguugacaaaauaguggguuuugguaugauauuuucauauaugcaguugagguaguuugauauauuuacgcacacacaccuuuuguuaaggcuuaugucugaaagccuuguguuucuuauuugauuucuucuugggcuauguuagggcugccuccuuguuaccuucaaagaaccgaaauugguacucgccauccuuuucacagaccuugccacuuaacccuuggucuuguguuuuaaggaguuuuacgcuagguuacgcuuuguuaguuaagugcuuguuggagaguuucagguugaggacaccugagucuuuacaggaaguagaggagauaguuaccauaacauuuggguaguuaccauaacauuuggguaguuaccauaacauuuggguaggaugguuucaggcaaauuacagcuaguccagaagccuugauaugccagagcaacauuaugacaauugucauuuaagaggagggagauugggaaagagagaaagagaugugagaugagagauaccagggaaccagauccguagaaccuugaaggacauuggaagaucugaaugaggaccuggagagagguggcucauuugguacagauugcugugcguauauggggaccugaguuuggaucucuagcgaacacauaaaaagcuagauguagcagugacccauguuugcguucugucuucaugcuuguaggggcaagggcaggggagucugugcgaguugcugaccaauguagucaaauuagagagcuccagguucagugaaagauacugucucaaaaaauaaacaugggaagcuacugaggaagguaaucuaugcuagcuagcuuuuugugaacuucauguaagcuuaguucaucugggaagagggaaccuuaacugagaaaguggcuccauccugcaggcacaucugaggggacuuguuuucauuaaugcuugaugugagagagcccaacccagugggagggaccacccuggcaagugauucuggauuuuagaaaguaggaaagugagucaggaggugcugaugcacuccuguacucucagcacucaggaggcagagguagguggccggucucugugagugugaggcuggcucugucuacagccagggcuacacagugaaacccugucucaaaggggcaaaaaaauaaaaaaaagcagagcggugguggcgcacgccuuuaaucccagcacuugggaggcagaggcaggcagauuucuaaguuugaggcuagccuggucuacagagugaguuccaggacagccagggcuacacagagaaacccugucuuaaaaaaaaaauauauauauauauauaaaauauauaaaaauaauaauaaaaagaaggaggaggaagaggaggaggagcugaguaaaccacggagagcaaggcauaagcagcacccguucaccaucuaugggcuucaguuccugccuccagguuccugccuugacugccuuccaggaugggcugugaccugggaagcguaagcaagacaaacccuuucuuucccaaguugcuuuuggcucugaucuuuaccacagcaguagaaagcaaacuaggaagauacaugaugucaacuucugcacuuccugugcacauaugugaacacacauacacauauaugugugugcacguacuaacguaagaauccggcugaaggaaggcuugauuaguuuuugagcguagaacaacucaaaguaagucacauuuuauugaaucccuggccguuucgacuauagguaaaagugcuugagaaucucugugugacucugcuacccaauccaaggucuccuugugucaaggaaauuuaaaaugucauuuuaagcuuuauucacuuuuauuuuuaaaaaaaaauuuaaauuucugugaaagcguuuugccugcauaggugugugugugucucuugcuuaccuauguucaaggaugucagaagaaaguuucagaucuccuggaacuggaguuagacaguugugagccaccaugucaguguugagaaucaaauucagaaccucggcaagagaagcaagugugcuuaaccacugagccacuuuccagcccuuugaaaacuuauuugagggcuggagagguggcucaguggcuaagagcacugacuguucuuccagaggcccuaaguucaauucccagcaaccacauggugguucacaagcaucuguagugggcucagaugcugucugcuggugugcaugaagacagagcacucauauacauaauguaaauaaauaaguuuuuuuuuagaaaaaaaaauagaagccaggcguaugccuuugaucccagcacucugaguucgaggccagccuggucuacagagugaguuccaggacagccagggccacacagagaaacccugucuugaaagucaaaagaaaaaagaaaaaaagaaaaaaacaacaaaaaccaaaccaaaccaaaaacaaaaacaaaaaaagaaaaagaaaacuuauuugguaguuguguaguuaggauucuauugcugugaugagacacuaugaccauggcaacucuucugaaggaaaacauuuacuuggggcuggcuuauuauaguuuagauguucagaccauuauuauugugacaugaagcauggcagcaugcaggcagucauggagagggggcugauaagaauucuacauccaggucagcacgcaacaggaagagaaagagagacacagagagauugagacagacagacagacagagagacacacugggucuggguugagcuucuuagauuucagagccuacucccagugauacauuuccuccaccaaggccauaccuucuaauaaugccacucccugugggacuaugggagcuauuuucauucagaccacaaugauagugauauuucuaaacauuuucuuuuucaugcagcccacagaacuuaauugcccagucucagucugguacggguaaaacagcugccuuuguuuuggcugugcucagccaaguagagccugcaaacaaguuugcccagguaaggacuuuaggaaucaggguuugcuacuaacauacagccuaaaggggucauaguuccuggacuaaaaacuguggguaaaccaggcagugguggcgcacgccuuuaaucccagcacucuggaggcagaggcggguggauuucugaauuugaggccacccuggucuacagagugaguuccaggacugcacagagaaacccugucucaaacaaacaaggggcuggcgagauggcucagugguuaagagcagugacugcucuuccgaagguccggaguucaaaucccagcaaccacaugguggcucacaaccaucuguaacgaaaucugaugcccucuucuggagugucugaggacagcuacaguguacuuacauauaaaucucauguaaauaaaucuuaacaaacaaacaaaccaaaagcuguggguagucaagguauuuacacuuguaaucccaauaaaggguaggcagaagcaggagaguuugaggguagcauaugcuacguaguuaaguucuaggcuagcuugggcuacagagugagacccugucuuuuuuucuuucuuuuugaauggucaguccugaaauguauacauucaaggaacuggacugagcagguugaggaacacacacacacacacacacacacacacaccacaggaacacacacaccacaggaacacacacacacacaccacaggaacacauucauuuaacaacaguuaaaaaaaaaagucaauggauuugaaagaaagcaggggugggguaugagggaaaguuuggagggaggaaauagaagagggaaaugauacaaguauaaucuccaaagaaaaaauauauaauaaaaaucauuuauugagaggacuugcagguagaaaauauaaugcacugagauuagccaaacccaaagucaaagaauuuucaaugaauuucuauuuaauuagaaaaaucauucugaagcauggauguuuacacuggauccucccucccuccccccuucccucccuuccccccccucucucucucucucccucuuucuuucucucucucucucucucucucucuuucuuucuuucuuucuuucuugacuauauauaaauauguauauacaggugugugcuuggugccugcagagaccagaaggcggcaucauauccuuggaacuggaguuacagaugguugugagccagugugggugcuggggauaaaacucagguccuuaauauuuucauuaucauauuuuuuguuuguuuguuuguuuuauuuuugagacagggucucuauuauguauuccuggcuguccuaaaacuuauguagaccaagauggucuugaacucacagagaucuaccuaccuaccucugccuccugaguggugggauuaaaggcguguaccacagacauacuacagcaacuaucagcuuuauuuuaaugcccuuauccaccacacacaccgaagaaaauucaugacagaguuaaagcuggaaaaacaauuagcuuuauagccuccuuuaugacuuauguuuucuuuucuugcauucuguccuuccauuaucaaauauuuaccuuucuacauguuaugcuguauccacauguauguuugcuuacauacacacacacaagugcacacccaugcaugcacauacacacacauacauuauaggcuauaauccucacuccauuuuccuucaaauuguaaauggcauuucauauuuuuauuauauguucaucuuuuucuuuuuuuuuuuugguuuuucgagacaggguuucucuguguagccuuggcuguccuggaacucacucuguagaccaggcuggccucgaacucagaaauucacuugccucugccuccugagugcugggauuaaaggcgugcgccaccacgccuggcucauuauauguucaucuuaaauaaacuaaaaaacccuuaugauuauuuuagaaagggucaacuccuuccccuucucacucuguagaggccacgcugugcugagacuuaguguguaauucgggaggacugugagcacacagcaaugagccucuucugugcugggaacguaagcaucugacuuggcuccguuuuauauaaaccagaacucaaguugacuggcaguagaggggcuaauguuuccggacagcacaaagcuuacccgccugcgcuacccgugguguuugcauccgggaggacugcuaaggggcuugacguuuacuuguagaagaaccacauuuauuauucucauagguuugaacauucugacaacugccaagaauggugguacaugccuauaauuccuaaauuugagaagcugagacacguugagcuugaauuuaaggcuaaccuggucuacauagucaucuggaggccacauuggucuauguauguagcaagaccuuggccccaaaaggaagagagggucaggcaguuguguguugcacgccuuuaaucccagcauuuaggagacagaggcaggcggauuucugaauuucugaguucgacaccagccuggucuacagagugaguuguaggacagccagggcuacacgagaaacccugucucaaaaaaccgagagagugagagagauguuuuguaugcuacauuuuuuuuccuuuggccucagauggaugaguggguucuuagggggauuguccuuggccaucacuuguuaagagcucucaguuuguucucuguuuuuuccucuagugucucugccucucuccaaccuaugagcuugcucuucaaacaggaaaagugauugagcagaugggcaaguuuuacccugaacugaagcuagcuuaugcuguucgaggcaacaaaugugaguagaagaaugggccuagagcauaaaugaaacuaacaacuuauuuuauuuuugaaaaccuucagaccauccccagcaguuaaaacaguucagugaauacauguguacuuccugcccugguucggaaaacguaacaucugccacacauucuuuauuguauguuuguauguuuuuguuaaaugucaguaaauugucaggauggagaaauggcucagagaauaagagcacuggcugcucuuccaaaggaccugaguucaauucccagcaaccacacgguggcucacaaccaucuguaaugggaucuggugcccucuucugggguuucugaagucagcuacaguguacugauauacauacauacauacauacauacauacauacauacauaaauguuuuuuaaaaaguaaacuuucuuauuauaguucauucuuccugaaucuuuuauaggcaccucauauggacauuauauaaucacaaugcccuuguuacaaccaaauaaauuaacaauuuccuagaaaacuuagcaucuacuuuacccuugcccauuuauacuuaaauuuuuuauuuuuuaguuugcugaaguauagguuggucuugcccucacagcucugcuuuagcuuccuguguguuauagguuauagacauccacuaccauuucuggauuuuuuuuuaauaguguauuuuuauuuuaugugcaacaguguuuuaccuacaugcaugucugugccaccacuuccuggugaguuaaugaaauuauauguuaaggauguaacaaaaaauaaugauaaagcugggcaugguggcgcauaccuuuaaucccagcacucaggaggcagaggcagguggguuucugaguucgaggccaaccuggucuacaaagugaguuccaggacagacagggcuacacagagaaacccugucucuaaaaaagaaaaacaaaaaaaccaaccaaacaaaaaaagauaaaaauaauuuuuaaaaggagccagaagggcuagagagaugguucaacaguuaagagcacugcuacacagaauaaacggauaaacccugucuggaaaaacaaaaaugaaaaaacaaacaaaacacaaaaauaauaaaaauuuuauaauaauuucacgaauccuaaauuugauuaacuaugugcccacuagauauuaugguggcauuuuacauuuucccuaaaauauaaacagaaaauuguuagaaauuauuacaaagcagcuucagaaugccucccagcugagagccggccgauugcacauaaugaaaacuuaucuuuccacaguggagaggggucagaaggugagugagcagauugucauuggcacccccgggaccgucuuggacuggugcuccaagcugaaguucauugaccccaagaagaucaagguguuuguucuggacgaggcugaugugaugauagcgacucagggccaccaagaccagagcauccgcauccagagguaggaacuagagccaggaggaacuggccagagcuccucuugcaucuuugaguucuuugcucugcucugugcagcugcauuggucuggugggccauuugcacagcagcugucaccaugcugccagcauggguuggggagagaggccugggucccucacucagccccagugcccugcugggucugcuccuccaugccaggaugcucucugcucaccucagccugcugcggcugcagcccaucuagaauggggaggcugagcuugugagccuucccucuggcucuaccgccuuggaauguugcaaagugcccgggccuccacuugcaggaugcugcccagaaacugccagaugcugcuuuucucggccaccuuugaagacucgguguggaaguuugcccagaagguggucccagaccccaacaucaucaagcugaagcgugaggaggagacucuggacaccaucaaacaguacuacguccucugcaauaacagagaggagaaguuccaggcccugugcaaucuguauggggccaucaccaucgcccaagccaugaucuucugccaugugaguagcugucccggccuacucagaugcacagucccuagaucguucagccugucacucaaagggaccaaauucucuguagcaaggaacuagcuuguaggaauggagaaaaugguuucuuuaguggucauguuguagggguucuguaaguuuaacacagcauuccuagaugggugucuauuuguagggauauguuccuggaaaauccaaagcaagcugcugcagacuccuaggaaaaaggaagcuacggaacaagcuggcucuugucccaggaggaagcccuugaaaguaguguuaggagacaagagacacauccucucugucaguacaaacauuccccugugcguucauuugcugggggauuuuguuaguuuguuuucuuuauguuguuuuucaagucaggguuucucuguggagcccuggcuguccuggagcucuuuucaaaccaggcuggccucacucucagaccccugagugcugggauuaaaguugcaguauauuuuuugagcuacggaggcaucauugcucauguuagcuuaaaguugagccaaccaaugauugcucacugcauuuaguaguucugucucaagacuccucuacccagaaccaucccuucaugucucugacauugcaugucugacuuuuuuucuucaugacaucucagagaaugaaugcagcuaauggggucaugaauuguagaacuucucugauuuccccaauuccuuuugugacccauucagguuugugguuuuugguuuuguuuguuuguuuguuuguuuguuuugguuugguuuuuuuugagacaggguuucucuguguagcccugguuguccuggaacucacuuuguagaccaagcuggccuggaacucagaaauccaccugccucugccucccaagugcugggauuaaaggcgugugccaccaccgcccggcuuucagauuuguuuuugagguaaauggcucacuguguagcucagacuagccaucuuaaaucucuucuaccucacuuucccaaguccuaaaauugaaggaguucuuuuuguuacauuuacauauuguguguguggacauggcacaauaugucaguauaucugaggacucaguucucuucauccgccaugugagucucuggauucaaacucuagucagcaagcuugacagugagucggagcccacugcaccauuucagcagaccccaguguaguguuguagugaaaauuuuguaaaauuguuucccuugugacacuuuugcuuacuauuguacuaucagguuggcaauuuuacugcguuuaauguuuaacugguuacaggguagauccacaucagucucuuuagguacuaauauuucuuacauauuuguuugcuuguuuuuccagacccgcaaaacagcuagcuggcuggcagcagagcucucaaaagagggccaccagguggcccugcugaguggagagaugaugguggagcagagggcugcggugaucgagcgcuuccgagaaggcaaagagaagguucuggugaccaccaacgugugugcccguggugagcagagacuggccccguucaccaggcugggggcccaggcccugugagcaagaaaaguucuugucucguggaggcggaggguuugagggacauuccuuccuaggagaggguggaagggaagcccgcagucugccuuggugggaagguuuccaggugcucccugucuuguggacuuguguccuacggccucagcuacagacccucuuuaguggugugcgcuuuaguggccacaugccagaugugaccugucccaggcaugucuucagcccaaguggguacguguggcugauggugccccucugucuccugccugccucccccaaccccucuguacagguaucgauguugaacaggugucugucgucaucaauuuugaccucccuguggacaaggacgggaacccagacaaugagaccuaccugcaccgcauugggcgcacuggccgcuuuggcaagaggggucuggcggucaacaugguggacagcaagcacagcaugaauauccucaacaggauccaggagcauuuuagugagugccggguuggcucugccuggaucccuuucagagggggugugggagagggcagguuuucguggucccugcauauccggggcucagggacugcaauaucagugcccugggaccaggcugggagaaccugacuuccugggaaguugguagcuaugaucagagauagcccuggugcuaucugcucaggcucaggaagccugcuugugccuagaggaagcaucauugucccucagggaggugccuccgcagacugccacccuguccugggugacuucuguugcguguccucgguaguucauggugagauguccucccgucuucucuuucccccucagauaagaagauagaaagacuggacacagaugauuuggacgagauugagaaaaucgccaacugaggcgcucgcuucuccaugggcuggcgccacccucagcgcucccugccugggagucuagugcuuucauggcauaggccugacgggccccucagagaccacgggcugaguagagacuaccuaccucauucggaauuacguuuggacuugacaaauuugugcaaaugaugagggaugguagaaauguguuuacacaacuuuggaagauuaggcaugaauacacagaaauuuaccuuuucaagucccaucuuuuuuuuuuggacaguauuuucccaucacacugaucuagauaauaugccuaggauuccucaugacaaaccuuagcuguuugugacuuggaguuugcaggccagccucguggaagugacagcacagaacagagagcacguagaggcagaguccucagggaggaggaggauauaagccagucgugugucaggaagauggcacaaggcacuggaguuggccuguggacugcugcuuaggacuugguugguguguaauggcuaagcuguguguuaccugaccccugcugacauucuuuccaggaaaagauuugccauguuggaccaaaaugccuuuggggccucuccuuaagcuuuguggcucaggaacaugggcaaaucuaguuauuggugaguucuuggcucauacuucagcaagaccuguggagaaguuguccuggaggauuaguggugccucuggcuuccgguaacaccuggaucauggguacuugaaccauaguuuuuacaucuguaacaucacuuggacuguuaguagucccaggcaaauaacaggguacugagguuuggguucuaagugaguacuguagcuuaaaguuucugaugggcuggcagccuugaucagagcaggcuaggcauggucagcaguugccaaaauuccuugcuuuguuugcaguuccugaaagauuaguccugucagagcuggggagugacugcagauauugggcaacguggcucuaaagggauucugauggucuguguucacagugagugugaugagggacaggacggaccacagccguuugucuguccacaaugaguaaucaacaaguacuugcugcuuucucccuuagcauccaucauuaggacaguaaaagcacacaauaaacagagaacuucucacacuggcuaggccauagauacuacagagugacagcaauguggagggauugagaagcauccucuucaguucuuugacuuggacauggggugagucuucucucuagggcuuguuuuguuaguuuuguugcauguauguguugugcugggacucaaagccuugcguucugcuaccuaagcacgguuacucugaacuauuauuuccagccaugauagaggcuuguuguggugagaaguauagaccuguguucccauaucuuaaggccaguuccguccccugggaaaggagagugccauggcuaccaccugguggugguucaaugucacagagaaaucaacaggugcuuguucuccacucuccaguggguauuugaauagaauucucugugggcuccuggccaacuuugaucuauuuuaggagucuuaaaaggaaagaauaaacuuuuucucccaaaauacuguggaucaaacuugaaauaagugaaaacaagaacuguaguuagagaaguguaugacucuucccugagucugagaaggagacugggcaaggcgagcagcagccccuccaguggcuucuggugggaguguagaucaacacuccuaaccuaguguccugcaccucggagaauacuggauggguuucauggugucugugaaguuauauacauuaguuuaagguuuaaaaacuucuuaggaagacucccaaaagauuuuccaccuuuuaaaaaggugaguccuacauugugaauggcucuggcaugucacuagugucauguggaccauacucuuucccagcccacacucacuccugccaccaucuaucccccaggggcagauuagcacugucuggagccuuaagaauguauugagcuuacagagccuugaucccagggauuugacuguuauguaucuauggagugagaaacugagcucuuggacgaaggagcucagggaaagaaagaagggagaagcucagggaaagacauauuuuuguguaaugaaaaguuuugugaugcucauuauccacaaacauauuuauauuggaauuuuauuccuugaccucaaacuuaaguuucugccucaguuuccugggugcuagaauuguagguguguacuaucaugccagacugugguauuuuuguucugaguaucauuuauugguuauaugcaugcauaagaucugauaaguuguugagacauagucuuuuagggauuugggguuuuuguuuuuuugagacaggguuucuuuguguaucccuggcuguccuggaauuugcucuauaguagaucaggcuggcuuugaacuccaagauccaccugccuuuagcuccugagugcugggauuaaaggugugcacuaccacaccccgcacgauauaguuuuugcugguguuaauuaugaauuguucauguuacuaagacaguaaugcuuauaagaagcaaguaguaucuugugguuggugauauauuaaguaaaguuaauaccaccuucagcuaguauuagucuaugucaggugguacuguucgaacgugagcaacgagggcaucuccauagaaccaggauucugcucacuugccaggcauucacaaacacacaugcauacgcacacacacaaauacacacaccauuccacuuuaguaaaacaggaugauuuaggucacagcauguaaggucagucugugggugcauccuccaggagugaugguauauaccagucagucccugcauuagcaacggugauaguccauaccuguagucccugcauaccaagagcgauaguccauaccuguagucccugcauaccaagagugauaguccauaccuguaaccccagcguuagcaaagcugaggccagagggauuugaguugaaaguaaacccaggccuacauagguccuguuucaaaaaacaaacaaauaaaacaaaacaaaaaacaaucucaacaugguaguucaugccuauaaucuuggcauuugugauauaaaagcaggaaguucaggaguucaaagcuaaccuaggcaauaagaggcugggucagggcauagcaccuggagauagaucuuuccuauuucuuacagaaucaguguccgagacugguauagaguuccagaggccagagaauguugaauaaaggagugggguuugugugugaggaagcaggcucgugacaagauuugcaaggaaaggacucauccucagguacaaagagaaguugaggcuagccuggccuacagcaagcccugucucagaaaggaaaagaguagaaaguauuggguacagugguccuuuuuuauaauugcagcacucaggaggcugagacaguauugcugaguucaaagccagccuggguuacuuagaaacaggccagccuuagcuguguuagucaagaugacaagggugacagagauccccugggaacacagcucagguggcccugugugggaaagucaggguucacaggauaaaaugcugcugcugcugcugcuguucaguuuuuauugugcuugguguagggucucacuguuuaacacagacuggccuggaaaucaaagcaauucuaccucagccuccugagugcugggauucuaagcaggagccacuaugaccuggcaacuaaauuuugacugucucacaguccaguguccugcugugacggaguagccagggcugaguagucugaggacaggugagccugcaggccuggagggagacaucaacaugagagcauuagcagcaggaugagggauucugaaaucagcguagcaaaauuggcuuucuguuguuggaggagggaacuggacugccugccuccucugcccacaccacucgagguaaugcugaaggcuucauggacucucaaguuucucuugauccucuuuuagagacacuagacucauagaaauucauugcaaguuuacauggcuuugcuucugugcuugagaguaaauauccugugcuuuguugcguggcuguuauggugucuucuauaaaggacccuggugcacggaauuaacucaagaaacguaugcugaggcacauacacugcuuuucuuacccuuagcugagauagggcuuucccagaacagcuuggaacccuagugugaagaugcagacccaugcuuuucuuggccuccagacugucuuggcuuuagaauccgauggggcaggggaguggcuguucuugucguaguuucagucaugaaguggggaaugacuagaagguggaggaaggugugguggcacacagcuguaaucuuaacacuugcagggcugaugguugaaacuuuagaguacuguuagggcuacagaggucuagacuguguagugagaucaugucucuucaaaaugaaaagauuaggucaagcuuuaccgugaugccugacaugccugcuguccaaaugaaccaugucuccccucugccuuagcuccaguuaauggacagagggacgagggugagagagcagaucuuugucuuuuugagcggcuagcuuuugccaacguaagaaauagcuuucccuacaagacugcuguugcucaguauguuuuucccauuccaauucuucaacuuaagaacagccuacugaguguaaguuauuguaauauucccugagggcaugccucuccugcuuuuuuguuuguuuauuuguuuguuucuuucuuuugguuuggguuuuguauguguguauguguuuaguucauuuugcuaucugacagcaguagcugcuaaguaugcguagaaauuaucaagauauggcuagugagaugacugguuauugcaguccaguuccuaaagguaggagaaaacuagcuagccucagggaguuguccuuagaccucaguaguggggcaauggugcauagucacacacaaauuuuauuuuuuaagacuugcucgucuuuuuaaauaaauauauuuuuaaaaaugugu

SEQ ID NO: 4788 - RNA, 29894 nt, Mus musculus
acccaguucagaacagcauuguuucuaacucuaguaucaagaaaaaacacaacagauguauuuccagucauaaaauaguuuuuauguuuuacucugaguagugagaaggcaaaguccccugguccauccucucaaaagaaucaguuuauuauguauuggagccaauggcuggccugcacuggguccaucuccuacaagaccauagccccuuaucucauuuacuagguaaauccagcccaaguccuuuccaacuugggaguauggcugcuuucaaaucucuccaacuggaucguguuuccaacggccuuuuaaaccuuuccaacagagcuguccagugcuuugguucugugcgcccaacugccccacucuucguuucucagcucugcggagucaggcgaccaucagcgcuugguccuuuagggagagaagggcgauagcaguccucgaauccucgucgcuccgguuuuuuccaaucaggguggggcggcggcaccccuccggcgggcagcccgcaccaaacacugcugcagcacuggguagaggcgcuggcagcccuccaggcccaggcgcacagcaucgguccaacucucagucugcccgccuuccccacugcccaguaacccggccaccugauugagcacaggcaugagggccaccgugagaccggccgcggagugcuccuccuccagccgcgugggguccagcagccaggucggggagggucccggggugaggcucaggccgcagcccaccaccagaucguacaucuccacucccgcgucggccagggcgagcgcggccgcggugagcgccgcggccagcgcacagccgccguccuccagcagcagcgccgacaccucgagcugagcacgcggguagcgccccaggcgcacggcgggcuccagagccuccuguagcgccagucccagcucgcgauccuccccgccgccgcccuggggcgcgcgacgccggcgaccggagaagggagcgcggcggaaaucgcagagcaggcgaccccggagggcagcgggagcuuccccgcccgcucccgcagggccgcugccgcgcucgccgcccucggccugccgcggaccggacacggcgcacagcaccuuggucccgcccgccuccagguaggcggagcccuuggccuggcucagcagcccggcgcgcgcguacaccgggcggagccgcgucgggucgcgagcagcgggcgucucgucgucuucggccgcguacagcugcggcggcugagacuccuccggcccgcggaugcggcgauggucucccggcauggcggcuaccggcgugcgagcuacuuccgccugcugggcugcccuugcgcacccggcucuuccgcucgcuuaaagaugcgcgcccgcgcagagccuaucgggagagcgguaggugugcgcgcugccaccuagcggaguggaggaagaacggcgagguauagcuggacuccuaugcugguacuuuagcuaguccuaaggaacggaucuguuguuauuccuagaaguuugcauucagacuguuucacauaagcuugcccaaggugagagguuuuuguuuacucgugcaauuaguccucuggcugcuucaacacuuguuuaauaaauggacgguaucucucuuuguacaacuagauauuucuaacacucugaggaacugucauaagcagacaguaucucugcuuccagacccugcuguuuguagauucauacaaauugcauuuuagggcugggccagggucuugaaccuacuuuagguuaaagcaguagggguggggcaguuaguaggacacaccuacauguucauacugccuauaucaguugucugaccucauaucagcagccucaaacaggcauguggacaggcaugguggagguuguccuaagagacuaagaacagugguucuccacuggaagcaacucagaauuauuuuccuccacccuucuauugaauuuccugaacuuucaggagucugggagucuauucggugauaccaucaaccagaaacaggcuggaaccguaacagauauacaggagccagggcucaccucaggacaagaagcagagcgcaugacaucaccaaguauugcacaugguccuuuuuauuuucugcagagaaaaggcuuccuuccucugcagaccuaaagccucaggcuggcagagugaccucaucuagaugugaucaugacguuaaaaagcauuccuggguagugauuuuagacagauggugcugacaugaaugggcucagagcaguaauggaggggggcaaugaaucacaggacagcuccaggcguguucccauuaccgcuggaucaggacggacagggcugcugagaggucccaugacuccaaugucuucguggcgggaggagagcuccuggcugaauucccgccuucggacaugucugguugauggcgaguugcuuucccgagagggcuucccucccaucaguucuucacaucucccagacggagcugggcaaaggagguagccagcugcagugcuuccugaaggcagcccacguucuugccuguggccugggcggacauguccuugccaccgccuuuaccauccaucaggccugaaaccugcuggacccacucgcuggcuuucaguccccgguuggcugcauucuaggagauaggaggggaaaaugguagucagaaugggauugaggggggaauggcaggcgcccccaacauccauuuguaucaugugugaugcuaccacagacuaacacuauagcuggcacaggagagcagcuauggcuacugccaaagugaggacagagagcaaagccaggcauuagccaggagugaagucuuucaccaaaagaaagcccgagggguaaaggugccgcaggaggcgacaaaugauagacagaucaacaguuucuagugaggacugcgugcacacaaacagucuuggcaaaugcugugaagaagcccuccuugaggagccacaggcaggguuucccacuggcauacggguuugcaggcuuuuagacugggacugugggaaguucugaccuggggaaccuggcacaagcacgugaucuugccagccucauuguccaccgugaacagcauggcagaugucugaggagaaugcgucuugaaaagcuucaacgcuucauucagggccuguggggagaaccucagguuaggucacuggcaagggagcccugcuuucuacaagggaagcugagaacucagcccucagagaaccaucccauuuccagcagaugcuguucccaggagcccaccaguggcaggacccugcccacacccuggcugaggucggccuccuacccccaggaagcuccuccuucucuggccaccggaucucuccagggcucagccuaacucuagaacugagcagugggccuuaagugaccacacagcccagauuuagagggcagcccggcccucgcggcuugccuuggccgaugcuccacucuccaucuccaggaugaccagcggcugguugggguugcugucaaucagcugcuuugucuucucuaacaccuacaagaagcccaggagagaggcuuaggccaagggaccagacucugagcccugucagccucugccuaggaaaaccucugggcgcucauccagcugcuggcacugccaagccuuacucgcuucugcacaucggcuuugcuggcccggucuaggucauccaugacuuucuucagggacuucagagucucucguuguucaucuuucugccacugggggaugacugcaguggccagggccuggaaccagaagagaagaccaucuggggucugggcuaauaggagguagggugaaauucaagcccacucuacccuaccccaccuucugucuuugaaccaaagucuuccauggccagagucugagaaaacagaaaaacacaaagauaccugcuggcuuuaagacuagucacuauauuaaugaaugcagcagccaucacuggacagaaaguagcaagauaaagagggcuuuccuugagaccugguccuuaccagcucugaguacagccugcaaagacgugcaggaaggaagcccagcauaccagaauacgagcuguucgagcgcaguguggauggcaugauauccuuucucaaacaaagaacuugacgacaccccaccacccccaguccccaacauguggcucauuuugcagagacaugcugaggccagaggacagcugcgaaucuguagccagccugagcgguauagugugguucaggcuagucugggcuauagaauaugacucugucuuuaaaaagcacaacaaauaaagaaacaaagaguuuaaaaacacagggagaaacaaacagagcgaagccauuccuaccucaccgaggucagcaauuucccucugcacguccuuguugggugcagucugggccuucacuuuggccuccauggcagagagagauuucuucaagguuucugacuuccugagagccuaggaagagaaccaucagagcucuaaacacuaggguuccuuuccuucaggaagcaagugcucgggccauacauagcuggccagcaaaggcugcacuguaacuccuguucagggcugguucauguccaugaaccagaagcccuuucaccugggaaagugaccauuccucaggaucuaccaccaagcugcgcggcucaccuuggugccacacaccucgccuuaggaccacccugggauaugucgagagggaagggcauaugaagcagaaggagacucuggcuuacacucacacggagcugugcugggaggaaggugcaggauuuauguauucuguuuuccuagacgcuguuugucuuuuggaacuuucuacuaguguguguguguguguguguguguguguguguguguguguguguguacaguguaugguguguguacaugguacauaugugugagagaaguacuuuauggagucaguucucuccauauguuuuaugugggucauuggccacaaccucaaguuguuagucuuuguggcaagugccuuuuuguacuaagcccugcaacugacccccaaauauaaaagauuaaccaugaagacuagaaaccuugcauggugacagcuuuccccugccaggcagggcccacaggccacccugaccugcucaccuucugggcuucagcaccugugacagcaacaauccuccggauacccuuggcaauagcuucuucugucacuaucacaaaagcgccugcguggcuagaauuccguagaugucugaaagcagaacacggaaggcugaagaaggggaaguuuacagagcccuggcugagaugcaucugcacucggaagcgauucugagacacagugucacuaugaaguccuggcugaccaggaacucacuugguagaccaggcuggccucaaacucagagauccuucugccugccucugccucccaggugcugggauuaaagacaugugccaccacugcccggcagccuuucacucuuaagagaucuaugagcauagcucagaagccaaggcaagaaagagaaggagcagaggggguuagaaaguugggcugagcccaggagcuagggcuucacaaugcugagagcaggacgccauuucuccgagccucaguucccucaaguaugaaaaggggagaagucugccugccucaccagacgguuaggaaaaucaaacaagacaaucuucaaaaugccaaaguuccuacuguccaacucagcaauacugcugcuacugaccgcauguggcauuuugcuguuuuguggaacaagagcuauaucuuaguauagugaaaaugcucccugggugagaacacuggggacuacuuuuccaaaucuuaauauaacccuuaaacaaacagaucuagaaacaggucguauucuccagucgcucagaggacucgaagugcauuaagucucagucacuuucugagagaauggcacagucuuugaaacccauuucugagggugucagugaggggugugugugugugugugugugugugugugugugaguauaagugacacucaccuaaaggccugagucagccggaaagaggccuggaacugggaucucucagguccccucgcccucuguguacauguuaaguguuuccugcuggccugagccuugcaggaggcucuggcugguuuaauugggccuuuaagaauaugcuuuccugccggguggugguggcacacuccuuuaaucccagcacuugggaggcagaggcagaggcaggcggauuucugaguuugaggccagccuggucuacaaagugaguuccaggacagccagggcuacacagagaaacccugucucaaaaaaaacaaaaaaaaaaaaacaaaaaaaguuuucccuuaugcuucuuuuggaaucugagcuugcagaagcaagcgaucccaagccagcugagccagguccacucaggagcucucaguggauucagcuucccuucccagaugcugcccaagguagcaaagggagucaaugaccuggggcuggagcuggagcuccgugagcaccaaaagccuugcucagccuaaagccugaauucucacaacuucauuuaaaaaaugaauccaggggcuggagagauggcucagugguuaagagcacugacugcucuuccaaaggugcugaguucaaauccugacaaccacaugguggucuacaaccaucuguaaugagaucggaugcccucuucuggugugccugacgacagcuacaguguacucacauacguaaaguaaacaaauaaaucuuaaaaaaaaaaaaaaaaaaaagacugugccgacagugucuucaucuccucauccugggaagaagauuucaucagaaacccaagacaugcuuauguggaccacugaggggucugacugugaagauucuuggaaaucuuauuggcaaguccauuucugaagacuucauuuuacccuuagaaaaugggagucugagggucaauggaagaacacucauuuagcaucugugaggccccgaguucccuccaaagcaugacagaucaaaucaauaagggaaugaccuuugaccuagcauagguucccauccccaaggggggugccagacgcaggagagugcuucuauugcugucccugccaaguuacucacguuccuccacagaacucaacagaaguaagggagccagcaggcccacacgggucauccagcagcucugacacggggaccccaauggagacgacucgaacggggucaggauaggucucaucaaacacagcucgaaggcccuggauggcuuuugcugcugccaggggacaauccuggguguagacaggcugacauacaaagaagacaggagagaagaaaaaaaaaagcuggaaaaaccucugaaggcaaggaaggagccuggcgagaauccaggcucuaaagcuguaagcccaccgugucugacacacacccugagcccucugaaauaacagccuguguuaaagcaacgaaauccggacaggaauuucuaaccuguuuguuaaaaugcuaggcaaacacuguacguaacuacaagaacacugcuuugucuaaggagguaggaaaucaaagacaccaccacuauaaagacaguuagggaaaggcugcuuucagcaucucugugaacgggucaggacaugguacaagagagcgggaacaucuggaucgcugagccuccaugacagaaagccaugguauaggaagagugcgccucagucgccagaacuccuccgacaugagagagccuaccuuagcugccucaaucaugccauugacaaucucuucagccuucuugauuugcuggguggacauggcucccuuggcagugaagucaaaccgaaggcggucaggagcaaccagugaaccuuucugguccgcuuccccaagcaccgagcgcaaggcgaaguugaggauguguguagcugugugguugcucaugacgggucuccgccggggcugcagagggcagagauggaagcuauggagcuguccgcacgugcuagaacauuuuguugaauauaagguugcucagcuuucuuuauagagugggcauauaccucaguucugaacaugagggugugagaagugagggauggaccacgcccucuccuuccucagcuuacaacaggaauaacaaacuagggcugaugggccacaucugacugguuguuuggauuuugguuuuuaggagauaggccugguccggaacucaaagaccccugugucucugccuccugggauuaaaggcuugagccaccaugcccagccucuugugguuuugauaguguuuuguaaccaggauuacuggaacacaacuccauugaucuguuugcacacguuaaacaugcaguaccuaccaccucacagcugagaaacucugcuugauauugaaccucuggcccgaacaacgcaccuuacaacuaccguuuugguccaugaaaccaaauccugagcacacccuagggaugagcaguaagcaaagacaagcuggcccuggaacaucuauguaaugaaacacacauugccgccugcuuucgagcuaucugucucaugcaacagaacccagcuuuuuuucuguuuuugagacagagucacacuauguaacccaaagguugaccucaaacucuugauucuccugccaagcacaaagauggcaggugugcccacacagugccugaguuccuaguucuuuuuuuuuuuuuuuuuuuaaagauucauuuauuguaucuauaagaguacacugucacucuccucagauacaccaccagaagagggcaccagaucccauuacaggaccucuggaagagcagucagugcucuuaaccacugagccaccucuccagccccacuaguucuuaauauaaauaagcuccugacuccugaaaaguucauggagucugaaaagcaacccacgggagaagggaauguuuuagaggauacgaccaagguauguuguauaccugugugaaguugucaaaggauaaauaacacuuaugaaaagacuaacuugggaccgaauaggcuugaggguuuuagcuucaucccaaacaaucuacaaaaugcaccuaacacugcuacuguacuuugcuaacagugucacuuacgaggugccaacaaaaggucucagugggcaaaggcgcuugccaccaaacuugacaaucugaguucaauaccugggacccacuugguaagagcugacuccuuucagguuggccugagccuccacaugugugcuuucacaugugcacagagaccagauauuaaaaacaggcgggcaugguggugcucgccuguaaucccaguacucagaggcagaggcagaggcaggcagaucucuaggaguucgaagccagccuggucuacaaagugaauuacaggaaagccauggcucuacagauagccucugucuugaaaagaagccaaaaaugaauuuaaaaaauuauuaaaaauaauuaaaacuaagaucaaauggggagcugggccagggggguccaggcacaugacucuagcaucugggagacuaggacaacaggaugacccuaaggcagcuuuaacuacaaagugcucaagagauugucucacuaaguaaguaaauauacaucaaauguggaccaacauaugcaacuuaccucaucaauaaacagccggacuugaucccccacuuucagguuaccauauaucguuccuaugugcagcacguacccgccucggaccugagcguucuucacuguaaacucgguuuucugcagggucaaggauagccaccaacaaguaaguaaaauuuccaaaucuaucaauucucucuucaugcgcguauacaccccuacggucagaugaugcacacacggcccugugauggacugggcagccuaggguggacgcgccucuuaacagugucuucucucucaggcgcaggggucacaugcucacagcccacucccagguuuauacaguguggggacgaacuccagggagugcucuaaaagugagcugcuuccucagcaagcgccaucuuaaaagucccaugaaauggauccuauccuaucugcaggaauccguugcuaaaggagacccaacagccagcaguggccacacuagaagcuaaguuuucucagaauguuuguccuucaagaaugaucucugccaggcauggugaagcccuaccucuacucccaacacaggaagggcugaggcaggcuuacugggaguucaagacugaccugggcuguaaguguaagacucugccucaaaagcccaacaaaggauaccacucagcaagugagacagaguccuuguccuuaugcauacggaagcauaggaaguaaggguuagccucugcacccuggcugcaaagaucccuuaggaccuaagaccugagacagcaacagguauaagaagcagcccucuuggcuacagaagaaauaccaaccaaagaauaaaauaaaaacaucuguccccaaggcucagaaugugaaggugaaagagaaggcgcccagccccugcuugccuuccacggcuaacaggagagagcuuggccuuacuuacguccucacugcugucgucgaccuucaccaaguagccuucaucguagaucugcccuccuugcuccgcauagaaacaggucuuguccagcaccacuccacacuccuggccagugaccaccucguccacaaacaucuuuucccgacgcagagcaagcacgguagccacuguacacucaaacacugaucaacagaugcagagauagggggagacaggucagugacuggugauauacagucccaugucugugcugagacuaaagauugaaucuagacccucacacguuacccaagcacuccuccacagagcucccagccccagcccagcucacguagucuuuuuuguuuuuuggguuuuuuuuuuuguuuugauuucuuuuggagacagggucauggcaaguagcccuugauggcuuggaauucucuguauagaaggauaacuuccaacucacagagauccaccugccucugcauccuacguguugagauuaaaaucacacaacaccauacauggcuccaaucacauauucuuaguugcuuuuugcuaaauucuauuuuucaauauucagguccuaguugucuauuuguauuuugaaaaccagcccauuagacuuuauaaaagaacuagcacacugauucuccaccagggaaucacugcuccggguucuaguuucaaaacucggggguuuccuaggcuguuaguguuaacacugggacauuucugaacaaacuggacaguuggucacucuguaucuuagacacaaacuugguaaaucuaauucugucucauauaauuauaguagucucuaguucaaauccucucucacacccauccacccacccacauacagacacacacacacacacacacuuaaaggacuugagcugggcacaguggcauguguguuuaaucuuaagcacuugagaggcuaagacagguggauuucuaugaguucaaggccagccuggucuaaauaggaaguucuaaaccagccuaggcuacauaguaagauuugucucaaggaagcaaaacaaaacaaauaaacaaacagccucacuauguagauuuugguauaagaucucugccaggcaggcccaucuauugcacaucuauuuguuuauuuagauuuucuaugagugugcagggaucaacagcuacuaugacugugacuguuuuaaggucagcuuucuuuuuucugcaacauguuaccaacuaagggaaauugguuuaagaguagcuggaaccuccccaugauuaaaaaaaaaaaacaaaaacaaaacagcuuucuguaacuauguuucaaaauaguuacggagacccccagccaagggugccuaugaguauaaccaugcagcauggcccgcugggcaccucgagacugaucucuuggagcuccccagauagaaaggcagacagcgugggagcagaaggcucagcguaccguagcuaccacuggagucugauugguaguuauacuuuggagaaucaucuguggccuccaaacccuuugcccggagcucuucaauagcguaaauguccagcaugaugaggucuucguccccugcucccuugcccugugacuucagcugucaaaacaggagagaaaaaaagccuuaauuaugucagucuagaugaagagagaacugagccuuggcaaaaacuguggccaagaaaaaacuaagaauaaugucuuuaaucuuuauacuccuggcauuuggggcuagaccagccuuugcuuugggggcugucuucuuucaugccaggacacugaguggcaucuugaggcucuaccaauaagauaacgggaaacaucagccccuaguugugaaaacuaaaaaugcuuuaacacauuuguaaaccauccaggaaagaugccuccagccgugcgucacugcucugggagugggggagaccuuaaaggaagggaauccaguugccuggugcugcccuucaucucauuccgcauauucuuucuuucuuuccuuuuugugguuggugguaagagaaauagggguuguuucuucuucagaaagagaaguggucccaaggauggggugagagagugagaagggaagacaggugcuuacgagucacuccucacacuccuuaccugggccagucuccucucuuccucaaagccauucauaucuaccaccaggcccuucucuucagcaaucaauccagugagguccacugggaauccauaaguaucauagaggagccaagcggugucaccugugcaguacacacaaaggaacugugucagaacgacauagacagacccuuuccuucccgccaagcccucccagggcgcugcugagaggaacaggugugaauggagguaaguaaggcuuuuagaacugaaggauaaagggucuccugguaaacuucuguuuccuaaucugagcacugugagugaguucuuuaaucuuucucugcaaacacuucacuccaauaaagggaaauaaccagaacuagagagauagcucagagguuagagcacacuugucauucuugcagaggaccuggguauccauuuucuggcuacucacaaauaccuaucauuucccagggguuccagcgcccucucuuguccucugugggcauuacacucacaugccaagaccccacccccaccccccaaucaaaaagaggcaaaacauuucguggaaaaaaaaaaaaaaccuuuaaaauuaauuuucucagcugaugaaagacaauguggacuccacauguuacauuuauaugcaaaauaugcagacauaaacaccuauuugcaauuuuaugcaaacagauuaaaaaauccugaagcauugauuacacacuaauuuuuuuuuucuguuguuucuucuugagauaagauuuuguuauguagcccaaaggcuggccuugaccuugggauccuccagccuuggcagcuacagugcugagauuacagcagacaucuugccaacuaauaguuuaccucugagaaacauauuuggaaaagguuuucaguucuguauuguuugaaguuuuaccacaguaaauucuuuuuuuuuuuuuuuuuuuaauuauauguaaguacacuguagcuguuuucagauaccccagaagagggcaucugaucccauuacagaugguugugagccaccaugugguugcugcgaucugaacucaggaccuucggaagagcagucauugcucuuaaccccugagccaccucuccagccccaguaaauucucuuauaauucauuuugcuccaagucuuacuuuaccaaaagcgguuuagguaagguacauucaaccuuggcagagagggggagaacugggccucaccugggaugguuuugcagucuccuaagcucugaauuuuucgguccaggaugcgccgcccucggcugagagucuugagaaacugcaccucuucuucauuaaugauguccuucaccaucucuggguccuucuucagcucaggaaaugcgucucccugacagaaaagguucagugugagcaggcuauuccgugaaacacccuccuuccuuuuuaagauggggcuucauucuauaugcaguccuggcuggccuguaacuuacacagugcagaucaggcuggccucaaacucaucugccucugccucucaaguguugggaucaaaagugcgcaccgccaucccuggccuccacggucucucucuuaaaauguccacucacagaacauuaccaccuaccauaucccucuuagacuagggcuucagcacagaagagaaaagcagagacuuuucuacgcaccagggauugaacgacaacaucaaccaauguagcgaagaaaccccugcuggcauucaguuucucaugggaauaccgaacagcucggcgaaggauccgucucagcacguaccugugggaggcggaccuuaguguuaguuagcuaggagacaccccuagcugaggggcccacgggagcuccuuuaaaacaucagcuuuuuguuuucucugcuuaugcagagaguuuguuuagcuacccaagccugccuagucaggaaugcaguuuccugggcugagucaguaccuaguccuauucugccaagaccuagcugaugguuuuagugccagcucuacauccuacucaguaaaaacuauuaaauagugucgccuuaaaauacauuaaaacgccguuagcuguuaaaaggugggagggaagggggucucuccacuacacaaaagacaacaacgaaacaguaaucaaguauggcuuugagcuccagucagaacacucaugcaugcuaucagcccagacccugcccacagugugaccgacucacccccguccuguguugucaggccggccgccaucagccagcgccacagugaugguccgggcguggucagccagaacccgguaggccaugucgauuccgucugcauccucagcaccaaccuucccaguauacggccgggcgccggugcccuacaggugaccagagagggggccaaugagacaguccugccccugcugccucacacgagagggugaggaggucugggagaagaugacuacccugccauccgccacacgcccucgcccuggcaaauggcauagugugccuuuacucagagagggcacgcugacaguaauggugcaggcagacagcagcaaguacuguggcauucaccuaugacgucaguacucaaaguccgcccugcagaccccguagaagcguccauguucacagccugaucaauaccuucugaauggcuucgaaguaaggcaugaaaaggucggugucguaguuggacaucuuguucugcagcacagacaccagccucucuaggcccaucccugugucgaugcuuuucuugggaagagguuucagaacaccauccgacucccugaaugacagauacagaaaggaagcuggaacgggccccgggcugcuccuuucugggccguagguuaaaacucauuuagcauuguuggaaaguugccauuauucaccauuugccauugucugguuugugaaggaggggugugaauacauacccagucuccuugucuugguuuuuuaggguuggggacgguguugagacagggucucucuacauagcccugaauucacuauguagaccaggcuagccucaaacgcacagagaucagccugccccugccuccugaaugcugggauuaaaggcgugugccaccacacacagagccuuauucuuaaguagaaagcagacagacgguucaggaagacauucugugagauaagguugguuuuuauauagguccaccccaucccagggagccaucggaagccugccagcgcccagaauguccaggagcaccugaagugcagggcuguucuccagcuccaaaaguaaagaucgcagaccaccuuuggccgagaaggucugguuaagaaaaggaacugcacauagcagggaggagcagggcccacacuaccuguuauacuggaugaacacgagguuccagaucuccagcacauuggggucauccugguugacaaggugugcggcgucccugccaccaaugcggucauaguggaucucgcugcagggaccacaggggccugugucacccaucucccagaaguuguccuucauguugccagggaggauucuggcuucauccagucugcacggaaugaggaagagaaacccacuugaagccgacaagaaaucccuccaagacuugcuucuaccacacaacgcaucccuaugaguccuuaugaagaaguaagucccacugccuggcaagcacuccuucagaggucacgguuuucuccugcuauguagccaaagcuggucacgaacucaggauccuguugccucucugccaccaggguauaaagauuauagguaugucaucaaaccugggugucacaugaaacuuaauuaaauaccaaguggcugagguauaguuauauaccuaaguguauauuuggaacucacuguaaagaggaaaagguugggguggguaacuguccugaaucagccugccugccugccugccucccucccucccucccccccuuuuucauucaagaaauuuguguaauguauaugagugcucuaucugcaugcacagaagaggacaucagaucauguuacaaauggcugugagccaccaugugguugcuaggaauugaacucaggaccucuggaagagcagucagugcucuuaaccacugagccaucucuccagccccaucaucccgaacuuagaaaucucucuuaguguaguggguuacacucuuaucugcaccaccccucucugcuaccuuuuuaagauaaagaauuccaacaaaaauucuccaagagcaguuaugagcucucaacuacugaaccacuucuccaaucccucucuuacccuaaauuuugccaaaucugucugcacuccagaucuggcucuaggccggccgccucaucaccaccaaaguaagugacauagagucuuucaacuggaauaccaaacuccuggguaagaaguuccagggccaucuuacaugccaauuccuacaaaaagaaagauccagaacacagcuuuaaaccaacaauaucuucauuauaaaccaaaaaaaaaaauucaacuuauauagaaaaauagaaacugagacaucaaaugauacauguuuccuagggagugucggaauuauuaaaugcccuucaucuccaaaucuccuaaaugauauuuuauguuuuaaaacaaucaaaauuaaaaaccccaucccuuuuguagaaaugaaccuuguguuaggaaaaaaaaaucuaagccaccuauguugagcuuaccuugaaauaguccccaaaagaccaggagcccagcaucucaaagaaaguguggugguagacauccuugcccacgucauccaggucguugugcuugcccccagcucggaugcauuucuggguauuggcagcucugcucagcuucgccauagggugagaugggucgauuguguuuaggaagauggguuugaacuaaagaaaaaggaagagcaugacuuuuacaguauggcuuugucacaugugcauagccuauaggaugugguccaggucucugagcagugguucucauccuuccuauugcugcgacacucuacuguagcuccuuguguuguggugacaccaaccauaaaauuacuucauugcuacuuuguaacugauuuugcuacuguuaugaaucauaauauaaacaucugauaugugacacaccccccccccaaaagggucacgaccuacagguugagaacugcuaucuuaaaaucauccagaaagccgggugugguggcgcaggccuuuaaucccagcacucgggaggcagaggcaggcagauuucucaguuugaggccaaccuggccuacaaaguugaguuccaggacagccagggcuauacagagaaacccugucucgaaaaaccaaaaaaaaaaaaaaaaaaaaagaucaucccagaagaauucauaugacaaaugaauaugcucacuugggaguaaaggugacaaagaaggaaaguacugacacagauaagcacaauccuccccgagcugaugaaggacuggguauguagauaaauaugagcaagcagcauauauauaaaauagaaauaaaucaguuuuuaaaaaaaaagacuugaaggggcuagaugagaagaugguucagggguuaaaagcacuugcuguuccuacaggggaccccgauucaauucucaacacccacaugauggcuuacaaccaucugaaacuccaguuccaggggcuuuaaaacccucuucugguaggcacacuuguacacagacaaaauacccauacauauaaaauaaaauaaacauuaaaaaaaauguuaagaacauguuugccagggauggguuuuggugguccaugaauauaaucccagcuuuugggaggcagaggcagguggaucucugugaguuguagcccagccuggucuauauagugaguuccaggauagccgggacuauguagagagaccaugucucaaaaaacaaaccaaacaaaaagagagcuguaguaacuagguagguacacuucgagaccagggcaggcagaucucugaguuccagggccagguaguaacuagguagguacacuucgagacuagggcaggcagaucucugaguuccagggccaggugcucacacaccugaacugaagguauagagugcuugcugaucaugucuugaagccccagguucaauccccaguaagaaaggaaagaaaacaaguauuuuuuuuaauaacuaaauuaaauuaauuuuaauuaaaaauaaaugagaaaaccuuuuuuacaauauggagucacauaugucuuuacaguguuuauauaccugccgccuaaggaaguaaaaaacaaaaaaaaugcaucaaauuucuuggaucuggacucauggguagaucugagauauuugcuguggaugcugggaaccaaacuuggauaccacugagaaaacaguacaggucuaaaccaugucauguaauaugggaugacaaugcucuuuuacuccugucuuuuaaacgggauaaaaaucuccacuaugaccucauggucaccaaagaggaaaacaauuauuuuuaagaaaacuucucagcuuucuuuuuuuauguguaucaguguuuugcuugcauauaucuguguaucacaugugugccuagugccaaagagccagaggaguagcauucgaucccuagaggugaaguuacagaugguugugagacaccuugugugccaggaauugaacccugguccucuggacaagaagcaagcagccagugcucucaaguguugagccaucuuaccagcccccaaaacaguucaauaaaaauaguuguuguuuuuuuuuuuccucagaagaaagggacaaugagggcuggagagauggcuccaugguuaagagcacugacugcuuguccagagguccugaguucaauucccagcaaccauaugguggcucacaccacccauaaugagugcccucuucuagugugucugaagacagcuacagugcacuuacauauaauaaauauauaaaaccuuuauuuaaaaaaaaaaagaaagaaagacagagaaggacaaugaaaaaauaaaaucuuaaaccuuuuuuuuuuuuuugcagggggaggguacuaucauacagggcuguagcuguguaccuuucuaagucuucccacuuucccaauuacucggaaaaguauggcuucccuuucuucuuucuaugccugcucuagugugcucucucacucagagacuuggacuuccucacucuuucucuaaagcuccucucccugccgcauggcugacugccguccaugacugcuuaacacaacagcauguuuuuuuuuuaauuuccccuucuugucuccauucuccucuaggccacugcugcagauguacaguuauccuggggcucucuuugaaaugcuuaaaacaacaacaacaaaaaaaaaguugcccuugaacucaaaaaaaaaccaaaacaaacaaaacaaacagaaaaaaaaaaaaaaacuuaaaaaaauuuuuuuuugagacuuggucuuacuauguagccuaguuuggccuuaaauucucuuaaaguuuucuucccuuccuuuuuccuuuccuuuccuuucuuuuucccuuccuucccucccucccucuuuccuuccuuccuucgugacccuggcuguccuggaacucccuaugaccuuuuuaguggagagccaccugccucugccucuugauugcuaagauuaaaccuuucaccacuauaccagggcuaucacugggccuaucaaauucuugaucucaaagaccauaaaagaaaagagucuuuccaagacucauuuaaaaaugaacuccuuggccgaaugugggagccauguucccagccccucuggcuucuaaccaucacacagaaacucgggcucaccacggaaagucacucgaguuuaccugcuacuuuauacagcccaggcugugcuuuccggcagcucugcugcccucagccagccaggcaggcagagaggaggaagacgacccuuaccugguucaugccagcguuggcgaagagcagaguggggucauccagagggaugguggcggaagaguggacauaggugugcucauuucgucugaagaaauuuauaaaccgcucucggaucucucgugcuguuaaaguggcauccauuucggaaagucuccucgggaacuaaaaggaagaaggaaugacgacggcaaguuagggaaauaaaaguaaaaguggggauuacacaagacucgugucgucucaagccaagucaaauagguuagcuguuucuuugauccuaaaacuuuccuguugcaaugucccagguuacagucacccucacugggaaaucuuugcugccucagcagacuggccccggcugucuucccccuguugacccgucaagcaaagcaaggcucuucuucaugguuucauucauuaaccaaauacgcacugaguaccuacggcuaggaaucggcaagggucaccucaacaaaaggggagucuguacccacuggccucugaggagcuuccaagcucuuuguuaaccuacaggcugaggcuuguccaaaguuccauauccccaaaggcacaggugccagguuugggcugacacuugugucaguggcuaugaacccagggauaagcccaucugugccauggaccacccuaaaguaucaagaaugcaucaaccucuacguagccuaaaccuucagagcccuagcugggaaagagccggguucuagccaugauauuacgaagaacuggggcuaucuguauacagcaucauuucgaaaugaguaugcuauuggaagaacgaguccggggacucagaagaggcagagguugagaaaagacaacuuuauagcgucaaaacguuuuuaugugcacccucaggucccugaaaggcagggaguguguaagguggggaugacagguuuugguuggagugcaccaaucggcgucuagugcuguagugcucugcagugcuggguguccugacaaaugagaacugucucauuuuugacaucaucuaaacaucucuagaauucuagagccagcucuaaacuuaacugcaccacuuuagcuugaguuuagugucuguguggaacaggaccuugugagcaucaaaaaaaaguuauugaacuggacacuauuuuacgcccauuagcacagaguuuuuaaacacacccgcaaagcacaugacauccugacucagccaaccacaacuccaaaugaucuacuuacaacuuagucuaucacucugacagaagccccaaaggggcaaaaagauggugacacaggcugaguguguguggagggguggggugggggguggggauggacuugcauucccacaggaucuugcuagucaccauaaggagucaagguuuucagaaaucuugucacaccgccuucucuuuucagcccuccuuaacaauggcuacaguucgacuuuaccuuuagagucauuguugcugaagaaaacaaccugcuucucuccacagacaagcugagggaacauuacuuucuagagcacacuugaaccucccaccuuugccuaaguaaugaaugaggacugugugcuaagagccaguggagaaccagugcccccauaggguggccacuacauacagacuacaccagaguuguauacugggaucuaacauguccauuacccuaugaagacugaaggcuguugaaagcuguguccccacucugaccaucccagagcucgggaggcugaggaaggaaaauggaggguuggagguuuccaggucagagacccagcccccaauaaauaaauaaauaaaugaauaaauaaauaaaguuuccaacauuaaaacuuguucuuuccucaauauacauaacacgucuguagcagaggcagguccgaaaacaguacaucccagcaggggcuuaaaaggccuucagaacuuuuauuuauuuguuuguauuugcaagcuuggggccagacccagggccuugaauuacaaggugacuucagccacaggaccuuguaacauauuuccauuuacaagcuagccguucugccuggccucuccuuucccuucuuccuaaugaggucguuuugaucaaucacaaagaaacauacuuaagcaaaccuuuccuuucuucaccaggucucuccucuuuauacugucuccuagccucaaaugauuuauuuggugugacuauuuaaugcucaccucccaaucacagucuauguuacaucucaguaggaauccuggcuggcuucacuucaccguuacaguguauuuucaguaucuaguaaaguggucgucacccaugcucaugauuaauuauacuaaucuguaaauagcaugcucugcacuaacauacuccaaagcacaccaggaaacuuagacuguuugaaaaaauugcugaauauauuuguucgggugaaccugaagguaucaacuauucuguuuuuaagaaucgaaucgggccgagggucguagcacacgccuuuggucccaccacucuugaagaucucugugagucgagaccagccuggucuacauagugaaacccugucucaaaacagcaacagaaagaagcgagucuggagugcuggcucacgccuguaauuccagcacuugaaaugcugaggcaggagaacugccgcgaguucaaggccagcccggguuacagaguugaguucaggccagucugggguaaggugugagaaccuaauaaagaaugaaugaagaugccucuuagagagacuccauuuaucuuagucacccugcucuucaggccugguucccuaacccccuaagagauuaaaauuagaggagacaaacccuuagcucuggguggcgacugaagagcaaccgcgaucuucccaaggucuugguccucugcaaguccaccagaaaccacaccacucucagugcuccgagggaauagcaaaagcuacucucgagauccggcuccugcggagaccggguccugacccaggccaggggcgggaccgcccggcagcccgcugcagcugccccucccccuccaagcgccggcucuucucguagagcucucggggcucacuugcuuuuuuucccgaggguccggguccccagguccuuccuugcccggagcccaccgccacucgccggcaguuaccugcucccucagaugcgcacaagaagcuauacucacccgccacaaccggugccagagccguaccucaccauccaaucagagcgcucugaugaaaagugacccgcuacgccuugucauccucugauaugauugguccacuggcaugccaaucauucggagcgcgaaugagcuaacaagccgguuucugggaaggcuccugggcucggcugaugcaaugcucaagaaagcuaggacauggagugucacgugacaggguugacuauuggcuucaggaggcagacauuuuggguucuauuggcaaagcccuaauaguugacaguuaacaagaggaaugaaaacaugaauuugguggcgaucacagauuuuggcauagaacuguuuaacugcaaagugauacacguaccucaaagguucguuuuucggccuuuugaaacggagcaagguggucuugaaaucaggggauuugccagucuugcaggugugcaccaaucaaauguucuuauuguuaucgcguauagaucggcaugccuucuuuaacgguacccuggacugaaauaagugcuucaaccacgccgaagcgcuuuggcacugacugauacguccgguucucucuuugagacagggucuggauaaauuguccagguuggccuugaauuuuucacucuugucuuagccuccggaguaggaggcaguacaguccugugacauuaggcauagcuuuauauuuguccuucaggucccaauaagaagaaauucgggucuugauuuugaagaggaagaaaugacguaacccaaguuaaaggacaucugucccucuguuugcuuuagaaaacaagucaacauucuuaggaaacgccuacaacggugacgcacauccauagucccagcacuugagagccaagaggaucagagcuuaaggcuacccuugggccuugggcacagucucaaaauaacacacacaaaaccuaaaaucuauagguaaggcaucacacuaaaaaguucacacaccguuuaauuuuuaaacuguauuaucaggucugcuaguaccacuuuuucacagaugaggaaaccccaaauuacacgaaaacuuuuucaugauguacagcuuuacagaacaaagagagucauaagucaagguaauuuuaaaauauagugaugguuauaucugaaaggcgacuauagcaagauggaaagcuuuucuauagacccaagauguuaucugauggcaucuuuagcuuuuuggaugguggaagccaguggucugguaaguuaauagauuccaaaugguuucuaucuguuaguacaagacuuuauuaguucaaacacagaaauggacaaagaaugguuguuuucagaaggccagaacuaguccaagacaaauucaauuagccugugagcuuacgacauuccugucuucacaguacugaccucagaucuaaucagucaauuaguauccacagacauaguauagucucuuuccaguuuuuguucacagcuauauaccaagaccuugucuuuuuauuuuuauuuuuuccucuguuuuuacauagucccuggcuaucaaauaacucaacaaauaaaccaggauggccuugaacucacaaagauuugccugccucugccucccaagugcuagguuaaaggcccuugcaacaggaucagcuuuucuuuuuucuuuucuuuucuuuucuuuuucugucugucugucugucuguuuguuuuucgagacaggguuuuucuuguauagcccuggcuguccuggagcucacucuguagaccaggcuggccucgaauucagaaauccgccugccucucccucccgagugcugggauuaaaggcgugcgucaccacgcccaguuugcccagggugucauaaagagaugagcagagggcuagagagauggcucagugguuaagagcacuggaugugugccaccaccgcccggcaggaucaguauuucuuaaaauguagacacuacuccugugaaggaauuucuauucauaggucaauucaacaacaaaugacaacuugaaacuucaagugaccuggagaaggcaucuaugggucuuuggagagaacaugcucagugcgcaugcguaagcaagagccguucagugccccucuuaugauuggcugggaggagccaacuucaaaggcucagccaauggagcuucggcuugguuuggauugugaguggccguuggggaagccuaaccgccauguugcgccgcgauggccggagcugcuggccgggucgaggucgagcccgagcccgagcccaagcccaagcucggaauccacuuucccugccccugacuggugugaguaucugugcggguagcuuuccuuccguaccuuuaggcgcuuuucucgcugcuagaaagaaggcaggggaauaaaugaacgaguaaaagcuaaggagacagcggggcagugguggcgcaacgccuuuaaucccagcacuugggaggcagaggcagguggauuucugaguucaaggccagccaggucuacagagugaguuccaggacugcacagagaaacccugucucaaaaacccaaaaaaaaaaaaaaaaaaaaaaaaaagcuaaggagacuuaaccaccagcaggcacggagccccaggccuuuaauaugucccagaacccaaaugacugccuaccaugaguuagcaaacaggcugaccucggcaacacggaaauaaguacaggagacugaacuaaagugccuaauuggucuuuccucacacaccacuuuggacaucacguucuuucuccuuagaaguccucaacgauguuggggguugagucuugagagucuagaguuuuuuguuugcuuguuuguuuguuuguuuguuuguuuguuuuugaaacaggguucucaguaacagugcugccuggccuggaacuugcucagcaaaccaggcuggccucgaacucagagauccaccugccucuguuuccugagugcugggauuaaaggcgugugccaccaccgcccagcuuuuuuuuuuuuuuuuuuuuuuaaauagaaauaacacacuaaacuuaguucaggauagcaguuccuccugugaugguuacagaggcugcuuuugguauucuuuguuggugcucugaacaaucucacuagcccuaggcuagccuucaacucaguauauagccaacaauaaucuugaacuggaucuuucugcuuuuaccuuccaaaugcaaguauuacagggagaacugccugccuugacuuggagagggcuucagcugaaauuccuuguuuauguuugaguuacuagacauucagggucuggauuagucugcuaggcaagagcaccacuuucaauuccacguuuuauuucuuuauucccgugguagaagccuagguugugugugugaaugugaauguguauggguggggggacgggacugacugacuuuuaaauuacuuuuuggcaauuucauaaagggucuuagcaaucuggucacacacucuuuaaucccccucccauccccuagaaacugagguauuuguuaaauguuauuuccuuuguuguuuaucugaaguaagauuuguuguucuuuuucuggggcgaggccguugagacagggucucacuguuuauuauagucuugcgugguuuggaacugucaaccaagcuggccucagacucauagcgauccaccacccucugcuuccugggugcugggcucauuuauaauggcucacuuuaccacacugaggugugcuuuguuuugguuuugguuuccuuuugaugguauguugcagggaauaauaaauaaaggcaucugcccaugcuauccucagcuacucucaggcccuggggacccugcugcaucccauucccagccauacaccccgcuguggucagcgaucccaaaucccagcaacccaguaaaaccaaaacucuagaggcuuguaauuuauaagucagauuuauaucaguaaauucucaccccacagaaauguccacgcaauuacucagaaccaauugauauugauauaaauugcccaccuagauaagacaaacuguccuguaauuauccauuucuuauaagauauucauaguuaccuguggcuauuuaaagccacauggaaucuugaucgucucucuuccucuaucuucuuccucucuuccugucccggucuuggucucugaaacucuuaacuccgcccccuuuucccuguccaaucacaggcuucuuguauucauauuuaaauuaauuggggaggggauucugauacuguacauacuuacuguacauuuuuaaucccuaagcacucaggaggcagaggcaaguggaucucugugaguuggaggccagccuggucuacagauccaggacaaaggaccuguugaucaccagcucuuauucuccugcuuucagccuaucacugggguuacagguuucaccaccaugcuauuuauuuauuuauuuauuuauuuauuuauuuaugagauucugacucaaaagagcacauggaaauuaacuuccgaggauaaaaugaaauugcagaugguagugaugguucaugcuugcaaucccagcauuuugucggcugaggcaggcaggucacugugaguuagauaaaccccucauaaacagucccuguuaguugaguuucugauaacuuuaauacuguauacacaccuaugugaguuugguuuguuuuuguggaucaaguggaaccuauucuacuguauugcaucuuguguaacuuaauguuucacuucaauaaaaucuauuugaaauuuuauuuauaaucuucuauaguccugaaaaauacaaaauaacuuaauuguuuuuuagcugcuuuuccuugggguuucuucuaacuugaaauaugaucauggccuccuagcuggcuccugccuccaccccacccuuaccuauccaacauuucuugagguuaauuuauuaucaugggguauuaguaaaauguuuuuauaguuccaggaagaugcucaguuucuuucuauggaauacacaggauaaagaccuauuuaauccugguuagggggaagcagguaguuccuucugccuuuauuuuacuauucuaaaacuagagcuauuuccuuuuuaaaauuuccaaaauuaggcagggcgugguggcacacaccuuuaaucccagcacuugggaggcagaggcagguggauuucugaguucgaggccagucuggucuacaaagugaguuccaggacagccaaggcuauacagagaaacccugucucaaaaaaccaaaaaaaaaaaaguucggaaaaaaaauucccaaaaugaaggcugugaaggcuggagagauggagcagagauuaagagcauuuguugcucuugcauaguaccuggguuccauuccagguagccacauuguaaccaucuguaacuccacuuccaggguauccaacacuuucuucugacuagguaccaagcacacauguggugcacauagacaugcaagcaaagcacucauacacauaaaauuaaaugacuaaaucuuuaaaguauucauccaaaaguaauuaaauaaaaugccaacgacacaaccuuuacauaggagaggagagauggccaucugaagaaagcauagauaacgccagaggucauguauuuuguuauuaaacugcuuuuaccauuuccuucaggaacugaauugauuugauugagcaaaccgcuugcucuuucuggucucugauacucuaccaagaauuuuccuuggcaucuuccuuugguguucaaaacucaauuuggggcauaucauugagcaccuguuuguuucacgggacugauugucaaugcuuagacaucuuauuaaauugaaaagaacagauacuauuuugaccuuagcuaagagucugguaaggcacguuuacacagaggcauuuuaaauauccugaaaagguaaaacacuugcuuauguauucuggcuguaauaguuauaccagggccaucuaugccaccaugcugauugaaaaugugacuuuccgccuucgguccaagagcauuuaaugcuggcuaccucaguuggguuguaggacgaucugcagcgaagggugaugggugggaacccgaagaggacaguaguggcgcuggauccccggaccuuaggggcgcggagcugacgcugacucugacgacaccguggcgcgccguuuccggucug

SEQ ID NO: 4789 - RNA, 3785 nt, Mus musculus
caggccgcagcccaccaccagaucguacaucuccacucccgcgucggccagggcgagcgcggccgcggugagcgccgcggccagcgcacagccgccguccuccagcagcagcgccgacaccucgagcugagcacgcggguagcgccccaggcgcacggcgggcuccagagccuccuguagcgccagucccagcucgcgauccuccccgccgccgcccuggggcgcgcgacgccggcgaccggagaagggagcgcggcggaaaucgcagagcaggcgaccccggagggcagcgggagcuuccccgcccgcucccgcagggccgcugccgcgcucgccgcccucggccugccgcggaccggacacggcgcacagcaccuuggucccgcccgccuccagguaggcggagcccuuggccuggcucagcagcccggcgcgcgcguacaccgggcggagccgcgucgggucgcgagcagcgggcgucucgucgucuucggccgcguacagcugcggcggcugagacuccuccggcccgcggaugcggcgauggucucccggcauggcggcuaccggcgugcgagcuacuuccgccugcugggcugcccuugcgcacccggcucuuccgcucgcuuaaagaugcgcgcccgcgcagagccuaucgggagagcgguaggugugcgcgcugccaccuagcggaguggaggaagaacggcgagguauagcuggacuccuaugcugguacuuuagcuaguccuaaggaacggaucuguuguuauuccuagaaguuugcauucagacuguuucacauaagcuugcccaaggugagagguuuuuguuuacucgugcaauuaguccucuggcugcuucaacacuuguuuaauaaauggacgguaucucucuuuguacaacuagauauuucuaacacucugaggaacugucauaagcagacaguaucucugcuuccagacccugcuguuuguagauucauacaaauugcauuuuagggcugggccagggucuugaaccuacuuuagguuaaagcaguagggguggggcaguuaguaggacacaccuacauguucauacugccuauaucaguugucugaccucauaucagcagccucaaacaggcauguggacaggcaugguggagguuguccuaagagacuaagaacagugguucuccacuggaagcaacucagaauuauuuuccuccacccuucuauugaauuuccugaacuuucaggagucugggagucuauucggugauaccaucaaccagaaacaggcuggaaccguaacagauauacaggagccagggcucaccucaggacaagaagcagagcgcaugacaucaccaaguauugcacaugguccuuuuuauuuucugcagagaaaaggcuuccuuccucugcagaccuaaagccucaggcuggcagagugaccucaucuagaugugaucaugacguuaaaaagcauuccuggguagugauuuuagacagauggugcugacaugaaugggcucagagcaguaauggaggggggcaaugaaucacaggacagcuccaggcguguucccauuaccgcuggaucaggacggacagggcugcugagaggucccaugacuccaaugucuucguggcgggaggagagcuccuggcugaauucccgccuucggacaugucugguugauggcgaguugcuuucccgagagggcuucccucccaucaguucuucacaucucccagacggagcugggcaaaggagguagccagcugcagugcuuccugaaggcagcccacguucuugccuguggccugggcggacauguccuugccaccgccuuuaccauccaucaggccugaaaccugcuggacccacucgcuggcuuucaguccccgguuggcugcauucuaggagauaggaggggaaaaugguagucagaaugggauugaggggggaauggcaggcgcccccaacauccauuuguaucaugugugaugcuaccacagacuaacacuauagcuggcacaggagagcagcuauggcuacugccaaagugaggacagagagcaaagccaggcauuagccaggagugaagucuuucaccaaaagaaagcccgagggguaaaggugccgcaggaggcgacaaaugauagacagaucaacaguuucuagugaggacugcgugcacacaaacagucuuggcaaaugcugugaagaagcccuccuugaggagccacaggcaggguuucccacuggcauacggguuugcaggcuuuuagacugggacugugggaaguucugaccuggggaaccuggcacaagcacgugaucuugccagccucauuguccaccgugaacagcauggcagaugucugaggagaaugcgucuugaaaagcuucaacgcuucauucagggccuguggggagaaccucagguuaggucacuggcaagggagcccugcuuucuacaagggaagcugagaacucagcccucagagaaccaucccauuuccagcagaugcuguucccaggagcccaccaguggcaggacccugcccacacccuggcugaggucggccuccuacccccaggaagcuccuccuucucuggccaccggaucucuccagggcucagccuaacucuagaacugagcagugggccuuaagugaccacacagcccagauuuagagggcagcccggcccucgcggcuugccuuggccgaugcuccacucuccaucuccaggaugaccagcggcugguugggguugcugucaaucagcugcuuugucuucucuaacaccuacaagaagcccaggagagaggcuuaggccaagggaccagacucugagcccugucagccucugccuaggaaaaccucugggcgcucauccagcugcuggcacugccaagccuuacucgcuucugcacaucggcuuugcuggcccggucuaggucauccaugacuuucuucagggacuucagagucucucguuguucaucuuucugccacugggggaugacugcaguggccagggccuggaaccagaagagaagaccaucuggggucugggcuaauaggagguagggugaaauucaagcccacucuacccuaccccaccuucugucuuugaaccaaagucuuccauggccagagucugagaaaacagaaaaacacaaagauaccugcuggcuuuaagacuagucacuauauuaaugaaugcagcagccaucacuggacagaaaguagcaagauaaagagggcuuuccuugagaccugguccuuaccagcucugaguacagccugcaaagacgugcaggaaggaagcccagcauaccagaauacgagcuguucgagcgcaguguggauggcaugauauccuuucucaaacaaagaacuugacgacaccccaccacccccaguccccaacauguggcucauuuugcagagacaugcugaggccagaggacagcugcgaaucuguagccagccugagcgguauagugugguucaggcuagucugggcuauagaauaugacucugucuuuaaaaagcacaacaaauaaagaaacaaagaguuuaaaaacacagggagaaacaaacagagcgaagccauuccuaccucaccgaggucagcaauuucccucugcacguccuuguugggugcagucugggccuucacuuuggccuccauggcagagagagauuucuucaagguuucugacuuccugagagccuaggaagagaaccaucagagcucuaaacacuaggguuccuuuccuu

SEQ ID NO: 4790 - RNA, 45263 nt, Mus musculus
cuuacccuugccgcgggccguaaagcgcggaaggucgcaggccccccgcggucccggaacucugcgcuccgcgucccgccccguccccaugcccuggcccccuuuccggccggcgcagacccucuucagcggcugggcugcccuucacuuccgccgggcguugcugagcgcgcugcccgcgagucgcgggcccgugagguaggaagccggcuaggacccgcggguccgggcggccuucuggucccgcgaacucuugcgccccgcacgccccuggcguccgagcuuugggcuccggcucccggccgucccuccgggucucugaggcggugccaccggucgggcgccgggauugagccaguggagcugcgcgggccucggggagccgcgcccgccgucccgggacugcgcgccggcucucccagggcggcggaccgggccucggggcgggcugcggcucgggcgggcgcgcgcgcacugcugucacggccagagguggccccgcgucucugcagguggaaugguuucccaccuuguaaugugcggcucggcugugcuucaccgacuccugucagagaccuagucagggccgugggguuuccagugggugacuuggggugacaguugugugugaucccgaggugcgaguccacggucuccaagccuacuucgaacauuuaugcaaucuugauuuguagggaugaugaugugguagagggucuaguuauaaagacguccuuuaaggauccucuuuuuuuuuuuuuuuuuuuuuuuuuugguuuuucgagacaggguuucucuguauagcccuggcuguccuggaacucacuguguagaccaagcuggccucgaacucagaaauccaccugccucugccucccaagugcugggauuaaaggcgugcgccaccacguccggcccaaggguccucuuuuuggcgucagggacguguauaauuuuucuuaaauucucucagccaacggugcauuuguugaaaauuacagcauccugaacuugcaugaucaaacuguucagagggucauucuguugcuuguaaacuugcccuggugauuccuccgaguuaugugugggagaugcgucaauguacauucagccuucauucuuugugaccuguggcucaugcuguuaccagaggaagcauucaggaguuguuagaacugucccugugacugccuuuuaaagacagagucuugcucuguggccccagcucaccuggaaccugggcauuucuccuguuucaguauccaguguggugggaauuucaggugugagcacugcuccaggauugagcuuguugguguaggauccgagcacaaucagucugggucuuaaggcuguuuagaaguuacucuuacuaguagagauaccguuaauuuucacgaauuucaagaaaaugcaaaacuuccugaccuuuccuuugaaugaguuugcagucuucagugucuguuuuccuggcucuaccuccuuuuccugugaaacuugcuugcuuuuacugccagaccccuucaucacauuuuauuuuaugaguguuuugccuauguguacguuugugcaccauguccacgcuugauguccacaaaagucaaggcauuggauucacuggaacugaaguuaaagauuguuaccuccuugugggaguugggaaucaaacccaggcccugugcaagaacaguaacguucuuaaccacugagacaucucucuagcccucccuuccugguauacuucagucuuuucugcccucaucucuucacucuugaaggucaugaugaucacagagucaacauucuuuucuuggccuuaucagacugggcauuaaacgugcuuuguucuuuccugaaucuccuguuuguccuuuucuuccugucuugccgagagaucauaaguuuauugagcaaacagugacaaaggacugggcaugguaggguuucucagggaggaauucucuguuauguuucuuuccuguugcuauucucuuuucuagguagggaaagagcuucugguacugcuuuacagcuguuuggccuuugcuuaccuggauuucuuugaagcccaugcuuuuaaucccagcacugggggaggcagagacagguggauuucuaugaagucuaagcaaccuuggucuacauagcaaguucuaggccauuugcuacaaagugacacccugucuagaaagaaaggaagaaagagagaaagggaaaaaagaaagcaguaguaguauuaugauaaguggcucugaugcuagauuugcaguuuugucuuugauuauagaauaauaauuuuacauaauauacuuuauacauaaguuuccuaaaguacagaacagaaauuauguccacccuauaggguugugcuuagauuaguugauacuuaggaaguaucuugcacacuguaaccacuaacagagacccaaauucaggaccucauccuugcacagcugcugcuuuaaccacugagccaccuuccucagcccuauguauguuuauugagauagggucucauuuagccuaaacuuuuugggguuuuuuguuuuuguuuguuuguuuucugagacagggauucucgguauagaccuggcuguccuggaacucacuuuguagaccaggcuggccucuaacucagaaauccaccugccucugccucccgagugcucccggcauuagccuacacuugcuacacaguuuaggaugaucuugaauuccugcucuucuaacucuaccuucucacuguugggauacaguugucuacuggccuaggaguucucauuaaugagggaaugauagucuuuuucucucucccugucuccacucuuccaucaucucucuccuucaccccacccuacccccagcuucugagcuuggcuuugacaucaguuacccuuuuguauuguauugguuuuuuuguuuuuuuaauuuacuuuuuuuuuauuagguauuuuccuuguuuacauuuucaaugcuaucccaaaggucccccauacccccccccuuguauuguauuguuugauuuaggcuuuccacaaccaugugagauagauauuucuaaccgauguuaacagauagaaccuggcacaccaaaauguggucagaguuguacagguaaugagauguaaggagacuugauaucuuguguuuguagaucuuggauucccccaguggguugcugaauuacuacuucacucaaaugccuuacagauaauuggagaagaggaaaaguucugggagaaguagaauauccugggagaaaacagaagacuccuuuacucaaaggcuacacugucagauugguauagaauaggccguguucugaggagguagcuuugcucaguagacaaguggcaggaacuuugccagcuagagagacagugcccacagguccagggcauagaagagagaguuaagccugacuuguuugagggguggagguggggagaaugaauaugagaauguauagcggggcggggagaagagggaagagaccagaaugauuggcuuauauaggaaagagccucuggggaaggggaaucccagccucuggguugggcaguuaagauagaagacaggcuaugccagguagggacugagggaugcuacgaggguuaaauauuccccucagcuguuuguuccagaucugaaucccaauaaauacaucauagacuugcucacagguuaaucugaugggacguuuucucaguugagguucccccuucccauagacucuggcuugugucaaguugauauaaaaccauccagcccaagggucuuucacaagcaugaccaaguggcaaugguugauaauggaauaagauggccagacaguagaacagguaagauaauucuccaguugagaguuguguuuccauugcagguggagagaauguuaguaaagggguguguauuuaacuuagaaauguagccuagagggccuuguggagaauuuaaggugagguugggcaauagaaaguuuuaugaagaugagacuucagaaaacugcucauguagagaaguuuguaucuuuguuuuuguuuuuuguuuuuggucuuggauuguuuugagacaugguuauauggaucccagguuguucugcaauucagaauccugcuuuagcuucccaagugcugggucuuaguuguguguugcuagaccagacugacacccuucagauagaaccucauaggaagcagaaauaauaacugauuuccacuugcaugagauuucucucuacacccugucugccaagauuguaguucugagcacuaagagagauggccaguuaagaguauuagcuguucuuagagggccgugcuuugauucucagcacccauaggguggcucacaaccauuuguaacuccaguccuaguggaucugacacccuauccugaccuccucagggaccacacauacauauggcacacagauauacaugcagacagaauauauguaugugugcaauauaucuuuuuuuaaaaaaagauugcaguucugagaguccucucugauagugugugugugugugugucuuugggcuuagaggacauagaccaauggggagucuaaguccagaugcuggugguggagguggcggcagcuuuauugcccugauucccacauaucugccacccugugucuuaaucucuuuaaugcuggcguagucugccaguaggucagccuuuaguuucuugagacuugacaguauuccuguuagauuuuugccaaaauccugcuuuuuuuuuuuuuuuuuuuuuuuuuuuuuuucugagacaggguuucucuguauagcucugguuguccuggaacucacuuuuuugaccaggcuggccucgaacucagaaauccgccugccucugccucccaagugcuaguauuaaaggcgugcgccaccaugcccagcuaaaacccugcuuuuuaaauuuucagccaguagugacuucuuguuuacuggaccaugccagaucaaauauucagagucccuugugguuggguucuuccuuuaguuccuguacuugagucuguauuaccguccuaagucagaucuguucuguugucuuuaguauguguguuuucuguuucuucuucuucuucuucuucuucuucuucuucuucuucuucuucuucuucuccuccucuuccuccuccuccuccuccuccuccuccuccuccuccuucuuuuuccuuuucuuuucuuuuuuuuuuuuuuuuuaaagauuuauuuauuuauuuauuauauguaaguacacuguagcugucuucagacacuccagaagagggcaucagaucuuguuauggaugguugugagccaccaugugguugcugggauuugaacuccggaccuuuggaagagcagucgggugcucuuacccacugagccaucucaccagcccuccuuuucuuuuucuuuaaagauuuauuuaacuaggcagcgguggcgaacgccuuuaauccuagcacucgggaggcagagacagguggauuucugauuucgaggccagccuggucuacagagugaguuccaggacagccaggacuacacagagaaacccugucucaaccaccaccaccacccccccaaaaaaaaggauuuauuuauuuauuauaugugaguacacuauaguugucuucagacacuccagaagagggcaucagaucucauuacggaugguugugagucaccuuuggaagagcaguuaguggucuuaaccagugagccaucucuccagccccuguuuucuaugucuuugucucuguccaaacaucaccccuccaaggcucaacuuacauccuacuuucaguaugauucuuuccagccauuaccuuuuucuuuagccuauuagauuuauuaucuuguagaacuauguacgacuuguguguaaacaauaagauaaaaccccuuuccuucuuuccaugaaaaagugucuaauauuugaaccucuaugcuugccucuuucacugggcucugggucucgccucuugucuuccuaagcacuccaugcuuuguuaaugcauuuuucuggcucuucagcugcauuauucacaccagaaguggaacauucucuuuguuugagacaagucucucuuuguugucaaggugcuuugaacuugagaucuuccugccucagccucuggagugcugggaucacaugugugcaucaucaugaguggcugaauucuguccuuucugcuuccagaacaauauguucauuuuccugacuuaucugccguguucagucucagccacugugaugcuggacugcuggaggaucuuccuuucucaucuuuuucuuucacucaccauccucucuccaccguggagccagacugaccuuugaaaaucaugcacgaucauuugauucccuugcuuuagugauuuuguuuguuuguuuauuauggcauucaaguauuauagaauugacuccugccuguuuuucucaggcuuaagcauuuucccuuccaucacuauaucguagccccugccuucauuuuuuuuuuuuugguuugucuuauuuaagggucuuuccauauacuuaccguucugucuaaauauucauauagcuguuuucuuuucaucugccgauguuauugccaugccucaccuuccugaccgucccacugcucuuccuuauucuuuuuuuuuaauggauaauagguguugaacucagguuauaaggccccauuucaaagugccuucacuuacuaagcccuuacauuucuuucugucuaugucugucuguuucuaucuuuagacaagaucgccgaccccagcuggcccugaaaucccaguguagcggaggaugaccuugaacuucugcggagccuccuguacucacuuuaggucuauaggcuugugcugcuaucuuccucucucucucucucucucuguguguguguguguuguuuuugagacuuggucucuuuguaguccuggcuguccuagaaaucucuauguagaccaggauggccuugaacucacagagauccuaccuccagggugcugggaauaaaggcaugugccaccaugucuggcuuuuuuuuuuuuuuuuuuuuuaaagcagaauuuggaacauagguuuucaaauauaugucgcauaaagggcuauuguucuauguuaaaucuuuuucucauuaguccugagaacggacuuacauggaaugauuuuuuuuuucuuucuaguucauauucuuuggaucuucucagcugagugaaaacguaucuuccagguggugaugcuuuaccgguugcucucuauugugcaaagacaaaggacuagcccaggauggcagaccuggucaucagcgagaagcagcacguccacugcggaggcacauucuauugcucugccugcccaggcccagguggucaucuguggagguggaaucauggguacauccguggccuaucaccucuccaaaaugggauggcaagauauuguccuuuuggagcagggcagguaaggaucaaauugacuugccuugggguuuggcugcaaugacaguauagggcuuugucacucccugucuuuuucauaaugucauccccauagcuaaucuaaauguugcucacuagugugagaagacccaaggugaaaucugcaccguguuuagcaagguucuagcacucauguuuucugcauuguagagagguagcaagcaaauuucagcagagugucuuaaaaggacaagaauucacagccagcucaucuuccucuguugucauccucuuuacacaguacaguuguaucuuguggucaugagcugaacaaaagugguuacauccugcccauguucuuuuacuaauuuuuguuugacucagucuaguuuuagauuugcagggcuuaagagacagcccagcaguuaagagcacuggcuacucuuccaggggaccaggguuugguucccagcacccauauggcagguuguagccaucuaccuaggucauaggugggucuguagcuccagauccagcagaucugauacccucuuuuggucucuagucaugaagcacacauguguuaugcagauaugugcagaaaaaaacacccaaacaaguaaaaauaaauacauuuuaaaaaauuaacaugguagaguucauaacugucuguaacuucaagauaugacacccucacacagacacacagauauucaugcugacaaaagaccacauaaauaaauuauuaaaaaauuaaaaauaaacuauuguauaugugugggguauauguguaugauucucucaucuaccuuuguuuuggggagauggguaaggauuuucuuuaagauuuauuuauuuuguguauaugaacacacuguagcugucuucacacaccaaaagagggcaucagaucccauuacagaugagccaccaugugguugcugggaauugaaauaggaccucuggaagagcaaucagugcucuuaaccucugagccaucuuuccagcccaggauuuuuauugugauuuuguguguguguguguguguguguauacauacauguacaugagcgcaggugcacagaggcgucaaauaaacaggaguuaucaggaaguugugagcuaccgaguggguucugggaacuaaacucgguuccuuuagaagaauaaagguucacuuaacuacugagccaucuccccaggccuuuguuuuuuguuuauuuuuguguguauggcuauuuugccuacauguaugucuauauauagcacauacaugccuggugccuguggaggccagaagaggguuacagauggcucugagcaacugugcagguauuaggaaucaaaccgagguccuaacugcuaaggcagaaugucacuggaacucagcgaucugcuugccucugccucuagagugcugagauuaaaggcgugugguuccuugccuagcugggguuauagaugauugugagccacaauggugagccagugugugguugcugggaauuagaccuggcuuuuguaagaacaaccacugcuguuaaucagaugagacuucucucaucuuggagccugaaauuagaucuacagauacaagugagucuuucuuuuuuuucuuuuuuuuuuuuaagauuuauuuauuuauauguaaguacacuguagcugucuucagacacuccagaagagggagucagucggaugguugugagccaccaugugguugcuaggauuugaacucuggaccuucggaagagcagucgggugcucugacccacugagccaucgcaccagccccaagugagucuuucuaacagaauuuugcaucuauguugcaggcuggcugcuggcucaacaagguucugugcuggcauccuaagcacugcuaggcauucaagcguugagcagaagauggcuaacuauucaaacaaacucuaccaucaguuagaacaagaaacagggauccaaacagguaagcagauaaccugcuguuuauugcucuuccugucucuacacccuuacucaguaguuacugucucugguucuguacucugucggaucugaugauuaagacuuguguuggagggggcacuggcugcucuucagagguccuggguucaauucccagcaaccacauggugacuuacaaccaucugugauggacucugaugcccuuuucuggugugucugaagacagcuauuauauaugcauauacaugaaauaaguaaaucuaaaaaacaaacaaacacauuuguguuggaggauuugccaagccagaguguuccuuucagcaggucauguagcuuguuuucaccuucuuuauguacaggaugaggagauugcagucaguaaucccaggucauuuucagagucuauaacuuuuuuggugggaguagagaguguauugcacucagggccugcaaauccuaccauugccaugauaugaaagucauuagcguauuucacuuguuuaaguauaguaaauggaagcacuuagcucuuaaacaaagagaaggagacuguucaagugcuuagcaggagcagguaaaucauagcucaacucauaaaacucuaccgauuaauauuaugggauauggaaauauauugucuguguaguuaggggaaagaagacuuagaauuauaaauuaaguagcucuguaauaguacuggagcuagugaggagaccagcuaggggaauguagggagacugucugaacuguuuggguccaggaauugcccugcaaaccacgcaaacacugaccucaauuaaacagggaugguuuauugaaugcacaccccaagacugaucagccagggcaacagcucaggcuggagagcugaauccacaugguggacauuucucagggccagccuauaaaggcuaaagcuguaaaacccauagugagcgcauaucagguguagaugcuggaagugcugccugguggccagcccugacucaagccauuuuagacauaacacuuuauauugaccuuuaauuugaugggacuuaugugaagcuuacgguuguggaguguaagauuaauaaaccuuauaacacacagaacauaacagugguauguagucagcauaacugaacuuggccaccuaaggcucugaaaugaacuuagugaaaguaguuccacaacauuguccuugguuuuuuuguucuuauugaauuuuccuuuccuuuccuuucuuuuuuucuuuuuccuuucuuuuuagagacaggguuucucuguguaacagugguccuguaacucgcucuguugauaaggcuggccuugaacucacagacauugccugucucugccucuugagugcugggauuaaagguuugugucaccacugcccagcuauaauuuuccuuuuuuuaagauuuauauauuguaugucugugccugucuguauauguguauguacaaauaugcauacauacacccucagaggccagaaaagauguuugcuuugugcaggacaagugagagauucuccaguuugguuggacugaaucugauggcagcguacagugcuugagucaaauguuagccaguuugagucagaugucuguagggcaggugagagaugagugagccuggcauuagauccaggucacacacagaugagacacacacacaggugagagaugagugagccuagcauuagauccaggucauacacagccuagaaccccuuauugguuugucuuuuaugcuugugaggcagcaaagacauggagaauagugcagaguuaggcagggguguaggguuuugcuuuaaccuguuguuuucacugcaguggaccaguaauggaugaaaggaagccgggaacgucagugguggggagcuuucugguuuuuuguuuguuuuguuuuugagccacaguuucucuguguagccuuggcuguccugggacuugccuuguagaccagguuagccuugaacuuagagauccaccugccucugagcgccaggauuaaaugugugcgucaccacaccuggcugagauucucuguuaaacagcguacaugggcuugugaaacagcucagaggguagaaaugcuugcugccaagccugacaaccugaguucaguaccugggauccuacaugguagaaagagaaaauugaccccuacaaguuguccucuggccuccgugaaaguacagugggacacauaagcucccucugccaaaaacaauaaauaaaaauguaaugcguuuuaaagaggcagagagcaguauacguguguaagcuaccaugauacuugcugcuguauuuuuacuuuuucuauuacuuguguguaugauaugcuuguguguauguguggugauucccuuuaggcuucaccauaugcgaacaaaacaauccaggaaaagauaagaauaaaauucagcucaagacuuccagagucugacccagaucauuguacuuuaguuauauuuaagcacaguacaauuuugggaaaaagucuuuagauaacaauuaauuccguccuaaguacacaauuuuagacaugucuacccugggauucuuuacaaagaacagcuagcuuauuucacaagaauggggacuguugacucagagauagugcccaugauuuagggucugggggucuuaagugagguaaacacaacacccauaggugucaggauugucucgacccuaagauauagaaguucucucagcugcuguacagcacaagugacgucacuuagaagaaugggcucugcagugcucaagaucugggcuaaguaaaaacauaaauucugggagauaugggcagagccugucuccucagucagcaaaggaucaccagguuguaaaacuacaucauucguggcauucccgggagaguagcuacgcaucucaucccuugacaagcuaagcaguaacuuuccuggcuccuccggugcuguccgugugcacaaggccuuucgccuucugcauguaugcagaggucagaggacacucucgagaguugguucucuacuuguaguuuguugaggcagggugucuuguuugugccauucuagguuagcucacucaccagcucugagaaguucuucugucuucaccugccaucuugccauagaaaugcugcaauuguagaugccagccagugaguccaacuuucuauggcuccagggaucucacuaagguuaccagguuuccgcgacaggagcuuuacaaccagugaagcauccugccagcccauugucuguuuuuguuauuaaaguugaaaacacguauauaaucuaaauuuaaugagaagacugugaccuuggauuccuaauccucuugcugccuucuuccaaguacugggauuagagaugucugccaucacaaccauaguucuuccaauggcaugugacaggauuuugucaaguaaguggaacacgaggacuaaaagcugauaguuuuucagugggcugaggacguagucuuugacugauauaugugaagcucuaaguuugauucuuaaaaguguagaaaauaaaaauggaaaguaacagucuuuacugauuuaacaguuuuaacaagcaccaacucuaucugacucuaauuccuggguucuacaugauaggggagaauuagcucuuccaagcugucuucagaggcccguguguaggcucuggaaugugagcauccacaccaaacaaacaaacaaacaaacaguuuacuuuuauuuuuaaaaauuaugugugugggguauguguacaugaguacaggugcccauaggggcagagcaguugggucuccccggagcuguaacugagugugagcccugaugugggugugggagcugagcucagauucuuuggaagaggagaaguacacgcccuuaacugcagccagcucucuauccccaaauaaauauauugaaagcuacuaucugcugaauguuugcaaaagaaauucagaaaaauaaagcuacugagauugauaggugggaaacaguauauaacagcugcaaucaggaaggguagucuaacuuucaauaauuuugguuuuaaaaaucauguaggacaggagaaguguccugaguucaacuaccagcaaccacaugguggcucacaaccaucuguaauagaaucugaugcccuuuucuggugugucugaagacagcgacagugaacucacauuaaauaaauaagucuuuuuauaaaaucauauguaguugaguuuaguggugcaugccuucaguuccagcauguggaaggcagaggcaggucgaucuuucugaguucaaggccaggcuggucuacugagggagguccaggacagccagagcuacauaaugaguccccugcccccaaauuuauauagauauuuucaagauuaauuuuuuauguguauguccugguuacugcuguauugcggugaguagacaucacgaccaaggcaauuuauaaaauaaaguguguaguugucaggaaacauggcagcaggcagacuggcaggcaggcaggcaggcaugguacugggcaguggcugagaacuugcaucugauuugcaagaugaaggaagagagagugugagacuugguguaguguguacuuucuuaaaaccucaaagcccaacaaccccaaugacacaccuucuccaacaaggccacacuuccuaauccuuccuaaauaguucccaacugggaaccaaauucaacauucaaauauaugagucuuugaagacccuucucauucaaacugccauguuauaugaguauuuugccugcugcaaguguguauguauguauauauguauauauacauauacacacacacacacacauacauacauacauacauacauacauacauacaaacaauguaugugccuggugccuguggaggccagaagaggugguuggaggaacuggaguuacaggugguuguaagacaucauguagguucuuggaacugauuguggauccucugaaaagaguaucaagagcuuuuaacugcugagcuaucucucuagcuucucuucugaaucauuuuaacauuuauauacucaaauauauaaagucuugaaagaugggaagagaccaacagaauuuuaaguggguaacuauuauacucaaguaagguaaaagaauuagacuagggaguuuuuguuuuuuguuuuuuuuaaaugguuuuucgagacaggguuuuucuguauaguucuggcucuccuggaacuuauuuuguagaccaggcuggccuugaacucagaagucugccugccucugccuccugagugcugggauuaaaggugugcgccaccaugcccggcugacuaggcagcuuuugaccaugguauguuuuuauuucuuuuuuuuucuuuguuuuuuguuuuaagauauauuuacuuauuauaugucucauuauggaugguugugagccaucaugugguugcugggauuugaacucaagaccuucagaagagccguuggcacucuuaaacacugagccaucucucuagccugguauguuuuuauuucuauggguuguuuuguuuuguuuuauuuccagacaggguuucucuguauagcccuggcuguccuagaacucacuguguagaccaggcuggccuugaacucagaaauccaccugccucugccuccugaguguugggaauaaaggugugcgccaccacgcccagcuuauuucuauguuuugagcuggacuugaacucgggcuccagugacccucuuaccacagcuucuugugugucugagauuggaauaugcccauuuuugaccaagguauuuaaacuguucccucuuagccuaaagacagauaacauuugauagaacugacccuuaauuagcaguuuuguuuccugaggauauguggacacuucuguuuuuuucugucuauccucaaaugcagcaaaugaauaauguaugacaguaacuagagaauaaguacguuacggauaaagggaagcaggcauuugguguugcaaaaggaggccauauuacuuguugcuggugacagaaugccugacaagccacguaaaggucuguuuuaguuuaugguuugagcgcacagauaguggcuacacaagagugaggaaggcaugguggcaggagcaagaggugacuugucaccucaccuugagucuacaguuaggaaacagaugaguuguacuugccuucuuuuuguuuguuuguuuguuuguuuuguuuuuuucaagacaugguuucucuauauagcuuuggcuguccuggaacucacugugaaagaccaggcuggccuugaacucagaaauccaccugccucugccucccaagugcugggaucaaaggugugcgccaccaccgccuggcuuacuugccuucuuuuuauuuucuguggaaccccagcccaugggaugguguuucuaaguagauaggccuuugaucuuuuauuaugccucccuggaauaaccucacagacaucucaagacguuugguuucuaggaaguucuuuuuuuuuuuuuuaagauuuauuuauuuauuuuauuuauaugaguacacuguagcuguacagaugguuguaaaccagcaugugguugcugggauuugaacucaggaccuuuggaagagcagacagugcucuuaacugcugagccaucucuccagcuccuucuaggaaguucuaaauccugucagguugacaaucaagauaaccaguagguuaaaauaccuagagaggcuguagcucaugcuuguaaucucaguguuucggaggcugaagcaggaaugaguguugcugugaauuccagaacaacuuggauuaaagaguuagacuuuguuuuaaaaacagaacagggaguuggagagauagcucaaugauuacugcauuuucugcucuuccagagaggagagagagagaauaugagaauguaaccaugugggccuuuucuaugccagccccaguuguuuuuuuuugguuuuuuuuuuuuuuuuuuugguuuuucgagacaggguuucucuguguagucccggcuguccuggaacucacuuuguagaccaggcuggccucgaacucagaaaucugccugccucugccucccgcgugcugggauuaaaggcaugcgccaccaugcccggcucgccagccccaguucugaaugacacugaggcuuauauucauuuaugaaugccuaggcccuguagcucgcauuguuuuucacuagcucauaacucaguuauccaguuuauacucuccuaaguuuugccacuugacugguugccucuccuuaguuucauccauccacaucuugguggcugacucucccaugccuuucucucucccagaguuccucucucaguccagaagucccaccuuacuauucugcuuuuugcuauaggccauagacuuuuaaccaaugagaaggugauggagaacaauguuuccaaaauacuagggcaggagaugcuuaacaauaccaaaauuuuugucuacaaucagaucucugcugggucagaaaucagagacagucguuccuacaugaaaauaguaucccuacaagagaaagcuggugaaauggcuugauagcuaacacuucuugcugaacccauaguagaaggagagaacugaccccugagaagguuguccuccaacuaucacacacaugcugugacauuuguauauccacucaucuauauacauuaauaauacuuuuuuugagauagggucucacuauguagccuuggauagacuugaacuugcuauguagacccuacuggccuugaacucacagagauucaucugucucugccuaccaggugcugggauuaaaggcaugugcuaucaggucuggcuauaaaaauuuuguuuuaaaaggaaaaaaaaugaacaugaaagaagaugagcuagagauggcauugcaucuugguuucagaaaaaccuucccacccaagaggaaccaaaacguauuaaaucacuuaauuccaggaaacuuccagcuacaaaaaggcuagggagcccagacauagggaagaugaauaagccguccagacauuacugcuucuccaggggaccagaaucuuccaggcauucacccgcuugcucaagacuaaauguuuuaagaggguccacuugccuguguuuagauagcagcuuguuguuuggcuguacuggggaaggaguaugaaucugacugccucucugguaaacaauguuaggaauggcuuucacuaaggaguguacucccaccaugacugaaagggaaacugaaugaagaaaggaaugagcucucagccuaguaaacuuucagccauaguagcuuucauuaucauuuugaagguuuuuauauauguuaggauucuaguugacucucacaaagcugugagcuaagaguaguuaugucucuguguuuaaauuuugcuagaugauucauaauagguauaaccuguuaaucuaguggaucccauuggacugcucauuugauugcuuuuucucacagguuacuuaaggacaggcucaaucucucuggcccagacucaggaccgguugaucucucugaagcguaucaacucaaggcugaaguacguaagaguucuauauacucuuagacuaaggacuacacaccccuccugacuuugccacagagcccauaacaguagaauuuuccccuguguucuauggcaguguuguagguaucccuucugagaucaucuccccgaagaaaguggcugaacuucacccucuccucaaugugcaugaucuggucggggccauguacguuccugaggaugcaguaguguccucugcugauguggcucuggcccuggcaagugcugccucccagaauggugagcagguuucuguuuguuuguuuguuuauauauuggcuaauuauuauuguuguuguuguuauuauuuugcaugaguuuggguacuaagaccagcuuagguauggggaaagaaagguaugagauauuauucaguuuuccaguuuugaccacugcacugugucaaaacuggaaaacugaauaauaucucacacgaacacugaucucagucauacagggaugauuuauugagccuacaccccaggacugaucagucagggccaggguccagauucgggaacugaaccaugauccugaauuaagauucuacaggguuuauuuauuuauuuauuuauuuauauuuuuauuuuuaauuuuuguuuuuuuuuuuuuuguuuuuuuuucgagacaggguuuuucuguauagcccuggcuuccugggcaugagaaaguuuccuaguaccagcagaaacauaugagaaagucuccuuggaauguuaggcuagccagaccuuaaaauucuaccuaggccuuuaauauuuuaccuggacuuuauuuuaccuagacuguauuuuuaaauaguauccauuuguucuaaggaccuaccugugcugauucauacaugucagacuuacgagagucccugcucuggacuugagaagugccaaggcaagagaaugauuggggaguuuaaacuagagcuuaaauaugacccagaguaaaccagaaaaggacucgguguccagaguguuacauauacucucucuauauauacacucacuauaguucugagaauuggacccagugcguugggcaugcuaggcagauguucuauuacugagcuguauugucuuuuguuuguuuguuuguuuguuuugaaguaggguuucacuauguagcucaggcuggccugagacuugccauguagccaaaccuuagacuccaaagugcugagaucaccauuguaugucaccauacuaugcugagguucuguuuuuaaauuaaauuauugacucagcuucuucagugccuuuuuggaguagagagucugcuucagagaacuuauuuuuugguuuuuugagacagaguuucucuguguagcccuggcugucuuguaacucacuguguagaccaggcuagccuugaauucagaaauccaccugccucugccuccagagugcugggauuaaaggcaugcgccaccgcgcccggcgagaacuuaucuuuuuaaaaaaacuuauuuauuuauuuaauauauaugagugcuguaucugaauguaugccuacacaccagaagaggucaucagaucccauuacagaugguugugagccagcuugugguugcugggaauugaacucaggaccuuuggaagaacagucaguguuuuuaauggcugagcuaucucucuagccccccaagagaccuuaauuuuguaacaucaaauaauuugccuuuuuuuuuuuuuuuuaaagauuuauuuauuuuuguuuuguuuuuguuuuuccagacaggguuucucuguguagcccuggcuguccuggaacucacuucguagaccaggcuggccucaaacucagaaauccgccugccucugccuccugagugcugggauuaaaggcaugcgccaccacgcccggcuuaaagauuuauuuuauguauaugaguacacugucaaugcucuuaaccaguaagccuucuaucucuccagcccuugccuucuuuuucuuuuuaguuuucugcgacaguuucuuuauguagcucuagcuguucuggaacuugcucuguagaccagguuggcuuagaacucccagagauccuccugcuucugccucccaagugcugggaucaaaggccugcaucaccacuguguggcuaauaauuugccuucuuuuuuucuuuguuuugaaauagguguucagauuuaugaccggacaaguguucuucacguacugaucaaaaaaggucaaguuacugguguggagacagacaaaggacagaucgaaugccaguauuuugucaacugugccgggcagguagguugguaacugggucuaugacuuaauuuaaaucugcacuuuuuacuguagagauacaagguuaucauuuuacugagauacuauacugcuuauuuggaguggguaauccagagcuauguucuaaacacaaaccuaguccucagauaugagcagcuaacaguagacucccacacugggugaaguaguguacugucuuagucagaaggcuacugacuguguuucuguuccucuucucacccacaaacuguccauuguagugggcauaugagcugggucuguccaacgaggagccgcuuaguaucccgcuacacgccugugaacacuucuaccuucugacucgucccugggacaccccucugcagagcaacacaccaagugaggacuuguauuuuuuuuucuuucuuucauucuucuuuuaaaaaaauaauuuuaucuccucgcuagcuaguauccuguccuuugaaaggaaaacuucauuaaggacauauuaugucuagaagccuuucuuucuuuucuggagcauguuacagggacguggaucccauucuaaauuuccuuugauuacuucuuaggaaaagauagccagaauggagaugccaccaagaauguucuugcuuuuugauuuuuguuuguuuuugagacaggguuucucuguaauaacccuagcuguccuggauucucuuuguagaccaggcuggccucaagcucacagagauccaccugccucugccuccugagugcugagauuuaaggcgugugccgccccacuuucuugguuugauuuuuuuuucugaaagcuuauuuuaaucccuaauauauaugguucauugagaauuuggaauauacauuuugugcuuucaucuuaaaugguaucaguuguagaaguguauagguaguccauguaccuagugguuuaaugguuauaagccacggaaggaagaaaagguggggcuauuuuacuccuuccuugcuuggccgguaagucucucugucugccuuccuuucuuuucuucuucuuccucuuccuacuccucuucucucucucuccuuccuuccuuccuuuuguuuuggggcagacaguagccugccuguccaccaauucacucuguaaaccagacuggccuugaacucagagguucaccugccucuaccucccgaguguuaggauuaaagguguguaccacuacugccuggcuuauauuuuauuuuuuugagacagagucucauuguguaguccuggcuggccugaacucacuguugugggcuuggaggcagaggcaggcaugcugagcuuaggaggguuuugauaucauuucagggaaugaacucugcaccuccccuuucuguuagacuuuggaaaggcacagugccaccauaguuuaguuugauugugagguguuggcaaagcguuuagguuccugguaauguuugggauaaucagagaaacaaucuuuucuguaaucuugagugggaagauccuucccccugacuuccaaugguuuuccuuuccuuuuuuuuucuuuucuuuuuuucgagacaggguuucucuguguagcccuagcuguccuggaacucacucuguagaccaggcuggccucgaacucucagagauccaccugccuccuccuccaaagugcugggauuaaaggcgugcgccaccgcugccuggucuucaguagaaguguuuuaauggaugccuguauuuauuggcugcugcacuguugguaaggcagucucuccaucuaggaaucuggcuggucucuaaccccuuguuuuucuccuuugucccacuucuuuguugcuucucuucuucagccauuguggaugcugauggaagaauuuacauuaggaacuggcaggguggcaucuugucuggaggcuuugagaagaaccccaaaccuauuuucacugaaggcaagaaccaguuggaaauucagaaccuucgugaagacugggaucacuuugguaugugaagucaauuauaacaacagugucgucuacuuaucuaagauguuacauuuuucaagguauuuucaugaguaguuauuuaucuuuaagacagcuccagcugggcggugguggcgcacaccuuuaaucccagcacucuggagccagaggcaggcggauuucugaguuugaggccagccuggucuacagagugaguuccaggacagccagggcuauacagagaaacccugucucgaaaaaccuaaaaaaaaaauaaaaagaagacagcuccagaaaguacaauaguaaucaugaaggguagucuagcguuugccugaacuaaggauaugguuacugguuagcucauggaggcaggggucuacaggcugaaugagcuugacugacuuauuuaaaucacugcugaagcuuuagacuagaagggggacuuucuuuuaguaagacuuaaugaaauugaagagguuucuacaaagccaggcuuggugugauguauuccugcuuguaaucacagcaugugggaggcugaggcaggaggauuguaaaaguagauuauuuugcugauguggucuuuauuaagacuuaaaauaauucugucuuuuuuugaauaauuauuguaguuacaugguuauaaaucgaaaggauaugaaauaucuccuaauuuuucuuccauccuugguggguuuuuaaaaggacaaauugcugcuuaugggaaacuaaacccuugugcccaucagccaguuaauccuguuuccaucuauuacugcuguccaaagggacagugggcagagauaguguagaacaaaugcaaacuuguucuuacauccaucucacuguaggaaacacugucuuucauggagaccuucccacaggccuugaccccuucaagauuacugcuugucaccuucuguguuccuuuuguuguguggcuccuugccuuuguaaaguaugauuuucuuacucugcaugccaggcauuuuguagguguguucuguaauucuaccaauuuucgucuuucugauaaccaaaugacucuuagaacggucuccucuaaagaaaggaggaguaaaagguauaaguacuugaagagguuuaauucccuaaaggugggacuguuuggguuuguuugauugcucagagccccugcugaguucccuccugcguaggaugccagcauuggagacucuggagauuuugaaguuggugaauugcccugagaccuucacaccagacaugaagugcaucaugggcgagucuccuguaguacagggcuacuuuguccuggcagggaugaacucugcuggccugucguuggguggaggagcuggaaaguaagucuuuuuuacguagagucaccuguggaugcuuuagcuugcuagguucuuccuuuuuagaguauucauuguuaauaugucugugaccagauaguaauguaaauaacaguguauuaucuucaagguaauuacuucauccauguuccauaaauguuacugaauauaauauuuuaguaacucagucauuaaccuguggaaaaaacuuuaauauuucaguuucuaccaauguuaauguuuugauugaguaagguuagaaguagcuagguaugguaagugaaauaggcaaucaagguaggcaauuaaauuuguaguuuaacaauagguaguuaggaaaaucccagcuggggaagcagaggcagguagauccuuacaaauuugaggccagccaagacuucauagaaagacuuuguuuugaaaagaaaaagauaagccaguuacagaaggauacaaauacuguacaauuccacuuaugugaggcauuuaggguagucauagaaacagaaagaaaaauagugguugccgggggaagagaaaauguggaguuauguuagauaggucugcugucucaguucugcaggauggaaugagcgccuaaguggccugugagagguuacacagcagggcacgugugcuugaccccacugugccacacacauguaguagucaaucagcuguaagcuuacagguccaacucuugggaggaucaggaguucacggucguccucagcagcauaggacacuuuauucucagguuaaaaagaagcugauuaucuggaugugguggcacgugccuguaauccgcuuacuuagggaacugauggaagaggacuguagugagcgaggccagacuggacacuuagugauuucuauugagccuggguuaagagugagaaagggaggcgguguuugggggacuuuugggauagcauuugaaauguaaaugaagaaaauaccuaauaaaaauauauauauauaaaaaaaagagugagaaagugggacccaacaugguggcacacaccguuaucccagcauucagaggucagaggcaaguggaucucucugaguuugaggccagccuagucuacaaaucuaguuccagggcagccaggggugcuucauagagaaacucugucuagaaaaacaaaaaaccaacaaauccccccccccccauaaaccuaaucugaaauuuuuacauauuacaauauaugugcguguauacauugccagucgacagugcuuacuuaugugcaucugauacgccuuuuuuuaaagggcguucaagacagaguuucuucauguagcucuggcccucuuggaacucacucuguagaccaggcuggcuacagacucagagauccuccugccucugccuccuggaugcugggacaaaaggugcauacuaucaccgccuggcuccuuuuuucuuuuuuuaaugaucuauuuauuucuacuuuaugugcauuggcuuuuugccugcauguuugucugugugugggugucaaaucacuuggcacuggauugcagacaguugcaaguugccaugugguugcagggaauuggaacucagguccuguggaagagcaaccacggagccaucucuccagcccaucuguucuucucuauuaaaaaaauguuuauguuuuguuuuuuauuuuaacuauguacauaugaauaugugcacaugaguggggguccuguagugccaggcguuaaauccucuugcuggagcuggaguuccaugcuggcuucugggaacugaaacuccaguccuauauggaagcaguaugugcucuuaauuugcugagccagcuuuucagcccuccuaacucacagugcuuuggauauuuguaggguacaugaguuauguuuuuuguuguuuucuaauugucacaaaguaacaauuuuuuauaauccagaaauaaaauacaccugcucuguccaaagccaugcucuucaagggucaaauguauuuaucauaguuagagcauuuuuccgggcaucuggggagccugugagauggcugaguggggaagggcguuugcacaagccuggcaaccuaaguucaacuuuaggaaucccagcacuugggaggcagaggcaggcggauuucugaguuugaggccagccuggucuacagagugaguuccaggacagcagggcuauacagagaaacucugucucgaaaaaccaaaaacuaaaaaccaaaaaacaaaacaaaacaaaaaaggaaucuuuguaaaggcagagggagagaagcgacuccacaguuacccugacauucagaagugccggcuccaaucauauacacaugcacagucauaaaaagaaaagguuacauucggaggucagugcuuaggcggcugugaaaaccgaagcgugucagagacaucuggagcagagacauggugagguaccagagagcugucuccaccugacugacugugaaggaggagcacagcacuucugcauacggcuuaugucuuaaacacuuuuuuggggauucuguuaggaauucuguuauuagaguuaaaaucuacaugacagcuuacaaccaccugaguccagcugcagcagauccagggcucucuucuggccucuguaaacaccagcaguuuuggugcacaaauuuacaugcagacuaaagacccacucacauaaaauuuuuucaaaaauccucaaaaacuggcacucuccugcaaucccaggacucgugaagcagaggcauacagaucucucuggguuugaggacagcgucgucuauauagugaguuccaggacagccagggcuuauuauguuccuccuugugguccugugagaaucguacuuggauccauguuuacuuuagaacaugugagaaaacugucuagacuugcucggcuucugugcugcccacucugugguuccacugguucuugauuguaugaugugaauucuucucucuguccuaucugaggcccaacagccuucugucuccaucuaaacagguuccuagcagaauggaugguauaugguuaucccucugaaaaugucugggaguuggauuugcagcgcuucggagcccuccagagcagccgcaccuuucugcgccaccgggucauggaaguuaugcguaagugugcuuuuacucuaauuuuacugggcucagcagucuuugugucguuugauuuauuagucagggcuuucccuuaccucuuuaauaaccauuuugaauuggguuucucaucugugccuauuucaggucggaggauggggauuuaugccccaccugacacuuaggagcauuuccggcacauggggccaugcuaggaauaggaaggacuagacuugcaagcugguauguugcaguuuccugugugcugcuagcaguguagccuuuucagugggccuuggugcuaccucagcuucccuccuaggcuuugaagucauuggguaguuuuugucauuauuuugagauggagucucagaauccaggcugucuuuaacuugcuauauugccuuaaacuucugaucuuccugccucuaucuccuaaaugcuaggauuacagguguaugccaccaauccuugucugucugucugucccucuguuccguguaaugguguguguacacauauugcagaacagggcagauguagggucagaggacaguuuuguagaguuggccucuccuacuuguacacagguuucuaggaauugaacucagguccucuggaagagugguuagugcuguuauacuaagccaucucuccagcuccaaaaaucuuaaaauaaagaagagaugaauuuggauuuuagcuuuguuaugugaauaacauagccuuucagaucucagaaccaccacaugaagguguaccauacaccccuuacacauuaaagggaagucuguaaaccagaggaucccugcagcacaagcaaagaauuaaguaccuuuuuuacacuuuuuguagcuuuagcuagccuggaacuuguuaugaaaagcagcuggccucucacaugcuuuuuuccccaagguaguuucucacuguauucuuagcugaccuggaaaucacagagaucucccugccucugcuucuugggugcuaagacgaagugugugugccaacauaugccugucuuugagcauaaacaaaauuacccacguccccuuuagauacagccuucaucaaucuaggugcacaccuuuaaucccauuacuugggggaguggaggcagaggcaggcagaucucugugaguuugaggucagccugguuuacugagugaguucaaggacagccagggccuucauacauacuuuggaguuuugcaacauuuagauucaugacuuuuucauuguuucugcugacuaauuuggaacuaaaaaugcaaacagguguaaauuacuugcuaguguuuguuagcaagauagcaccaguauuuauacacuuuucucucuucugaacuagacauguuccauugggugauaucugauacuugagcuuuuccccuguaaauuacucucuuuugaguuggaauaauuccaggcucuuauagcuauuggucacucaguucuucucaguucagucugugacucugaacuuugauagcccaucaugaacaccaccuuaguaauucucagacaguuucucuguguaguccucccuguucuggaacguguucauguuccuuagaccaagcugaccuugaacgcagagauccaacugcaccuacuggaauuaaaggccugugcauuacuguugcuuggcuuuaaauuuuuuuaauuuauuuaaaaauuugauguguaugaauauuuugcuuuuguguaugccugugugccacuuugaugccugauacuuaugaaggccagaagagggcaucagauccccuagaaguggaguuagagaacaauugugagccaccaugugggugcuggaaaauaaacccagauccuuuggaaggacagccagugcuuguaucugcagagagguuguucuuaccccgacucuacccccuuuuuuuauggucgugggaacugagccccagagccucaugcaugcuaagcaaguccaucugccucagucucuugcuugguuuuugauuuuuacucugaguuggggacuuguuaaguugcaguccuaguuacuuuucucuugcuaugaggagacaccaugaccaaggcaacuuauaaaggaauugcuuaacugggggcuugugcauaguucagagagugagucugaccauuaugguggggagcauggagcaggcaggcaagacugguacuagcacaguagcugauuuuuaucugcaaguuggaggcagagauagcacuggaccuggugugggcuuugaaacuucaaaguccccccagugacauaccuucucuaacaaggccacaccuccuaauccuuuccacagaguuccaccagcugggaaccuaacuuucaaauauaugagucuauggaggccauucuaauucaaaccaucacaagcugcccaggcuuggcuuggcuggaaccuugaaguccuucuacuucagccacccaggucucuggaauuguaagccugugcuuccagguccagcugacagaguguuuaucuguucuagcucugauauaugaucugaagguuccccguugggauuuccagacuggaaggcaguuacguacaucuccucuuuaugaccggcuggaugcucaaggagccagauggauggagaaacauggauuugagaggccaaaguacuuuguuccacccaacaaggguaggaaugugucugucugucugucuucuuuuuuaagaaucucacauuuuagccuagaacuuacuuuauauuuuaggucagauuugaauccugaucagcccucuuauuuuggcaucucaauugcugggaucauaggcagaaaccacccuuggcuguguguguguuguaugcauguguauaugugcacccucguauaggccagagauuuauguuuucucuguacuccaccuuacuuuuucagacagauuuuuucacugaauuuggaguugacugauuggcuaaacugcuggccaacaagccacagaauccucucacuucugggauuaaccaggguucacuguuaaucccagcuuuauaucagugcugggaauccaaacucaaguccucaugcuugcauagcaagcucuucagcuacugagacaguugcuucuacccugccuuaaaacugguauuuagugagugccuuuggcuagaauggguuccuggaaggaaaagagucuguaggccauaauaaaauauaugaagacuucucagugucaaaacucuuuacuuuccaccguguuuuuucugcuucauagaccuucuugcauuagaacagagcaagacuuucuacaagccagauugguuugauauuguggagucagaagucaaaugcugcaaggaagcugugugugucauugacauguccucuuucacaaaauuugaaauaacuguaaguauuaaaguuuggggaaacauuuucuacuuauugaguguuuucuuucauguauuuucauguuuuuaauuauauacauauaguuauuuugcuucaauguaugccuguugaccgugugcaugcaguaccugaggaagccagccagaaggcagccuuggcuuccccugggacuggaguuauaaauggcugugggcugccaugcgggugcuugggaauugaccaaacagccagugcucuuaaccaaggagccaccucuucagcccccaaaauguuuguuuugaucucccccuccccuccccuucccucuccuccccuccccucccuccccuccccuccccuucccuucccuuccccucccuucucuucucuucucuuucagacaggguuucucuguguagcccuggcuguccuggaacucacuuuguagaccaggcuggccuccaauucagagauccaccugccucugccuucuaagugcugacauuaaaggcgugcaccgccagcccagcaaagacuugcuuguguaugaguguuuugucugcauauauaucugcauaccagaagaggacacuggaucucaugagacucuaguuuuagguggcugugagccacccugugguugcuaagauugaacucaagauuucuuucuggacguguagccaguuuucuugaccacggagacaccucucuagcucccaaaugcccauuuuucacuuauuaccucaaaacugauucuggaagaacucuacacuauuuuaguguuucaacuguauaaucacauuuuucugaaguuuagcuccuguagcaguuuuuaauuaacuugguaagacauguuuaucauaaguacugaugguuagauuuccuuguggcuuacaggaaaguaagccugcaaauggugccauguagguuguaucuuugaguucccucagucgggcagugcggucaggugcuccuguguucacuguccccaccucaaccuugccuugcaguccacuggggacgaggcguuagaaagucugcaguaccuuuucugcaaugaccuugauguaccuguaggccacaucguucauacuggcaugcucaaugaauauggaggauacgaaaacgacugcagcaucgcacgccugaccaaacgcaggugagcugagcugccaugcccuucuccuuccacuaaacugauacuucacgggcucuggauguugaacaauuaguacuucucuaggaggccacaguccuaggagcccagaaacgauuucauaaacuccugucuaaaucacuagucaccuguaaacaaaucagcaaaggccaauaaagagaagaaacccaggguggguugguggcucauacuuauaaugucaggaaugugaagguuuaacacaaguuuggggccaaucugggcuacaugagaaguuccaggccagcuuggccuaugaagugagacucacucugcuuaaaagauaagaacagaauaaguuguacuauguauaacuguacacuggguguagucacccuaaugggaaaggauucuuuagaaauguuacuaaaucuguguaaauuuucugccuuuugguuuugauuauuuugggguuuucauuuucaguuucuuuaugauuucuccaaccgaucagcagguccacuguugggccuggcuuaacaaauacuugccgaaagacagcaacuugcugcuggaggacgucaccuggaaauacacagguaaucagucaaccuucacagggcagcccaguaaagaagcagacgcagaucaucuucuacuuuauguacuuauuuauauuugacuuuacaaguaagcaucagaauuagugugaaagagacaugcuggggcagggcuggagagauggcucagugauuaagagcacugacugcucuuccagagguccugaguucuauucccaccaacuacauggugguucacaaccaucuguaaugggaucugacacccucuccuggugugucugaagagagugacaguguacucauauaaaauaaauaaauuaaaaaauaaaaguaaagacaugcuggggcuggaguggugguugagaaguuaggaacacuuuacuuugugcuccuguagguuucugguucccuuaccugagggcagcucacagcugccugcaacuccacuuccaagggaccugaugccuucuuuuggcuuccauuugcaucugguacaugugcauuugcaaacacccauaaagauaaaacacauaaaauagaaauaaaaacaucuuuggggcuggggagaaacggcuaaguuaagagagcugccuggccgggcaguggugccuuuaaucccagcacuugggaggcugggaggcagaggcaagcagauuucugaguucgaguccagccuggucuacagagugaguuccaggacagcaagggccgaacagagaacccugucucgaaaaaccaaaaaaaaaaaaaaaaaaaaaaaaaaaaagaaagaaaaagaaaaaaaaggaaaacaaaaagcugccuguccuuccagagcacguugguucacuuacuaccacugcuggcauccaguguguucuucuggcuuucaugaguaccacauacacauggggcacagacguauguaaaacauucaugagcaugagaagaaaaucagcaagucuuuaacccuuagcuacauguaaugaugcuuuucuuuaaucacaacacccaggaagcagaaguagguagaucuuugugagucuggucuacaugaugagccuuaggacagcuagagcuguuucacaaaaacaaacuguauacuccuuaaaaaaauaaaucuuuaaagggaaauaagacacugugaacacagauaauuguccauucaauuuauuuauucaguuccaaucccuggaaccacaguggaaggagaaaagugacuugcacucaucuuauuaaccgcucaucucaccaaggacuucauucucucucguuagcagaaagcaugauuagcuucuugcugcuagcuuggcaaaguguagaauauuacugaauacugguugucuucuagccuguacuagagcaguuauguguaguucugucaaaggaacagagccuaggguggagagacaguucucuagacacuguuuugugauggggaucacuuccaucauguaggaagaugaacuauagugcuugguguauggccagcccuggaagugaccucuuggucaggucuuggucucgauccuaaucuucugcagaggagacuauaaaauacacccuucuugugcacugcaagaaccacaccagcacacacagucagcagcugcguucagcagcucugucaguggacugggggccagagcccagguacuuaccauugaaccucaggacccuaaauaaagggccauuuuuuauaucucaucagcuguagaccagguccuguguaaauauggugguuaguuaaucaccugggagauaaauguacuugccuaugggaaauuacugcccgccguggauggaccgacuuugaacuauaaacuagaaaacuaucguuuacguugucaguguauucaugacaguagcagguaaagaaccggggacaguggacacggucagaagaggcuguucucuggagaggcuggacaucucuuguucuuuacccuauagcccucaaucugauuggcccucgagccguggaugugcuaucugagcuguccuaugccccuaugacuccagaucacuuuccaacgcucuucugcaagguaggugcuagucauuuauuguuugugaucagugucucauguagugcaugcaggucucaaacuuguuauguagcugggcaugaccuuacacuugcgagcuugcucaagugcugggaaugcgggugugugucuguguguguguguguguguguguguguguguguguguguguaauggguuuauauggugcugagaaucaaacccauggcuccaugcaugcuaggcaagcagucugccaacugagccacauucuuagcaguucuguuuuuuuaaauguuaaauauguuucuuuuauagugauggcagguucauauucuuaauaugguguuaauacuuaaacaguguuuugaccuuuauuaagcaagcaaaaugaccaagcaacuuuuauuuuuuacuuccaagucugcuuuauuuaguaaggauuaggguauucccugaaguauacuuaaugucuuugaaugucagguauguguacuuauugguuucucuagcgccugaauuaaacuuaaggugacaguaaaugcacacugaggucagauguuuuuucuccuugcauuugcuguuuuguuuuuauucucauaguauauugauagcugaacccuagacaacacacaacuaguugcuuggcacacacuacacugaauaacugagcgcuuugcaggaagcagucacacagccacuuuggacaugcaccaugcauggagaaacuuggaaguuuaaacccaaguggagauuuuuagagcagauuguuuaaugauuuccugcucucccaagcagagaaaacaacagaaaacuuccauguuggugaacagaucccucuacagucuucucuguacuuuacaaaugauccaaccugacugucaaaugccuugucagaauucauguggaauuguuucagugcugucuugcuuggccuuacacuucccuucauagagcaguauuauaucagugacccuuucaaggcgacugagcagcuguaacacuagaaacugagcuuuuggucccagagugcaugaauuguauucugcaggcauuguccuuuaugugucuuacagaguccuccagagaaaacacuugguuggucuucauuguuccuaacgcugcuuggcuaacucaauguuuuagcaugagcugguaaagagagaugcuuuccuugguuguagcucuuccaggguuaacauaggguggguacugacaggcuccccucgggacucagucucuugacugucaggagggacgaguacugacugcuuuccuuuucuuuguaggagaugagugugggcuaugcaaaugggauccgggugaugaguaugacgcacacgggagagccaggcuucaugcuguauauccccauagaggugagagggcucugggcagggguaccaguuucccaagauuccugaguaccaacagauuuagaaugguguaucccauccagucuuggacaggcugcagggaagaaguuuucaucauuuuuaauaguuacuguuaaagagauacaugcauuuucaaaaaaaacuugagggagggaacauagaauacuuggguucugucucaacacccacauggcagcucacaacuaucuuuaucucuaguucugggagauauacugccuacuucugacccccaaggguaccaggcacauacaugguacccauacaugcauacaggcagaacacucacauacguagaauagaaauaaaauguuuacgcaucuuaaaaaaaugaaaacuugacgggauguagcucacuuaguguacaguuugucuagcaugucagucaguccucaguuugaucccuaguacucuaucaccuaccuaggcaugguaacacaugcccauaauccuagcacugagaagguagacgccggaguuucagucuagucugggauacaugagacucuaggaaucucaaaaaucaacaccgugggcuagagauggcuuaguuguuaaagucuaggcucacaaccagucaaauaaaaucaguucuguagauaagacucagcaucaccuucauaauuaguucccuucagccaacagcaaccugauauaguagcauuauuuaaucaguaauuuugauguauaugcaaguaaauucaaagacagggaagggggguaguacuuaguaguaccuuugggauuacauguuuguuuguuuuguuguuguuguucuuagagacaggguuuuuuuguguagcccuggcuaucuuuaaacuuacucuguauaacaggcuggcuuugaauucagagaucugucugccuuacagggaacucucaggaguacacaguaauguuauuagguagugguaagugcuacagaaaaaagggguaaaguacaaagagagguaagaggacagauagcuuuaaaaaaggucucacuaagaaguucccugagaguucccugcaagugcuguuuuguuuuuguuuuuuaaauuggucuugggauucucaguauucuagcccaggcuguucucuaccucuugaaagcuaggauuauaugugucucaccauaccuggcaugucagucaaguguaauuuaugaaugaggcagaguacuacugaaagccacuccacagagcuggcagucuauucuucuugccucugaacuuggccagaguuuccuggagcaugcauuccugcuagguggaacaggcuagacaggcugcugcucuguguccuaaugcuuuguuuuccuucuggcaccgcaagccacuacuguucccuuucaggccucauauuaccucccccacccagcacacacaugcacaccuauauguauaugauuuaguacaucuauauaugguacacauguugcgcugcacugaggagaccaggagaggugugaaauuccuggaaguggagugacaggugguggcgaacuaaugaugugcuugggagccaagccugagcaagugcucuuaacugcugggccaucucuccagcauucauauuacaguuuguaauguuuugagacagaguuucagaauauagcucuagcuguccuggaacucacuauguagaccaagcuggccuucaauuuaagagauccagugccucugccuucugaguccugggauuaaaaguguggcaccauguccagccacaucacuucuuagugagaccuuuuuuaaagcuaucuguccucuuaccucuuuuuuaccccuuuuuucuguagcacuuaccacuaccuaauaacauuacuguguacuccugagaguucccuguaaggauuuuauaucuuaucacauaaagaaaucggugucacagaguaagucagaguagauguucccuggcguuuuuggucacaugcuuuccuuugaccaugcuccuucccaugccccaggaccaggccuggcccacacuggccuccuacucuccauucuugcaucaaccuggaacugcuuccacauuaccaaggcuuccucccauaucaccuacacucuuaguuuuuuaguuuauguagugucuguaugucagggcauaccuaucaugguacaugcauggaggucaaaggguaaauuuuuagaguugguuccucucuuugugggguccaggaucaaacucaaguccuuacauaggguacaaauacuucaacuacugaaccugaucuucaucaauuuaguuuuucauuucucuccagccacacacacauuuuuuaaagguggggcuuauuuugguucaguuugaguauuguccagugcacaguaaguuauuguggcagaauuguaacuaguuucauugcauccauaguaaagaugcagagacauuaauuuauauuucuagauacuuuaaauacuuugaacauacuauuuuuauauguauggguguuuugccugcauguaucccuuuguaccacaugggugcaguggccaugggagucagaaaagggcauuggauccccugcaauuagaauuaaagaugggauaguuaaacuauugugagcugccauguuaaugcugggaauugaacccaggaucucugcaaagaacagcaagugacccaucucucccaugcaugaugcauuuuucuagguugucaugugauacaugguaugagguuuuugcauguguauuacagaacugaaccaagagucacaggcacgcugggcaagugaguauaccucugagcuuugugauugcuaggaagaugucugucuaccaacugagcugcaugucuucagcagcuuuaaggugguuuuuaaaaugugauuauguuuggcuggagagagauggcccagcaguuaagagcacugacuccucuuccagagguccugaguucaaaucccagcaacgauaugguugcucacaaccaucugaaaugggaucugaugcccuuuucuggugugucugaagacagcuacaauguaaucacauacauaaaaucaauaaaucuuuuuuaaaaaugugaauauauccauucaaaauuaacuguuaaaaaugauaaaauccuuuuccugcagccgaccuaagaaccaaagggauacaccacuucagccaacuagaaagcucacuaguugcuaacuuuucuucucuccauauaguacgcucugcaugucuacaaugaggugaugaguguuggacagaaauauggaauccggaaugcuggguauuaugcccucagaagucuccgaauugagaaguuuuuugcuuucuggggucaggacuuaaacacccuuaccacgccuuuggaauguggaggagaaucucgagugaaguuagagaagguauuauuuaucuacaucucucugugccucucagccaaacaguugugaugugucuaagauaggaagagcugaacaaauaaagaagagcaggaaagauagggaggugcuagcuagcagcagguaagucaugaggaauaguguguccucagggcaggacacuuaccugugggaugcacauuucagauaaaaucccaacaccugguuacauugacauacauuuuuuagucaauuguggucacaaauaauauugugaauguaccacaguauucaucuaaauuagucaucuuacagccagcugccuaauuuucucuuaaaauauauuuuuaacuuuuaauuaugugaaugcauguaugucugcaugagguguauuugaaugcaguugccaaaagaggccacugggaacagaacuuggguccucuacaacucuugucucuccagccccaggucuuuuuuuuuuuuuuuuaaagauuuauuuauuuauuauauguaaguacacuguagcugucuucagacacuccagaagagggagucgaucauuacggaugguugugagccaccauaugguugcugggauuugaacuccggaccuuuggaagagcagucggguacucuuacccacugagccaucucaccagcccccaggucuuauuauuuagagaaguauaguucaaaagguuagucuacugucuuccaccucugaaccucacccggugucuucucagaagcagcaguugguuucuauucuagaguguuagaaugggcaaguaugccaguguguguuccccugcccacuuccaaucuagaucguguuaaacuugcuuuacuuacuacaguguauuuaggcagugcccuaacaguacaccuguagacaagguccugcuauguaguccuggcugaccuggaaauuucuguguagaccaggcugugucucaucaugcccagauaguacucacuuauucauuuauuuacuuacuaauuuuggccacugcauauaacuagacauaaagaaauuauacauaauuuuuugugugcugugaaaaugcuaacuugcuuaaaaugaccuguauucuaauuauagagauaaucacuauuaaguuuguuuaccuguauauauaaguauauugguacauacauaugcaggggcuucuugcuggaaauacacaaagguuacauaccucuaacucuguggaauugguucuuugcugccaacuuuccuuggguuuuggugcucaaacuccaguuucuaggcuugugugauaacagccuuuaccugcugaaccauccugccaucccucuaucaaguauucuugauuaacuuuucaguuuuucuaacauucuuuguuacuaggcccgugauugaaaucuguucacagaaguauguacuucagcugugucucugcuguguacaaagcuuuucauaaugccuuccucaaacaucauuuucuaaaagcuagcaggaauguagucuagauguacccucuacuuuuacaugccaagggccaucuuauagacugguaucucagggauuuuuucccuuuuuucuccuagggcauagacuucauuggucgggaugcccugcugcagcagaagcagaccgggguauauaagcgccuugcuauguucauucuggacgaccaugacacagaccuugauuuguggccuugguggggagaacccauuuaccggaacggaaaguaugcuggcaagaccaccaguagugccuauagcuacacacuggagcgccauguaugccuggguuauguacacaauuuuucugaggacaguggggaagagcagguggugacaacagauuucaucaaccgaggagaauaugaaauugacauugcaggacaucgguuucaggccaaggccaagcucuacccugucaccucuuuuuucacucacaagcguagaaaggacgauguggagcugagcgacuuucaugggaaguaacgcaagacacucccuucccacauucuugccaugaggagcaucguucucagagccgaguuucccuccguccuggucuccucacugaagguaccuuuguccuugccuagguucaauuugaccuaaacuuuuuccuugaaaaccuuucuugucuucccauuuucucccauuugcuguuaccccuccuaauaauccaggcucuucucaucccuccagcaggcucacauacccacaauggcgggcagaacccacuuguggagugguauuagggugacagacugauuuuaaauucaguguuaggcaaguugguauuauuuaagucuuaggguaaauauccauuucccuucggcuuagauucuuaccaaguaaccuccuaguuucgguagaugauuuugugucugaugcagcccugggaauaacuugugucuuaaccaggcagauaauucuguuccacugugcugagguugccaccugauaccucguaaccaucuaccucaccaauaagagcgauuguguggacacugucugcucuguggaagggggaauaguuaccuggcacccaguauccuccaacuuuguccuuacauguuugugccagggcacccuaccugcauuuucuucauuuucugcuaucuuuuaucaugauguugguuuuuagcugaguaaacagguaugccaguauuugaaaggaaagacaaaccaugcugccuuuucuguugcuuuucccaguaggagcagugugaacucagaugcugaguuccuacuauuagaggaggagugcugcuuuucuuuuagcuaaucauauuuuggcuaucccuuauugauuucuucagaugacuucuagacucaucugugccuuguguagccugccuacaaccucaacauccauucuuagccuuuuagaagaggaagaggggaucaggcggguuguuuuggaugauuaaguaaaccaugcuggucauacugcauuucagagccccaggcuuugugucccuagcaugaacaaagccagacagaugaccacugagaacuguaaguacagugcaggccagagacugcuucccauccuuucuuuccaggcuccccaccaaaugcaccacacauuucaguggcacuguuguuuuugugaaaauuggagcuagccucaaauuugugauccucuugcuuauuagucucuugaguacugagauuucggguguggugacaguuuuuuugaaguugaaacuuggaugucauggcuguucuauauaccaucaacacugauuuuguuugcucucauauacaaacugucccagucuuggagaacuuuuaauucucucagcacucaagaugaagaggcaggcagggucuuugugaguucaaggccagccugguccacagaauagagugaguuccaagagagccagggcuacacagagaauccuguuucauaaaaccagaaaguggggggagggagugaaggagagggcgagggcgagcucaggcaagagagcuagcuggccauaacacaugccagccuuuaauucaguuaaaguaauucucaguacccgggaagcauugguuuugcuaaacugauaucaauagaaauccuuucauuucuuuagagcagcucaaauuucuagugucuucuuugacauuucuguagaacuuuauccacucagacuuuucuuucuuccuuccuuccuuaacacauuucuugcuguuuuuuccagcuaggccauuccuacuuggcuuucaagauuuuaaaugauuaaaaggacacacaauuagaauuugaugugaggggaauuaguauuuugggaaaaauaccuauuuaaugagaugagaggaacuguuucuccacuagagagcugagcagggcagcaguagcaguaagcuccugaggagacagaacaggcucuuaacugaccuauggggguggaauacagaugcacagcuccagguauugugugcccucucucucucugauagauauggcuguuggcuguaacauuccacagucuguguaaugaacguuuauuugguauugaauacaaaauacauuuuugaacuaugcauuacuuguaaaaaaaaaaaaaaguagcaaucagcagguuugcucuuuaaauauggaaguuaguacuuaaguuccaaaucagaaaaacuuccaaaccaauauaguuuacaauuggguauaccaccaucacaguauauuauucagaaacaaaugucaucaagaguauuuucagcaguuuuuuauuuucuucugcacuuguuaaucacuagcuaauuaacuauuaaguuggagggaaacagcagcuuccuaguaaguuuucagcuagaaguucuggccgaugcugccaucagcagagcuuacacaccgugcuugucuugcugcaguuuuuucuaugcuugauggcacaaguaccuuagauagucgagggggcugcuuaccuagaauaucugauccaccagugugguagagcugggcuucucaggaguagaugcaaguuguuagcagaaaugguagcucuagagcaaccccugacccuuucacaggucuccuaaauaauuggaaagcacagauauuuacauuaugauucauaauaguaacaaaaucacaguuacuaaguagcagugacccuacauuggggucacugcaaaugugaggaacuguauuaaagggucacugcaucaggaagguugagaaccacugcucuagaggcgugaaugaaaaucuaggacgacuaaggaggaacaaucacuguaccuccugagcugugugacacuuccaguucagggacagugaggcuaucuuggcuugccuuguauaacacacuggggagccgguuagcuuuaagggauuguaaacacuucaguuuuaggugacagauucucuggaauaauguuaccacaucuacuuccuagaagugaggggguuccauguucucuucuuugauuauagaagcaauuaaaucucuuugaacaagguaacaaaguauauagaaaaccuagaauuggaaguuuucugugauacuccaugaaggcucuuuucucuuagccagaugcaaagccuauuucucagcacuaccacaguuauuugaaauaugcucaagcuuguaacagaguucccuuccaugacauagguacugaacuugcaaaaaggaacaaagaggaauggcuugaauagucuuaauugugagacuaccucacugcauuucuaguucuucuguggguuccuacagaucauauuaguccugcacacaggaucauuuagcacaauuguaaacccuagcuucagucuggucaccaagagcccauuuaugcagccguggacuauauagccacuucagcuuggcacuuguuguggaaguacauuagcucuggccugucuccucuauauuguguucaagaaaaguaaccaaacaugaaaaacaaauuuguagauuucaguauuaacugaucuguuuugggaugugggugacagcuuugauuuucagguuaccuuaugaacacauuugcuagcaugggaaaaguucuucacuguccuuggagagaacuguaugccuuacaguauugguacuagcccuggagacagaccuggaugagcaguuccaucauccuguuugcaggggugaacuacaaauuucaucuuuguaucuuuugguuaacuucuuggcuaagguaacagauuuauauuuaggacaaugaagucacuuuuccauuuucugcaucccaacacccccagcucacauguugauaagcagcauaguaucaacacaguacacuuuccuucuacuggaggaugcuccuccugcccuuacgucuguaggcacacagcuugaggagcaguaggugagcgggugaggaugaugccugaguucggcuguggcugagcugugggcggcuuggcagcaccucccuuucuuuuggccuccaaggugcugaucuguaagcccccauguucgucagcauggggcuuucucuccaaguccucagcaguaccugcaccagguacuguucacaaggaucgagcguuccccuuugccaucucagucugucacgucagcauuucccuguauaagacucuuggccucuaagcaguuguccgaaucugaauaauuauacacacuuucuucauauuuugauucaucuuugcaaacaucuaccuccuugucuuuugucugugaaugacagauuauaagaggagggggaguuauuuuuaucauguuucaaaagaucuaugccaagauuucuuuugcacaccaagaacugaagcuuggagcacuucucaggccaguucuagugccuuacacuccaggauguccagcaucggacugagguaggaugaaagcaggaugcucggucuguagguucucaucccccacaucagcccucuuuguucaaaauaaccuuggugugggguaaaaaguucugcagcucauuucacugaaagcuuuucuagcgcauacuuaacucucuggucaaugcuuaagauauauaagacaccagugcaauugcuauaaagaucuuuaaauucgcauuuagugugugguucugcucagcucccuucuguuccuguguaguaucagcaugugauccugaggacauucuagauauuggaguaaauaaaaucuuuucuuaagagcaaacucagccgacuuuggacacaugggguaauugugcauuuaugaccagaauuauuucuagauggcuggauuugaauugagauuuucuuuucauguauuagguguauaaaugaauaaaaagauguuuccauaacuauuguaauauucacuugugaaauguccuuuaauuugguuacaugccuucucaaaggauaaaauaucucugcugcuaagggguuuagaaacuaaagggagggaagagacaggcuugugua

SEQ ID NO: 4791 - RNA, 105945 nt, Mus musculus
uaaauacacgucgccggcgggugcgucgagcucgccgcgaacccaagauggcgguguguggacguguacgggggauguuccgcuugucggcggcguugccgcugcugcugcucgcggcagcaggggcccagaauggucacggucagggccaggguccggggaccaacuuugggcccuucccagggcaagguggaggcggcagcccggccggccaacagccgccucagcagccucaguuaucgcagcagcagcagcagccgccgccucagcagcagcagcagcaacagcagcagucgcuuuucgcggcgggcgggcucccggcccggcggggcggagcggggcccggugggacuggcggaggcuggaagcuggcggaggaagaguccugccgggaggacgugacccgugugugccccaaacacaccuggagcaacaaccuggcggugcucgagugccugcaggacgugagggaggugaggaggugggacgagccuggggaggagggccgagccuggugcgggccggagggugucgccggccuggaagccgcggaugccgggcugcagcagcagcuucccucugcucuuuuccuucagggcugugcucgcgccucucucuuuccugccccucacucccgggugcguucgggcaagcggaucccaccccgauccuuccuccuccgguccccuaguucgcucccugucgucgcgguguucugggaucaggaccucggcucacggccucaguaggcgcaggccuaaggagcguguuuucuguuugcgcuccugucuuuugugugaugcucuaugcagagcgguuccucgccggaaaaccaguuuaggauuuguuugcuauccguuucgaccucgccaguuuguagcaauggauuucaacguggaaaaaaaaaucgguacauuuaaacugcuaaagaucgaucugcuguuuauuuagcaguaggcgcuuggugagcuaaccuggguucucuucuggugugaauguagucaaaagccgaauuuacuguuucuaccacauucuuuuuuaauugguaaaucuuuacuauuuaccuggugcugaaacuaugcuuuuuuuuuuuuuuuuuuuuuugucuucacuuccuguggucaguuuguaaaggaccucauuuuuuaggcuguuccuucaugucccuuggaacccuauaaagucugagaaaguugcaggcagcauuugaugcuauauaauaaauauaagguguuuguggucuguaguggggucuuucugaagucuuaagauaguuguuuuugagaccggaucugcuuguagcccagguuggccgccuaugagaggcauccuuccgcaucuggcugaaccacuucaucuaguuugaaauaauuuuaacaguaccuuagugaguucuucuagagcuuauauuacuuggugugcuccaguuaaaaaacauugacaacuucuuuucuauauuugaugcugcagacgugagcauauugguagaaauauuuguuuucaaagguuuagauaaacaagauuacucccaaaaucuggcaaguagaaaauugcuauuuggccaucucauuuggaauacuguaucuucaggauuguucaaggccaugaugugaccacugguuuauagacauuugcuagucuugcuuuaguguuaugcaaagguaaggcccuuuuuuuuuauggcacauccuguuaauucuggaacuugagaggaagaggcuggcagaucucucucugaauuugagacuauagccuagucaaaguagagaguuccagaccagccaggguaacaauaggacuuaaaaaaaccaaagucauaagaggaaaagacauacaaaaucaagagccagaaaguuuccagagcuaccagaaauguggaaccuuacgugggucacauguauagcuugaagauuggaaaguagauauagccaauagucuuuuuucuuuucuuuucuuuucuuuuuucuuucuuuuuuuuuuuuuuuuuuuugguuuuuccagacaggguuucucuguguagcccuggcugcuguccuggaacucacucaguauagaccaggcuggccucgaacucagaaaucggccugccucugccucccaagugcugggagugugccaccgcugcccggcauagccaauagucauaacuguuaaacuuuuuuggaauuuucuauuugauuuuugaggauacuuacuagauguuguuuccuuaaggugagauugucccaucuguuaguagauacauuguuacuguauugauguagaaauaggauauuauuaagggaaaguggcaaaaaaaguccaguugaaggagugccuaaagcuauguacauuaugaacaccuauauaccuuuccuuagaggagcacugaauggucuucugucaugcauguaguggcccucuccguccauaaagaacagacuugucuaauuuuggagucuuaacuuagugguaccauuuuucccccuuagauuaguuugcauaaagaaaaguacacgcagcugaaaauguagucacuggucuaccaucggucucaaaauucccaauucccagcaaggauauuucaguaaauucauucauucauucucucucuuucucucuuucuuucuuucuuucuuucuuucuuucuuucuuucuuucuuucuuucuuucauguaugugaguacacgguuguugucuucagacacaccagaagagggcauuggauccccauuacagaugguugugagccaccaugugguugcugggaauugaacuaaggacuuccggaagagcagucagugcucuuaaccacugagacaucucuccaaccccguaaacucacuuucuuuugucagggucauauauaaacugaugguugguagcuauguuucuauuuucuuugugauguucuagaguaccuaguucagggcuggaacuggagaauauuguuagcugcuuuaggaugagugaauugauggaugugcguuuauauuccuuggaggggagugacguguaaauuggagacccacuguuggaaggaaggagcugaauauucaaguuguuuugucuuuguuuuccaagaccaacacaggauuucucuguguagcccuggcuuuccugcaguccaguuuggccucaaacucaagagaucugccugccucugcuucccaagugcugggaauaaaggcaugcugcuugacccgcccacccucccuccuccuccucuuccuccuccuccucuuccucuucuuccuccuucucucuccccucaaaaaagaggucuacacaggucuuacucuguagcccuggacauuuuucuguauccaccaaccuggcuuuaacuugcuucugucucuugaauacuggaacuaaaggcuuugcuacaaguuuagaauuuaagguucucucuagugugguccaaaauuauguaguucacuuacaggauuuauuggagcacaguuuuuuuuuguuuuuuuuuaaagguuuauuuauuuaguauauguaaguacacuguagcuguccucagauacuccagaagagggcaucagaucucauuauggaugguugugagccaccaugugguugcugggauuugaaccugggaccuucugaagagcagucggcgcuuuuaaccacugagccaucucaacagcccuggagcacaguuuuaccuuuaaguaauaucaguugguauuuaacucaguucaucuaaugugucaucugccaacaaacuccacaucugaggcuaugccuuaguaaaacucaugucagcuaucgauuaauucaucacagcuuuacugaaugaagguaguuugaccauuauguagagcauucuuuuggaccccucugaugagacauacuuuuuugagacaggguuucuuuguguaccuuuggcuguccuggaacucagucuguagacuaggcuggucuggaacuugaacuccauaaagaucuaucuacuucugccucucaagugcuagguaggauuaaaggcacaugccagggcuggagagauggcucagugguuuaagagcacuggcuguucuuucaggggaccugaguucaguuaccaacauccacauggcagcucacaacugucuguaacuucuaauccagggaauuuggcauaaugcaagcaaaacacugauguacauuaaaaaaaaaauacacuaccacuacccagccugagucagacuuuuuaaaggacccaauguaggcuacaggcccacucuguuuuuuguuuguuugauuaguguguauagguguuuugccuucauguaugucugcuucaaagguguccaguaucacaguauccacacagcauccaguccccugaaacuggaauuucagaugguugugaaccaccacguggacccugggacucaaacuaaagucaucuauaagagcagcaagugugcagagccaucccucgauccccuuacccacuucuuuguuuuuuguuuuuuucuuuucugagucaggauuucucuauguagcaccaguuguccuagaacuagcuuaguagaccaggcuggccucaggaucuguccuaaacccacucugaaguaguagaugguagaguauuaacugcagaggagggucagauacuuguuuguguguaugugugucacuccccugcuauuuuucuaggguaguguugggagacugauauauuuuaaagcauacaccagaugucauuuuauuuacgaguacuucagugugugucugagauacuuaaaaauauuucuuaguacuuucuaugaauauacuaauagccacuaccuaaaccuuuguacagagaaaauacuuuguauuuauuuaagguggacuguuuuauacaagaaucaggaaaaaaaaaucucagcauuacaaacuucuuuuuuuucuuuuuugagacaggaucuaauuguguaauucuggcuggccuguaacucacuuuauagaucagguuagcuucaaacucagaggucugccugcuucugccucccaaauagugggaucaaaggcauguaccacaccccuggcuauuuaacugacugacuuccuuucuuucuuucuuucuuucuuucuuucuuucuuucuuucuuucuuucuuucuuucuuucuuucuuucuuucuuucuuucuuuuaaagauguauuauauuuaaguacgcuguagcugucuucagacacaccagaagagggugucagauuucguuacagauggcugugagccaccaugugguugcugggguuugaacucaggaccuuaggagagcagucagugcucuuaaccacugagccaucucuccagccccuaaaccaacuuucaaaguuaguaggugagcauuuuugauaacucuguuaacagugcuggggauugagcccggggccaggcaagcacacacaacugugcuguauuucugauccucauuuuaccuuucuuuggaauuuugagacagggucucaauaaauucccagacccagcuguuucuccccuccccuccccuccccuccucuccucuccccuccucuccccuccccuacuuuucuuuccuuuccuuuccuuuccuuuccuuuccuuuuccuuuuccuuuuccuuuuccuuuuccuuuuccuuuuccuuuguuuuccuuuccuuuuuuucuuuucucuuuucuuuucuuuucuuuucuuuccuuuccuuucuuuccuuuuccuuuuccuuuuccuuuuccuuuuccuuuuccuuuuccuuuuccuuuuccuuuuccuuuccuuuuccuuuccuuucccuuuccuuucccuuuccuuuccuuuccuuucccuucccuucccuuucccuucccuuuccuuuuuccuuuccuuuuuccuuuccuuuuuccuuuccuuuuuccuuuccuuuuuccuuuccuuucuccuuuccuuucuccuuuccuuucuccuuuccuuucuccuuuccuuucuccuuuccuuucuccuuuccuuucuccuuuccuuucuccuuuccuuucuccuuuccuuuccuuuccuucccuccccuccccuccccuccccuccccuuuuuccuucccuuuuuccuucccuuuuuccuucccuuuuuccuucccucuuuccuucccucuuuccuucccucuuuccuucccucuuuccuucccucucuccuucccucucuccuuuccuuuccucuccuuuccuuuccucuccuuuccuuuccuugacgggcuuucucugugcacuugugguuuuccuagaauuuacucuguagaccaccagccuggaauuuagagauccaccugccucucccuccugagugcuggauuaaaggugugcgccaccaccucccagcugcuacucuguucuuaaucauuaacuggacuuuaccugagagaauagacacacucuuuguuauauauacucgugauaguccugugagcugaguacuguuguuuuacuuucuuaaugaggaauaggcuccaacagguaguguuuucuuaugucuggugaggcugauguuuaacaaguccucugacuuagagagggaaucguuuacucuucaaguuacuguuugcaguuagggagauuacuauguggcuguugaagaugcuguguguguauaaauagauaaaaaguaggaagggacagcuaguaccagaagcuccuuucuucaguaucaaaacaauuaaauaguagcagcuucugugagcugaaauagugcugauuguuuguccaggcagacaaaccagcaauaucagguaaugcuaaucuaauuacuggucuggguaucucaugaacagaauuucuauguaaugcaguggaucuaaaaucccaccucacaugaaccagaauuuuuauuacugaaauagaauugguuauauuuuccuguuauuugaauuagcucccugaaccacacaaaaagugaauugggccauaauaguaugaccauuaacuuugugugccugccugccugccucuauauuuaucuaucugucuauccaucuauccauucauccacccaccuaccuaccuacccacccaccuaccuaccuguuguguuugaugcauguguauauauaccugcaacauuggaugucuuuuccuaacacucucccaucuuuguaaaaauguuuuauuuuagacuuacuuauuuuuauuuuguguagaugaguguuuugccugcauuuaugaauguguauuguguagaugccugcuguccagagaggucagaagagggaaucaguccccuagaacuagagauguggauaguugcgagccaccauauaauugcugaaaccugaacuaaacaagagcucuuagccucugaggcaucucucucucuagccuauuauuuauuuauuuaaucuuaaguuuuuuaaagaccuaguagucagagcuuuaauuuuuuucuuuuucuuucuuuucuucguauuuguuuuauuuguaugaguacauugccacugucuucagacacaccauaagagggcaucagaucucauuacagaugguugugagucaccgugugguugcuacgaauugaacucaggaccucuggaagagcagucggugcucuuacucgcugagccaucuguccagcccuccuauuauucauuuuuaaauaauuuauuuuuccuuuaaucccagaauucaggaggcagagggagggagaccuuugugaguucaaggccaacuguucuacauauugagcuccaugccaaccaagcuuggcucaaaucuucccaacccccuaaaaauauuuauuuauuuauuuuguguguguguguuuuugagacagugucucucuguguagcccuagcuguccuggaaacgcacucugcagucucaaacucagagaucugccugcuucugccacccaagugcugggauugaaggcaugagccaccacugucuguccaaaaacaauauuuaauuauguaugugucuguauuuagauauuugcacaugaguguuugccugagaaggccagagaacuccccugaagcuggaguuagagacaguuuugagucaucaaaaaagugagugaugggaacuagauugggguccucuggaagagcaguaagugcucuuauccagagagcccuaucuucagcauuccacuguucuuuauuuugcuuuguuuuauugagacagggucuuuuauaaacuugucuacccuagaauuuucuuuccuucuuuucuccuucuuuucuuucacuuuuccuuucuuuccuuuuuuucccguuguuguuguuguuguuauuguuuugagacaggauuccuuugaguagucuuggcuguccuagaacuaguucuaaaccagacugcccucuuacuuacagagagaucuuccuaagugcuggaacuaagggcauguaccacaacgcccagugaauugcagauagcuaggacuauacacagagagacccugucuugaaaacaacaacaauaaaugaaaaagaaaugauuuuaugugcauugaugcuuugcacauaaaauuggaacuggagguacagauggcugugagcugccaugugggggcugggaauugaacccggguucucggaagugcagccagugcucucaaccacugagccaucugacuccagcccccuagaacuugcuauguagacuaagcugggcuaggacucagagaugcaccuggcuuugcugagauuagagguguucauuaccacccccauccugcuccaccucccuuuuugagacagguuuuuuuuuacugaaccuggagcucacugauuggcuagacuggcuagccaguauacagcgauacugggaauacaaauucagguccuuaaguuuauguccuccucccaguccuguuuguuuuguuuuguuuuguuuuguuuuguuuuguuuuguuugaguugggaucucaauagucaggcuguccuagaacucacaguguaguuacagugaccagaaacuccugacaaccugcccuuugccucacaacugcuuugauuacagguaggagcaaacacgccaggcuugcuauuagcugcuuuuaagaccgugggcaaaacauuuaccacccugaggcuuaauuuuuaauuaguuucuucauguguuaagugagugagauuagaagggggccuuggauccccuagaacuggagcuacaguugccugucaguagcaguguaggugcugggaacuacucagguuuucugcaaaagcagcaagcacucuuaacccuauagcccuaggaaacguguguguguguguguguguguguguguguguguguguguuucuauguguguuucuagggcuuccccuagguaaguucuuuaugacugauccccaacucugaagauuuuucugucuaaguugucuaccuuucauauucuggguaggcauauacuguauggauucuaggauuuacauauauaauugucucaugauuucuugcucauucagagggaaagagugguaggaauagcauaaacagcgguuaaucuaagccuuguuuuacuuuaggguguaguaguuuuguuagcgaucauauggaauuucuucucaugcuaacccagugguuggaagcaauuuaaacaccuaaucaaaucauuauugagcucccauuauguacuucauuguggaaaaacauuaguacucugagauacuaccauuguucacagcuugauaaaugagauugugaacaagaaacaguucuagcagaguguuaauaacuugaugucuuauagauacuaaauucuuuuagggcagugaaaugaacacaaaucaaggguaaaaauuugggucguacccagcccugcuauuccuaguuuaaaaaucauauuauuuggggcuggagagauggcucagcaguuaagagcacugacugcucuuccagagguccuaaguucaaaucccagcaaccacaugguggcucacaaccuucuauaaugggaugugaugcacucuucuggugugucugaagagagcaaugguguacucauauacauaaauuaaauaaaucuuuuaaaaaaucauauuagcccaguaagguggcacaugccuuuaaucccuguacccuggaggcagagacagguggaucucugaguuuaaggccaaucugaucuacauagcaaguucuaggacagcuaggauuguuuuuuuuuuuuuuuaacuuuagauuuauuuauuuauuauauguaaguacacuguagcugucuucagacacaccagaagagggagucagaucucauuacggaugguugugagccaccaugugguugcugggauuugaacucaggaccuuuggaagagcagucgggugcucuuaccugcugagccaucucaccagcccgauuguuuuuuuuuucuuaaagauuuauuuugccgggcgugguggcgcaagccuuuaaucccagcacucgggaggcagaggcagguggauuucugaguucgaggucagccugguguacaaagugaguuucaggacagucagggcuauucagagaaacccugucaaaaacaacccaaagauuuauuuuauuuauuauauguaaauacacuguagcugucuucaggcacaccagaagagggcgucagaucucguuaugggugguugugagccaccacgugguugcugggauuugaagucgggaccuucagaagagcagucagugcucuuaacugcugagccaucucuccagccccagcuaggacucaacacacacacacacaaacacucuccacuccccccccauuaguugucuaauauggguucaaucucuaguacugaaaaaaguaauauauuuuuaaguaauggcuguguauuuagcucuacuuucagccaagacauacaugaauuuaagaguuuaagugcuauucauauuaugcuaaauagguguacuauauuaaaguauacagcaccauuguacuaucagaaauuguguacauacacagcagcucagggcuguucuuccucagccuccugcacuccuuugugcuaggucuacuaacugguuuucuaaauaaagaucagaaauggaauguuuuuaaauggucuuuuuuauaugcucaagauaaucuuaaaaacuuuaagucuucuugccuuagccuccuaagugcuggcaugguuuuuuuuaucccaacuugagauaaagauacuccucuauauaacugagaguuaccuguaaaauagcauugacauuuccagcaaaugcucaagaaggcucucgaugggagugcuucauaguauacaguuguuaauaauucauuguucugcagaaggaaguaauacacuugaauaguucaaaagaggaaaugcuacagcugcauuuucuguuuuguucaacaaauauagucagcaauauuaucacgauuauguuucuuaaaaagaagcuauuaaaauggcugguggguaauuaauuuuucaucugucagcaaauauuuacugaauccuguguacaggacacuguucaguguugguaauauagauauugauaauagcucuuguuucucuuuaguuuuuucaaggcaggguuucuauguaacucuggcuguccuggaacucccucuguagaccaggcuagccucgaacucagagauccauuugccucucuccccaguuuugggauuaaagguguaugccaccacugccuggcuacucuuguuuuuuauaagcgcuguuuuaagagagacaaaauacuuucuagguaguauuuaauccaaugaaaaguguuuuuuuuuuuuaaaaacuuuggggguggggagauuuuuaguuuuuuugagacaggguuccuccucauagcucuguccuggaacuugcucuguagaccaugguggccuugaacucacacugccuccagagugcugguauuaaaaguguguaucaccaccaucuggauaguggggcugauuuugagacagaaucuuauucuguuaccuagacuggccuuauucuuccucagccugcuggguucauuugugcugggauuagaaguagggucugugccuagcuuuuuuuuuuuuuuuuuuuuuuuuuuuuaaagagggucccuaguucccuagaacucucuugccuccacccacaaucuuuauuuauuuacuuuuuaaaaaauauuuuuauuuauuuauuauuauaaauaaguacacuguagcugucuucagagggugucagaucucauuaugguugguugugagccaucaugugguuugcugggauuugaacuuaugaccuucggaagaacaguuugugcucuuacccacugagccaucucaccagccccacaaucuuuauuuuaaaugagguaaacagaaucaguaacuagccucaagugaaucuguaaauuguaagauagcuuacuuuuaucuaugccuauagcacuuauagagcaggacuguccuauuugcugugguaaucaccagucagcuguagcuguuaacaguugagcuguaucuacuuggaacugagguguacaguguaaggcacacacuugauuuaaaagacagugcaaucuuuuuucagucuuuauauuauauguuuaaugauaauuuguguguacugaguuuauuaaaauauauuauuaaaaucagauacauuuuuccaggugugguaguguacaccucuaaucucaguacucaggcugcugaggcaggauuguuguaggguuguugaggcaggguaggcuacgcuacggugcccgugucucugaccucuccuucaggaaaggaagacgcuacucugucugcugaucuuguuaauggguaaacuggaucuucagcuugauccaugugcugaaugaagagaugucuuagcuuccuccagaggaacaacacuggauaaaacugcaauugcucaaugacucauccuuaucugagugaguuagauaaaugugaaacucaggaaucucaaagugaugucccucagagcucagagcugagcuaguaauaaccuuuguaucugcauuaaaauagaguguggaggaacaagaaguguggccuggaaucuaaaaacaaauaaagggagagagccaaaccucuguuuucauucagcauuaauuuacugacaugagaugauguuagguugaguacuagggauauagcaaguuaacagagugauugcccagcaugcuugaagcccucaguuugauuccccagcaccaaauaaauccagcauaaugguuuaggcuucugauacuagcacucuggaggugaaggcagaaggauuagaaguucuguguuugggguugggaauguaguuuaguuggcagaguauuugcuuaacaaaaagccuugcuuuugguccccaucaccacguaaacuaggcacauaccagcguuugauagagggaagcaggagguuaggagccuagagagauggcucagugguuaagagcacugaaugcucucccaaagguccugacuucaaaucccagcaaccaagugguggcucacaaccaccuguaaugagaucucaugccuucuucuggugugucugaagacagcuauaguaaauaaauaaauauuaaaaaaaaaguucaagguuagccagcuagaaugucaaagcuuuuaaccccaguacuggggaagcagaggcaggagaagcugcguucaaggccagccuggucuacagagagaguuccaggacagccagggauacagagaaauccuaucuuaaaaaaccaaaacaaacaaacaaaauaaauaaaauaaauuugggagcuagugagcuugagagcaggguuaauauacaaacauaacuucagccacauuaaaaaagaaagcaaaacaaaaacaaaacaaaaaacggcauggcauggaauagaauauuggccauauuaguuuuaugguguaguaugaaguggacagaaaauuuuaagaggaagaaaaagcauguauugagaaguguguguguguuuaaaugugucaguacaauuuuugagacuaggucuuccuguguacccuaggcuggccuuaaacucacuauguagcuuaggcuggccucuaccucagucucccuaaguauuaagaugacaaaggugugcuacuucuaccuggcucagggaguucuaacaagcagagucuuccauguguuaauucauauaacuacugagcacacauccauuauacaugaaauaaaagucugaagaguuaaggacuuauugccauguggaaguuaagaucugaggagcaguagaaugcugaggaaaacagaaugggcuuuggagguacgguccugggccagaucacaucaccagaucuuagaccagucagccagccucuccucacucccccuuuagggacagcaccuccuuauguaacacucgcuggacuccaacucacagagaucugccugccucugccuccaggguauaggauuaaaggugccuuaucuaacucaaguuaauaucuuaauauuuuuaucuuaaaguuuuaaauuuguguguuguggguguuuaguucuuagcaacaacguggcagcucaccacugucugucucaaugaucugauacccucuucuguccuguucagguaccagugucacauacauaaaacuuugauggcacugaggacauaacuacaugccaggggagaacucuagcacugaacuaaugcuuuuuauauuuuauuuugaaauaagaucucacuuaguuuuccaggcaggccuggaauuuauaauccugcuugaaccucccaaauccugagaucacaggccugcgccauuaggccucgcuguuugcuugcuugcuuguuuaaggggcagggccgauucucauuguauagcccaggcuaacuuugaacucuugagcaguaccauacuugagugaaauuuaagaaaaaaaaucuuuuuuguuuguguuguuucaagacaacccaaaccugucaacccaggcugaccuugaacucuguaugaucugagugcuucacccucuugaguguugagauuauugguaugaaccauuacacugucuuaccuuuucaauuuuuuuuuuuaauuuuaaaaaauuuuugggcuguagggauggcucagcuaagagcacuuguugcucuuccagagguccugaguucaauucccagcaaccacauggugguucacaaccuguauauaacgggaucugacacccucuucuggugugucugaagacagcuacaguguacucauauaaauaaaaauaaauauuaaagccgggccauuuaaaaacacagggagccgggcgugguggugcaugccuuuaaucccagcacucaggaggcagaggcagguggauuucugaguuugaggccagccuggucuacagagugaguuccaggacaaccagggcuacacagagaaacccuguuucgaaaaaccaaaaaauaaaauaaaauuaaauuuaaaaauauuaaaauuuuauuuuauuuuuuuuauuuuucaagaccaggcugaccuugaacucaacagagaucugcuugccucugccucccaagugcugggaucaaaggcgugccccacaccuccuggcuuccucuuuuuuccaggacuuacaguguuguguauuuuuauuuucauuuugaaaguacucugaaauagaaauuaggacagagaaugcuguagucagaaguuguguggaugugguucccuuucucccaggggguggggaaacagcucaaauucauuagccugauuucucagccaaccuuccugucuuacuuugcacugacuccauacacaacugcccacauccauaaauacagaguccugcugggggucucuggagaguaguguuacaguuuugacuuucuaggguuuauauguuucuguggugcgugcuagacagacaauuacuaugguaguuguuggaaaggguuuuaagucuaggucucacuauguagcccuggcuggccugguccucauuauauaggacaguauucacagagauccacaggcuuuugcuucucaagugcugggauuagagucuuacaccaucuuuguuucauuuaugagacagucuucaucauauacacaggcugaccucaaauucccuguucugccucaagcuccuaaaguauacugggguuguaggcaagugccaugcuacuuaaaacuuacuuauuuaaaacuuaauauuuuggggcuggagagacagcucagugguuaagagcacugacugcucuuccgaagguccugaguucaaaucccagcaaucacaugguagcucacaaccauccguaaugugaucugacacccucuucuggugcaucugaagacaacuacaguguacuuagauauaauaauaaacaaaucuuuaaaaaaaaaacaccuuaauauuuauuuaauuaccucuuucccaaauaauauuuaauuauucuggucaaggaugaauacuuacuuuaugaaaccauuaucucauuugcuacacuuaaucacugcuauugauagauaugggagguagcagccuuuuucuuuuucuuuuuuuuuuuaauuauuuuaaaaaucaaaauagguuuaguguauaccuucuaccccagcuauuuaggacgucaagaugggaggacugcuugaguucaggagccugaggucaaucuggguaacauaggacuaccucaucucaaaaccaaaguaacaggucaggcaggcaccuccaucagauugugauuugcccaagucacauaauauugugagagcuuagauggcaaccccaaagucaaagcgcuggucuuucagugucacccugucacuuuucagauggcuuucacuguuguauaaauaucuuaauguauuuguuucuuguguuuuaguaacccuuucaaauuuuuuauuuuaaaauucgaauacauacugggagcccauuauuuuuaguuuuccugcucuuccuuuccagaugucugguugugcauauguuagauugaaugcuaaugucuuuuuuaaaaaauauuuauuuauuuucauuuauaugaguacauuguaguugucuucagucacacaccagaagaguacauuggaucucauuagagauaguugugagccaccaugugguugcugggaauugaacucaggaccucuggaagagcauucagugcucuuaaccacugagccaucucuccagccacgaaugcuaaugucuuaaaggccacagggcccucucuucuguacauacauacuccauuauguuuauuauguuuucuuaucuuuuuuuguuuuuuguuuuguuuuguuuuguuuuguuuugguuuuucaagacagaguuucucuguauagcccuggcuguucuggaacuuacucuguagaccaggcugcccuugaacucagagauccgccugccucugccucccaagugcugggauuggcaucaccacugccuggcauguuuuauuuucuugcucuguuucauccaggguuauuacuauugcuuugucuucauguucauggaguuuucuuuuauaugauccagucugcuacuaauacuauccaggaguuucguuuguguccuggucucuuauaagguccagaucugccuugaauuuacuguguagaccagacuggcccucaacuuucagucuuccugccucagcuucuuuagugaugaaauuacaagcaucagcccccacacugggugggugcaucuacugucuuuaguuaguuaguucuguuuuugagacagagucuuaccauauagcauuggcuagccugaaacucaguauguagacuaggguggcuuugaaauuagaaauccaucugccucugccucucugccucucugccucucugccuccgccucccaaguauugagauuaaagaugguugccacuaugccuggcucuguguguguguguguguguuuuuuuuuuuuuuuuaagauauagaaguuugauuuggucucaaaauuagauuuuauuucuauuuuaguuuuaaagguuuuucuguauauccuuuaguaaugcuuuuuucuuuuuaaaaaucaauuacuuuuuauuuuccucuuugagacagagucucauuauguagaccuuguuggguuuggaacucacaaagacccaccuucacuugcuugcagaaagucugcuaaauuuuuauugcauacgaaggcauugaccagauuuccucucuguguguaugugugcaugugugugcuugcaugugugugcaugcgugcguguguuuaccaguucuuuuuuuuucuuuguugucuaucuugcaaguucuuuuuuuuuuuuuaaagauucauuuauuuauuauauguaaguacacuguagcugucuucagacaauccaaagagggagucagaucuuguuauggaugguugugagccaccaugugaucgcugggauuugaacuccgaaccuucggaagagcagucgggugcucuuacccacugagccaucucaccagcccuaucuugcaaguucuauucaguuuacaucuccugagugauuuuccuccacuacugagcaauaaugugagguuuguuuggguuccugcgagcacagaucaguguuccagagauuaaauaguacuuuucuauuuugucaaauugauaguagguuuaaagagagcaauugcuguggaaauuaauucuucaugggugagaguacauaaaaagaacaaaaguuuaaagucagccuuggcuacauagcaaguuugaggccagccugggacauaugagacuucaucuuaaaaauaacaaaggcugggcgguguacacgccuuuaaucccagaauuugggaggugaaggcagaggcagguggaucuuugaguucuaggccagccuggucuagaucaauuuccaggauagccagggcuacacagaaaaaccuugucuugaaaaacagacagacaauaacccacagagaaucuuuaaauguucauauguaucuuuugacucauuaaucuuuuuuuuccugaaaaauuauucagaauauguauauaaaaaguauaguaaauguggaggccuuuuuccuuuuacauugcaagcaaccuagagaaauaauuaaagaggaauggacagacaguguuucaguguaggcacuugcugccuauaagauagagagaaccaguuucuucaaguuauccuuugacuuccgcauguguacuauggcaugugugcaccugcacacauacacacagaauaaauaaacauaaagacauuguuauuagccaggugaugguggcacaugccuuuagucccagcacuuuuauggccucuaguggcagguggaucuuuguuaguuugaggccagcuuggucuacagagagcgucugggacaaccagggcuacacagagaaauagugucuccaaaauaaaacaaauaaauguuuuguuuuauuguucuuuugaggcaaaguuucuuagagaugugggccaccacucccagcuaaaauguuuguaaagaaagugauuaaguuaugaaguacaccgauacaaagaggaugcuggagaacacaugagaaacuucccacuguguucuucuuugauuguucuguuauguauguaugauauacacacacagaguaccuuuuuaaaauuaagauaaacuagccauguugacauaggcuuguaauuucagcuucugagaaguuagagguucgagaucacguuucaggacccugucuuaaaaaacaaaaaaaaccccuugggucagagagauggcucagcgauuaagagcacugacugcucuuccagagguccugaguucaauuuccagcaaccacaugguggcucacaaccaucuguaaugggauccgaugcccuuuucuggugugucugaagacagcuacuguguacucacauauauaaaauaaauaaaaucuuaaaaaacaacaacaaaaaaaaacccuuucauuuuauauauuauuuaggauaaaacauugccaugacaagaccaaaaauaucauuugccuaacacagaggacuugggaaaugguuuaaccagccagugaucuggagacuaaaaaagaaaacauuuuuacguauauuuguuuacauuauauguauguacaugaggauauguagagguagaggacaacuuguagaaaucacuucucuucuaucguguacguuugagagacugaggucauaagguuugguagcaagggccccacccauugauccauccugcuguuccauuuuccccacccauguguuuaaaacaguuuauaaacagguguuuuaaacuguuuagacuugaaauuuguuggcaaacuuggauuagguuuaauaaguuuuaauguguuggucagauuuugaauaaauaccauuugcugcauuucagaaaccuaaugguauguacugggaaaugcagccauuuuccuucccugaugaccugaaagaucugauccccacuuucaugggcauaucuucuaauagagacgcuauuacaaucagagcugccauagaugauguggcagaguacuugccacauauauuuagguccugguaauaauucccaguaccaaaaaaucaaaaugaaauaaaaccaaaacauaucuuuagguuggggauauaacucaucauaguuuucaccuugcaugugugaggcucuuguuaaauccccagcaacacacacacacacacacacacacacacacacacacucacucacucacucacagaguauuuggaaaauuacagcuuugauaagugcuaugaaagagagguucgaggacagguuuucagcuugugcuggguuucaaaugacagccagacacuaaaagcaguuuccaguaaagggauguaaauuuagaacaaauguugaaccgaaucuaaaauuuacaguuauuuuagucuaaaaagguguagcuggaguaugaaaaugcccaagccucuuaaagaauacaguguaaauacaguguaggguuccaaggacugagcccuggggaugcuuacaguuaggguuggaaagaggcugguugagggaauuguaggggacagaaggagugguagaaaguugaaagauuuucaagaauuuaguugugaaaaccaaggaaaggagaguuucagagugagagucaaggacagggcaguuuuuaaaagaggcaauaguaaucaggagagucaacagaauuaacaaaagcaacaacaagauuacugacugagaaaagagcauguuuuaaucaaaugcucuugcugaaccccaaggacauuguuuuauagaaaaauagaacaacuguuccuuuagaaccuagauucaacuaauugagacuauauuaacuugagaaauuugcuggugaaagauaauuauaacaucccaguuagcuaaagaucuuuugagauaaaggaaauucagucuacagccacaacuuuuaacucucagcacuccuccccacugauagacacagucugucugucugucucucaacuaaagaaccuauuuuaguuuaaggacacagaaaaaagaaccaguaaagagaggcuggaagugccucugaggaauggaaugauguacugcaucaagaaggggagcaggugaccuggagagauggcucagggguuaagagcgagcacuuguugcucuggcagaggacuuggguuaaacuguaguuccagggauuaugaugcuggcgcagaggcaggugggcuuuuggccuacuuaauggauuccaggccagcuaaggcuaccuagugagacccuuuaaaaacaaaacaaagcaccuaagugugcauccgaaaccaaagugccagggaacagagacccaugguucccuggaauuccccggcuagccagucuagugaaguuggugagcuccagauccacuggugcuucccuuggagcuguaguuacagacuguuagagcuuccaugugagugcuggaguuaaaccuggcucuucugaagagcagccaguuccuuaugcacugaaauaugccuccagcccugaccccgaaucaaaaaauaaaguggaggaacuggagagaugacucaguucaguuaagagcccucuuugcucuugcacaggaaauaaguuugauucauagcacccacaugguagcucaaaaggaucugaugcccuuuucuggcauccuuggacuccaaguauauuugugguacauagacaaauauacaagcaaaauaccaauacacauaacuuuuuuuuuuuuuuuuuuuugagaacaggguuucucuguauagcccggacuguccuggaacucacuuuguagaccaggcuggccuugaacucagaaauccaccugccucugccucccaagugcugggauuaaaggcaugugccucauuacauuuuuuaaagggaagaaaagauggagagugacuaaagaagacacccaacauuuaauuaaugaacuaacuaacagaagggcaaaccuugauacuugggaggcuaaugugaggccagucuguguuagaaugagacccuaucucaacaaacuacagaaaaggggucuggcauguuagaucaucaaguaaaagggcuuuccugauagccuuaguuccauuuuuggaauccacaagagaagauaaaaacagauuccuaacuaaaacacacacacacacacacacacacacacacacacacacacacacaugaucuugaaccucuaacuucucagaagcugaaauuacaagccuaugucaacauggcuaguuuaucuuaauuuuaaaaagguacucuguguguguauaucacacauacauaacagaacaaucaaagaagaacacagugggaaguuucucauguguucuccagcauccucuuuguaucgguguacuucauaacuuaaucacuuucuuuacaaacauuuuagcugggagugguggcccacaucucuaagaaacuuugccucaaaagaacaauaaaacaaaaggggagagagaacugucauggugguauacaccuguaauugcaaggaagguaagaguugaaggcccauauuuaaagaguuuaaaaccagccuaaguuacaugaaacccuguuuuuaaaaccaaaccaaaaaugaccaaaaaaagggaagaaaggaaggauggaucaaagacuuuguauuaacuuggugucagauguggcacauacaugcaugaugguauugaaaugcuuuuuuaaaaaauauuuaauuuauguauaugaguacacuguagcuguacugaugguugugagccaucaugugguugcugggauuugaacucaugaccucucgaagagcagcagucacugcuguuaaccacugagccaucuuaucagcccauauugguaugcuuaacucugauuuucauccuuggugagugaagcaugcauggcuguguguaaauacauacgauauuuuuuacuccuauuuauuuuguuuuguuuuguuuuguuuuccagacaggauuucucauguaacccuaccugucuaggaacuagcucuguagaucaggcuggccuuaaauucacagcgaucugccugcuucugccuccugaauacugggauuuaaggaaugcaccacuacugccacuuggaucuauuuuauuuuuugagccuguaucccagacuggcuucuaauuuacuauguauccaagaaugaccuucaaguauuguuuuuuuuucugguuguuguuguuugcuuguuuuuuuuuuuguuuuuuuuuuuuuuuuguuuugagacuagugucucauugcaagccuuguggaaacuggaauuugacuuguagaucagguuggccugaaucuacagaguucugcuugccucugccuccuuagugcugggguuaaagguguguaccaccauacccagcuccacccuguaaauucuguauaugugccuuugugccuguaaugauuagagaaaaccuugauguugguccuugucuuuuuaaacuugcaauguuuuuccaggcuggcccugaagucucucuucugauuccacuucccagaccaaagggauuucaggcgugucccauccaccaugcucacucugugugccauuauucucagugcuauaucuauacuuuacauaaauggcaauuauuggugauccuuaacaauuccuuacaucuccggcuuggcaguuggcucucccccuuuuccugguaggcucagaaagcccuccuggaauugguuaucauguguauuaaugauaauauuuuaagcuggccguaauugugcaugccuuuuauuccagcacucagaggcaggcaaauuucugugaguucaagaccagccagggcuacauagagauucuaucucaauaaaaaaauuucaauaaauuacuuuuuuaaacagugucuuacuauguaguccuggaugggcucaaacccagagagaucuacugcucuguuucccggggcugguguuaaaggcaugugcucaauccuguaagagugguauuuugaaucugguucuuugucauggaaccuuuaguauuuaguauuuaauaacuguuauuuaugaccuagaccuuuguuuggaaagaugguagugcugaagauguaguguagugauuagagcgccugcuuggaaugcuuuagaaccugggucugaucccaacaucccauaaacugggugugauggcccacgccuauauuccagccuucaggagauaggagguuaggcaggucaccagguccccugcauccuggguugcagauauuuuuguguauuugugaauauugaagugcaccagaguaagauaccagggggacauuggaaaauacuccuauagucauauguauacucugugugcugacaggcacuugggucuuuucccucuuuucucagucaagcaguguguauauauaguuuuaauaaucagcccugccagcuuuaugugaaaacuguaauuucccuacucagcucucucuacuuccucuuccccugucccagucccuccccccuccccuccucuuugccccccccccuuuuguuguuguuuuuuuuguuuuuuaagauagggucuuucuuuguagcucuggcuguccugaaacuugcuacauagacuaggcuggccuugaauucagagauccacuugccucugucucccaagaggaggauuaaguucaugggucacuauugucaagcuuccauuuucaauucuuaaaucuuuauuuuuauuuacccaauguuuuaguagaauacuuaagguccauccccaaucucucccccuuuucucucgugcugaggacagagccuaagacuuauuagcacacgcucacuaagcagucagccacuguguuguguaucgccccuucuguggauuucuuagaacuuacuuuuauuuucauacuauauacucauuuucaugguauagucugagagugcacuccauagagcaagaagucuugcaaaacugaagaacaaaugggugaugagugcggcauugaaaacaguacucagucgggugguagcuguagaacaagaagugauuuggcugaguucuauggaaagcuuuucccuuuacuuuaaugagaucaauuuuaguucauuuccuugucuuauucucacucaucagucaugagucauccacaugcucauucaguaaacauggcuucuuugucagaggagaucaaaugcaguguuaguuaggucugcugauaaaaaauaaaaucaccccuccccaauuaaacaaacaaacacuaaacaaucugaaguuggaaagccauucccauuuuuuuuuuuuaaagauuuauucauuuauuauauguaaguacacuguagcugucuucagacacuccagaagagggagucagaucucguuacagaugguugugagccaccaugugguugcugggauuugaacuccugaccuucggaagagcagugggugcucuuacccacugagccaucucaccagcccccaccauucccauuuuaaaacaauuuuuauuuuauuaguuuauguguauggguguuuugccugcauguacgucuggacaacaugugugggcaaugcccucagauuccagaagagcaucucaaaacaacaaccccccccucaaaaaaaaaaaaacaaaacaaaacaaaaagcaaaaacaaaaacaaaaaaaaccccaaaucuagcuugaggaguuugguuuugagacaaggucucacuauguguaguucuggcugcucuggaauuuguuguggggaccagucuggacugccucuuaccugauuuugccuugccaggcuaguuugaguuuuuaagaguugaugugugcacaaauuugcaggcuucugcuugcuauugauggugaacauuuuuaugaaucuauuuuaacauguuuauguuaguuuguguuacucuucaugcuaugaaaaaaagccugacugaaggaaguuuggcucacaguuggaaggucugucccagaaaaaaagugaggugacuggucacauuguauccaccacagucaaugcauuagcucaugggugauaccucccacaucugaggaaaggcccucacucagaaguauaucuccuaguuccuucuaaaguccagucaaauugacugugaacucaccacaguggaguucacagauugaauauugccauguguccuugcaguuuacauuuuaugaguguuuugucugcauguugucuguguacaacaaacagugugugccuaguaccuacagaaaccugaaggagacauuagauccccugaaauuggaggaguuacagauaguuguuaguuaccaggugagugcuagauaucuaaccuggguccucuggaaaaaguagauagagcucuuaacugcugagcaaucucccuaggaccaugaugaaauguuuuaaaauugaugaaugguuuccaaggaaaauacuguaguuccuugguuuuaaugccuucuuuuugguuuuucgagacaggguuucucuguauagcccuggcuguccuggaacucacucuguagaccaggcuggccucaaacucagaaauucgccugccucugccucccaagugcugggauuacaggcgugcgacaccacgcccggcuauguguucauuuuuuuuuuuuaagauuuauuuauuuauuauauguaaguacaccguagcuguccucagacacaccagacgagggcgucagaucucauuucgggugguugugagucaccaugugguuucugggauuugaacucuggaccuucggaagagcagucgggugcucuuacccacugagccaucucaccagccccuguguucauuuuuuaauacuucuaucuuaacaauauuugaaaucagaauguacuuaacauuuuauggcauaauuauaauuggcagagguuacccuaucccugaucccuguuauaugaaguaacgguacaucuuuuuuuguuuguuuguuuauuuuguuuuuuguuuuuuucgagacaggguuucucuguauagcucuggcuguccuggaacucacuuuauagaccaggccggccucaaacucagaaauccaccugccucugccuccugagugcugggauuacaggcgugaaccaccacgcccggcuguaaugcugcaucguaauaaaguauauaugugcauacauauguguguguguauuauguauguguaacaaaccaaccuaccucugccuccugaguguugggguuaaaaguaugcaucucucccaaccccuaaaguagagacacuuaaccugagugucaccuaggguagcuuuuauuucauuuuauuuauuugguuuugagacagaauccuggcuggacugaagcucaguauauagaccaggcuggccucaaacucacagaaaucuguugaucucugccccugucucccagguacaggccugggauaggaugacuuuugguuuuuagaaugucagugcucacuuuuuuuuuuuuuuaaacaaauuaaaaguucuagagagaauuaaaaggcauugacuuauauuuuaaucuuucacugucauugcugguuuuuuuuuuuauuaaaaauagauuuaccuuuauuacuaguacuuuguuucuaggccuucuuguaucucagcuacauauaguaaauucuuucagauuuguuuuuggguuuguuugauaaguggcuacaguacugggauugaauucugaagacuauacauaguaggcaagcacucaacuguugaaccauauuuucgaucccugaauuucuuuuagugaaagucacuugagccagggguggcauuacacaccuuuuaauaccagcacuaagaguucuuggacagccugaucuacagagugaguuccaggaugaucagggauacacagagaaaccuugucuugaaaaacaaaaaacauaaucauaauaaugaaagaagucaguaaaucucuggggugucaguuuaccagcagauuuucuuucuguccuuauucuguauauguuuguguauauauauuccaugauuccaaccccguccucuauacuuaggagugaaucccgggccuccuauaugcuaggcauggcucuaccacuaagcuauaacuauagcucuuauccaguacuugaaguaauuuuucugcuuuuucuuuuuaaaucauaaauuuuuuuuguauguuuguagauagagaggaaaauguguuuuuccuacuguuuauucaaaauguagucucauaccauuccucucacuugcccacccuccuuccucccucucucccuuccuuccaacagggucucuacauauucuacauagcucuggacucaaacucacagagauugccuacuucugucuccagagugcuagaauuaaagucaugcacaccaggcuuucuuaccauuucagacagcacacaugucuguggauuuuuccccagcagcauccagucuuguagauaaguaguucuccagugaaccccagcuacaaucggcuggaacuuuguuccauucugguucuguaccuuucacuggccuuuaaucagcugagggcacuuaaaugucuucuugaaguaaccucuggcuucagugguaaccuucaguccucucugacugccuggauacaagacauagcaaacaguuauuggacuaaaccaggaacaaaauuaacaggauauagcuagauccuacagguugagagcucaaucuugcaagacucaacucagaugcaguuacaaaaacagguuuuccccuguuucuagccaauuggcuaugaaucacaguuucuauggucuuuuuggauuugauuaauucauaagagcagcacacagaacuugggaaacuguuagucaaacagauauuaagaaagauauaugggguggagagauggaucauugguuaauaaaguauacuguucuugcagaggacuguaguuuggcucuuaguacugagcaggaucucauagccuggucuccaguuccaugggguuccucugaucucuauggguacuugcauacaugugcacagacacacauaaucaauaguaaauaaauguuuuuuaaaaagaauggagaucaggcagccauguggaagaagugcaaaggguggcauguagaccaggauaaggaucuucuguguccgaaugcuucuccaugaccagcucucuguaagucauagagcucaguccuuuuggcugucuauggaugcuucauuacauaggggagaugaaguuauggcuaaguugaaguuuaaaagcacugcagaagggcugaguuccaauacauagguacucuucagauaucguuuaucauauuugcuaauaacucuugguccauaauaaguuagguggccaagcucagaaucaguaaggcaaagaaguuagacugcaucuuuuuaaauuuuauuuuaguauuuuaauaauauuuugagauuggguuucauguacuucagauuuuguagcuaaggaugacauuggaauacauauccucuugccgccuccccccggcccccccacccccgaaauaggauuucucugcccuggcuguccuggaacucuuuuuuguagacuaaccuggccucaaacucagagauccaccugacucugccuucugaguguugggauuaaggcaugcaccaccgugccugauucuugccucugccuucuaagugcuaggcuuucagaugugugccacuguacccaguuuauuaggugcuggaaaccuaauccagggucuuaugcaugcuaggagggcauccugucuaguggagcuacaucccguguucuuagaccaucuuuugaugaucucaauaugauguacacaggacuaugcuuaaaauagcagggugaguugauggccuuuaaaaaugguguguguggggaagcuggagagaugacucaguaauuaaacuauuugccuugcaaauauaaggacuuuaguuuagagauucaauacccacaaaaagaugggcaugguggcacacaccagugauuccaguaaugguuagauguguagaucccuggaacuucauuggcuagcugguuuagccuacuuaguaaaguuccaggccaauuagagcucuugucucaaacaaaagauagaaaaugugaagaacagcauuucagauuuccucuaacguccauaaacaugcaaauaauaaacaauuucaaauuuguuuuuuuaagauuugucgcugggcgugguggcacaagccuuuaaucccagcacucaggaggcagaggcaggcggauuucugaguucgaggccagccugguuuacagagugaguuccaagacagccagggcuauacagagaaacaacccugucuucgaaaaaccaaaaaccaaaacaaacaaacaaaagauuuguuuauuuuacauuuuaguguuugucuauguguguguacauuaaaugcauaccugguguccaagaaagccaaaagagggugucaaauguuuguuuguguacauguguuuauacccucccacacacaaacuuuauguagauagagaucauaaaccagugguagaugccuauaccuuaagcuacccuagaggcucaagaaggauugcuugaauccaggaguuuaaggcuuuccuagauaacaugggaaaauuccaccuuuaauaaauuaguaaguuaacuagguaaggaaguaagugaaugaguaaauacuguaugcaugcgcauuuacuaggguacacaguuuuaggguaagguaauuuuccuacccccacccccguuuugauuuuuugguugguugguugcuugguuuuucgagacagggguucucuguauagcccuggcuguccuggaacucacuuuguagaccaggcuggccucgaacucagaaauccgccugccuuugccuccugagugcugggauuaaaggcaugcgccaccacacccggcuucccuaccaccaccauuuucuuuaucccacuaucuuuugguuuucauuauuguuauugaacaguagucgugccauagcugcugggauuugaacuugcccucacuuguguagcaagaacauucauuaccuacugagcuauccccucugaccccauuuuuuucuuuucuuuuuauuuuuuauuuauuuauuuuauucaguuaagaacuguugaugcucuugcauagcagaagaucuagguucacaucccagaacccacaugauggcucacaaccaccuauguggcuucaauccagggaauuugaauuuaauuuauuuuuauguguauaacuguuuuccuuugugucugugcaccaugugugugcagugucuuuggaagagaggagagguauuggauucacuagggacuggaguugcagacaacugugagcugcuauguggguauugggaacagaguccucuggaagagcaaccagugcuuuuaaaugcuaaaucaucucuccauccuuuaaagauuuaguuauuaauuccugacuuagcucuguaaccuccaccccaucugccugucuguccaucuguccauccauccguccauccaucccuccaucuuuuuuguuuuuugagacaguuuuuuuuuucccuguguaacccuagcuguucucaaauacagagaucccccugccucugcuugcugcgauuaaaggugugugccacccaccacaccuggcccuucccuacuuuuaaauuaaggaguacauuaguacaaucucuccuuuuucucccagugguaacugauggguuuuaacauguacaugacucauuccuuuauguuuccaagcuccuuuuacuaauaguacacucuuaaucacuguugcuuugagguaagguuugaaauuaguaugagugaucaaguuuucuuaucaaaauugacaaauucuuucauuccuaucuaaucuacuagaucacuuuguuuuagagacagguucuuacuauguaggccaaacugccauugaauucaaacuaggcauguaccacagagcaguccuuaggacccuuuuuguuguuugcuuuuucuaaaaaaagaaaaagagauuuuuacacuuguacaaguguacacauaugggugcaggugccuguggaauccacaaaagggguuggguccuuuagagguggaacugcaagugguugugagccagcuggcaugggcgcugggaaccacacagguccucugcaggagcaguguaugcucugcacgacggagccacuguucagcuuccucagccacuucucaugccugccuauucucuaaagaucucuuuuuucaaguuuaauauauuucuucaacccuuguucuaacaucauggcccauuauaguagucaccagccacuuguggcuguugaacacuuuaaaauaucuaauauaaauugagauguguuauaaguauagcauauaaacuacuuuaaagaauuaaaaugaaaacuuuuuauuacuguguuuuuacauauggacaguuaacuguagcaaacaguauuuuaucauauauaucauauauaaguucaacaacugaagugaauguguguguucuguguguaggugugugugugugugugugugugguaugggauguguguguguucucuguguauguguguucuggugugugugugugugguaugggguguguguuuguguuaugguguguguguguguaucugugaguggugugugggauguggugguagugaugaagauagaaacugaggugcugcugugcaucagugcugagcugucugccugucucacuguugcccaugguguagaacuuggggcaguuaucuaguuacagcuccccagugguggccuuauaagcagguuguaugcucaucgucuuugccuguuuuuguacugaggauugaacuuaggccuugcacauucuaggcaagcauucuaucacugaacuauauccuuagcaagguguuucccuacacucaccucagacuugugggcuuccuuuucaguagcuugucuacuuggcaccauggucagcugaagucuuuagagaucugguacuuuuucucuuuuugcucauuuuuauggaugccuuauuuuguagcauguguaguuaauuuuacugcauguucuucauugccuuuugcaaauuguuggaauaauuuugugcccaagauuagaaauaaugguuuucugaaaaauuuuuguuucugccagacauucagaccauuaccauucuaugccccuccuaaaccauuucacugcguaagauuuucuggaacgcuacagucuguauuuggaucuguggaaaggauguuggucuguuucugguuugcccugaccuuaaauauauaguuuuugagauucuagcugaaguuugggccauuuauucauuuauuagauuuccuuccuuuggaaggucuuaggcucuguuccugccuacagucccuuaagaaaugaggauccacuuugauaaguuuagggaacuccuuccagacaagaguaagcuuuuguccucuccuaugcuucuggguaaguaacccccuuuuuacuugagcucuggcucaguguuaucuaaugguguuauuacucuguagcuucuuuuaagaucacuuucuuagaguuuuaguuguuuacagaguuguuccaagugguggucuaacacacuauugccaaaagcuggcagagauagauagagauacacacacacacacacacacacacacacacacacaccuuuuucuccucccuguuaaucugacaugggcacuaaguuuaggauacuuacugguuaagccuuuugcaaauggaagguguguguagaacugaaagucauccgggcgaucauggugcucucaugccuaucagauuacagguugguauucuuagguaaaaauaggacauugguuuuguuguuuucuuucucuuuuucuuuuuuucccucccucccucccuuccucccucccucacuccguccguccguccgucuuuccuuucuuucuuuucugucugucugucugucuggacaggauuucucuguguagcccuggcuguccugaaacucacuuuguagaccaagauggucucaaacucagagauuugccugugucugccugaguacugggauuaaaggugugcaccaccaccaccaccacuugauuuuuaguuuuuugagauuggguuucauuguauuucugguugucucuguagaucaggguggccuugaacucagaaacccccugucucugccuccaugugcugugauuaaagguaguaguuguagcuggccuggagugcaugaagacuaaacugugacccuacugcuucagccucuggagcucugggaucauagucaguaccaccacuccugguaugauagcuaaaaaaaaaaaaaccuuuuacuaugucuuuauuuucuucaauuuuuuuugagauuuauuuuuuaaaaacauagguaguguuuguuuguuuguuuguuugguaggguucuacauaaaugucuuuacaccaugugcaugucauaccucccaggccccauggagauucuguccuguacuuuucucuauaugaaguuucauuuuguuuuuauuuuuauuugcuggaugguuauccacugcuguauguuauuuugagcugaagugagcauuuaaggcucuucagugagauggcucauugguuaaagacaccugcuaccaagucuuaacaaccugaguucaagcccugaaacccacauggugggagaagagaaccugcuccugcaaguuguccgcacgcacgcacgcuugauuaauaauaaagaaaagacuccaguaacagaaaauuguaaucacaguguuuuuuuaugaacugggaacucugggucuggagugcagccaagauguaggcugauguguuggggaagcacuugccuugaggugaggguaauuugcagagaauugcagauucugaaacagaagcacaaacgugcagagaaacauaaacugaaaacuuuaguuugacuucugagcaaguggcagacaggaagcaaagcagggugaaggugucagaagacuugauuccagaaacaucugaagguucugggaacagccagauugguucuuugguagaaauuuauccacacacuccccgcccccccgaagaucaugggcuucgaaucauuuaccccauauugaaguugagauaaaauaaauuguuuuucauaaaacauacuaauuauuuggaggaaauucauacuaaacaaaggagaaaacuugggguaaagaagguucuggguuugauauucugcacuucaagggaucagaguaauccauaaauaccauuuuguuguuguuguuguuccuaccaucuuguccauauaucuucugugaggcugauaucuccuggaggacuaguuugcuuucuugugguaagagcaaaagugacgcuucugugauuuagaaauuugcaauuaacuuguuuuugcuuguuuauucauuguuuguuuuuuuguucauuguuguucucuuuugagacagggucucucuguguaauccuggcuguccuggaacucacuauguaaacuaaacuagguugagaucugccuaucuuccaagugcuggaaucaaagacauauacuacugugccuaggugauccaucuuuuaauaaaagaaaauuguaauuuauaaccauaauauauguaugguauuaugguaugcuuaugcacucggauauuuugccuguaugcaccaguagaugccagaggucagugucaggugucuuccuccaucauucacaaccuuauuuaauguauuuuuuuauuaauacuuugagaguuuuagacagaauauuuuaaucauuauuucccccccaacuccuagauucauaaucuuuuguauguggccaaucacuaaaugugaaugaccuacugugacacauccuuaaagaaaucucauugucauuuuuuucuaguagcugugcuuggcccgcaaacuccagggauccuuuguuucugcucccgggugcugggauuacagguauagacgcagugccuggcuuuuguguggugcuuuggaucugagccugugcccucaugcuugcuuggcaagcacuccauucacagagucgucucuguagccccuguggguuuuuuuuuuuuaauuuuuuauuuuuuuaagauuuauuuacuuauuauaugaaaguacacuguagccaucuucagacacuccagaagagggagucagaucucguuacggaugguugugagccaccaugugguugcugggauuugaacuccggaccuucggaagagcaguugggugcucuuacccacugagccaucucaccagcccggguuuuuuuauauuagcaucucauguucauguauauauugguugguuaggucuaguguugggcagagagcaguagcucaagagacaacgauguuaguaacuuuacaagucaaggaaguuaauguuagcaagauucauucacuaacaaguaacuuuagcuauguucuuugccaguuccuauccauaaauacuucuaaugguacuucuucauuaugguuuaauaaaacuucaucuguugaguuuaagugaccaccucauauuuagcaggaauaauugggaaaaauauaggguuuuuuuaccccauauuuugaggaaaccuguuguaaaaucacuuuggaacaaagaauuuaauaaauuagaggaacuuugcaaauaauaaugcccugauuaucucuuauagcugauuguauguacugugucuaguuucuuuuuuucuaauauuuuuccuugauaaauucuauuuauuuauuuauuuauuuauuuauuuauuuauuaugugugguguuuugccuaucugucugcgcacugagugcauauccccuagaacuaguguuacagacauuuuucagccacccuaaaggugcuaugaaugggaucuggcuccucugaaagagcagccacugcuuuaaccacugagccauuucauacauacaucauauguacaguguauuuauauuuaccccaacuccuccuccuaacuccuuccagaucuauagccaaccccucccaguuuuguggcuuuuuuuaaaaaaauuugugcuguccauaaucauggauguggaaccacaccuuuaaggaaggcugacucccuucccuggaagccauaaacuuucaguaacuucucagcucuggguagagacuguggguggcucuaaugcugagaugagcuugaagccuugcagaaccaucaucuuauaaugggguuuacugaaguuaacagugcuucagaaaaucuugaacaagcccccagagaagaccaacuaacgccacagaagagauuuuaggaugagucagaaugaauagaaauuaguguuuuaugcaaauaaagggcuuaugagauaaaguguguguuuguuuuuaaaaaaagguaauauaaagauuacacaucagcacacacacacacacacacacacacgcacagagacagacaaacaggccaacaccuaaggaaaggacaguaguacgcaccaaaagcaagucaucaggguguacuucaaaggaagugucaccugauugagcauuuuuauuuaaaucuguuuguuuuacuuuuucgagauacgguuucccuguagcucaggaacucuauuuguagaccaggcugaccugaucugaucuaggagauccgccugccacugccuccugagugcugggaucaaaagugugugcuugccaccaccacucagccuuucuuucuuucuuucuuuuuuuuuuuucuuuuugguuuuuugagacaggguuucucuguguaguccuggcuauccuggaacucacucuguagaccaggcuggccucaaacucagaaaucugccugccucugccucccgagugcugggauuaaaggugugcaccaccaugcccagccacucagccuuucuuuuucuuuuucuuuuucuuuuaauuauaauuuuaauuuuucucaagacaggauucuacugucuggcccuggcuguccuggaacuugcucuguagaccaggcuggccucgaacucacagagauccgccuccuuuacuccccagugcugggauuaaaggugugcacccaccauugccuggcuccucuuuuaaaaauuuauuuuuauuuuuuaaaagauuuauuucuuuauuuuauguauauaaguauacuguagcuuuaucuucagacacaccagaagaaugugucagaugguugugagccaccaugugguugcugggaauugaauacaggaccucuagaagaacaaucagugcucuuaaccucugagccgucucuucagcccugcauuuuuauuuuuuaagaaaguguuuuuguuuuguuuuuguuuguuuguuuguuuuuuaaaagauuuuuagacaaaaguuucucuguguaucccuugauauccuggaacuggguguguagaacaguguugcugauaacucagagauccaccugccugugccucuugaacgcugggauuaaagacaugcaucaucacuccuggcuuaacuuaaaauauuuaaaaauuauuuaauucuauguaaauggaucuuuugccuaaauguguagaccgugugcauacagugcccagaggccagaaaaagggcacugaauuccuuggcguugugagcuaccaugugagugcugggaauagcacccaggugcuuugugagaacucagcugcugagccaucucuccagccucagugacuuaagucuuaauaauuucaugauaaguauagauggguagacuaaaucuuugcauguaagagucucacuauuaucagaugauuauuucuuuuauuuuauauuuacuuauuuguguguugguugaggaggcacaugcacagcauauauguauguaaagguuaguggacaaauuaccagacucaguuuucuccucccauggucuggguuccaaagcugaacuuagauccucaggcuaaguuucaacaaguugaaaacuucuguggggucuacauguuuuaauuuuuuuuucagagaauugccauuauuaauauuagaaucaugccugaauaguaaagccuuugggaggcagaggcagguggauuucugaguuugaggcuagccugguuuacaaagugaguuccaggacagccagggcuacacagagaaacccugucuugaaaaacccccaaaaaaaagaagaagaaagaaagaaagaaagaaagaaagaaagaaaggaaggaaggaaggaaggaaggaaggaagaaagaaagaaagaaagaaagaaagaaagaaagaaagaaagaaaacaagauuccauaacuaaauugugaacuuaaauccaauuuugaguguuuucagaacuggccggggaaaugaaaagcacagcccagauugaguguggugaagugaaagagcggucccucuccuguccucccacuguggugaagugaaagggcagucccucuccuguccucccagcacugcaggaaaggaugacaacccacccccaaaagacaguguuggucucaaguagauuuuagauaugcuuuuuuuuuuuuuuuugguuuuugagacaggguuucucuguguggcccuggcuauccuggaacucacuuuguagaccaggcuggccucgaacucagaaaucuaccugccucugccucccgagugcugggauuaaaggcgugcuccaccaugccccacauuagcagagguuuuauauaacuuguugccauauccccuaaacaaggucauagcaguggcuuaaacuauauauacuucaaauuuuuacagguaauauuuaacucuuaaguauaaaagguggaggaaaagagaaccuggaacugcaguuuguucuagcuauaauuuaccuucugcuguagacugccuccuccuguaaccgcgugggcuaauaggugagauuguuaacaaccugcaaguagagaaaguuguuguguguggugcuuagugaaccagugcccugugcaugccagccaggugcuccacugaacugaucccagccaggagacaaguauuuuaacaucaguaucugccaggaaugguagugcacaccuguaaccccagcacucagugggcuaaggcaggagaauuaugaauuugaagccuuaaaaaucaagaaugcuaucuuccuuuccucuccccauuauucuccugauauauuuaauauaaacuacguagcaucauaggccuuggcaaaaagacaccuaaauuuaagucuuguccaguugcauacauaucaaaacuuuuauacaacuccacaaacugguacuucaucagaggguuggggauugcucaggaucaaacccuguuccucacgcacugcacacugcacuucaucucuaacccuaacugacacacuuuagcccaggugcaguggcacauauaguucaucccagcacuugggguuggguaguggggagcugaggcaagaggguggggucucggucuauucaaggccaacuaggucuacauaguaagacccugucuccaaaaaaaaagagguaguauugcaaaagcuguuuuugugcauugcaccuuuauauuuauagaguaguuagaauuaguuuucauuuaaauucuuaaaacauuuuuuucagaaaauuuccaagcuuacuuccuaucucuugacuuuucuuugagucuuugucuuauuucaaagaucaagagauguuaccuaguuuagcuuuaaguuguaaaucugauauuuuuaaugcagaagucccuuuuucauuuuaaaaaugcuuauauuuuaaauuuguauuuaccacauuuagugucccagaauagcauguugagguuuuggcaucgucuguccugacaaugccaacacaagcugcaccagaugguaggacugcuguuacgaggaaacccacacacuguagcgacauugccugacaugaagcagagcugcuguucccauaugcuuaucucauuaaagcaagcauguugacccaggcuagcugaggaguauggcacaucacaguaucauauaaauuaagccuuccagcucuucccagcuucaguaucugauauauuauaaacacauccuuaaaauuaauagggucucagaagcuuuugaagagcuauugugggaaagaggaauauaugcuuuuuagaauauaguuuagugucccauaagugcuugcaaacuuacaccagugugcucuuuuuguuuguuuguuuguuucccacccugaccaaauauccggaaggaagagagauugcaaacauaagauuguuaauauaugugugggaugagagauuagaaugggagaggagcaaaagagaaaagggaaccaaccucgagcauggaugguauuccauccauucauaagggcucagcugugccuccugcuaggccucacuugccagcauugccgcugagaaaauaaggcucuaaaacacauguacuuugaaggaccuacucaaaccauagcauuuaccuuauaagaagugaaauuucugacacaacacacaccccaccacuaccacccaguaucguuuggguauuuagcucaggcaaaucucaaccucaugacccuugugccucuugaguccuggaauuacaauugcaugcucuguaccugacuuuaggaguuuuuuauuuuuacuuuuuaaagugugugggucaguguuugcuguuugccuguguguaugccugggauaugcucagauauccuaauagcagaggugguauuagauucccuggaacuggaguuacagaugguugugaacugucauuugggugcugggaaucaaaccuggauccucuggaagagcaaccagugccuuuaaccgcugagccaucucuccaucuccuggcccuagauuuaaagagauguguuuaugaaaaaaaaaguuuauuuauuuguauguguggguucauaugucugccaugugucucucucuguguagucucuggcuguucuggagcuugcuauguagaccagacuggcuucaaacucagagauccuccugucucugccuucugaguacugagugaauggaaaaaaagaaauagaaaggaaaggaaaugacugcuucuagguaugguguaggagaacauuuauauagaaaaguauagccagaaacagggacaucuaggagaguccagaguggacaugacccugacccaggccucauaggaagauggggagggagaggggagagcugggggaccagguacaaaagagagcagguaaccaaaaugguuagauuauacugggaaaagcagccuagucccuugugcuagagaguuugggguagaagugggggugucuaugccaaccaggaggacucccuguaccaauaggucugggggaugcagggagacucugguggccagguucacuuugauauauuaauaggcaccucagccauuuguucagguuugaaaccuaucacugagaguaaaggagugugccauugcaccuggucuagacuuuaauuuuugagauugguucauccuguugggacauagcaaaauuaauacuuuuuuuaaaaaaagauuuauuuauuuauuuauuuuacguaaguacacuguagcugucuucagacaccccagaagagggcaucagaucucauuacggaugguugugagccaccaugugguugcugugguuugaacucaggaccuacagaagaggaguuggcgcccuuauccacugagccaucucucaagcacccaaaauuaauauucuuacguauagaauauuucuuuugcaacuauagauaauaucuauuugcuuacaacaaggguuauauuguuuuguuccauuauaccuacaugugagcacacagaguuucuugaagagccugcauuugauagagaucucucuuuccaaagucuguacucuguagccacuguuagacugugcagugauggauacuuaggaauaguuaguaauggcugcuggagaggaacauucuggacuagggaaggagcacauguuuaaauuacagccauacuuaggaacuauuuuaaaacaauauuuuaagagugcuuccuggggcuggagagauggcucagugguuaagagcacugacugcucuucuagagguccugaguucaauucucagcaaccacaugguugcucacagccaucuguaauggaaucugaugcccucuucuggugugucugaagacagcuacaguguacucauauacauacaauaaguaauucuuuuuaagauuuauuuguuauuauauguaaguacacuguagcugucuucagacacaccagaagagggagucagaucuuguuacggaugguugugagccaccaugugguugcugggauuugaacucuggaccuucggaagagcaaucgggugcucuuacccgcugagccaucucgccagcccaaguaauucuuuaaucccugcauaguuaggaguuuagaucccagcacucacauaacaagucagauguccuacaagagccuuuaacuccagggaucuuacauuuucuggccuccauacccacacaggcacacucaucugcacauacacaugaacauauacacagucacuugaacaugcacauauaaguaaauaaaauaauuugugguggagcauugagacugggucucucuggcuguccaggaaguugcuauguagaccaggccuacccuugccucccaagugguagguggaaaggcgcugccauuacacccugcauuuuuuuaaaagaccugucacuguucugccuuuguucuccuguuccuccuccuuguuuacuucucugaaguuauuuucuccugcuugaagugguaaucuugugcucuuaggaaauucagguugauuuguagccguuggaaucaaaaugucuugcuuuuucugauucucuucuaugauaacuacauuguggacauuguaauuuguguaggucuuaaauucaaguggaguaccaucaaaaggauucucuguaucuaucauguuuuguucuuuuuguuauuaaguuaauugauuuuauauuaguaaauuacuacguuagaaggcauagauaugauuuagagauuaaggagaauguuuauaaaagauugcaucuuuauuacuguucauuaauuuagcagcauuucucaaaguagguaguuagcuucuaucauuucagcugcauuuguuguuucaaauagugguauuuauuuauuuuugagacaguuucacucuggucccucaaacugguguucaaccaucagcaguacucuuuccuuacauccugagagcuagaaucauaguccuggcugacuauguagcaacuugauuuggucuaauucaagugguagacuagucccagaauuaaauuguucccuuagaaguaccuguaauugaaguagguccuauaaaaaagaucugcauaucccggaaccuuugccuguuuauuuuucucagaccauuccuguaucucucuugccugacuccuuuaccccuuuuaaaaccaagcauguuccuauguaagcgaguaacuaaaauauuuaccacgguguugucuuaucacuugagaagaacacaaguaaugaaaguaaguuaaacccauuacucaggacuuaguguaacauguuaauuuggauuauuggaaaacaaguugaaccuaccuugagguacauuaaagccuuaugguuauccugcuacauaucaggagauacuaaauaaauaauccugugaauggucagcauaggguuacucacuuucucgcucagguaucuacauagaagaugccuuuccaacaauaccuccaucauccuguuuuagucccauacaagcccgcaucaccugccucaacaucuagacagcagcuuacaaggaaccauaccauuuaaggguuagcucaguagccguccuccccacacucuccuguugcuuucucugugguacugauagugcuguguuuuuccuuuaaaauaccagcagcacuuccccuccucuacgcuuuuuuguuuuguuuuguuuuguuuuuguuuuuguuuuuguuuuuggagacaggguuucucuguauagcccuuggcuguccuggaacucacuuuguagaccaggcuggccucaaacucagaaaucugccugccucugccucccgagugcugggauuaaaggugugugucacugcccccggcauauauguguguguguguguguguguguguguguguguguguguguguguguauguauguauguauguauguauguauguaugaguacaucauagcugucuucagacacaccagaaaagggcaucaaaucccauuacggaugguugggagccaccaugugguugcugggaauugaacucaggaccuuuggaaaagcagucagugcucuuaaccggugagccauuucuccagcccccuccucuacucuuuauuuagcugugaacuguaaauaaugguuagaugguggugugaggguccuuggcuuacuuccauuuauuacacuuuuuaguaaagccagacuuuguauuucccguuuguuagggagagaaguguugagacugucuucauguagcccaaggauggccuugaacuccuaacugccuccgcuuccaaagugcuggccuugcagaugaguggaccacuguacccagcaaaagcaccccucuuuagugcgucagcacuguuagggauauaccccugugcuaaucaccauccucuggaaaauagaguucagcuuugcccucugcaugagcagaaauuagccacugagcggaaaguaguuuugaaucugaggggacuuacucagggacaguuuuuccaaagcuauaaagaguuuaucccguuagauaaacaauuauguuauauucauuuugcuuuaggagcaggcuuugaacuagauuaguaaaugaauugugccugugauuggggauucacuaaaugaacuccuguaugaauugaagguauuacugcagaauguaccuaaucaggaggaggcaucuguuugugcugccuuccaaauguuucaaggacauuuucauugauaagcagaucuguugugaauucaguagcuaauacuuaggaaaagcaacuuuuuuuugcauucuucugguggguguuucaacuugaguugauaaaacuuuagggugcuuaguauucuagucaccacccaacucucaguuucugucucagaaacugggauaguuucuagguuauguccacacaaaaaccacagugcucaucuuaaaggaauuguuuauucuggagccauuuugaguguucauaucuggguacacauauagguuaccccaaaguccauguucugauguggaaacauuuuuguaaccuuuuuaugguucuauagaacagaaaaagucagaaaucaaggcaaguuuaaaaugcauugauggguguauuagagagucagguacaucuacuagggagauuuccuguagguugaagauaauaucugcuggcauuucugucuuugaggcugguagaagcugguuuucugcuaaaucuauagauucuaaucaagaggcuuuuuaucuacuaucacaagcugcuaguucuuacuuggggcaaggaaugauugcucuagagggccagcacuuagcccaagguaauuagccucuggaccugcagcauuccaaucuccacaguacugaaauucuuauuagccagucucugcagacagauuccugucaaguauuuuuauuuaguuaguauuagaaaucuguuaauuucucuggcaagacucaguauuuuggccaguuuaccuuagugaguacaucuauuuauauuuaugcuucuuauaaaaaccuuccauguaagugaaugggauugucaguucaauagagaacauucagaccuaaaccaauucaauaauuuauucugaaaacucuuuguuaugacuuugaacagugagaaugauugaaguaacuuagugguggccaugauaauaugcaaauuacuugcauuaaaagacugaaaauucagccaggcguaguggcgcacaccuuugaucccagcacucgggaggcagaggcaggcagauuucugaguuugaggccagccuggucuacaaacugaguuccaggacagccagggcuacacagagaaacccugucucaaaccaaacaaacaaagacugaaaauucaacauacuucuauauuuaaauucuacaucacagauuuuagagauucauggaaagaaccucaauuaaugcuuaaauuauuaaguucauauuuaauuuucuaaaguuuauguguauguguguguguacaggugcccucagggaccagaugagguuauaggcaguuguggcuggcaugggugcuaggacucaaacuuguguccucuggaagagcagaagguucucuuaaccacugagcuaucagucuaccuccuaaacaauguuuuauaauuuuccuuugucuaguaaaucuuugggggauuuaaaacaaaaaguuuccacaaacguuuguauuggauuucaagaugaucucgggcuccaaaagcauauugagucuaugaauccuaagccuaugaacagaaucaguucaaguccaaagccugcccucagcaguuucaagucauaaagucauaaacguguguggauguggacuguaguucugauagucaggcaccuuuccaugcguggucuucauacuggguaagaccuuguccucuugucugagccucccaggugcuaggcaucguucuucucccaaauaucccuucccuuacaaccagcucugaauuuauggagcuuugaggaagggcuaggaauuuuaagucuuaaaaucaacuguuucaguuuugcuuuuccugaggaggagguuaaguacaagaauagccacaacuucugagucacugauggagaaaagcuaaguaaggugagccacgcucucauaauucaggguggcuauuuaagggcuagucuaggucccuaguuuaucuaacugugucaucugccuacaucugaauucaucauuuaacugccaaauuaaaccauuuuauauuuuaaagagccucagugggugaaauuacuugucaugcaagccugacaguugacaucccuggaacucaucauggaaagagagaaccugcuccugaaaguuguccucugucuuccacaccugcacuguggaguccgugugccugugcucacaaauaauauaccuacacauucuugucgucgucaucgucaucaccaauaaaauuuuaaaauuaagauccuagaauacuaaauuuguguauuauaccugacuacccuaccaagccaucuuuugggggaguggcaucacacugaaagcucaccuuaagucucucauuaucauucaucgucauucuuuauagccuaguuugccacuuagcaagaguaugucugguuauguuagucaguuucuuuguacuuaaauaacuuugccuguaaacuugugcauagucccauuuguguccaggauguuauguuggaagaaauguaguaucaguuacgugacagcuuaggcucugauacaccaguguugguuuuuauuggagcugggcaaguaucuccaaguacucuggucauccucucuccugucuuacugccuuuguuugcugcaguuacuccaacaccuccaaguuccuucuccauuuuacuucccacuacguugaggguggguacgugugcuggguucuccccuuagcuacugcuuuuuuguuuuaagauuuaaaaucuuuauuuuaugugugugugaaugcuuugcucacauguauguuggugcaccauaugugugccuagugcucucggagguaagaagagggcaguugaacuggaguuauagguaguuaugagugggugcuggaaacuguuaaccauugagccauguuaaccaucuaccccaaauuucaguucucuauccuuaucauuugaaaaauuaugcauaucuguguuagucaggcuuuucuggaggaauacaaaugauaguagagaguguguguguguauuaauauuagaguaauauuagagugguuuacaggcugugcccaguuagucuaacaauggcuguccaccaguagaaagccuaagaguucaggaguuguucaguccaugaggcuggaugacucagcuuuucuucaggauaugccagaauccugaaaaguaggcucucaugucagugagggaauggauuugccagugagaccaagcaggcagagcacacaagcuuccuccuuccuccuccuuuguauaggcugccaccaccagaggguguggcccagauuaaagguggaucuucccccuucaaaagauuuaaguaaaaaaaaaaaaauccuucacaugugcacccagccacuuggauuuuaguuauuaccucuaauguauauauuaaugaauauucuaauauuacuuauauuuuaaaauccauuaaaacauaugaggcugggaaacuacuugggaaaguguuugccuugcaagcaugagaacuaugugaacccacaugaaaaagugaguguagugugcacacuugugauccuccuacucagaggagauggagagaugaggaucuggaggccagccaguguagcuuauucagugagccuugggucucaaugagagacccugucuuaaaauacaaggugagcagauacugaagaaugacacccaagguugaccuccccccucauucucugucucucucucuccuuccuuccuuccuuccuuccuuccuuccuuccuuccuuccuuccuucccccccucccuccuauauuauaaaaaauguuguuuguggaaauuaggugcauugucuccugcugugugcucagguuggccuuugguggguuucucugcuucggccucccaaauguucucccacuuguccuugcguauaacucauucucaaugguucucaaccuuccuaaugcuacaauccuuuaacauagguugguggcacccaaccauacaauuauuugguugcuacuucauugcugccauuuugcuacuguuauaaacuguaauuauauauuugauaugcagaauaugugauauucgauccccagaucaugacccauagauugagaacuacugcucuaaguaauuauuuagaucugccucauaaccuacauuugcuugaccuagaaaauuuucuauacuacuguauucugaacuaaucaguauuggcucaggacccccaagaccaacuucucagcacaaacgagauuuauuuaccccagaggaacagagggcaggaaauaaaagacaaagauaggaaauagagagugagggagaggaggaagggguauuugugucagagggacacaaaggacugccucuggauagagaggagacagacagggcccuuaggaaaauugugguauauaaagguaaaggggaaacuccacauuaggaugagguguuuacuuuuaauuggguagguuaauuaggggcuuuuaauuacuagaccucaauacuuugauagcuggaccuuguuugucacuuucaggaggaagaaguagccaaauaagggcauaggcuuugguagcuagcuuuaggaauauaaucuaauguuuuuuuagcaaggcauagggaaucugggagaaaggcaaggccugucagagccauaccugccaugcuccggcuggccagaguuccuucaaaauaaauauugguuaauuccauuuuggggauuguuucacugguggcuagaaaaauggaggaacgcucuuaacuauauucugccuuaguaauucugggguuuguguccugugcuguucuuuuaggaguaaagguaaucaguguuaaagggaaucugcauucaguguagaggaaauagguguucuuaaucuugaaaaucgcuaagagaaagaccaagucauaacuguacaauuaaagcaagcauaauuuaauacgggcaagguccguacccaggauucccagagaauggugcugaguuaggucagucagaugcucauaaaaacaaaacccacauggcagcaugcucccuguccuaguccaguggaagcaaguauacauccugauguccugcuuaagugucuccugccugccugugaccaagcauguccugugcaguuggggcaaccaaccuuguuuacugaggugaaagaaucuaacuuguuagcuuacauguguagccuccagcauaccagaagucagcugucccugggcaaguggggcuuauagguuaccuuuaguccugaccguguuugguagaaaugauuugauugggguauuguggaauuaguacauucugagaagcaaccagaguuagcacccacauugguuuugaaauuucuguaauuuaguuccuuaucaaauggcuaaccuacuauacaucuaugcuuacuccaguuaauuuucuuucuuuuuuuuuuuuuguuuuuuuuuuguuuuuuugagacaggguuucucuguggcuguccuagaacucacuuuguuaccaggcuggccucgaacucagaaauucgcuugccucugccucccgagugcugggauuaaaggcgugcgccaccacguccggcuuccaguuaauuuucauuggcagugaaguuaauuuucauaggcugccaagccuaaccaacugaauuugauucccagaaaacacaagguggaaagaaaaccaguucccacaaguucugcucugauaugggaaugugccugugugugugugugccugugugugugugugugugugugugugugugugugugugugugugccugugugugugugugugugugugugugugugugugccugugugugugugugugugugugugugugugugccugugugugugccugugugugugugugugugugugugugugugugugugugugagagagaagagagagagagagagagaggagagggggggagugucagucagaaagcucaaaaucacuaaaaaaguggaaaaaacuggcuucuaaaguucuucuauguuucauuaugucauaaauaaucagaacuuauuagugacaugaaaauacaguugucugguugucaguagauuggcucucuuacuaguugaaggauucaggacucauuuaccauuuccuccauaaggauauuuguuuuccugugugugguugugcagguuauuugauugggcuuugcuccagucaggagguuagauucaguaucugcuuccuaugucuucuccaugcaaacagagccgggcacacuuuucaauaggagacaagaauacuagaauauaguguuaaccccagagaugugaggagaaauaccacugacccaaaucauagcugaauuaauuaaagcaagcucuuuuuauuaauguacacaugcugucuuuccuuaauguggaguugaagagaucauagacaugaagaagacaaggguuuuuauaguucaggagugggggguuuccaaauggggggauuugacaagcaaauaggucggguuacagaaacagagcagaacauaagcauuacaacuugguuauaacaacauccugaaacaaagaccugcuugcaagguggucuuaacagccucuugaagcaaagguguaauugccauuucuuggaacaggcaguauagaaccauuuguaguuaagguuacagauagggcauagcucaauccuugaaaaacagauuuaaucauaaacaagaaugacucuaguucaccuuugcuauaagauggcuuucaagccuacgaucugaaagucacugaaggacuuggcacaaccucucucacugaggccagacgaggcugcccaguuaggggaacggaauucauaggcaagcaacagguccaggggcagcuccugcuccaguuguuggggaaccugcauuaaaaccaaguuguauaucugcuacauaugcgggugggcgggugggcuagauuuagcccacguucacucuuugguuagugauuuagucuuugggggacacuccuucccuccaccauaagguuucagguuaguugacucugcugcucuuccuauagagucccuagagucugaaauaggauuucaauauauagcccuggcuagccuggaauuuacuauaaagaccaggcuagccucaaacucagagagauccuuuugccucuacugagauugaagcuaugugccaccaucccuguucuuguuuuuguuuuguuuuguuaauuuuuaaauuacauuuuacuuguuuauuucaugugccaccucacuccuauggaagucagaggauaacuagggacacuguuaucaaacugagguuuucagacuuggcacuuuuuuccucugaacaaucucagcagcccacaaauacucuuuuagucugaaauguauuugaaugauaagauuaugauauugucuuguauauaaauuaaaagggauuaguguagaauacuacauaaauaagguaagaacaaauucuuguuaauaaacuguuaaaaguuuuaaauuaucacuugaaauugaguaguuaaaaacaaaguuaaaaucgauucucaggguguggaggcugauuucagggacucaaaggcauuuaaguguuuguucuuauugagacaaguagguaaacguucacaauagugcaguauagucugaucauuacccaucagccuaauaaggcccacuuuaaguagguuuuauaaauaacuauggauguuaauuccuauuaaauucugaauugaauuaauaguucaguagaaguaguuuucuucuuaauacuuuguguaauucuuugacuuguuaauaauuccuuuauaaauuaaaaaauaguuauauaugugugugcaugcaagugugcauuuguuagagcacacuugugggagucagaggacagcuuuuggaguugguucuagccuucuaccacaggguuuccaugggauuuaugaugucugcuaucuuucugugugauagaaacaaagaaagaguagucucauguaggaaacacuggaacaaagugacacaucugaacaagccaauugcuuuuugcaaaaggguguagcacuguccaagccagguugcaggaacacggugggcaggaaguacacuuacuuuaaaggcgugcgccaccacgcccggcucacacuuacuuuuuuuuauucuaauucugguggggacugugccuuccccacuagcuuugguccaacaucauagucuuuccgauuggcuaguuuuaaaagaaggauagggucagcugcuaagccaucuggacuauagagaaagugagggaccagugcuuucuauaaacaaaaguuuagcauguugggaagauuaaaagguuuguguaaaaguuuuaaagauggggaaguugacauuucucacugggcuagagguuuuauccugucaagccgucuugcugacccaacauuuuaguuuucaauacuauagacauaagaauuuugaaaaauaggugcuuguagagauggcuuauuaagagccagguauucagguacuguuuuuccagagaacuggaguucaagucgcccagcaccuacacaucuggcaguuaacaaccaccgguaccauuaguucuuuuggccuccuuggucacacgugcauagagugcacagauagacaaggggacaagcacauaaaauaaauaaaucugagagagaggggagggagggaaggagggagggagaaauuaaaaaaaaaagcugggcaguggugcagugguggcgcacgccuuuaaucccaguacaugggaggcagaggcaggcagauuucugaguucgaggccagccuggucuacagagugaguuccaggacagccagggcuacacagagaaucccugucuggaaaaaccagggcacacgggggagagcaauuacaguaacucagugcuagagugccuacauagcaaaugcagaagcgucuggcccaggcugaaggccggagcucagagccuauggucaauugccaucagaacaguauuaagagacaggaccuuuaagaggugauugggcccugaagucucaugaaagagcccaugccucucuagacccuucugccuuucuucggguagaguccuguaaguuuuucccagggcugucuuggacucagauuuuccaaaucagcuggcaccuugaucuugaacuugcagcuacacagagaaacccugggggggggggguugggggggggagaaaacaauuugagccaguguguuggugcauacuuuuaaucccaacaguaggaagcauagguaggaggauguaugugaguucgaggccagccuggucuacagaguuccaggacagccggggcugcacagagaaaaccugucucaaaaaaccaaaagaaagaaaugugaaaaaguaguacauagaaguucaguguacacaucauagagcuuuuucuuacaguaacauuaaauuugcuuugguuuggcuguccuggaucccacucuguagaccaggcuggccuugaacucaggagaucccccugccucuuccucccagaugcuaggacuaaaggcagguagcacucugccuggccaaauuguuuucuuuuaaacuaguguuuaguguuugcuuuucugugaagcuguuucauuuuccaaagagcuuugccaugcuuuuccuccuagcaguaacuagcuuuuccuccuagcaguaacuagcugucacuacacuuguggacagacugcucuauuuugucagguaguaauuacagauguauuuuuacaugauuuucagcugcaccucuucacagugaacuuuguuccacuuuaacuagaaguguggccuucagagacauggacagcaaauaagccagccuuccucaguagcucagcugggcgaguccucacucacucucaggacugcuacagcagcagccugaccaagaguuuuaccuccccuacaccaagcacacguaguggguaaacuaagucaauggacuuugaucucaaaccauguaggugcaaauucuggcccugucacuugugugacuaggcuaccuaaccucaccauugcuaguucuucaguuaaaaaaaaaaaaagguagaguggaggggcaugcuuuuaaauccaucacgcuggcagaggcagacaugucuuuugaguuucuggcuagccagaacuacauauagagugagacccuauuaaccucccucccagugggacagacagagacaaggacagacagggagagggagagagaacaccuuagaguuagaauaggcagcagucagauuuaugacaacagacaucaaacauuagggguccaaauaucuauccacuggcacaaauuuaguuauuuauaauaauaaaauggcaaaaauagaaguuaaaguuacuuuaauuuuuuuuuuuaaaagaacucaagaaugaagucauuaaauauaacuaagugcauuuuaaguggcgguaacuuguauuuccugagcugucuaucucagauucuagucuuagcggucagggguaaguacaaagauauauacagggaguacaaacccaaacugauguauucagcuaccuuuauuuuuuuuugagacauggucuugcuauauuacauagcccagucaccuccaauucacacuccucuugcccuaguuucaaaauguccuaaauuaguuuuugaaucaucguugggccuccuguguacucuguuaagccuaggacauucuuguuugcuugcuuugguuuuaggggagguaguucugagguagagucucucuauguagcucaagccggccucagaauuggccauucucuuguuuuagcuuccuaagugcuaggagugaucugccaguucaggaacccuggauugugugcggacaucuuuggcuuuauuuuuauuuaaaacuauguauaggugaguguaugugagugcagcugcccuuggagguugaaaaaugacaucaggguucauggagcuggaggugcugggaacugcacguaaagucucguuagugaagaaacccccauacuggccuucauugugugagugucagugcaccugccucuagcugguccucuaguuucuuuuuuaauuaauuuuacuuuuauguguguugugauuuguguacauguaugucugugcaccacaugugugcagagcuuauagaauccagaaaaggacauuugaucccuuggaacuggaguuacaaaugguugugggcagccaugugagugcuagaaauugagcccaggucuuugagaagagcagccugugcucuuaacuacagagccaucucuccagacucuacucuuaagcauucaaaauuagaaaaugucuucuucuucuucuuuuuuaaagaauacuaguguugcuguugaaauauuguauuaguauauuuucccauuuccauauuauacauuugauagagaagggauuguuucucucucucuuuuuuuuucucccuugguuuuucgagacaggguuucuucucuguguagcccuggcuguccuggaacucacucuguagaccaggcuggccucgaacucagaaaucugccugccucugccucccaagugcugggauuaagggcaugcgccaccacuacccagcugggauuguuucucauauguaccuuucugguaaauuugcccucagagaucuggaaggugugucaacuucaguuuacuuccugugcugaaaagacauuugauuaaauauucagaguuugguuuugacuuuauuuuugugauauuugaaaacuuuauggguuggguauuuuaguguuuguuugguuuuuuuaaacauuugcuuuuuuuuuuuacuucuagcccgagaacgagauuucuucagacugcaaucauguaaguguggauguucagugacucaccauaugugcuuuauaaauacggugacagauuuugggaugcucuuucauuucuuucuggaagaguuauauuuucucugaugcuacuaguuuuaaguggauaguaaaauaagccuuguuuaaagaacuuuauaaacaccauuucauuguacgaaucauuaggcuuggccaauacuaguuacccaugauauuccuuacugcaauugccauauaaaaagaauuaguucccugcuuaucaagucaacaacuucuuguuaacauacugucauuaagauaucuacuguguaauagcaccuucaaaggagagggguaugccaccguggugguuaaucucagcaggcagaauaccuguauacauuaaauaaauaaauacaaagcaaaaccaaaaaccuaaaccagguagugaaugaucagacagguguuuucaaggaguaaagauggauauuccuagaaacucaaaucugagcagcuuuccuuaaggcugcucgaaggaaaacacuagcuugugaaggcucagacuaacccugucacaugugagcauuuggggcagaccuuuuggaagcaaauauuuucuccaaaacuuuaucagggauuucuuuaauguuuaguuuuucuuaauaccacuuaauuuuuuauuuuuacuuuuaauuaaaugcgucuaucuguggguuuuguguaugugggugcagugucuguggaggucagaaaaaagugucagaugcccuggagcugaauuuuuaaguaguuauaagccucagaacccgaguucugggaacuucuucugcgugagcaguaccuauucuuagcuacugaaccauuucucuagcccugugccacaucauuuuaauucuuaguuuuuguuuguuuguuuguuuuguuuuguuuuguuuuuucgagacaggguuucucuguguagcccuggcuguccuggaacucacuuuguagaccaggcuggccuuaaacucagacauccgccugccucugucugccucccaagugcugggauuaaaggcaugcgccaccgcugcccggaaauucauaguuuuaaaaaugucauuuagcaggaaaaaagaaaacaccugaaugcugggugcugcuuuauguuuguaaauauuuugcgcuuuugucuaugaaggugaugacuuuugagcuacuggaaaugucaaugugcuuuaugugacuguauaauuaguuuugucauuuaucacugaugauaaauuucaugguggucuaaccaaaagguuuuuguuuguuuuguuuucuucuucccuugaacccaguuguuguggaauuacaagcugaaccugacuacugaucccaaauuugaaucuguggccagggagguuugcaagucaacuauuuccgagguaaagugugaaauaauuguguggcuauugugauuuguaggacaaaguagagucuguugacccacuccucguuaggagaaugaaugacucaguugcuuuucuuuucuuggaguucuuucucaucugccuugguugugauucagcagggauguguaacuagacuaauuuuugugauuacccaccaacacaguagggugagaucaggcucuuguuguuucccagauauacaguacagcuacugagguuaucagaguagauuucccuggaggucuauaaaccuuccuacgugauuugacucugcaguugggccuguugagcauauguaucagauaauggguauuaguauuuaaaaauuaucaauuuuauauaacuacaaauguaauauaacaacuaaaacaguuaaugaaauuuuaugucucuguauggauguuuuguuuugauauaaggccucccaguguagccuuggcuggucagaaacacacuauguagaacucugccuggcucuaccuccagagagcugagaucccuccuggcauuuggcuacccuucuuguccccaguagucuuuugugggguuauaaacaucccaguaccaaagacacuuuucuucuuccaacagcaagauuauacugaaaccaagacaauuaacccccaugacuguacaugcagucaaggcucacuucuaaacucagaaucccccauagcaccuaagugcugauauuauaagcauucaccacaauacaugguuccuuggcgauuucacuaguucuucugacugguuaaaaaauugggguucaaaaaagccaaacaaguagcuacaaauaaaggaaucucaucuucaaaaaaauugggguucaccuagcuuuuuuuuaaagauuuauuuauuguuauaccuaaguauacuguagcugucuucagacacaccagaagaagguaucagaucucauuucagaugguugugagccaccauugugguugcugggauuugaacucaggaccuuuggaagagcagucagugcucuuaaucauugagccaucucuccagcccucauauagucuuauuguaacuuguuauaccauguuugauugauaucccugggaggucugcuuuuuuucugaagggaaacagaggaggcuuggaucugagggaggguguguguguguguguguguguguguguguguguguguguguguguguguguguguguuaggggacuaggaggagaggagggaggggaaaugcaguaggauguaauacaaaagagaagaauaaauggaagagaaaauugggguucagcugggugugaugguauacaccuuuaauuuuagcgcuuaggacgaagaggcagccuggccugcgcagugagcuccaagagagcuagagcucuauagagagaugcuaucuccccugucucccaaaaugggggauuuccacaguuucucuguuugaaugguugacuaaggaaaacauaauuacugcugucuuauaaauggcauuugagagaauauagauuagugguucucaaccuucugaauguugccaaccuuuaauacuucuuuuaguuguggugacccccacccauaaaauuauuuuuguugcuacuacauaacuguaacuuugcuacucuuaugaaucgugauauaaauaucuguuuuucaauggucaugguggccucuguaaaagggucauuugacccccuauucccuucaaggggcagcgacccauagguugagaaucauugauagagaugaaacaauacacgagucaagguacaggagcaaggccucaagcucuuugcccugcuccuggaugcucugggcgucugugucuagggaucuagaaacucuucuaaaccuuguucuuccagauuuuuauggagauggagacuucauuguguaacuaauauaaaguggguggagaaauccagccagcccugucagcacucuucuuggccuuugcagcauucuguaguacuggcaugacuccauggaguuggaggguucucaugaccuacuaccaggaguucagagaaggcaacagccacaugacggaaugacacugucguuccuuaaaaccagugucuuucuaaacauuuuugaccccuauguaaagagcuuuuaaucucagaacucaggaggcagaagcagguagaucucugaguugacagcuagccugauauauugaguguuccaagccaggcaggucuccauaguaagaaauuauuucuagcaguaacaacagcaaaguaaguuucuugacuuaaaugugauaucuugacuuuacacccguaaagcagccacguucuuucuucuuuuuuuggaacagauuaaagaaugugcggaagaaccaguuggaaaagguuacaugguuuccugcuugguggaucaucgaggcaacaucacugaguaucagugucaucaauacauuaccaagaugacggccaucauuuucagugauuaucgcuugaucugcggcuucauggaugacugcaaaaaugauaucaaccucuugaaauguggcagcauucgucuuggggaaaagguauuuaacccauguacuucuccaaugaacuggggaacuuaguaaaugaaaaccauuauguaacucacaucagagaaaacuaggcuugaagucaucuuaaagucaaauuuuaaaaaaacaaaacccaaaaaacccaaacuuguacagacaauuccuuuaguccaagacugauugacuuagaacauuuugugagguuguaacaaaauauuucaauauuuauauuagcuauuucccauguugcuguaacaaaauaccuaccagaagcaacuuauggaaggaaggauagauuuauuugggcuuucugagcagaugccauacaggucgauuggucauauuccacccacaucgaggaacagagagagagaccauagccugcuccacuugcugccuucuuuuauucagcacaggaccuuugccacuuuuuaaaauugcucuucuuucaguacuuugagcuaaacacccucacaaacgugcccagagggcuaccuccuaagagacucaaaaucccaucaaacugccaguuaauauucuucaucaccuuuguuuucugcaagagaaauuaagaaugguaaagcuacuucucacucucaggagaacaauguccugguaacugaauaacuaaagaaaagcuuauaauaaagacagaaaugaaguaacuacucaacuaguuucuccuuccuuaguacaacugaucuuccauucaaaauuaauuaguccaguguucucaaccuucuuacugcucugccuuuaacaagguuucucauguugugaugacuucuaaccauaaaguuauuuuguugcuauuucauaacugcaauguugcuauuguuaugaauccuugaccaagcuggcucagucagucaacaggguauugagggagugagcauugaaaagaaagacacuuaggaaacauaaccugacaccagccagugcuggggcugggguuuauuuuucuccagucugcuuuuauaccauucuagguacaugcaaagaauauggucaguccuaaggcauaaacauuaaaagcucuugugaucuugacaugaagauuugaggcaaucaacaaaaggcugguuuuaggaaagaguguauuugucuuucuuaacagacuagaaaugacacaaaaacauuugagucacccugauagauuuaggaaguuccccugaguuuguuuaggguguuggggauuacauuugauuccaaccucacucuuuguaaaaacuuuccacacuagugcugcugacacacuucccaggaaucuuggauaguuugacauuguguucagugaccagacaggauaguucuuuuuuuuuucuggguuuuuugagacaggguuucucuguguagcccuggcuguccuggaacucacucuguaaaccaggcuggccuugaacucagaaacccaccuugcucucccuccuaagugcugugauuaaaggugugcgcuugcacuaccaggugacacuauaguucuauuaugggagaucugucgguugcccauaagagcaagagcugauaggcuuccccacucucugaauuaccaguguaagaccuacucuuagcuccaggcccuaagucugcaguggcugcagcugaaagccaagacagcuuguuuauuccguucuaauaaaaucaccacugcucccuugaaccuccuuugguuuacuuuuaucauuuucaccuuuuugucguuuuugcuuguuuggggacaacaaaugcauuuguauguagauagccgaggcggguuuuucagaugcaggguuauugguguauaucaacacacccaguucauuuuuauuuuugguauaacuaccaauuaagugaaacuucuauucauuacugauccaucuuuacauaccagguuuucuuaugcauaaagggcagugauaggggcucagucuaccucauagaaaaaauaauauuccuuccuaugucguguccuuuagggccacagacauguuuaaaaccucuuagagccaaacuucaaguuuggugccaccgcaacugaccgccaacgaucagagaggagaggauucauggucaaucuguucucauccuuacucuguauaacaauguaaaagaucacgacgcucaaccuuagugauuuauuuuuccaaagugaguuuuagagcaaagauauguuaucaaaucccuuugggcuuucuaagugaaugucaaaaugaaagggcagguaucuagaagugaaugugucguuauguaugucgugaaggacgguaggaugagccagcagaacugcucaguuguggagcugugcugugcagcugcuucugugcuuuuacugacuuaucagugugguguuucugcuucuaaccaaacaccuggaauaguggagucuuguucuucaguccauggaaggaaucacagaaaaccucagaaacuucaaacuagaaaaugguuuaugcaaaggaaaagcccagccuuccuuaccaucugaguuaguauuauuguuguugguuagaggacaaggaaugagagaagaaauaaaaccaucaaacuucaugaguauuucucaggccaacuuuuucuuauaauuuugguugugagccuagccuuuaacggcugagcaaucucuccagcccaggccaacguuuucugaccacaauauaauuaauaaauauuuauugggaguugagaggacaugcagcucuuauagaagaccuauguuugacuuucagcacucacauguauaauaugccccccaacacacacacacacacacacacacacacacacacaucacacaucacacauacacacacacacaaaauuuaaaaguagaauaagucucuuuuuacugaccugaguuugauuuuccagauccacauggagaaagaacugacuuccauaaguuauccucugaucuucacaugacacauaagcaaauguauacacacacacacacacacacacacacacacaggcuuugcuuuaauuucuaacaccaaagacauuagaaaauauagcuaguuguggugguacacgccuuuaauuccagcacauggaaaagcaaaggccagcagaucuuugaguucagugccagccuggucuacauaauguguucuggggcagucagagcuucauagugagacccuggcuuuaaaaacugauaaacaagugaaaaaguuuuauugacucuuuuguuauagaugugacauucuaacuagccuuuuuccucccauguguaugugaugguguuuguguuauguaugcuuguucuugugugugugugguuauauguguaagaacauuuguguagggcagucauuguccuuaaauauugggucaggcuuugacuugaacuccaaucuuacuguuaggucuagucuggcuugccacuagagaucucuucugccucuauaaugcugggauugauuacaugugggcugcuguccaccuggcccuuauugagaacuagggaugacacugagcucuguccucauguguacacagcaagcacauuaccugcuuaucugcuaagacaucucccagacuuguucuuuuuguuuuaaccaggcuuccuguagcacaggcauagaacuuuuuugaggaguucaaagugaccuugaacuccuguuucaucugcaucuauuucccagugugauagaauuuuauagcucauccuguuugauuauagacaaccuuguuugauuuacauacucccaggaauggaaccuagagccuuuuguaugcuaagcaugcuaucauccagccacaaucucaguacaccuaccuaccuaacuuccuuccuuccucucuuuauuguuugcuuguaaauagauaggauuucaggcuggccucaaggucacuauguaagugugauuagcuuugaacuccugauccuucugccuccaucuccagguuagugcaaagauuauaaaucugugccaacaugcccagugagccuuauaguguuaccuuacaugugcaaucucccagugcuagggauugaauccaugagcuguguauacuagacaaacacucuaccauugagcuacauccucagccucagacauauaguucucguugucaaauauuuguauaugggcuggagagauggcuuagccguuaaaggcuaggcucacaaccaaaauauauuuguauauaauucaguuacuaaaugggcagaagaaacucaggguaccuuugcaaacauuuuuauuuuggaaaaaaaaaaacaauagccugggauaguggcacauaccuauaaucgaaguaaucccagugcuuggcuuguuuuuaaguacagagugucugucucugucugucugucuguguguguguguguuggcacacaugaggaucagaggacaauugggggagucauuucucucccuucauguguauaccagggauuaaauauagaacauuagguuugguggcaaaucaccuuuacccacuagacccaucaguugucuuucaaacuugacuauaaaagcacuuuaacuuguaaauaucuaacucuuagagguaaaugaguagguacuuuugcaguauuauuucaguauucacauaaacugugcuuguaacaauagguuauuuucucaugaauuucuugccaaaagcaagcgcagaacagccaggucuacacagagaaacucugucucaaaaaaagaaaaaaacaaacaauuuuuucuagcuauacauguacaaaacuaaauaacugauguaauuuaaaaauuuaaagccuaccgcuuuaauggggggaggagguauccuaacauuuaaaccauacuaauucauuaacuguugagcuaucuguccagucucucugcacccguuucuuuaacuaaauguuuauuugaauacuguagggugaaaguuuuuaaauauuuuugcuauuuuaggaugcacauucacaaggugaggugguaucauguuuggaaaaaggccugguaaaagaggcagaagaaaaagagccgaagauucaagucucagaacucugcaagaaagccauucuuaggguggcugagcuguccucggaugacuuucauuuagaccggcauuuguauuuugcuugccgagaugaucgggagcgcuuuugcgagaaugugaguuacuaaaaagcuguuuuuccuuucuuuucaaguguaucuguauuauuguauuccagaaugaaauauaccagcacaaccuucaccaauaggaaaacaacggaagcagaagauggaauuaaucccaagauacaaaaaauaguauugaugcucagucuugaagauguaacuucaaguuaacaauuuguuucugacacucaguauauacauuauuuuuucuucuuucccucaucuuucauuuuuuagguugguugguugguugguuuuuauacucucuguauagcccugguugucuuggaacucacuauuuagaccaggcuagucucaagucaucugauucuguucucuaaaugcuaugauuaaagguguagaccaccaugcuggugucaguugaagacugaucuguggugcagaggugggacaccgcuuuaaccccagcacugaggagcagcggcuaucacaucuugaguuugacaguucuguucuauagaagggauuccagcacagccagggcuacauacagaggccuugucugaagaaaaacagaaaaaacaaacucuauuuuaucuauaggaaccuuacucuaccaggaaguccuguucauauccuauggcuaaagcucuguuacauuacauuuuuauaugguuuugauuaagguuaauaaaauagaugugacuggaugugguggcaggggcagguggcucuugugaggccagccuggucuacagagugaguuccaggacaguuagggcuacacagagaaacccugucucaaaacaaacaaacaaacaaacaaacaaacaacaaaagggaaagagaaauuaucuaauguuaaagccaaguccuuggauagagccugaugauucauuagacaccucuuaguucuucucugucuacauuuccuuccugcuuuucuucuuccuuugcuuccuucuuuccuuucugugcugcagauugaaugcaguaccuuauacaugcuggaucccugaucuuuguauacacuuuagcacuaucugucuuuucugacucacguaugcccuccccuucugccugcuguuuugaaauuuuaaaauuaacuaucagagccacugauuauaaaguuuuauugacugugguaucaaauuguaagagagucccucugauaauguccuugaguuuuugaauuaacaguguauuuaauaaaaguucuguauaagacuggauauaucacagcaaaacuacuuagcuaauaguaauaauauguauguuuuaucuuauagacacaagcuggugaaggaagaguguauaaaugccuauuuaaccauaaguuugaagaauccaugagugaaaagguaccucuuugaaaagaacuaagucuuacuaauuucauaaagcuuucacaaacucuugcuuccuuuuuugguuuagguuugagugauuguuucuggaauacagucucauagcccgaauuggccuuaaucucagcauggaaccaaggaauuucuugaaauucugauccuccuuccucugccuccuaagugcugggguuagcaugcgccaccacucccagcuuucacagacauguucuuauauaguuuucuugugguauuuacaaaggguugauuucaaaacacuacccacauacucaaacaccgagaaacuuaguguuucuuauauaaaauggcacgguguuuguguauaacuuaagcaauuucuccugugauuuuuuuuuuuuuauuuuauuauuuuuuuuuuuuauucauuuauuauauguaaguacacuauagcuguccucagacacuccagaagagggcgucagaucucguuacggaugguugugagccaccaugugguugcugggauuugaacuccugaccuucggaagagcagucgggugcucuuacccacugagccaucucaccagcccccaucuccugugaauuuuaaauagugucuagaucucuuaaaauaccucacauaaugcagaugaggugcugcuauaacgaaauugcuacguuauauuguuuaggggauaaugguuacaaaaucauuugucuauaguuaaugcaaacacauuuuucuuuuucccaaauauuuucaaacucugauucuacagaauugccuuuaucgagguaugaaugacugaugaauugagacguucuggguauuaaugacugaugaauugagacaccuuuguuuaaguacaugaaguauauuugaauaaacuggugugagagcacaugauggcacucagaaggcuaaggcggggggggggggggggauuuaaaguuugaggccagucugaauacacagucauacuccaucuuaaaaucaaguaaagccuggcauaauuguuuagaggguaaaggcacaugucaccaagccugaugacuuugaguucaucccagagcccacaugauuggagggaggauuacucaaucucugcagguuguccucuggccacacacaugcuauaguacacucacccacccccagcgcgcgcacgcgcgcgcacacacacacacacacacacacacacacuauaaauaaauaaauguaaaaaauaauauauuugccucaaaccaaaaagggaggcagggaagaaccucuaaucaugaugccuauauaaucaaauguuauuugggaguaaaauugaagaaaaaaauuuaagauuuauuuauuuuauuuauguaaguacacucuagcuguuuucaaccauaccaaaagaaggcaucagaucccauuacagaugguugagagccacuaugugguuggugggaauugaacucaggaccucuggaagagcagucaguacucuuaaccacugagcuaucucuccaacccaaagaaaaaauuuuacccaggaucacauuaaugcuagcucugcauacucggguaguauaggcuaaccacaccaauauccuucauagauagccaguuguuuaauuuuucauuauuaucucauuaaauauucuuauuacuauuaguccugucacugaauggauacaagaaucuuucuaauacuuugguuuuguaauucuaacuuuuguuuucuuauauaguaaaguauuuacuguguucagaguaauagaaaguucuguauaauagaacagccaaauauaauauuaguucuugugaaauuuauaccagaaguaugguugaagaaggaagaauacuuugugucaaguuuaguauauuugaacccuccaaaaaccuaugugauguccuagcaacaguuagcuacuaauuuacugccugauuucacuuucccagugauuuacuccuuacucuuuccauacuagagucagauuuuuuuauuaucauuuuauuuucauuuauuauuuuucauauaugaauguuuugccugcauauauguagauacacugugugugugucagcagaaguuggagagggcuucauagagcacccuuggaacugucauuguagauggcugugagccaccauguaagugaugagaauggagccuggguccucugaagagaugcaagagcucuuaacugcugagucauaucuccagaccuuagagccagauucaaaacaaacguacagauagguguuuugguaaaaagugcaacuugcuugguucugaguuucugcuuuucagagauagcugagccacaguaagucucaggguagacuuaagguuucguuccuuauccucuuuccucaguguagagaagcacuaacuacacgccagaagcucauugcccaggauuauaaagucaguuacucauuagccaaauccuguaagagugacuugaaaaaauaccggugcaauguggaaaaccuuccucggucccgggaagccaggcucuccuaccuucugaugugccuggagucagcagugcacagaggugauguucuuuuuccuuuucuccuuucacuccuucuucaguucacauuccaaagcuucuuguaccuguaauuaguaguuuucuucugcauuuuuugaaccuuuugauuuuuagaaugacuacuggaacagucuuuagaagaaugggagaacauuaaugucacaugaguuuuuggucagagugaugugacuucaaauccugggucuauuacuaaaguaacuggguaacuuuuuuuguuuggacuugaggacugaguggggugguugcugcuuuuuauguucucccuguucacauuuauagcuccaagacauggggagccaucaugaauuuuggaagaauagucuuuuccacaaacuuuagcuguauagggcaauaacgauuguucucaguuuauuuacugccccgauagcuuucguauugcuauguagcaugaaugugaccaugaguucaauccccugcaucagaaaaaggacuugcuuuggcagaacauuuguauuaugguugauaagaucuauagugcacaacccugcaggcuaaaccugggucuaagcuuuuuuuuuuuucuuuuucuuuaugcugcaaaaguuuuaccauguucuaagcauuucaguccagauaguaauuccaucuggaaaggcuguggguuauucuuuuccagacagaaacguaguuuaacauguagagcuuucugguccucagacucccauuucauaacugucugacuuaccccugacacagggcggcaggugagcagugagugccaaggugagaugcuggauuaccgacgcaugcugauggaagacuucucucugagccccgagaucauccugagcugucgaggggagauugaacaccauuguucuggauuacaucggaaagggcgaacccuccacugucugaugaaagugguucggggugaaaaggggaaccuuggaaugaacugccaacaggcgguaaggaaaaauauuucugcugccacuugacuguuuucuuaggauuacuauugcugugaugaaacaccauaaccaaaacagcugggaagaaaggguuauuuuaaaugcuuguucuuucacaucguacuccaccaucauugaaggaagucuaggcaggaacucaagcaggaaucuggaugcaggaacugauauggaggccauagaggauugcugcuuacuggcuuuggcuugcucagcuuacuuuuuuauagaacccaggaccaucugcccagagguggcaccacccacagugaacugggcacucaauugcuaauuaagaagaugccccugagcugagccgggugugguggcacaugcuuuuaaucccagcacugaguucgaggccagccuggucuacagagugaguuccaggacagccagggcuacacagagaagcccugucucaaaaaaccaaaaaaaaaaaacaaacaaaaaaaaaauugcuguggagcuagguaaaggaaauccauuguuuuccuguuucuaaagaacuugccaguuuggauuacgaaagacagaauaaaggcaaaucacuuucuucaaaaugagaggcuauuaggagaagagaacuugccugucuuaacaaguuugauugaguugaaauugagaguugacaugaauggaaaauuucugccaguuuacuuuuuuacgauaugccacaagucugaaggaucauccucagaaucaagugucuuuauugauuaaaucagggaaacuauaagcagaaagaucugucuuucaccagcuccaaacuuuacaaacaagaauauaaagauagucuuuuccacaaacacuuagcuuucguauugcuauauaacaugaaugcaaccaugaggucaguccccuacaucagaaaaaggacuugcuuuuucugggagaaaaugaagugacucuugauccuguguuuaugagcagcgcaguccugcagaucacaguacagagucagcacagugcaugcagaacaucgucuccugccuuugaccauguuuguuauuuguauggguuaaaucuccugcaguuuagcauaccaggugcaagccucuacaacauagcacucucugcaaugacuuucccuuuuaaagcaggaaagauacuuuaguuuuauaaccuaagucacgcuuuaggaaaccacaauucauuuguuacuuuguuuuggcuauuuuuauuaaacacuaaauacuacuugaauuuucuuuucuucuucucucuccuuuuuuuuaaaaugguuugaaggcauuuauuguagaaaggcagccacguggaggggggaaggaaaggggagaaggagagcaagagguaagagacaaggagagagcaagagcuuaagagcaaauuuuauuuucuaguuaaucauguaaaaucaaauuuguacaguugggcuggagagauggcucagcgguuaagagcacugacugcucuuccaaagguccugaguucaaaucccagcaaccacaugguggcucacaaccaucccuaaugagaucugacgcccucuucugggguuucugaagacagcugcaguguacuuaauaaauaaagaaauaaaucuuuaaaaaauuuuuuuuuguacagucuauaacaauuuuauagucugaaauacaaguuuacaugagcuuuagauauggagucagguuuuguuaaccaugacccaaaguagauacuaacagcaguuacauugugcaugucggugcugggaugggaagaccagugcagccucuucucucaaacagcagaaucagcuggagggcugcucuggaggcugcagugagacugugaggaugagugugcugugcuccucugcaguccuguuuguuggcaguugccccgggugcccuuugugccagugaauaugccuggcugcaguccaggaugaaucaggagacggccucugcuguguuugcuuuucauccuuaauuccaucuaguaagguuguggaaggaggauaggaaaaaaggaaucuaucuauaguaagcuuacaccuauuguaaaaauguucaggaaaaaaauagacuggacucaacucuguuuugaggcacauaguucacuaugagguuuuuggaaaguuagcuucguuaaaagaacuagugacucagcuucaaagauaaauaaguuccgccuacaccacccuuugugcccagaagaagaaagugcuuuccaaacccagagggcaagcacaaauagugaacugugugguuuugacugcauuaagacugcuuaggaaggaagcacuucauuuuuauuguauggauucuauuuuuuaaaagccuuuucucacaaaaacuaaaggcaauuuuuccagaaggauagagucguccuuugucuucuauauuaucuagccuuagucaaacugaagaauaucuuugagcaauuuggguggguuucuuuuuacuuugaaaguuuuauuccuugacacaacagacuucaacaucugucucuagauuaauuuaaugaacugguaaugguuaucagcaagugcugaacuguaaaguauguggauaauuauuauccuaaugaguguccacuccuccagauuuaccacaguuacgacagggcuaugacuagccuaugcuucucacaucaaggauggcugcauaaugcauucuccagaccaagucucuccggagcuuugcucgggguuuuuuuguuaauaucaggggccagaauguauauacaaucauaacaucaguuuauagucuauuuuuccuuuuuuuuuuuuuuuuguuuuuguuuuuguuuuuguuuugagauagggucucuuuauguagcccugacuauccuagaacuugcuauguagaucaagcuaaccucgaauucaccgagauccaauugccucuaccucccaaagccucagauuaaagggguuccuucaucauugcaccuggcucaguuuguauuccaauugcauauuuuccucacucccuacacugaauucuagaauggcaauaauuccuugaauuauuagccuacuagaugccaugggauacuagaaaaaagauauuacuaucuugaucuuggucauccggugucaaaauuugcucacaaaguuauuuuucuaccagcaagcuauaauauucuuuagcuuuuccaaauuaccaacaauaauuuauagaaauacuuucuaucccagaauauugacauuuucccuauauuucucucuuaaugauuuuuuucuaggauaauagaauugggaucuuuauuuuaucuaaaaucuguauguauguaaaggggccagagcuuuguuaugaaccauugugggaucccaggucagauguguacagaucagaaaaggcuccaagaaaggguaaaccagugacacagagcaugucuaaacguguuuguuuguuuguuuauuuguuaaaacgggguuucucuguguggcucaggcugucccaaaacucacucuguagaccaggcuaaccuggaacucagugauucaacagccuugccuccugagugcugggauuaaaggcacauuccccuccucuucccccccacccaugcccccaccucccgugcugaaguaucuaauucuuaaggauggagaaaaaaaaaagaaaagaaauuaaaacaguaaggguuguaauuucuauuuuucuuucucuauuuaagauucccacuccacagccccaucugcuacccaucugugguaauagugaucuucuaucuauaaaaugcuuugcaguugaccuuacuuuguuucaugugguaucaacaucugucugucuauccguucucggauacaauaucacuguguagcugucuuggaacucuaaaccaggcuggccuugaacucaccugucucuacguccugagugcugugauuaaagacauacaucaccacacuuggccauuucuuaaaaucuguaauugaaagaacuaaaauuuggagcuggagagaugguucugggguuaaaauucguacugguggcucuaccagagagucugaguugaguucccagcauucucauauaacuaaaaacaucuguagcuccagucccaaggaaccugaugccuucugcuggccuccacaggcacuguaugugcacagguuagacagacauacaugugggcaaaacacuuguacacauaaaauaaaaauaaaaauaaaaaagagggagggaguaaaaaacucaguggcacaugagacuguccaacucucacagcucagguagcacagaacagaccaggacuugcacuuggucuucugauccauagucucuucaguccuccacucugaggccccuguuuccugccuuuaucuccaguaagggaugggccaagugcaaguagaugggaagagugcacuuuuauucuuagguauuuuacagcaagcauucugugcuaaugcuugugguauaaauauaguagguaaaagguaauaacuuguaagcauucuuuucuuuucucguuuuuguucuugagucugucagucugcuuuuuaggauaggauuucucgguguacccgcccuggcuggaacuccucuguagaucagguuggccuuugaacucagaaaucuuccugcugcugccuccagagugcugggauuuaaguugugagcuaccacuguccagcacagucuuguuuucuaauuccagcuaugaguuaauugaaaucucucacaucuaccuuaauaaaacauaguaugcuuguuaugacaccgaugucauugcagcaacauuuacagccuuuuuaggaucaaauuguucucuaauugagaugucuuuucuuuuacuuguuucaacucuggcuuccuuuggagugaacuugcauagccauguuuuucagacuuguuuugcagaugaccaaguaaaucuucaaguuccacaaugacuucaacagaaaacccagggcaaguggaaaauggagaaaaaaauuggaaaauguuacaacaguguuuuccaacauagcuaguaacaucuguagauguuuguuuggguuguguuaugaugguuggacugagcaucugcugggugacauugcucuucucugugccuaaacuaccuuuuuuucccucaauccagcuucagacacugauucaggagacugacccuggugcagacuaccgcauugaucgagcuuugaaugaagcuugugagucuguaauacagacagccugcaaacacauacgauccggagacccaauguagguucacucuccauauuguguuuuauuugccaacacagagaacauuccccucgaguggcuuuugaguaguguaauaucuugacuaacauuuuguugaacauggacacacaccaaacuuuugcuaaaacuaauauugagacugagacuucugaucugccuuacccaugauauagagacacucagacccagaacuaugauggcaguuguugacagugacugggcauauaggaccuauuagucauugaguaacuuccuguaauucagagacucucagggcaucaggauaaagugaaacacuuggcacugugacugucucaugcuugcuuguuuguuuguuuguuuguuuguuuguuuuccgagacuugguuucucugugaacccuggcuguccuguaacucaaacucagagaccugccugccucugccucccaagugcugagauaaaaggugugcacuacaccuagcaucuuacaguuuuuguguuuagaugauguauagauguagaugagcauagauagaauguuuauaguauaguagccauggcaaccagaagagggacaggggaagggaaggagauucauuuuacauuuauggguguuuucccugcaugcaugucuauguacuacuugcuugccugguaacacacaguagucagaaaauggugucagauuuccuguaaccagaacaguuaugggggugcugggaauugaguugaauccuguugaugaacaaucugugcucuuaaacacuaacacaucucuccauccccagcaucuuuaauuaaauaugauauguggcgcuuugcuggguuuugauuugaacaaauauuuuaaaagacaugagauaguugaaaauauuuaagauguggggcaacaagguuauguuugcuugcuuucuugcuugcuuuguuuguuuuuugagacaguuucucuguauagcccuggcuguccugccacucgaacuauagaccaggcuggccucgaacuugauggagauccuccugcauguuuucuaagugcuaggauuaaaggccugugucaccacugccugcccuagguguuuauuuuauaugauguguuuaccuuuuuauuguuguuauugauaugacagugaucucaaauuuuagagaaauagacugaaguauuuacugagcuaugcuucaaauaucagcagaagacacugaguuaaaacacauuuaguugcaggaucaccaaagcucuggagaacagaaguggccuguacacuauucucuacucuugcauauguuggaauguuuucauacuaaauaaaaauaaagcugcuacauaggucuuacauaugcagaguuugaaguccaaaauggcuuuaaacugguagaagaaauaauuacugacaagaucaguuaauuugugugauucucaaucaugucacccuggggaaugcguauugaaaugauuuuagaagccugucgucaaaacacuucuucauuacaaucuaccucuuuaaugaccaggauucucucaugucugauggagcauuuauacacagagaagaugguggaagacugugaacaccggcucuuagagcuacaguauuuuaucucucgggauuggaagugaguauuuuaaaaauaguggaaggcacugccucauucuguucccuuguguggucaauaucaaaagaauggguguguguauggggaagaaguuaauaguuuaucaguguguacauaugcaugcuaugugucuguuugccucagcgagcaguugagagucagagaacaacuuuauagagucuguucucuugccuccacucuuaaauagguucugagaaucaaacuagggucaccaggcuuaaaccauaaagugcuuuauccacugaaccaucucagcaguccacaugagguuuaaacccagggcuuuauacuguagaguguacacuccucuacuaagcuguguccccacaccccacuuuuauaguuuaugauaauaaguaacaaauuaacacauucuuuuuaaauucuuggauagcuaacuaucuccaacccucagaaaaccuauucuuacugcuccuagagcaguaucuaaaagcagagucaacccacuaccagccuguaccaagcaucccuguucaccacuacuuuggaugcuggacucaaaacaguuucuaauaacacaaauaucuauugagaaacagcccugguacuuguacagauagcaagagcaucuucagcuuugacucuaaaaggauaacguugcacaaaugacagcuugauugucuaaagaaaggaugaacuaggagcgugcucuuagucagagucacuguuauuuauuggcuguguuaccuccuccucuucuguacucuuucuggacuguucuuuuccaucuagugcugcugacacuggguuccacugcugccucuacuucccauaagcugcuuccucuuuaacuaauuuacgucaauauccuaugaccuuuacucuuuuuugaugauuaauuuauauuuuauugacaugugucaauggaaaaagguuacuugagguuugauguguuuuuauggauuagucuggaaggucaggcacuaugacauaugagugcauauguguauaaugagggcuagagcagaauauugcaaguucaaggcagcccuuaacaacauagcaagaccaaguuucaaacaaauaaauagguauggaaagggaucaaaggaaacugggugauugcuuuucugagcuuccucaagcuaucugaacugagauaacuugaguuuacugcacuucuccccaaucaaggcagugauuucuccuccccccuuacucuuucuccugugaucaaaaugugcuucauaaucucauaaaagcuuaauauuagcgucucuccuuccauuaaauaggucuccuacaguuuacaauggaaugugaacagaagaaucagacguuccucagucugauuuagagaaacaagcagguucgguacaucaucauguccacagaugauucggaaugaaaugcuuuauaacuugaugagcaauuuucagguuaauugaagaaaccacugcuuuaucuuccauaagaagauagauaaauuaguuuuguuguugaguguucugaguaggagacuaguuccugucauuuucuaaucuuguugaagcugguauaucagauaggguugcauugcauugugaauugccuaggcuagcggcaaaccaguuuuacuuucugcugucugggccuacucagucuuacaguagcaguguguaccuuagagucuuugaggaagaguacgucuucuguaugaagaugucuauacauugacuauugugucacuaugagcagcauucagagugaggugugccugcuaaugccuguaagaucaguuuaggaaguggagacaggugaucaagaguucauccccagcagcuacacagcagcuccaaagccagccugaauuauauaggaccuugucugaaaggagggguggggggaaagcccgcaaaaacucuuacaauggaugagaaggaaaauacagaaaguagagcuucucuuuuaauccuuaaccuucuagguuggacccuguuuuauaccgaaaaugccagggagaugcuucccgccuuugccauacccaugguuggaaugagaccagugaacuuaugcccccuggagcuguguuuucuugccuauacagacaugccuaccgcacagaagagcaaggaaggaggguaugccaucacucuugguucuccccacugucauuuguuuccuacuguuguucugguuucugucaacacaaggaagccuugcagguauaugugguagagugggaggaugcuccacuccuagaaaagcaguccuuggcugagcaucccugcuguugcagcugucuguccagcuucucuccuauguguuagucugucuuuguucuaaacaaaggauguggggaaacaguccagguuuccucuuuaaauuuucaaaauccaaauuacaaauggacaauuaaauucugcuguucuaacuuuacuucgcuuuaaagauccauuagaagcuuuuagcugggauacaaaugguucuuuagguuucuacaccuuuggcagccagacacaaaaccuuuauauuaaugagacuucucuggcaaugcacugaguggaggagaagcuuccacacaagcuucuuggcgucucccugcccaguugcugcucuguaagauacuugugugagcuucuugucuucuggugccaccuacacaugcugcugggucucauuguugagaccuuacugaaucuuauuucugcauguuacagguguuguacuuucuauacugaguacagcuaccccuucugagcccagucuaagugucuaagagucagacccaggagguacaauuagaaaauaucauaauagcuaaaagccuggccccccaauuuguauauuuuuauucucuaccucucuuucucugucuccucuuccccucucccucccucuccgugugugugugugugugugugugugugugugugugugugaagccagaagacaacuuggggaaguuuguuucuucuuccaccauggaaugaaaaugcugacucagaacaaacuucuuguagaguugaccuuuuaguagcuuccuaaagcauuuaguucuuguccuagauagcauuuguuauagaguuugagggguaacuacagaccugguuauuaguuugcuacaccuaggggcuucauguauuuauuucuguuaccucuaaagucucuugcucauuccuucucuguagcucucacgagaaugucgagcugaaguccagaggauccugcaccagcgagccauggauguuaagcuggauccugcccuccaggacaagugccucauagaccuagggaaguggugcagugagaagacggagacugggcaggucagugacagcguccacaugcuuuuccuaaaguccccauggcggccagcucaguguuugcugguaggguuuguuaucuuuucagucuucuuuccuagaaaaaaaaacccaucagaguuuuuuguuuuuauaucuaagaauaacuacauuuuucacguuuuaauguuaugguuucuguauuuuuagaguugauuauuuccccucuuugcuuaaaguuuaagcaaaaggaucuaagaugacucagagguuaagaauacuuguugcucuggaaaacaacccagguucuguucccagcacucacaugcuggcucacagucauccguaacuccaguuccagaggaccugauuccucucuucugacuuuugcaggucuaggcaugcacauguugcacauguuaauuuaggaaaaacacauauauuuaaacgaaaaucuaaaaauuuuuuaaaaugaaaaucuuagagccaaaauauguccuggucugacgaaaauauaagauuuugugcuagacauuccaucuuccuuagcacauuuucccuuuucuuuccuccuucucucucucuuucucucucucucucucucucucucucucucucucuuuauuuauuuauuuauuuauuuauuuauuauaugcaaacacacuguagcuguauucagacacuccagaagagggcaucagauuucguuauggcugguugugagccaccaugugguugcugggauuugaacucaggaccuuuggaagagcagucagcacucuuaaccgcugagccaucucaccaguccucuuuuuuuuuuaaguauuuauuuauuuuauguauaugaguacauuguagcuaucuucagacauaccagaagagggcaucagaucccauuacagaugguugugagccaccaagugauugcugggaauuaacucaaguccuuuggaagagcagucaaugcucuuaaccucugagccaucuuuccaccccugugucucauuuuuaauucuuucuuuucuucuucuuuuuuuuaauguauuuucuaacauuuacagauuacauuaaauccuuuugugauagcaagguauaauauauucauacaugucugguauauaccaguagauaaugugcuuggccuaaagcagcccuacaagauacauggaaauggaauuauuuuucuacuuaguugaucaaauugaaacucagagaagaaaucuuccuuacuaaaaucucaagaugaauucuaacuaagaauucauuucguuauaaccuuuucacaaagaauaaaccagaaaagaguagccucaauacuuaugugccuucugugacuggccucuaagacugugugucuaguuuggggaaaguguuacugaaauuuaugagcaaggcaaugugucuucaucauggagcaagguaaucaguuaggagcaggugcuugcuuagaaagaucuuaauguuagaauaaggacugaacuuaggccucugggcuucauuuauaccauaacagaccccuucuggaauuuucaaagucacauauagcuagauaugggagcuagcacaugagauuaguaagucuuagaguucucgggaaguggaagcaggaugaucagcucaaagauagcuuuggcagccggccaugguucacaccauuaaucccagcacucaggaggagaggcagguagaacucuguguuugaggacagcccuuuauuaaacguuagauccugucucaaaaaacuaaaacaacaggaaaagauagucuuuggcuacauagagaauuuggagccagcugagaugcaugaaauuuuguuucaaacaacagggauuagaccgguagcccaguugguaaagugcuuaguauacaaacauagguuuggggcucagcacucaagugaaagcggugugagguugcucuugcuuauaauacuagccccugggaaggaaaaacaggcaggucccuggagcucacucugaaaccaaccgaaccaaauuggcaaccuaaucucucacccauuaccagugagagaccuugucucauaaacagguuggacaguuacuaaacaacacccaagauugaccucuggucuccauaugcaugugcacacacaccuauacauguaugcuauaucuauacauguauguuaugccuacacauacauauaguaggaagaggacagaagguccugguccuagcuaccauucccugaagauuauagccaguaaaugaccauuaagaaaaauuuucuuuuucauuuauuuauuuuuuaugguuuuagagcuuuauuguagaaaggcagggagaaagagagaagguagaaagagggagaccacugguccuggccacuuggaaagaagggggaagggagugagagaaggagggcuagagaggagaguaaaaaaggugagcgcuuaaagagcuucauuuauuucuuaacuuuuuuuugagauauggucucauuagguagcgcuggcuggccuggaacuugcaacauagaccaggcuggccucacacacagagaucuuucugccucugcuuaccugagugcugaaauuuaaagugugugccacuacauccagcuaugaaaaauuuauucaguaguauuaaaguauccuagcaggugggcuccaggcaguaccauaaaaucacaccauauaaguuuaguagagaaaaacacaggacgguggcaacaaggaccggagcuggaaaugggcuuucuaugaaguuucuugaggguagauuugggcuuggcuguauucugagagggugggccuggugguuggcuguccucagaagcugggccuggccacucagggccuugcaguaguauagaccaugcuucuauaaauaagccuguacauacgccucaauaaacaacacuaauuacugggucacauacagagauaccaagaaacugucacauuggaguuggauauuuuaaagaagcacuguaauuaguuaccaaggguguuggcuguugaauaucauuuucagcacuaguguacauguggcacauagacauacaugcaggcaaaacauucguaauuuuaaaaaaacagccugcuaaaguuuauaaccugagguuuauaguuugaagccagcugacuaguuaguucucuuugggcuuguaaacuuggccuugugaauuugcauggcuuacaguacugccuggcccucaccuggguuacauuggaaacaugcuacaccucaguuuuagucacgugaagcuuuuguguucaguuuagugagggaguuuuaaagggaagcugaguacaaaggaagcagagaccgagccccucucaccuguucacucccaugacugaagggcuugccucuuaugugcaggagcuugagugccuucaggaccaucucgaugacuuagcuguggaaugcagagacaucgugggcaaccucaccgaguuagaguccgagguaaguagugaguaguccuagaggagaggggccgccagcauuacuuagcaccuuuguuuccauacucuugagagagcagauugucuugucaauuuaaucccaacacuggggaggcagaggcagguggcucucuugaguuugagaccagcugaucuacagagcaaguucuaaggcaacccaaauuguuacagagaaacuuugucccaaaaaaaccaaaccaaaacaaaagaaagaaacaaaacaaaacaaaagaaggaaacaaacaaaagggagggggaggaggcuauagaagaaggaagaugagaaggaaaagaagacaguagcccauugugcugaagcccgacccuucuaucacugcuccagaagccguauaacugucuauacauuuagcucugagguuuuuuuuuuucuucaaaauuaucauuuauuagagcuuuucucacuugagaaaacauggcuccugcauuucagguuuaaucacauuuaaaagcaaucuaaguagccauggucucuuuaaucugaagcucuguagugaggucauuugguacuauuucuaugcuuaauaaaaucuugagacuuccaguuauacaugagagauugaaccuguauuuaucccuguuauagccugaaaccuacuaaaauauaaaacaugagguuaaaaaucccaauuaggauagaugauacuguuuagaaauagaaagaccauaaaaacuccagagaaguugcaugcucuaauauuauugccaaguauuucaucucccuguucuuaauucugccucuucaguuguucaaguugaugaaggcucucccugccaggcacuuuaaugccaccacucaggcagagacaaguggaucucugaguucuaacugcagcuacauaguuaagacagggacacacacaccgauagccuccuccuccuucccuggccuuugcauagcagaguaacuaaucuauuuuaucuucuacaggauauacaaauagaagcuuugcugaugagagccugugagccuaucauucagaacuuuugccacguaagugaugucuguaggaacgaggguuacuaacauaaccaaguucagcgggacuuugggccccaagggugucucucucuucagcauacauuacuguugagugauaaccagcuuaggaaguaaaauuuagaacuauaaacacaauugagggagaggccaacaucugagaaccuuguuugauuguccaacuuaauuccgcaguugguagcacucuguaguggagcagugugugagaugauuucauaggaaaagauacaagagggaaacuccaggguguggcugagcugcuucucaggagcuauugcagugguaguaacuaguaacuguccauuacgccuggugcuuagggaaucacuuaccuuguuucuuacucacaggagggaaguacaauuaguaacuguuaagaucugagagauaggaacggucccggaagcugcugcuggcauuauacaaggacauagugauaguccucauggcaaagguuccugcuucaugaauuuuauucugcugaauugcuaucguuccugauuucucaggcuuguuuuugaauuuauggcauaucuuuauuuugaagacuuggagggucacuccuauucacauuuucauggauggcacucuagauuguauuguuaguugugacacauaaaguguaagugugugcugucucccccaggauguggcagacaaccagaucgacucuggggaccugauggagugucugauccagaacaagcaccagaaggacaugaacgagaagugugccauuggcgucacucacuuccagcuggucagugcccuuccugucuugucugcugugcugacugugggauagcugccccugcuuuacagcagccaugcagcucugcuauuccccagcuucucaauaaacugggcuuuucucaacagcuuagcauguggugagaugagaccuaguccuagggaacauucguuacagaagggauagagacaagagagccagcagcuccugcucuggcuguaaugcucacauuaagugucacuuacgucacggggaucuguagcucugugugguggguguacaucaguacacuggacccugacgccucucuucugucccuacugucguccccccuucucuucccucccccacacacagugugcugcucuaaaucccuucacagcauaucuaccuuuuuucuuuuuaaaucauucaacuuagauuuaccauuugaauaacaugguuugacuacacucuugguaacaagcagcagcuaaggaggugggguauagcaagcacucuguucagagaggacgauuugucagucagcugaggcuauuaacuguuuucucagagccaggagcccauaugcuugcauucuauuauguuaaugggcucucuugcccugcggccaucuagacucuaguaaaagaugccagaacagguguagucuauaucguagcugcgugagcagggcagguucaaggaaggaaagcaaagccagcacaggggcuguggaaugaaaggacuucgagaagacacacuaagauauccccugggggauagcagcaggaauugacauagugagcucagaagugugauuugaaguacaggaggaccugugugcugucacagggagaugugagaucucagcagacuaugaaaggucuuaugaccagccucaaacuugcuuuauagccaagaaugaccuugaaccucuaauuuuccugugcuguuucugucucccaagugcuguugucaagggcaugcauuuuaugucgugccaguuuugugcaugcuagccaauugcauacauccucagccugugaaugcuuuuugucugacaugucacucauuguucuuaaucaugacuuccacagagcugguuuucuuucucaucuuucagguacagaugaaggauuuucgauucucuuacaaguucaaaauggccugcaaggaggauguguuaaagcuuugccccaacauaaaaaagaaguauguaucucuuuaagugauuuguucuguuucccuagcuucccucgacuacagaguggguguguagggugugaggcccagaggccuccugugucucucuuugguagucuaaucaaacugcauugucugccagaccauugccacagcugccuacagucacacuuguccauaaccauagguauuaucaaaagaaaagcuccuggaaggagggaaugcucuggauuuuuuuucuagguucagacugccugucugagucagguguagggagcaucuggaaaaggcaauugcuggcucagccuuuucccagcaucacccuagugugucaucucugcagagaagcagcacaggccucacugaaguagagcuuuggggaggaaguagaccuugacucucuugggaacuaggucucaaugaggagacugcucagcuuugacagcacaaaucuuacagguuguaaggggaggagagccauguugcuuggacauauuuucccuuuugugugugaucagguucccauuuuggaguucuuauuaauaaguauugaauuguccuaucacaagugcuguguguggccucuguuccagucagaacuaaagucaucauucaggcuacugccugacuucugaaggugcaguggggccauguucuaaagccacagugagugcuuaagucuacagauaguaccaaccauuguauaaaccuuucccuauacuugcauaccuaugacaaaguuuagcacauaaauuagccacagaaggaaaauaacagguacuaauuauauggacagauaggguggcacacaucuauaaucucagaacucaggagacagaauaagaagacuaugaguuccaggcauucugggauacauugugaaauccugguuguuguuguuguuguaagaaaaauuuaaaacaauauacucuauauagucauaugaauauauaguggaagcugguggcacaugccuuuaaucccagccgcacucaggcugaagagauagguggaucucugagcucaagaccaaccuggucuccauaugguauucuaggauagccaagcuuauacugucucaaaaaaaaaaaaaaauuaugugaauguagauauaacaucuauagcuauauccauaacaaucucggcauacuuuuuccccuuucaaauuuagaacuucaccuuuucaaucaaagggugugauugugaguguuuauuugccauauccagggucugggcuuuuugagccauuguuaauaagggcgacagaugaauuauuuaaaacaacagcaagacuugcaagagagacauuuaaaaacacagcuauauguuuaugaaugaacucuuucuuuuuuuuuuuuuuucuuucuuuuuucuuugggggaggggucgagacaggguuucucuguguagcccuggcuauccuggaacucgcucuguagaccaggcuggucuugaacucagaaauccaccugccucugccucccaagugcuaggaucaaaggcgugcgccaccacugcccggcuaugaaugaacucuuaguaaacaguguggccccagcuccuguuucagccuagugcuugggcauucagccccuuuaggcagacagucuaaagccuucuccuuccauggcaggguggacguagugaucugccugagcaccacugugcgcaacgacacucugcaggaggccaaggagcaccgaguaucacucaagugccgcaagcagcuucguguggaagagcuggagaugguaaugccuccagaaaccacaggacuacauaggacaugcaguaacaguuagcaaucuuuccuugugccacuagcuucuuuacuguuuugaguuugguuuuaaaugaaagaacauuuuuuaaccacacaacacaggacuccaaacuaggacagagucaaagugcagucacugcagccacugaaucagugcuguuguccugggcacucagcugucguuggcaucacuugucugauccucuggcugccagagaagcaaugagacugucuacuucacuuuucaucuccagcaagaaaggagggaagggcagucucucuuugccuugaaauaaaaccuucucccuuacaucuaagugugucagcuugggagcugugguugcugcacaaguggcccaucugaaacaacugagcgcgcggggggugguggggguuggggggauaaggggacaacuucagcuaccauugugaagcaugagacagagucgcaaaggaaguuuuaccacuuagugcuuagucaccuauccgagccauuagucaacagacaagucuauaacaauuugacaucuccauggggcuagagagauaguuuagugguuaagagcacuuaacacucuuacaaacugacccgaggucaguucucagcacccaaaauaaugaaagucauccuuuaagaaaauauugacaucuccagcuuaaaauccucucauuucucuuccacuugggcuccuucucauguagacagaggacauccguuuggaaccagaucuguaugaagccugcaagagugacaucaagaacuacuguucuacagugcaauauggaaaugcucagguacugucuuugauuacagaucucaagucagcgcacccuugcagccccagcuccucaccguuuccuuucauugugcacuugggcugucccagagugcuuugccuguuuucuccugcuacuccucugcaugcacucugccugucugccuaguaggcuccugguuguuuccuccacacagcuucccagugacuccacuucggcgucucccagggcucuacugcacaguucucuuuuaggaccucaugagugcugggcuagcauucuacugagcugcgucccugcuccuuucuucccuuuuguaauuagaagauauuaccuguucaaaauaaagugguuuuuuuuuuuuacuuuuauaugcaugugauauaccuugaucauauuggcuucuuuauucagcucucacugccugcccauggucuguaugugcucuucugauagcaccucacacagaaaucucuguauguuugauuuuuaggacaagguaucauguuucccagcuagcuucaaacucccuagguagcuuagggugaguggucuucaccugcucgucaaccugguuuaaaccaccuugcccagccgggcaugguggcccacgccuuuaaucccagcacucgggaggcagaggcagucggauuucugaguucgaggccagccugguuuacagagugaguuccaggacagccagggcuauacagagaaacacugucucaaaaaaacaaaaacaaaaaacaaaacaaaacaaaacaaaacaccuugcccagcagcagaauccuuauuagacaucaaguaaaaucacccaugaacuuuuucaaauaacacagaagcaaaucccagaaucaccaggguuugaacuuaagguuuucaugauuuuuuuuuuuaagguuugcuuauucaucuaccaaggcccaagcuagguucuuuagccucugagaggcuuucuucccugucuucuguccauacuuugccuuugucuaaagucugaauucuccguuuccccgcuuuuguaguuagucuuucuauuagguuuaguuucuguuugauggaaaugagaucgggcaggaucuugcucucuaacacggugggcacuugucagcacagauucuucuucugggugccauuccuucagauacagcuuugcuuucccuuccugcggaauccuguggacagguguugcacccaggucugucccuagugaccuuuuccaucuccuucuuaaugguuuccagucuugcuuacuuuguguuacauuuguuacaauugcucagggugccggggcgugguggcacaggccuuuaaucccagcacucgggagguggauuucugaguucgaggccagccuggucuacaaagugaguuccaggacagccaggucuauacagagaaaccgugucucgaaaaaaaacaaaacaaaaaaaaaauuauucuucaauuucucccucuccuucccucccuucccucuucccaaccccccccccccccguuugcuuuuuaagacaggguuucucuguguaacccacgcugucaugguacucaauauuuagagcaaguuggcauuggauuuacagagagacccaucccuuugucucugccucccaagcacugggaugaaagaagccugugccacuguugccagacaggucucucauucuuuuguuuguuugguuuuuuguuuguuuuccaggcaggguuucucuguguagcccuggcuguccuggaacuuacucuguagaccaggcuggcucaaacucagaaaucugccugcuucaacuucccaaguacugggauuaaaggugugcgccaccacuguccagcuuuuuuuuuuuaauauuauuuauuuauuauuauuuauacgaauacacuguagcugucuucagacacaccccagaaaagggcaucggauccuauuacaguugauugugagccaccaugugguugcugggaauugaacucaggaccuuucagaagagcagucagugcucuuaaccgcugagccaucucuccagcccaauucucucauucuuuaaacaguaccauugagcuuuuucaguucuuaaaucucugcuugcuucuuuuuauaacuauauauucuagauucuuguuuaucauuuucuacuuauugcuucuagggcauuuacauguguuuuugcagucuccuuugaguggucuauuaccuuuuccucucagguuugaguucuuggcuuauguaucauuucuuaagguguuagugugauuuaacaaguuaaugguuucuaguugugccuaacguccuucagagaaguauugugacuucaugcugcagcccugacuuggcacugcuccccaccugcuuuccuugguuacaugucuuacauuugguauaguaaggagacuacuucaguauaugcuuaccuuaaaauccaucccaugacgcucuuuauagugucacuccaccucugcugucacagcuccucauaguuugccuugaagauggcauuggauacaauucacacuuaacaucuaacacuguucuuauaaaauauguguugaguuuaaucaaauuucuagacuuuauaccugcucucuagucagagaagucaacugugugcuccacgaggaauccuuacaaggaguggcucaggaaagcagaagaaaucagaaagccuaaauggguucuuuuuagauuccaguacagccugcuaaucacucugaauuuuuguaauuugguucacuguuggcccuaagguuauauaaaugcaugagaguaauucuccuuaaugagagaauccuuacuccuauugccuggaauuagaaacaaaagguccuggguuagaaaaacagugagugugucagucagaaucgaugacuuucaacccgacacacuuccuaacacaaccauaacucuuguguuacaugugacuguuuguuuacuagaugaacugugaauuucucgucuauuuccuaacucagcuggaacucuucuguugcagauuauugaaugucuaaaagaaaacaagaagcagcugaguacccguugccaccagaaaguauuuaagcugcaggagacggagaugauggacccagagcuagacuauacucugaugagagucugcaagcagaugauuaagguaaaagaccaagggcgaccuaagugacaauagcagugugauccuuucccguuguguccuguuaaacacagccaacauggugaugcccucggcugugggucuacaguccaauagcauugucuucaccugccaacuuguguguuccugagcuccagagucucugggaguggaacagugagaguguccauuagcccucuaagcaacauggaugcugcucauguugggaaaauuacagaacugaacuaacuagcuugcuuugaacaaaguucagcuaaauagguugccaggaaaggugggcuaaaaaagccacaauccaguguuuuuuucagaucauaucccacacucucaagauguugcuuucuguucaagauuuuuacauuuuacuuaauguguaugagucuuuugccuggguguaugaauggauacaguauaugugccuggggcccacugagaccggagaaggcauugguuucuuagaauuaaaguuacaggugguuauaagcugccacguggggguggugagcugaacccagauccucuguaagaauuacagcaaaugcccuuguccauuagccaucucucaccugcaaaauguguagguauucuauauauucguuugcuucaaauaaucuaccagugacuguuuauugguuuagguuuuguaagacaggguuucucuguguggccuuggcuguccuggaacuuuuucugcaaacugauuggcuucaaauucacagagaucagccagccucugucucuugagugcuagguuuaaaggugugugccaccacuacauggcuuccagugaauuuucuuaaugguccuauacacacacacacacauacacacacacacgaaaauuaaaauuaaggaagugcaaagaaauguuaauaaaauuuucacuuccuuuaaaauaccugauucuaccaauaacuguuagugggaauuuaauguuuguuuauuugugugugugugugugugugugugugugugugugugugugugugugcacgcacauaccaaagagaagaauggcgggggaggggggacacaaacacuaaaacaagaaagggagaccuuauggugaaggaaggauccuaagcagaguuugaguugccgugaccagacgugcagauugacaaguacagauggaguucauuaccagccccagacugagcucuaauugaagggaggagagcagaguguguacaggggcuaaccucacauuuggauuacagugcucaccccaaaucccuguccacauuaguuaacaguuauuccuaaguacuaccucuguggcuggguagggauggcccgagggcauggugacuguucuguucauacucaucaaguaaugacaugugugaaacggccuguacuguaacauagccauaguaauaggaaccaagcccgagcagaauuuacauccugugugguugauguccaguguuggcagagagaaaugugugaaaugcaggagauaaaaaguaaagaggggcaccggggcugggcacuuacugaugcuuagcuguucccugcuuacgucaagugaugccuugacuugugcuucugugagcucccugguaacuggaaaagcaaucacggguagauuaguugccagucugagauagccauuuucauauaauuuuauuuucuuugcagcgguucuguccagaagcagauucuaaaacuauguugcaguguuuaaaacaaaauaagaacagugaauugauggaucccaaaugcaaacagaugauaaccaagcgccagaucacccagaacacagguaccgucuugcucagcucuacugcuucuguugagugcaucccaagucgaacuugcaggacguguuguuaucugagccgugcacucuccuccuuugcaggcguuccagaaaaauagaaugaaggucaaagggaaagggucgaauuuaaaaaacaaaaaauaaaucagcauuagagucccuaggacaguaauucuagagauuuacucuagaauuucaaacuucaugagcacagucaauaauuuucagagggaaaauuucagcucuugccugggaaaccuuguaccuuaguggacaaaaacuguuagauauuucuuucaaaauuaucuauuacggacaagguuucugcuguccaaaugauaccguuuguuuuuaaguauuggagcacagaccccugcagaggugagggcuuccugagaaggagucaggugcccugagcugagucacauugcugguguuggggagaauaggucugguaacaggcacacuuaauccagcacaugaaagacugaggcaggaggauugugaaguucaugccugcugucauaccuuccccugugaagggauguguuccuugaacugcaggaaguccgucccuccuuaaaaacaacagcaguccuggccugauaucucaucugcuguuagcuaacuuaacaaaucagcauuuauauuccugacuauugacauacugugccccuaugacccccacccccaccccucuuuuguuuuuuugagacaagguuucuuuguaacucuggcugucuuggaacucacacuguagaccagacuagcucagacucagagagauccaauugcuucugccuccugagugcugggauuaaaggcuugcaccaccaccucccucuuugcuaauaugcaccccagcuaguugcaccccaauuaauaugcccccuuugaaagaugaauuuccaaaaauuugugaaaaucuacaggugaaccauuuucucauauauuaacauguuuuuauucuagauuaccgcuuaaacccugugcuaaggaaggccuguaaagcugacauuccuaaguucugucauggcauccugaccaaggcuaaggacgauucagagcuagaaggccaaguuaucucaugccucaagcugagauaugcugaccagguaugcuggccaggcucuauagagcuguguugaugcgcauuuuuccauggacaucacuagcauacuccuguugccauuuuuaugccuuccccaaaauggggugugagggcucagguaaaaaucggaugcucucagguaugcugauuuggucucccuuugucaucuccagcgccuguccucagacugugaggaccagauccguaucaucauccaggagucugcucuggauuaccgccuggacccucagcuccagcugcacugcucagaugagguaggcuaugcaugcaaaggagggcuucccccaaaaggugacaagaaaguucuauaccauauauucuuccuaacucgggguuaccuacaggccugucuuguagguaagacuuccaaguucuacauaacccugaaccagacuuggcguuaguuuguuacacugcaguacugcuuccacacucuacuauugaauaagaauauucuuuuauaauugcuuuuccaugcacugugagccucccugauuauucuggagagccauucagaacccaucaagucuuaccagaaaaauaagagugcucucuaaugccucuaagcgccuguccuuagaaaucauuggucuacucagcuagaaaaggcuaccugaggagcccuguuuagauugcucuuaaagcuaucuaaagaaaaugguuuauucucuuuucugaagauccuguuuggaaaguccaugacaugcaacacaugucaaguugaccuuccuucuguggaaucacagaggaaaauguaacucauuuucagaauugacagugaacuuugaaaggagaacagaacuugggcguccggcaucaaguacagguguggggagggcgccguccacugggaagcuguuaagcugacccucgggugcauguuugggagaaucaacaugguuaucuucagaggcccguguuucuaaagacaguggcauugucucucagcugucccugagaagcaggccuauucagagucagcaacgggcacuguguuuucagggcugguuagacagagucggucuucucuggaagccggcugguuauuccucuuuaggauagcccuguuuccuugucuccugaguagauugccaaucuaugugcugaagaagcagcagcccaggagcaaacaggccaaguggaagagugccugaaggucaaccugcucaagaucaagacagagcuguguaaaaagguagccacccucaucgugccucaucucuugccuccuuuucucuuugucuuuuaauucuauuacauuauuuauuggaagagagacauagaagaauggucaaggaccauauuaugguuuggaaaggaauaacagcauagaaugcuggguagaaaggcuuauauuuuguauuggauacuuuuuuuuuuuuuaaugagacaaagguuuuucuguguaucccuggcugacuugaaaugcucucuuuagagcaggcuggccucaaacucugagauccaccugccccagccuccaaggauaaacuuacaggcuguguauauuaaaguucucaauuuaauauuugaguuucacauuguucagguuuucaaaaguaacagacuauaucaauaaaauauuaacguauacauacuuuaaauuaauguggcaugccagaauccaagaacccugccugaugauccagucucuguauacuauccuggauuccucagagguaguuagcaaauuaaaucagaugccaaaagucuacauucuguacauacugaaucauauuaccacccuccuagcccagaauaguuucugguucaccuucaauuuuggcuuguuuguuugcauguucuguagaguauuacaacaacagauuggauaccuuuguucuacaaagcucucuccacaaugaacuucccuuuucaggaaguguuaaacauguugaaggaaagcaaagcagacaucuuuguggaccccguucuucacacagcaugugccuuggacauuaaacaccacugugcagccaucaccccuggccgcgggcgucgugaguaauguuuguccagucugcccccaucugaacuuccuugaguggaacaaaagcuaccuuugaguuaccaguugcagcuacuguguucuguggcuauuauccagucauauacagcaucucuguaugucuguucgaugguaaagccaggcuuugugguguuagguaugggaacaauugugcagguuugaacugaccagagccagagauuucgugaaaaaauaaauuugagauauuuauuagagaaucaauaauucagguacagcuaggcauaguggugcacaccuuuaaucccggcacuuagaagcagagagaggcagaucucuuugaguucaaggccaacauggucuauauagagaguuccuggaaagccagaacgacauaagaacucugucuucaaucaccauccugcccucuuucccccuuucccacgcugaacaucgcaggggccauaacgucaccguggcagcuccucagcgucuggaacucaggugacacacagcuuguuucugagccagggacacccaacgaaaauggaagguguuuagagaccuugagcagcugacaccugugggaucuugguaaagguuuuuagagagaaucugacucuguuaguccuaaggagcugaguucucagaugcuuggggaucuucucccagauuuuauagaauucuuucugugcaguugcaaacuucuuacucauuugcuuccacagagauguccugccugauggaggcccuggaagauaagcgagugagauugcagccagagugcaaaaagcgccucaaugaccggauugagauguggaguuaugcagccaagguaaagaccaagagaguuucugacauggcagccucuucugccaguuuuuaucucuguggcauaugucauugguguuaucuugacuagaaauugagcaguagguauauuccaaaaaucaggccaggcguggugguguacaugcccauaucugugaguuccaggccagccaggccuauguauccugucucaaaagaaaaaaaaauuauuguuucuaaaucuggacuguuuaugaacccugaaauaccaucucccucacaacagacuaagucuacaaagcauugucucaguuucccagacuccaauacugaaagguuaucaccuaucaugacugucagccaucccuucauuccuccugacagaaagaagacgcgugugaagccccagguuauguggaacagcacacacuaagccaucuucccauguuguugucuuccucuccuuugagcuccuuagauuauggcugagugacacagagucacucacugacuauuguaugcuagcaaaucucauuaauugcacccucccuacgcugcucauucauauauguguguauguauauguauguauauauaucaugaacauaggaggcacucauguuucccuuuaccacgcuucuggaaugguacccaaaagaacaguuuuaugugcaguuaggaaaccuuugauccugguucuaccacaugacucauugguggagacagugggaauugaggauaaaaacaguuaaacuauaaauguccaaaauugguguauguuaaagcgcagucugucauucuaggugaugauuauacaacguuuuugauguggaaauacuuacagugugguaguuaauaaguaaagucaaaauaagaaacuugauagagaccagccagaguguggugcacggcuguaauccccgugcuuggaggguaaggcgagcgcaucacaggucugcggccagccugcacggaggccagccugcacggaggccagccugcaggaccuucgucuaacagcaacaaggaugucaaaaugacacuucauagccacaagaaaaagagaaggaaagaaaaacauaaacauggucucagccuuucaggagcugcuggugugucaauggcacaugaggaugauggcaccuccuggugucuuccuccaucucaguuuguacagggaaaccugcaguuuaugauccagaguguuacagcuguguugauuuuccuucucucuccccaugaacuaaaagauaugaauuaggauguacaugagggcugaguggguaaacaccugaagaccagaggccgaucccuggaaccuagucagaagcaggaguaaacugaccccccggcgugguccucuguccuccgcagguugucacagcuugugugcacuaacauacucacaucuuacacauacaagcacaugcacagaacaagaauagcaguaauaauuaaaaaagaaaagaaaaggccaggucuuaugcugugugucauuaaucccagcacucgggagucagaagcagguagaccucugaguuaaacaccagccugagcuacauagugaauuccaggcagccagaacuacauaaagagacuccaucucaaaaaaccaaaguauuuuuuaaaauuaaaaauauuucuaauuuaaacuaaagaaaaaaagauaguugaacuaguagguguccaagggacaaguuagacauggcccugcuacccacccagcuuacccucagaggaucauauugcugucuccuuucagguggcuccagcagauggcuucucugaucuugccaugcaagugaugacaucucccucaaagaacuacauccugucugugaucagcgggagcaucugcauacucuuccugauuggccugauguguggacggaucaccaagagagugacacgagagcugaaggacagguagaggcgcaggccugaccaccaaggagccaccgcccgggcccgccuguacagccguccuguauaguguacccucucacugcgcccucuaacgguggcacugacacccacaguagagcagcaucaggugcccacugcaucuucccauccagacuuggccauguccucgguguccuccuccuccuccuccucccagcugcccuugcagcgucggcagcuggcugcuuuggugguagcuuuuguuggcgaagguuuaccugccuguagacaauucugucauaccuacagaacugcugguacuuccagaccgacucaccugaccugcaacucaaauuuuuaaaaaaaaaaaacaaaaaaacaaaagacaaaaaaauuuuaaaaaggaaaaaguguauauaguagaacuucuccuucagucuugacucaaacaguaggauuauucuuucauguaaaugcagcaggugucagcaggacuuggaggagcgaugcauaucccgugccugaucauugacaugucuguuuccucucccagaagcaacuuuggcccacaucaaggcagggacuucagcaaguaguggggacacuaagcagccugcucuagggccuguuugcuucuacugcagugugaugccuucuacccucuaccccagacgagccacugcgacccacagucucauagcaacaggcauuucugugucgcccacuucagugcagaugugagccucucugugucaguggaagcggacuagggagggagcagagucugaagcaggccugggugcacagccagcaggggcccagccauccucuuccuccaagaugggauagagcugccucaucuugaugaacccucauaaaugugggguucccuggaaguucucuaccucgacaagaaguaguuacuaaguugggguguagggcuucuaagaugaggguggggguggcagggcaggaaggaacagguguaggacuugcuucacuuaguuugcugaacaauaguacaggccagaagagauggcuucugaagauuuagcgugaucucgggugcguggcuggcauugaagccugacuuucugugcaugccaggcagacuuccugacugacaggcagacuuccugaccaacaagcuccuuugugccucuaaaugaagggauguggaaagugauugcauuaaaagauggaggauuuucuucguucuuuuuucccuccuuucuguucauuugcugcguguacccacuccaguaggcacuggcucaguguuacauuuuggugaucugacaaccuuccauagucugagcuuuacaggagcaggauccccagccaucuucccucacuccuccagugugaagaugacagggccggagcauaggagggaggagcccaggcacugcaguuccccuuuggcgaguuugggccauggugucacaguggcuguacagaggguggcauguacaguaggagauauauuuauauaauauauauuuuauuaaccuguuagauguccacagaguauuauaaaucaugugccuagaacuguccacacagacccaggcccccucggugccgcccugcuccugccucccauaugcaccuacagcugcugccgcacuggagccaugugucuuccugagaugcguucugugcaggcucugucaguugcuccaaaucacucugugucucaccugacugacauucauuugaauacugugguuuucuuuucugcugccuuuucugguggcagugaguuccagggcuagcuguguauccccugcauaggguaauagaagucaccaggggaaaauuugcaaagcuuccugggccccuacuuacugcuucuagagucuuccugauucucagcagcuguccugggauucuugaguuugaugagacuuaaaacuccugcucuguaagcaaccuccuccacugcuagcuggcugagccaaucuaaaggucccucccucccucccccgagagucuccgugucacauugauguuccacaguuagacggggguagaaucauagcucugauccuguggcucccuuccgguaugugcuuagcauaugaugugugucucagcacugcugcuucugcacugacaggaauccacacugccugcagcagauuuggagguuugguggguuuggugaauuugauucuuaaacuauuugccauuagacauggucagaauagaaaaaaaaaauagcuacuaguguuuuaaauugcuuaguacaaggaagugaccauauuccuuggaguaguucuuaugacuugaugguccuaggccuggucuuaagcagguuuuucuaggcuaugucuaaggggcccagugcugucuauucuguagcucauugggcuuaguagggugggcucugugcccucauaagucagucauggguauaaauuagauagacaugaacuugccaagaaccccaaccuggccgggcagugguggcacaugccuuuaaucccaggacuugggaggcagagguaggcgaauuacugaguucaagaccagccuggucuacagagugaguuccaggacagccaggguuacagagaaacccugucuugaaaaaaaaaaaaacaaaacaaaacaaaacaaaacacagaccuacagugcgagccaaagucugagccucacccuucacuguccugcuuucauugccuaagaauagcaguuaggggguguaggccaaggcucaggcacugcuaagucacugugggcuagcuugccagcucaugccagugucuuggggaccacuggugguagguacauuucccuuugguauuucaaaaagccggggccugggccagggacagggcaucuguggaccaggucagaaaucugucaaugagccaagaaccagacaaacuaaacuucuuuucugauggggcugcuucuagugaagggacuccaggagcaagacauuucuuuuaacccggucccuggacuugacuguugucgcugcucuuggggguauuuuagcagucugacccugggaaagccuuaacucucugcauucccagagaacuucuggccaccauuuccaguccugguucuguggaucaagccagcuugcugagccaugcauccuuaauaggcaagggcacuccagagccacugaugaggugacaucuagugaucaggugauaacaaaagaguucaguacagguaccaugacuaccaccuccuguucuuagauaggagcaugcaguccacugucccagacgaguuggcagaaaguuauccaacuuuuuaugucuuccuguugaaaucagcugauggaagaugcucugcuucucagacacuaggacgaggguggaguugugugauuaguauccucggccuuccuagagagcauccacucuugugcaucagugugacuuccagaacccccgccucccuuagaggcuaugguaccguuucuggacuuucuggaaagaaaccucccuuccauucuuuuuucccuaccccaaaacaaaacaagcuuuuuccacuugcccccaguucaguaucucagaagucaacuggcccagucugguauccugcagccuaacacagggccagagaaccaaaagaagguguggcuuuuugaaucccaugcuucuuggaaguuuguguuucuucuugugagugugaaaauucaacacagcuccgaacacccccuugaguuuuuugcucuuugggcacacuuaguaguucugaagagugugaccuucagggcccaggucuccugacccaucucugccccacuuggcuucaguucccaaggggcuguaccugaccucucgccuccccuucccuccagguagcuuugguuugccaucuguuuagcuccacuucucccuggccucuccacuacggaggccuggaucaccuguuauaguaaccaagucuaaagccaaauuucccuucuugcuacccagaccucaaacaacagugaguuguaaagcaaccaagauuaaaccucagggugacacacuccccugagcagacagugagacugcuguggcggcuuagaggcugcuugucacccagaacacaaagauacgguugucugugcagacagguggugacaagggguuuucucugacaucuucaccugggcacugagcaccaggcacuggagagcuuccaaggugaggaggugcgcagacagaccgugucucuaugucacguuucaccuucucccagcucacacugacaugagaaccucagagcgugggguccuuacaggaacaggucccaggucacuuggcagcacggucguggccgagcgcuuccugauggcuacucccagcaagcaggucagcggcaauggaaaggcagagcgcacagcaugcugugcagggucuugggccucuaaccugucuuugcuuuucguuuuuguuuuuugaaagaaaaguacaauuaacaaaccucuuuuguaaauggauuuccuuucuauguauaaauccccugcaguuccuuguuuuuacuguucaugcuguguaauuuugagauguuacugagauucugaacauaaugugcauuuuuuucuguacagaugaaaugggagaauuuaauaaagaguuugcagguuuguauuugucgaau

SEQ ID NO: 4792 - RNA, 74087 nt, Mus musculus
agaaacugggcguggccggauuuauuagcaggcuguguggggcuuacucacgcggggagucucggacuugggggugggguuggggguggagggucgccugcuggcaccccacgaucgggcuagugagauggcggcgcgcuggagcagcgagaacguggugguggaguuucgagacucucaggugagcugugcgugaauggagccaucugggaauggagccaucugagcaugcgcuuuccgugguuuacacccucacccgcccccccccccauccccgcaccccugcacccccgccuuuucauccaucccuuugcucagggugggaagauggacgcggugcucaucuggagcugucagucaggauagcuaaggaagcuuugauuacuggucaggacaguuagggcaaaggcguguauggccuuuaggguuccaaacaggcuuauggucuugggacgccaagauagugauuguaaaugcuaaagggauucugaccuuguucaagguagugaacugggggagguguccacucccugagguagucgacugcacuuggugacuucgggaaaguugcagaacuucucugagccucaguuacuuggaccaagucucaccuuggaccauuuugggggugaauuugugaaauacuguuuugcggagcaucuguuucagccuaagugguugcuaaugugggaaauacucugucguugacaagauacauguauugcuuagauuggacaccugugagcccaucccucacaucacucuccacgccucgguuuucuuuucuuuuuuucuuuuuucuuuuucuucuuucuuuuugguuuuucgagacaggguuucucaguguagcccuggcuggccuggaacucauucuguagaucaggcuggccucgaacucagaaaucugccuuuuucugccgcugccucccagauuaaaggcaagcgccacuacugcucggcuaugccuaguuuucuuaccuguagaagggagguuauuauacuuacaggacuggcaugagaauuuuaugaggccacauguuuaagaaguguggcacauggcaagcuuuaaaaauuguuaacauuggaggccugcaagguggcuggcaaaggcacugcugccaggcuugccagccugaguuccaggacucacaugucaggaagaaccagcugccauacaauggucuccuuccuccaucugaaagacuccgagaggagccccucacucaggccucgggacaauaguggacacccaagaacucaggagagaccaagcuugaugcaaaccacacaaggcuuuauuuggggaaagccagagcucuggagacgacucauaucccacgcagggguagaggagucgaccacgaggggaaaaggggcccaguuuuuauaggccuucagggggaaaggagagggagggagaaggggauuuccagaucuaaacaaugucuauucucaagaaauggguaugggagggguacaaggaaagagucuggugcagguguagcaacucuggauuggcccggcugugguugcuggggagauuuucugacucuuucucagcaaccaauaucacaaacaccuggcaaugggcuucaucagugggcacacacauggguucaaggaauggccaaaacauuggcagacaaacggcuucaaggaguggccagagcauuguguaccucuauuuuucuaaaucagugaagcuaauucugcuaacaaugaaaucuauuuugccaauuucagggcuucugugaccuuuuacauucugucaggaucuuuuacauccacaucccguggcacucguacacacagucaauaagugaacaauaaaaaauaaaaacaauaucuuuuaaaaaacauuagcauugagugcuugaaauguuucagguauuggcucuugccagccuccgaccacuugaguucuguccccaggacccacauggcugaaggaccaaaccggcucccacaaguuauucuuugaucucuacacauauuguguggcaugucugcccacacucauauacacacaaaauuaauuaaaaaaacuaauuuaaaaauuaaaaaagaguuuuuacugacuggcuauuuuaaucauuuuuccuuucuuuaaauucaaacaaaacauuauuauagugaguguaugauauaucagaggacaacacuugggaaucuauacucuuuuacuguggaacuuaagcuuaugucaacagcuguaucuagcuagaaucuuuauacuaugagccaucuugaagguacccauguaaaauuuuagguguaugguuguuuugccuguuuauaugggaaucguucaugucuagugucugcugaggccagauggaggcacagaaucuccuggaacuagaguuacaggcaauugugagccuccauguggaugcuagaaaucuaaccugugugcucuggaagaggaagaagcagucucuuccuccaguaucucccccccacaccuuuuuuuuuuuuuuucuuuugagacaggguaucauauguaacucuggcuguccuggaacuuauuauguagacuaggcaggccuccgacucagagagauccuccugccucugucuccugagaccagggguuagaggcacaggcuaggacucuuuuuuuuuuuuuuuuuuaaagauuuauuuauuuauuauauguaaguacacuguaguugucuucagauacaccagaagagggcaucagaucucauuacgggugguugugagccaccaugugguugcugggauuugaacuucggaccuucagaagagcagucgggugcucuuacccacugagccaucucaccagccccgcuagggcucuuuugaagcaggauuucaugcguuccaggcacacugagcauaguguuagcugaggagaucuugagcuuuugauccucuugccuuuaccugcucagugcugaggucauaggugugcaccaccacacagaguuuuaagcaggccucagggcuucaugcaugcuauccaaguacaauacuaacugagcuacaucccuguguuuuuaucauuuuucuguauugugucaggcuucaugcuaggcagucuaucuauguguucuuuuucuacuugaaagagccaugcaggcuaaguagguauuacccuagcugggccugguggccuuuaaucccagcacccgggaggcagaggcagguggauuucugaguucaaggccagccuggucuacaaagugaguuccaggacagccagggcuauacagaaaaacccugucucgaacccucccccgacccccaaagaaaaaaguaggcauuaccuuuuuccaccaaaacaggaagcuggucccugcuuggcugaucuugagagaguugucuaaggccuccugcauguggcugguggcacugggauuuguacagucuuuggccccagagcucauuacucaacuuuaucucuuaauagcucauaaugcgucacacauagguucauaauaaaacaucgugucucacuuuccugauaccuaggacauuucuucucaaguuuuuucauuuauucaacaaauauuuauugaguacuuucuuacauuuuuugguuguaagccuagucuuuaauggcugcgucaugucuccagcccugaaugcuuucuguguguuagacuuuuauucaccuguuuauuuauuuauucaauaaggacuuauuuauuucaguuuuuguguuuuuauguguguggugugcaaauauaugcguaugcauguuuuugcaugugucuacacaugugucuugggguuucuuuugaugugaagagaccaugaccaugacaacucuuuuuuuuuuuuuuugguuuuuuugagacaggguuucucuguguagcccuggcuguccugaaacucacuuuguagaccaggcuggccuugaacucagaaaucugccugccucugccuccccagugcugggaucagaggugugcgccaccaccgcccggcuucaugacaauucuuauaaaggaauuuuucuuuguuuguuuguuuguuuguuuguuuucaagacaggguuuuucuguguagcccuggcuguccuggaacucacucuguagaccagacuggccucaaacucagaaauccaccugccucugcuucccaagugcugggauuaaaggcgugugccgccacuguccaaaaggaaaauauucaauugaaaaauuuuaaucagcuugcaguucagagguuuggugcauuacuauuauggugggaaacauagcggugaagcaggcagacauggugcuggagaaggagcugcauucuacauguagaucaaccagcaauaggaaaaaaacugggggccacuaggcaugcuugagcuucugagacuuaaaagccugucccaauagugucacacuuccuacaacaaggccacaucuccuaauggcaccacucccuuuaagggucaagcauugaaacauaugagacuauggggcugucccuauucaaaccacauaacacgugugggugcaugugcaggaggcccaagguugaugucaggaaucguccuggcugcuuuucuacuuuguucauggagguagagucucucugugaggcccagagcuugccaguaugucuagucuugguagccaacuugcucugagaaauccaguuucuuaguuuuucaagucuagaaguacugggaggcuacucugcccacccuauauuuauguggguuucuuucuuucuuucuuucuuuuuuuaaagauuuauuuauuuauuuauuuauuuuauguauaugaauacacuguggcugugcaaaugguugugagccauccugugguugcugggaauucaacucaggaucucuccuuucuccggcccugcucacucuggcccaaauauuuauuuauuauuauauguaaguacacuguagcugucuucagacacaucagaagagggcgucagagcucauuuuggaugguugugagccaccaugugguugcugggauuugaacucaggaccuucagaagagcagucagugcucuuaacugcugaggccucucuccagccccuuauguggguuucuggagaucugaacuuugguccucaugguuacaagcguguguuuuaacuguugagccaguccccuuuaaacguaaggauuuauuguggucuuacuagcgcacagugucccaggcacaguguccguauccuguuacuuugcacuuagggaaauauagauuacaguaaauggguagcugugucuucuaaaacuccauccugucuuuugccaugagggcugauaugaggagccgcccaccagucugcucuguggugcccucugauaaguagucccuguggagaauuugaccagcagcucuuggauuaagggaucuugaaacacuuggggcugucagcauugucagugugaggucugcuuuccccagggaggugccagacuccuaggggagaagacagauugcaguuaccgaucuuguuaauugcuuucacuagggaucaggacagagccgaaccaguaucacauguccaagccugcuaauuuggaagaugcuaaucuauaaaucuuuuaauucucacagaaacccaggcagucuuaccccuauuucuuuauagagauguaacugaagagaccugcagagagggcacugacaccuacacuggagugcuaugaaguaggagcaaauaauuaagccuaaacagcaguuggcauagcaggagaacaaaguaaacuggguaauuuaacugccuugugggaguuucugcuuuuccuuaagauuuuuucuuuaguugaaaggguauaucuauagugugaguuugccuguuuugucugacguagauuggcaagaggcagaaaccuguuuuauuauuuuugauuguuuguuuguuuuuguuuuuaaagacaggguuucucuguauagcucuggcuguccuggaacucacuuuguagaccaggcuggccucgaacucagaaauucgccugccucugccucugccucugccccucugccccucugccucugccuccugagugcugggauuaaaggcgugcaccaccaugcccggcuagaaaccuguuuuauuagcuuucuacuacauagaaaaaaaaagaaaauccuuuaugcugccucucugaagaagaugguuagaacaguaaacuucucacaaugcuccccauucuauuuuauauucuagaaaauaauuucagcagucuggugguuugaaugcaaauggcucucauagauucauauauuuuauaugcuugguccccaguugguggagcuguuugggaaggauugggaggcguggccucauuggaggggaugugucauugggggccagccuugaaguuucaaaagcccaugccauuuccaguuaacuaucucugccuccugcuuguggauuaagguguaagcucucaacuacuguugcagcaccaugccugccugccugccugccgccacaugcagugacggucauggacccucugacacucgaagcuccaaaugaaaugcuuuuauaaguugccuggaucgugguguuugucgcagcgauugaaaaguaauuaagacacaggucacggcgcuugcugccaagcugaugacuugaguuugaucugcaggggccccauggugggaguggagaacugacuccugaaaguuguccucucacugccgcaggggcaccauagcaugcgcucugcuauccucagcacacaaacaaaugaauguaaaaguuauaaauuuuaaaauuguuuuaggguuagagauguagcuaaugggagugcuugccuagcaugcuugauguuuucauuggguuguuuguauuuuacguauugcguauguaauccaccugucuuuaccuuagcacugggauuacuaagcaugagcuacaauggcuguuaagaaagcaaaaaaggccuagagguccaagguuugauuuccagcaccugccauagcacauguguggucagaugacaacuuuuaggggucagcucuguccuuucauggugagaucuggggaacuaacucaggucuuuggguuugccccacgaacacugucaauauuugguuuuugaguuuaaugaaguguuuuucugcucuuggugggcuuagcuuggggguggguaguaggaccguggaaauccaguggccuucagagucacuuuggucucacaaucacaaaggacggugaccgaggccacuagcagggcaagcaagccgagauccccugauaguaacagcuuccacagcagguaggagucucagaaaugacucgcuggcuggcuuucugcucuuuuauguguugggucucauugcuuuagccuguauauuguauauaaauuagcuguugauuugggaugagucugggaacacaggcacacacacacacuagugcacuuuuguaugauaugaguguggguaucuguguguguguguguguguguguguguguguguguguguguguguguguauauaugcauggagagagagaccagugucagcuuugggcuuuaguccuuaggaaccauucauucaccugucugucuuuacguccuuggcgcugggauuauaagcauguacuacgauuaaaaaaaaaaagggaccagaggauucagguuugauuuccaacaccauaugacagcucacaaaugucuauagcuuccagagcguccaauaacuucuggcuuccuucaguacugggcacacauguaguacacagacauacaaauaggcaaauacacauaaaauaaaauaauaauaaaaaaugugugugugugugugugugugugugugagagagagagagagagagagagagagagagagaaugugggugccuguggaggccagaagaggguggcaaguuuccuggcucuagaguguuacaggaguuugugagccaucugggaacugaacucagguucccuggaggcagcaaacucucugcugcugagcuauagcuccagcccccaaaccccuggcuguguguaugugggugcugagagucacacucugguccuggcgccuuuggcaagcugcucacaauugccuguaacuccagcuccagggaaugcaugcucuuugguuuccaugugccagugcucacguacacacgcauacucuccaccaagagccacauaauuaaaaguaaaauaaaucuuuaggaaacaaguuuguucauuugaagcgauucauuaagcuguggguaguaagucuguauuaucagagucugggagguauccuggcaggagaguuaggagacaaaagcaaaacaaaaccccaacuacaaaaccaaacccugaaaacaacacaacaagaaaacaugaauuagaucccaguaguaagccacaucacagcaggugugaauuacucgcuuuguuaaaaguuuaaacaacaaugcuuaacaguaguaagaaaaugcagucuagccgagagguuuggagccagcgugcugagccaggaucccggugaugccaucgcugaugccaucugugggccaggugaccucggcuaacuuacugacugccuuucuaagcuucagcucuucauccguaaggcaaggcaaacacuagguaucaagagcuccuagagcaccgucaggaugcugaguacauggaagacugcaaagcaaaaaucaaggcaauacugagacuggacaagaggaagcccagacuccccagugaccauucaugcuggggaaacauaggacaucgauucucucagugucagugccugaaguguuguuuggaaccugguugguuaggagcuacaucguguacugagagugcagacccccuucaggagaaaagcaugcucuaguaaaauguuaaagcaucccguguagccacaggaaccguuguuagcagcugugugaacacuuccaaaauccagguucucaagacagcagcaacccagcucugagauugcgaggaagccuucagcaggcuggccucaggccuuagccucacauuccccuggcagcucuauuuguagacuagcugggaggguuaaaugagggcaucugugcagagcgcuuagcacaguggcuaagcaucagacugcuugaugccugucauuaucgcauuggaagucugaccuaaggaaguaacgaauggguucacagaagagacauugagagcuggggugaucuuuaggugaugucucaucuacccucguauuuuauacauuggaagcugaguccuucaaagaugaggcgauuuccucaacgaugcucucuguguggcguuuaaguuuucagagaggggagauguuccuguauuaaagagggagauuucccaagcgaacaccccucuuguuguauaaacuguuuguaauucauguuagacaaugaugucaaagacagcuuuggcagcaaugucagccucuauaauuuaucuagagauaggauuugauaugguaugauucuuguuaauaucgguugguuucagcuuguggcuucaggcugugagaucugauuaugcacucauuacgguccaugcccaggcuggagacaaacugguguugagaaauggcccagcucugacuugcacugauuggaaggauaagcagacaacauacuuugccuuccugccuuccuucuucugucaaguuuauguggccuagucuggccuugaacucacgguucaguuguaggugacuuugaacuccugauguuccuugccuccaccuuccaagugcugagcuuacaggaauguauugucacgcccagcccaagaucaguuuuuguauuuguacuaauauuuaacugcaaguccaaaaauggauuuguaauagaaucugucccggcauuuggcuauuacuaaguacauaauuaccuguuaucuuuuuaaaaauaaaaauauuacaaaaauaauaaagcaugagguuuguuuguuuguuuguuuguuuuuggcaagcucucacuauuuagucuugacugguuuggaauuuauuauguagaucaggcugaccuugaacccccagaguuccuccugccucugccuccggaggcugggaucacaaguguauacccggcuucaugggcuuuccuggcuaacagaucucugagcuguagggauuaacuguacauuagccuguuuaaagugaacaucugaaggaguuuuaguauauguccguccccaccaucauuucuagaacauacccucacccugacuugaaacagguuuuuuaucuguuuguuuugagacaggauuucucuggguagcccuguggaacucacuccguagaccaggcuggccucaaacucagagagcuccuccugccuuugccugccuccuagguguuaggauugcuccuuccucuuuauaguugaguaacgauccacuguaugaguguccagugcucauuucucuuuauaagugagucauaguccauuauugcuauacagcuucuuauuuauccauucaucaguuguuggacauuguuuccacuuuuaggguuuuaugagugauguugcugugaacacugauguauauguuguuguguagcauaagcauuuaagaccauuuuuaaguugccuuuaauaccaaauagucacuaaauuaauauguuaacaaauagcaugugguaggcauuauacuagcaaauugauuuuuacccucaagaaaauugcaaucuaauggagaaaauguacuauaauuaaauaccauuauaauaucucaagugccaagaaacagaaugcuagguccugcagauacacagauguagcuaauucauccuggggugugagaggacgguccagcaaaaccuuagaagugucuguacugaaucccaaagggcgggguggggggggggaaagaagaaggagaucuguguaauugcugugcaaacuucaugaacugauuuugggucccugugacccgcauaaaaugcugggcaugguuguaaaccccagugauccaaauacugaguagguagagaugggaccaucuuuggagcuugcuggcuagccagccuacccauauugguaaguuccaggguuccaugagaaagucuguaaaucagucagucagucaagcaaacaagcaagcaauggaggaaggcacuccauguuggccucuguccuugacacacagggacaugcauguguaguguacuuaccacacaccacacacacacacaaagauacagacacacaaaaagacaaagaauuagccagauaaaggauagaagagucuuccaggcagaaccagccauugguauaaagguccugaggugagagugggaggaagguggggggcgggguaagggagagaggaggaaggagaaagagacagacgugaguuuggagggcuggcaggaauucaucuuaaagaauugauaauggcuggcauaugggggcagcguugggaggggagagcucugagaugggcugcgggaauggacaggaagcuccaagguagucuguaaggcuacacuccacugaggaugcacucaguccugcugacucugcagagccauggccagauuuagcacagcagucucugagaugacagggagcacagcugguggcaggcuccuggccuucccgggaagaagugauaacaaggcagaggaugggagugguugaguaggggagacaggaaggucugugcagacuuagcugcagucuaguaaagcuguauuccuggaagcagggccuuuuaggucagaacgaucauugauucugauccugucuuaauuucuuugcuaggucacuuugguuuuguuuguuuguuucuguguuuuuaacugaauauagcccauguuggcuuugaauauguggucguccuguugcagccagcuaaguguuaggauuacauguaugcaucacagugugugugugugcaugcgugugcgaaggucagagaacagauuagaaauugguuuaaggcagugccucuuguuucgccaccauaggaaugcuggaaguacagaagugugcuaccauaucuggcuuuucaccuggguucuugguaccgacuaagacugucaggauuguauggcgagugcuuuugcuuuuccuugcugagucaucucucuggccuuguuuaaagauaccuuucuuucuuuuuuucuuuuucuucuucuuuuauuuuucugagacaggguuucucugugcagcccuggcuguccuggaacucacucuguagaccaggcuggccucgaacucagaaauucgccugccucugccucccgagugcugggauuaaaggcgugcgccaccacugccugauuuaaggaugccuuucuucuaugguucuuacuuagucguguguguguguguguguguguguguguguguguguguguguguguguguagguguguguaggugaguagcgcugcagugcacaguaggaggccagggagcuuuguggauggaggcgguucucccuuccacugaggauuagguggucaggcuggcauggcaaacacagcuaccugcucagccacucagccaccucacucguccccaguacaaguuuuaauaggggguacaaucgcuggucuauccauaauucaaguuugaaucgcuggucuaucuguaaucuaccagccccuuccuucaggcagauaggaaguucuacccacgucacugcaaguguucccuccucccuugccuuggcgucugauaaaaccccacaccccguucuuuauaacggcucagcaccuuuuguucauugucauuuuuuucacuuagcacauccguucauuuaucucauguauggagcccugucagcaguaaggcccuggaccgucgccccuguccccucagcucguccuuuucucuggucagauggcuucuuguuuuggugagagaaccuccuuuccacuucuucauggggucaaccuagcauaaucucccuauguuucccuacaaauauacugguagcuuuuuuuuuuuaauuagugguuucuuuuaaaaaguaacuuucugggcuggacagaugguucaguggauauaggugauugccaccaagcuuggugacaugaguuuaagcccuggaacccaugugguaggagaaacccaaccucugcagguuacccucugacccacacacacacacacacacacacacacacacacacguaucauccacccccccaaacaauaaauaaauguaaaaggagaucccuuaauauggugauuuauaauauauuugcagucuugaugcauuuuuguguuuuuaaaaaugcuacuagaagcauuccauuguguagauaugcaugcuagaguuguaaguaaacagcucuguccagaaagcauuugcuaccuucugggguagauaccagaggcagagcuccugagacaaaaggcacggcacuuuuggacuguugccagauugucuuuucuuagugcucuguuacuguaugccucacacuacaaauuuagcaacuuacaacaauaaccaucucuuagcucagauuucugugggucagacguccaggcacugcauggcugguuucuuuguucagugccucauugucaaaaucaaggcaucucugagccauguuuccacuuggaggcuucaccucagaggaauccauuuccaagcuuguucaaguggauuucaauauccagucucuaggggcuaggacagaaauuccugucuucuuuuuuuuuuugguuuuucgagacaggguuucucuguguagcccuggcuguccuggaacucacauuguagaccaagcuggccucgaacucagaaauccgccugccucugccucccaagugcugggauuaaaggcgugcgccaccacgccaggcaauuccugccuucuuacugacugucgaugaggccuugcuuccagcucccagaggucaccaucagguccuucccugggaccccuuugucugucuuucauagguggcaugggaaucccaucuccucuuuagguuaacuggccggugugauuaacucucucaguugcugccuuccaaauagaaggucuauacucacuaaacaacacucccccaaccuugucagccucugcuuugucucugugagcucuccugcugcaugugugucaaccuuuuguguuggcuguuguugcuguaauaaaauacuguaacuaaagagaggguuuauuugggcuugugguucuagagggagaguucguaaugucaggggaagcugagagaucacaugccagccacacacaggaagcacagggagagcuagaagugggguaaagcgguaaugccugcuucccaugacuccuccagcaccuccugaaggauccauagccuucccaaacaaccccucccacggggaacaaggguuugaauacacacgcugaugggacaguuuugagccuccacacaagccuuaaguggaaccaucuuguacuagugucucguuggguguguuucucuuggugcaauccuaagaaucauuccuaucagaaucuaucagaauuccuguuuuuaaaagcugaauaauaaucuacugugauggugacuacuuuucuuuaaucuuccauucuuccccugcuggauacuugggcuccuuaaucaugucaguaaaccacuggccacucuagcuagaggaguguuuuauuaauuagccguguguagcaggcacaagggguaugcaucaagaacccagaaucuuggggcuauggucagauccuccaugagaugcccucuagaaagaugcugcucccuguuggggaagccaccuuguucucuuuacagcauuaaucuauacaucacacagaaggguucuagagauggcauggcgccaagcuugcccaugcagccaggguucccucugcucaggauucuagggcauuaugaaggauguucuaaccacuuuucacccucugggcgaacagucuggcuucaugucuccaggacuaggcaugacauggguuuugagugguagauacgugugagaaaaccauuagugaggccagugggggugggguuggugcugccauucauagguuaugauuguggcagcauccacaaagugaguucuucuagcaugcgcucuuggaaagaacugagagcauuuagugaccaaacagaugauacaggaaugacaggguaaggcuguaacugccaggauucaggcagccacaugccguaccuucacuagccuugguacagacuuggagaugaggcucugagucaugacauugaugcucacuaggaucuacgagauggaauuucagacugaaugucgaugggacacauuuguaacaauauuaccuuggaggauagugaggugcagggguccguuugacaguaugcucaaaguacauugggaacuggcauaacaauagcuucauguaacccuuuauaauaaacaauggcuaaaauauuaagaauaaaaccuuggauccaauagggaugguauuugagaaauaugccauauggcuucaagaaggucccaugugcuguggaaagaaauggguguucuguggguauguagguagcaauguuccagguuagcuuccggaguagaaggucuuguuaguagcuguuucuugcucugugcuaguuagauucccugagggcucuauaacaucuuucuccacaacuuagaauaugcugucuugguuguguauaguccugguguaugugugugaguguguguauaugugugucuguguguguauguaugugugugugugugaaacagaagcgaucauuugccaaagugaauguaagaucugggugggagccgggugugguggugcaggccuuuaauuccaguacuugggaggcagaggcaggaggauuucugaguucgaggccagccuggucuacagagugaguuccaggacagccagggcuauacagagaaacccugucucaaaaacaaacaaacaaacaaaaaagaucugggugggaacuaaaagaacaaugguucgcaacccuuuggcaaacuucuaucuccaaaaacauauuacaauucauuaacaguagcaaaauuauagauaugaaguacuaaugcaauaauuuuacgguuggggucaccacagcauggggaacuguauuaaagggucacagcguuaagaaggcugagagccacuggaaagugcagaacacuaacaccugagaacggauuauugucaaccaaggacuuccugagaaacaggaagaagagucaaagguaggucugucuuuuccccugguuauuuugucaguagaacuaaaacuguguuccuucucacaggcaacugccaugucuguggacugucuugggcagcaugcagugcuuucuggguaagugagcuuuuggaguuggucucccacaaguucuggggaacaaaguauaaauaaguuccugggaacucgaaaacuaucuuuaugugugaggacaauccgagcgagcggggcuuuaguauucacauccuaaggaccacaagggcgcuugcagggguucuuugagguuuuguuuggucuuguuuugucucucauagugaacucacauuuuaguguuuguaguuuggccuugaguugacaguguucuugucacaauacugucucacugaggaaucagucuaguaugguuagagaggugguuaggaggguugaggcaaccugggcucucuggacacucacucaguuuaccuaacugggcuuuggcuuuuuuuuuuuccagaaagaauuuaaaaaaugauuuagagugugugugugugugugugugugugugugugugugugugugugaaaccucaggugucauuccucagucaccgucuacuuuguucacuuuugagguagguuuucuuguuggucuggaacucacagguaacacaagccuggcugaguagccagcuccagagagccaucugucuccuccuccccaggaaugaaauaauuacugcagggauguuaacucacugaccaagcgaguuuucuuucuuaaaaaauauguagcauucuucuucuucuucuucuucuucuuuuuuuuuuuuuuuugagacaggguuucucuguguagcccuggcuguccuggcacucacucuguagaccaggcuggcuauugauugacacuguaaacuugcuauugacauauuuacuauguuacuuuaauuguuaugccauuuucuugggucaucaguucuugcagauagaucugguuuucauuuccaaguuguagacuugcagaggaauuugagauuuuucugcaggauuucgguccaguaacaagaaugcuuaacacauuuauugaauguaaagcucugugccugguaauaccgggcuuauaaagauauuuuagacaucguguaguuuccagaccuacaggugaauugagacaagagccuuagcauuugguagacuucuuguagagaaaacacaguugaaacgcagcuccugcagugggauugauauggaucccagccaggggcacugagaaaggcugggggaguugcugagcucagagggaccagacacacucugauguauggaugugggagugaaggccaacccuggaaguagcugucacagagacacuguccccuuugcauaaccaucagcuuggguggcacuugcuaccugugugccuuuuacaguagaugauugucaugugcuaguaacugagaguuuggggcaagcuguaugcaauucugaaugugcuuuucuagcgccgugugcaugcucuuacauugcugugaggcuauaacacugauguccuucuagccgacgauuccuguacaucgucaaucuagaugccccuuuugaaggucaccggaagaucucccgccagagcaaaugggacauuggagcugugcaguggaacccucaugacagcuucgcacacuauuuugcagcuucggugaguucauuuaaggagugccauugagagcuggcaagucuuuguccuguacaaagaagagaauguagucgucacugcucaauaaaaggggaaaaagagguuuauggagcuggagagaugacuuagugguuaagaucacuggaaugaugaccuuccagaggaccugggcucgauucccagcaccuacgugguggcuccugaccauaacuugaguucuaggagcuccgacucccucaucuagccuccauggguaccaagcauuagcuuacugcacagauaacacaaaggcuaaccccccccccauaaaaauaaaaaaggagguuugcccugcagguuuguauguauaaguaauuugcugcuggccccuggucugugucagacuuuguauuucuagggagugaauccaaauauuuaaugagaagcaaguggaugccuucauuucuguguguagugaguuaccuuccuuagcgacaguguaacuagccagggauugcauggcagaugacuuaaauauacuccaaggaggaggaaugggagcuggucugagcuggccuucuuugccuucagaggggucaaacaccucauccaucggcagcuagaagagaugcuucagcaguuaagagcaaguacugcccuuucagaggacuugaguucagugcuuaacacccaccuugggggcucacaggggaccucuggccucuucuggcuggcguggguuccuguacucacaugcacaucccccuuccccacagacagaugauuaaaaagagagaaauuaaagcaaaaaugucucauucuuuccaaggaugggauuccuuccuaauuggaguucauuggcuugguuaaccucugcagguuuugagugccuauuuguaaauuccccaggauuauaccuagcuuuguuuuguuuucugagaaacuuaccacucuccaaaaagauuuugggucaugucaucucuggcaccuuucucucgauccuuugccuccauucuuuucucuagaacaguggcuuucaacugccugaugcugcgccccuuuaacauaguuccucauuguuguggugacccccaaccauaaaauuauuuuugcugcuauuucauagcuauaguuuugcuacucuuaugaaccacaacguaaauaucuaauaugcagaagucaaccccugugaaaggguuauuugacccucaaaggggucauaacccacagguugauaaccacucccccagagcaacuguagauuucugugccugaccccuuaugauuacuauugugugugugugucauguggauauguguuccugcucaugugugcacgugcguauguguguaucugugugcacguguuugcaugugugcauacauguauguagaggccagaagucauugugggaugucuuucuugaccauucuccaccauauuuuuuugagacaggaucucuuacugaaccuggaguucacuaauuugcuggguggcucagcuggguggccaguaacccccagaguuucuccucucuccacguccccagugcagaaauucuguucccagcuuuucauauggaugcugggcaucagacucaggcucucaugcucucugacuaagcuguguuccaguacuuaauggacugguuuuuuaaaagcugaacccagagaaucugccauaaagucagcuucuguaccucaccuccuuuaccuuaggcaguuaggagagcuaacaccccagguaugugccgagccacucacugucuucucguccuugcuuccucucagaguaaucaacgggucgaccuuuauaaguggaaagauggcagcggggaaguugguacaacuuuacaggggcacacucgaguuaucagguaggcauugccccugggcagcuccuuggccugucucacuucgucacaguccuuugaugaaugaaaggaagacgccagccucuucacaugcuugaccugcuguaucgccuuugcccugaguagccagcagggcucagacuuccaggcaaagugccuacagauaacggagagcacagccacuuaaaauuuaggaagcauaacuuggcuacagccuagaccaaaguacaggucagggcugaguuuuacugcaggaaggaguuguugcuaugaaacagucucccuauuugguguccguaguggccagcaugccaagacaccccggcagcagccauggguggagccucggggggcuccuguuucagagcugccuccacgaggggcuugcuuuccagagcucccugauccucuuuucuacaagguugcuauuuccuuuuccuggagaguacuagcagggaguguggggcugggggagaugaccuggaaaugauaggaaaaguuagucaucugaccuggaagugauaggaaaggugagauacacaauguguguacacagugucugaggauugcugccuuuccuaggacugaggguaacaggcaggaaggaacaguuuugucacugcuuaagacgguuuacccaaggcucccgugguugauaacucagagaucacacuaugcuuccuccuuguuuugucuguuuauucagagagaggggagaaggagagaguagggcgaggaagagugggaguuguuaggggaggggggagcuuauguuuugucugcuguuguuuuuaagucuuaagggcaauuuaauagaguugcaaagaaaagcuccaggguuagguuagccacagucucauagccgcccggaggaggaagguggagaagaggaaaaggccaggcaguuugggucaaaccugcguacaugggucagccauguuuguggggaggggaacuuuagagaaagcaugcuuacaaagagauagaaaaaaaaaagaaaaggaagcugugcuuuuuuggaucaggacucagaaaaagggcaggauggccaggagcuugcugcagcauccuccugcuguggcccgcggcgucugcagcauccaccucagugcauguugugaggugaaugccccaugucuuuucaagaguagacaggauuauggccagcaguucuagggagacggaccugaguuuccuucccagcucgguuaacucuuguucuuucgcacagagcuuuagugccuugcccugagccguguuaggaggcauacugugaagacaugaaaccauuagaaacggaauuuguuaaugcuuuugaauaugacauugauguucugucuuucuguuguucuguuugucucugucagcgacuuggacugggcaguguuugagccagaucuccuggucaccagcucuguggacaccuacaucuacaucugggauaucaaguaagaacaaugagaggccauggccuuuugguggaccgcugagaacuuuguuagagcuuaagugucuuaguuugguucccauggaugcagauccuagaccaggcugugagagcagguauaguaagagguaagagaagagcugccagggauaaagaagacaggcaguuauggauggccacgaggaaacuccuuccucagcugugaccugaggagggccugggggguaggggacugcagucagagcugauggcugcccccagaagugugaaugccucgacucuuuaggcuugccaggguucuggaaagcagucuucagagaccagacaaaucccuuuggcaaagcagcacagaugcuggcauuugcgaguugagcuggucugcagagggggcaagugaugaguugcuaagacaucugcuuagcucuuauggcucugugaggcgucuguucuccgucugucuggggugaggcgggguagggaagcuaauggccucaucauaugguugcaccucaugagguaaagucaaaggagcccccggccugaggccugccguguccaggagcagcucuuuugcugauggucagagcuggucauucccagugggccaucaguguauuggaggucccguggcugccaggucacugucucccacguggcagggacuuucauuguuuuaccccaccagcagggaguguagacaggugacaagccagagauggagggggacagacuguucaaaccagcaacaguggucugaggcaauaaggugugugucucuaaccugaccaaauauggcccccuuaccugcagaccagcucuuaagucugugggucucaggacaacaccugaggagaaucauggcauucugaaguaguagaggggagccuucagcaauuggagaguccucagggagccaagcaagggcuaggacuggggaguaccgcucauguacaugcaguaagugcuuucaucauucagauaccgaauuagcccagcgugguggcacaugccuuuaaugcuagcacuugggacacagaggcagguagaucucugaguuugucgcuaaccugguuuacagaguaaaaaccccaggauacccagggccacacagagaaacccugucuugaaaacaaaaacaaaaaacaaacaaaaaaaaagaaagaauagaagaagaaaauuuaaggaaaaaaagagaaaagacccugaagacccugaauuggcauuauuuaaguuacaccugaagguaugagguuguuaaaaaaaacaaaauuggcaacaagaaaagauuuuuuuuccuuaagauuuauuuuauuuauuuaaguacacuguaacuguccacagacacaccagaagagggcauuccauuauggauggccgugagccaccaugugguugcugggauuugaacucaggaccucuggaagagcagagggugcucuuaacugcugagccaucucuccagccccaagaaaagauuuuuggauauucagugaccuaaaaauuaauucaaaaucaaccacagaaugaaucugagguguuuugauuuuacaccuguuuuauaaacccgugagccccaggguuacauaaaaauuucuuaguugaaaauggaauguuaauuugggaaguuuaagaaacaauaaauagugagcuuccuuaauaccagggagccaccugcuucucucauagucucuguggaagccacccccacugacucuguagucaacuguuguacuuuuguguauccagaguaauuauucuucacuaaaauugcaaugucauauguuuguaacuacauuaucuugucugcaaagcuuugucuuacaaaucguagacuuuacaccuuaaacaacuccccuuucccugcagcacuuggaaggaagcacucagcucuugccagcugcagucccaguuucuguuuaaugggucugaccgccuccgcuaccuccuauaagaagguaguucuuacaaggaggguucugauucuccuuuugaggcaaggucucacucuucauuauggcugguuugaaacuugcuauguugaccaagguagccuggaaaugacagagaucuaccugccucugccuccugaguauugauugggcuuaaagguggguacccauggccagcacaggcuucugacucuugugguuuccucuccugucacacaucacacaugggcuaccuggguugugaugaaguuuguaaucuguuucuauggauccacucaaaugauuuggaacccaggcuuucuuaucugaagcguuggacaaacagaucucucuuuacacauuguuuuaagguucuuaaagcacuguaaagucuaaaugucccuagaauagaguaccagagugugagcagacgguggagcgcgcugucugggucuugguacaugaugaugagcauuugaauucugcuuucucuguuucagagacacaaggaaaccuacuguugcacugucggcuguaggugagugugugcauccuggcuuguccuccccaguuccuuccuguuccuacuguugcacugucggcuguaggugagugugugcauccuggcuuguccuccccaguuccuuccuguuccuacuguugcacugucggcuguaggugagugugugcauccuggcuuguccuccccaguuccuuccuguuccuacuguugcacugucggcuguaggugagugugugcgcccuggcuuguccuccccaguuccuuccuguucauccuucgcacaacucugacugcccacagcccaugcuccaugguggcuaagucccauggugccagaugcugaccugacucugcuccaagcuucucaccauuagcuucaauaguuguuaccauauguuccauuuuguuucacccucauucccuuugugauuauuuugaagcuaaauauggguauuauaguacuuauccaauguuuuauuaugcauuacacauacauacacauacacacguauggaaucucugaaggcuggagagauggcucaguugucagagugcuugccuuccaagcauggacaccccaguuugauccccagcacucauguaaaauaagccaggugugaugguguguacuuacuguuccagaucuagagagggagagacaggagggucccuggggcucacaggccagccacccagccuaauuagugagcuuagaccaguucaugucaucccaaguucaugugcucagagccaguggccaaagcuaccugugcugaugggagaugacagucaagagggauguguagagcggggcauggugauacacagaagcaggcggagcucuguggguucaaggccagccaggucugcauagugagaucuugucucaaacaagaaaaacaaaaggaguaggguacagagcguguggucaaaacugccuaaccuggagcugauucuagggguugaguuaguguuucuugaagacgaucauguagaaacaacaaugacagaguagggcgagggggggggucagagugagucagauucuuuuuuuuuuuuuuuagauuuauuuuuuuauuaucuguaaguauacuguagcuaucuucagacaccccagaaaagggagucagaucucauuacggaugguugugagccaucaugugguugcugggauuugaacuugggaagagcagucagguucucuuacccacugagccaucucaccagccccgugagucagauucuuaugacaacaguguuaccaaccuaacuauccccucuugcuccuauaagaggcuccucaccccgauagugugucucccuuggagaugauuuccucggaggggacuguguucuugcuccuacgugugaacucgcuuguuuauagcuucuucuucuuuuuaaaauaauuuuuauuagguauuuuccuuauuuacauuuccaaugcuaucccaaaagucccccauacccuccccccccccaccccccuacccacccacucccacuuuuuggcccuggcguuccccuguacuggggcauauuuacagcuucuguaccagcagagccagugcccucauagaagcuggacgggcuuccuggaccagggcucguuacccagcaucccuggacaugcuccucugccucggaagcaucaaaagcagucacucuccccauguuguuuuccuuugcagcuggugccucccaggucaaauggaauaagaagaacgccaacuaccuugccaccagucacgauggugacguacggauaugggacaagcgagugagugaccugucuguugugacuuuucccuguaguugguguuugguucuucccagaggguguggagaggauguuguugagucccaggacucaccucaacacauugaagagugggcauggcaagaugucacuguaaccagaugacguuugcuucucaucugaguugcuguugaaggcggguggaaaauaagcucuugugaucagugguugguaaacgugccuugaccuaaggcugagcccaacuuugcugcucccuguuaggacaucaggguagccacugcagcggcuuuccugucuuuguccguuuuccuguuuuguuucuuagagacacggucucacuguguaucccugccuggcuuggagcuuacuuuguagaccaggacuguguagaccaggcuggccuugaacucacagccaccugccucugcccauagaguccugagauuaaagauuuguguugccguggccagcaugcuaccccuuccugucccccucucucuugagaauagucugcuacagaggugccucaggaguuaaaagcacugucuacuccuuauucccucauucccagaguccacauggcaucucacaaccaugaacuccaguucuaaggggucugauacucuccuguggccuucuugggcacuaggcuuucacguaauacacuuacaugcaggcaaggcacccuugcacagaaaauaaaaauaaauaaacuuuucaaaggagagggagaaccuugaagucucuccuuccgcuucugcauccugaguacugggauuacaggugugcugccagcacacccggccucaaaaucuuugucuucaaaaucaagacaauaguagugaguguaucagugaggucuagccuuuaggacccagugcuugcagggaaugaccuacucgccuccugucucugccccuguuugcaaagugaacgcuuugguuuggggccucugccauuuucaguccuucuagcauaggucucugaggcaggggacugauuaugcuuaccucuuccuuuguguauuuugucagccucagagagccucauguaccauguacuagugaguaugcagagcuugccgcacgcuuccuguguauaauggacggucaguugggagucugcucucuuggcauuaguagagaguggugggugaggcuuucccugcaccgacuaccugcuacuccaugggguaaugacaggcagaagagucagcuccauacagucuaggguacaaucacuguuccaugcuuugugaaauuuggggcuacagauacucagccuuuguagagagggugucuucaugacugucccaacccaggugccuauaguaaaguccuggcugugcagagaacacuacacauuuuugaaagagggaaacaaagcagagcucgggggcuugggaguggcucauccugucugcuggcgaaggcuuuaggaccugcuggggugcacugcgcagcgugcaggcugaagucugccucccagggcucucaggagaaggagauuccaaaaaacuggaauggccuagcagugucugguuuuguuuucucuaucuuugguccagucugccaguagccaucuuucugccugccugcgugccuucuuuccuuccuucuuugaaucugguuguuuuuauucaguuuaccacacauuuagguguacguaaauguucuuagaaagguggguuuggcucacaugucuguaauccuaguacuuacauguugaggggaggaauauugugaguucacaauuuauucaauuaaauugcacccuauuuauugguucuagaaguugcuuuugguauucuagaguuccaaauaacccuaacauacaugucuagaguuccacauaacccugacauacaugucuuuugugucugaagcuucaguugaauuaggauaacugcauuacaaaaggaaaauuguaguguuucuuuuuaaacauauucaggagugggagggagggagggagggagggagggagggagggagggagggagggagggaggaaggggugugugugaguaugugaguaugugugaugugaguaugugugugcauaggguguuuuggagaucuuaguacccagucacuaaaauacucuuacccucaugguugagguuggguuuguuacagucccucuucuugugucagaaggggaacagaaauguccucucugaaaggaaaagagacagccauuaccuguaucuucuauuaaaaucacacacuaagcuggagcggguagacauguggaagggucuggggaagucuucuguuguuggguuuauuugcuaugaacaaagagagcuuaugaaagguugaggcuuaacuguccugagauuguuaggguccccucagugcccaguacaccguucguuuugugguagccauucaauaguguucuuucaaagucaacaaacauggcgucauugugcugcagaaacccaguacagcuguggaauaucuagcagcccaccucuccaagauccacggccuggacuggcacccagacagugagcacaucuuugccaccuccagucaagauaacucugucaaggugagugguucccacuggggccguuggaggagcuuugugugacggacguuagggaugcauggucaugguagcauuuuggaaggaaacaugcaguuugcuguaugcuccaugugcguugugagugcaugugcuccuugggggccugagugugucagcccggcucugcugaccagcagaugcgaugguguagcggcagacuaaugagccucugaaucuguucagauuucuuucccucucugaaacucagaggcagaaagcauuuaggaaagaaaaguuuaccugaaaaggauuuguaaggaagccagaaguacacacagagguaaagaggcccacacaaggguuaaagccaccaagauuguccuuuaucuguucaugguggcaagccagcaguuccucaucaaauuaucauaucuguaaaaguuauguccucacacauuagcauugacaggauagagcuuugcuaguagucucuaacuuaagaccugcucaaaguuuauguucaggagcccugccaguuuugauuuaucuuagacaguguuucuucuuugcuuguuuucuguagcuguggcaucaggcuaugcacccuugaucaaagcggugauggggcagggucaucucugcuccaccauccuucuucggucaagucucuaucccugcaggucagcacuuggccacagaaguuggcuuagcaauuuugugacuucaucaucaucaucaucauauuuaauuggauuuacauagcaguacucuuucugguacaguuagcuaaaauugagcccaagccuuucuauguaaaggacugaacguucucucuggagguuuguaaauccccuggccuuguguuggcaagugacuuguuugucuguucauuuggguuucugucccuaaccucccaaacucaggaaacaggaacauacuccaaucugcauuuggaaaagagauuaguagcauccugcaauguuuguuguaaagauuguguaagauuaaaaagaaaaguuuuaaaugucugucugauggccgugaguugucgccuaguguuaaauugcuuuuagauguaauguaggaucaaacccguuauuuuaccuuuuagcuacagugguuauuugagaggcaguugcucugcccuguguguccuguugaggucuagaaauccucaugcgauguugacuaguguaaauggaagggcucucugcgugucugacaguaccgugguuauaggggaggaacugaaaacacacuauugaaguauuucuucggccaucacuggaaagagaggcucauuggacauacaaacuuuauaugccccaguacaggggaacgccagggccaaaaaaaaugggaauggguggguagggaagugggggggaggguaugggggacuuuugggauagcauuggcaaauguaaaugaggaaaauaccuaauuaaaagaaaaaaacccggcauuuaucauuucucaaacguucuuucuuguaguucugggauuaccgccagccucggaaauaccucaauauccucccuugccaggugccugucuggaaagccagauacacggugagugagcuguuaaaccucuugucuggagugugcguuuuucugcuuucuuugugaggcaguuucuccuucugucuugguuuacaguaguggccuuaggugcuuagccuccggggugcucaauaggugcuccacagagaagcaggcguguggagguucuuagucacggaaguagcucagcaggguaggauggagagaggggccagagucggacacugcugagcuauaggagaaagaacucugguguagacucagaggaccugguuuggggccagcuuaauguuuuuguagccuuggaaaacauacuucuuuuuuuuuuguuuguuuuuuguuuuuuguuuuuuuuuuuuucuuuuuucgagacaggguuucucuguauagccccagcuguccuggaacucauuuuguagaccaggcuggccucaaacucagaaaucagccugccucugccucccaagugcugggauuaaaggaaugugccaccaccacccaacauacuucaucuuaaguaguaguuuuuuuucaguugcaaaguugaaggacacuuuucacucugcccuuuauauuuuuuaaaaggauuuuguguuuauuuaucucuguguguguaccaugcaugucaguguccauaggcuagaagagaguguuggagccccuggagcugaguuaccugcaguuacaaaucugccaacaugggugcugggaguggaacuuggguugucuggaagggcaacaauuauucuuaacugcugagccaucaucccagcucaaagauuuuauuguuauuuuuuucauauguguguacauaccaugggagugcagguacucacagagguuagaagagggcgucauaucccuuggagcuggaggagguuguggguugccugcaguggaugcugggaauggaacuuggguucucuggaagagcagcaucuuaauugcugcugucuguucuggccuccaaccuuccuuuuacuauugugauaauauuugccauucuaaaguggacaguuucauggcauuuggaauaucaaucugccuuccauugguaauaauguauaugaauguccuuuguaaaucacagaaugguacaaauagccgguuauccgccuccagccauguuuccauggcacguugauggcugugagucagagauaaguguaucuccuguaaugucacuuugaaagcaauccccgggaugaacaaagcagcaguuaugcauuaggcugucacccagggacauugggaagcaaagaagauaauuggacauuauguuguuuugcaucugggaucacuugccaagaaaugagacgcaguucuuaggagcugacaucucugcauucauguuugcuuuaaaaaauaaacaggaagguuggggaguguuauggggaggggacggaaagauaaauagaugugcucuuguguaacuauguguuuuuccuucaauaacagucggguuguaaaccaaacggguccucauuuccccugcagucuggguuuuacuaagucaaacagcaguccugggguaacuaaguucugcuuugauuccgugcugcucggaggcagugagagggugauguuucauguggaugguguucugcuggcccgucugccugcagauuuucccagccagcuuugcauacucacggagaguagcuaggacauggaccagaaagaaccauuugcuuacgguagaauuuccagaguuauccaagcauuuggcuuagccucauauuucauuugcuguguuccauagaggcuguguguaauagacaucauaugauauuugacaaaauuuuccccagaugaguuugagcuuuccauaauuuuuuuuuaaagauagguucuaagcugggcaguggugccacacauuuaauccuggcacucagaaggcagaggcagguggaucucugaguucgaggccagccugcucuacagagugaguuugaggacagccagggcuacacagaaagacccugucucguaaacuuaaaacaaaacaaaaaaaggauagguucuuccuguguagccauggcuauccuggccuguaauuugagaugucgaccaggcuagccucaaagguguggcaauucucuugccucugcuuucucagugcuggcauuacaggcccgagccaccaugccuggugucuaucauguagcuugauuuaguuaggaacaguuccagcuuugguuugguuucggcugauuccacauggaguaagcccagcuuccccuuccuggcugcagccuuucagcaacgggcuagugaccgugaugguuccccagcugcggagggagaacagccugcuccuguggaacgcgucugacuugaacgcuccaguucacaccuuugugggucaugaugacguggugcuggaguuccaguggaggaggcagaaggaaggugagugaguagggagggcugugcucugauuuucuccugagcucugcuggacaucucugccagucauguugucauagugaacuagcagaccagggcuggcucuagggacuggaauggaaggcaggcagggagggagggcuguguugaauuagagaugaauaaacagagugugcaacauuuucccucucccuaguucuguucuccaacuuccauugugucucucuugcuuggaagagauccgcuccaggaagagguugaagaggugguuuuuauuuugguuuguuuuuuuaaucauuucaagggccaaagacuuuagaaucuuccagagccaagccauaacaauagcaauuuuuaaaaaaagauuuauuuauuaauuuauuuuauguauguauacgaguacacuguagcuaucuuuagacacaccagaagagggcaucagaucccauuacagauggcugugaggcaccaugugguugcugggaauugaacucaggaccucuggaagagcagucacugcucuuaacugcugagcugucucuccagcccacaauagcaauuuuuuuuucuuuuuuuuaaaauauuuuuauuagguauuuuccucauuuacauuuccaaugcuaucccaaaaagucccccauacccuccccccccacuccccuacccacccacucccacuuuuuagcccuggcauuccccuguaguggggcauauaaaguuugcaaguccaaugggccucucuuuccagugauggccgacuaggccaucuuuugauacauaugcagcuagacucaagagcucagggguacugguuaguucauauuguuguuccaccuauaggguugcagaucccuuuagcuccuuggguacuuucucuagcuccuccauugggggcccugugauccauccaauagcugacugugagcauccacuucuguguuugcuaggccccggcauagucucacaagagagagcucuaacuggguccuuucagcaaaaucuugcuagugugugcaauggugucagcacaauagcaauuuuuacuguggggguugcugaugccuuuaaucccagcacucaggagacagaagcagaccaugucugaguucgaggccagccuggucuacagagccaguuccagaacagccagggcuacacagagaaacccugucuugaaagcaaacaaacaacaauccuccccgaaaaaaccccaaaacucauaaaaccuuaacaaaccaauagcaguuuuccaccuacccucuuccucuccuccuugccuucuucucugacuacucagucugucugucugucugucugucugucugucugucugucuguugguucuggagauuaaaccuaggacuugcugcuaagguauaccccuggcuuucacuaccaauuugugaaucccuaaagcugguuugaauuuguauguuuuugagcuuuccacaaauuuaauuauucugacuguaugcuuaaauucgaccuucuucccgaccuacuguugcuuugguauauuuuuacuaucaugucuucucagugcguuuuuguuggagcgagcaccucaugccuuuggcuuuggucggcacugugggaauggaucaggacguggcagcuaagggaauaggaaagaaccaguagucagaggguuggguguugcugaaggaucacagugaagagagagaaaaacauguaauugaacaaaaaggaagauguuuggucauuaggagagaaauugcaaagcaggcugaggcuagaagccagauaccuaggugguauaagggaggcagcaggaacugcuggcuacgcccaggacaaggaguagaauggagaguuggugaaggcaggaagaggcugugugaaggaagucaguggugagaaggacccuugggaguucgaauggcauggaaagugcagggauuggagcugaauuuacaggacacucaggucgacccuguccucaaagcccgugcaugugaggacagauguuggaucgaagcauugaugcccaugaacaugagacaagauagugggguucagcagugauucagagaggcagaacuaaaauacuggagaaaaugcagagaagggacugauguggagacucacccuaguccagagcccacuuacccuguuacugaguacagagcauguugucuguugccucaguuuccccauguaugaagugagggaauugagugaaauuuauucugaauucuuuuuugugugaaguuggccaggagggagauugcagaugcucuggaguuacccuaguauccucaggcuuuauaagcuguuucguggagcacccuaaacuuuugaaucaucccuuuagacccaguaucuaaaaaacacgauucagcugaucaagagaauugaaaggcugaguauuuacuucauaaagagauguaucuuuuuaccaaaauagaaaaaacaaaaacauuuugaacaaugagaucccacgaugcauagaacacaauuauuuuuacacgccuacgagcuccuugggagcacauuugcagaggugaaaguuuaggugacacuaggucuuagugucacacucugucuguuaauuugucaauuauucuuucacuucauuuauguuucugcuuuuuugagacuuccccagggaguccuagcugaagagccucugcuguuaucucuccugcugcuuaucaccaggauuuuauuauauguuuaucugcuggucucuucccaccauuggaaugggagcucuauaaagcuagauaaucucauucaugccacuguuuggggccuaggcagguaccugucagacuaagguguguaguaacuauuuguugguuguauguacuaugaaugaaugaaugaaugaaugaaugaaugaauggaugaaugaaucauacuccacugcugucuauaacaaaauggaugucaaaucugaaugauuuuuuuuaaaaacacauuuuauugauuuguuaugaguuucacaucaugggccccagucucucucaucucccugucuccucaccuucugcccuugcaacuuggugucuaaaauaaaacgcacacacaaacacaaaaaccaaacaaggcauagaaaacaucucagucugggagcuauagugugucacagugugucccaaaguauaccccucuguccacacaucaucauuuacaaauguuaguuacagucagucauuggucugguucaagaucuuugacuucugugagaccaacaauauugauucaguggauuuuuuuguuguuguuuuuuuguguuuuuuuuuuuuugguuguucguuuuuugugauuucuaggauccaaggacuaucaacugguuacauggucccgugaucagaccuugagaauguggcgaguggacuaucaaaugcagaggguauguauucagugguauuauagagaaauauuaaguggaugcacuagaaauuuaaccaaaagauacaaaaaaaaaucagagaauguuugcugacauugugccuguggugggcugguggccuguguggccacgggcuuggggucuucagaaccaaaguagucuucacuguaaggcuacgcauguaaggcuacagacucucugcguguccccuuuguccuaguauuggacaggauggauaccacagugagcacauggcuuagccuuucauuugucucuuccccaugauugggaagccugcccugugcucgucaguaccaccuucucugugaagcucccuccagugcuuucacauaugagcauuuguuucugacaucaauggaagugguacuggugugccgcucugaaccgucaugggacaguccucuucucauccaguggcuggaucaccugacggugagaagcauggcucacuggcaguucauacccaacagcauugagagcaucuuucacaccagcucccccagggcugaugggaaaugcugggcgaagauuacagcacugcuuaguuuaaacucaccugagcauuuuagucaaaucugcuaccuuaucacuuuuuaaauguuuuucuccagaauauuccauuugguccaaaugcuugggcuuaugguauuuguacuugugaguuaacugaauaacuccacuaagacuuggaauuuaaguagauuuuuuuuccucagcauuuuuacucugaucaugguggaaaaagacaauaugauaauagagucaauuauccuuuuuauuuaaccaaggaauuuuggugauggguaaaaccuauuugaggguacaaguucuucuucuucuucuuuuuuuuuaaaagauuuauuuauuauauauguauauauuuuuguuuuuuugguuuuuuuuuuuuuugguuuuucgagacaggguuucucuguauagcucuggcuguccuggaacucacuuuguagaccaggcuggccucgaacucagaaaucugccugccucugccuccgagugcugggauuauauuuauuauauguaaauacacugucuucagacacuccagaagagggcaucagaucucauuacagaugguugugagccaccaugugguugcugggauuugaacucaggaccuucagaagaacaguccgugcucuuaaccacuaagccaucuccccagcucgaggaugccaguucuugacuacucucuguccuuuaugauucccauuuuaaagaaagaacucuugagucagacacagugaccauuucucuuacaucucuagcccuacaucuuuauccuuauguuuugguuuuuugguuuuugguguugcugucaaucaaacgcaggguuuugggcacacuaggaaaacacuucagcauugacgccuacucugcacaccacccuuugcccuugcuuucagcucugugccaaugacauacuggaugguguugaugaguucauugagagcaucucucuccugccggaaccagagaagaccccacauccucaagacauagaucaccagcccagcuuaagccauggagaggaagaugguaauguaacugauguccuaggggagggaccccacucugcguuccagaguuacauagcagagaccccagaacugacuaaaacauuucuaaaacauuuccaauauugccuguuucuccugguagccauaaaggaagacccucccagcaguuugcuggaagagaagagaucagaccaacuaggccucccccagacucugcaacaggaguucuccuugaucaacgugcagauccggaaugucaauguggagguaaggcagaguuauacacugagucucugucagagucucugucagagcugcccaacacaggcacugagaacucuggcccuguggaagaacaagaagcacacuuaacugcugagccaucucucuagcuccagucuucauuuuuaacucacacguuucuguagaaauagaaguuuuaaaaacauagacauuuuuugaagcucauguaccauagcaucuccguagcacccagaauucuauccccuuauuuuaugauauuggcucaaggaaggccugcugauugucaggaauacggggcaggcuaauggcagagcugaguuuggagcugcagcuccugucucuccaugcuauuauacugugcucuuccaucuccccuuugugagcuaguuuccucuucuguaaauucagagugagaagaugaccaaagccucuuguucacuuaguacuuggagcagaccuggaucagcagguuguucuucagugacagaaucuaaggagagugaggccagaagaugagacaauaaagaaaacguuaaccugggaucaggaggucuugcacaagcuaugucuuaggcuaagcaaacuuacuaagaaauacagcaucucacauauacaguuuccaggggagacaugggaugaagucaguagaaacuggcugucacacaaugggacaaaguccacaagaugcuaaucaagcugcuguguugcacgaagggagccuggucugcaauguacuugugauaccccaugcucagcacagcggccuugggacugauaacuccagucucuucaaggggaaaagccaaguacccaggaaccaaaaccuuaacuuguuugaugcccagaccgcagccccagacuaaaccuugccaagucugcuccugagcaaggacauaacauaaaacuugguucuuuuuguuguuucagcggggccucugaaagccuuggauuggccuggcucucaauguggaacagugugugugugugugucugugucugugucuguguguguguguagacuucaagaaucuuuguuucagagaccugaguaucacuccaagaagggcuuugggagcucagguauucacaauaggaauguguacuacagugcugugauuuguuuagucuuuaaagcuguuuuguaaugcagaguuaucacgcuucacagaugaagaaauugagacacaagguacaaaaugacuucaaaggccagcagcuguuuggugggaagacauaauauuugaauauuuaaauguaguugaauaguugagguuuuuagguuuagcucucuucacuaacuugacuucaguugcuuuuucuaguuggccacaauggaaaucaacagaccuaaaggcuacuuuaauggcuucucuguaucagcuuagccugcacugcuguugucccaguugagagcaguggugaucuggugagagcagugguggucuacugagaacagugguggucuacugagagcagugguggucuacugagagcagugguggucugcugagaacagugguggucugcugagaacaaugguggucagccuucagaaaggccuugauuggggaguugugcagcuuccaccauugccuaauuccagaacaaaagacaaaacagaauucaacaaagaaaccucugugucuuaguuaggauuucuauugcugugaagagauccugcaaccaugccaacucuuauaaaggacaauauuuaauuggggcugguuuguaguccagagguuuaguccauuacugucauggugggaagugugcaggcagacauggugcuggagaagaugcuaagaguucugcauccugauuugcaggcagcugggagagaacugauuugaacuucugacacacuuccuccaacaaggccacagauccuaagaguacaacucucuaugagccaagcauucaaauacaggaaucuauggggaccacaccuauucaaaccaccacacuguaaccagcaagugugguagcacacuucuguagucucaacacucagggacguucaugaguucaaggucagccuuagcucuauaucaaauuccagacuagccuggaguacauagugagaccugucucaaaaaaaauuuaaaaacuccuuuaugcaacuauagagauggaucagaaauuaggaguacuagccacucucucagaggacccaaguuagguucccagcacucacauggcagcucauaacuguaacucuaauucaggggaccugagucccuccccaagccuuuguggguacuacaagcauguggcacacaugcauacagauagaaagucuuuuaaaagaacaucuauaccuguuaucaguuacucuccauugccccugcuccuacccaucccacaccccauugccccuggccccacagucacuauuuuauuuucugcuauccauucucucaggaguuuuuaaguugacucggguuaugucuuucaacuucuugcuuuauuuauuuuuuuucaucacaaauuaaguauacaaguuuuagucagcauugcaacuuugagaugcuuuuuuuuuuuaaagauaaaaauauuuugcguuuggggcugaagcgauagcucucugguuaagagcaccugcuguucuuccagagggucuagguuccauuccagcacccacaugauggaucacaaccucuauaacucaguuucagggaauccaaugcccucuucugcccuccaaaggcaccagacauaugagcaguauacagacauaccuauacacauaaaauuaaaaaauaauauauauauauauauauauaugaauuuauuuaaaccaguacuaaaacuuaaaaaucuguucugaaaaugaauuauuuuucaaacuuauuuaccuuuauagguauuucccuucacucaguuacuaggagcugagcauuuguguugauugcuaaaaucugugucuugcugagggugugguucacagggacaugacaggucuugccuauucaaggccggcguugaggcucagcaccgcaaagacgaugcggcacaguaugauaaggugugcaggugccucugcagucccuuugcuguuugucuugcagauggacgcugcagaccggagcugcacagugucugugcacugcagcaaccaccgugugaagaugcuggugaccuucccggcgcaguacccuaacaacgcugcuccuuccuuccaguucauuaauccuaccacuaucacgucugccgugaaggccaagcugcugaaggugaggcugggcucccagcguuagucucuccucguggcuguaacaggccguggcgagcuugaggacaaacguggagcaguggcuguggaagcugcccauuccccgaaugcugcaguuccugcuucauagccacuguccuggcugcccacuuggugcagacagcggcaaggcagaguuucucugccuugaguuucuuuggccagaguaacccuggccauccuggaacaugcucuguagaccaggauaaaauaauuuuaagaugaauuaauuuuaauaguacuuuucuuuaaccuggcacauuuuaaaaauauuaccaugccaacauauaauuagugaaaaugagccaguuaguauaguccuguaauccaagcaucucgaaugggaggcaggaggaucaggauucaagguuaucuucagcuacauaguuugaggccagccugggcuacaugagacccugacacaaucccucaaaugagauauuuuacacuuuuuacuuuugauaucaagccuucuauacaguugugaauuuuauaugugcugcagcugugagucugaaggaggcgcaccaccgugcaggcagugacggcaguggucccguuaauguguccgucuuaaugcgggugucaguuuauaucucuguuacuguuuaguggauaaaaauauaacaauauguuuuaacuuuugcugaauagaagucucugcccuggccuauaucacuugaagcaguuuucucugcagcccagugacgguguuuuuaaaacaaugagauuuuucauguguggaaggaaacuguagaacucacuagaaagagagaguagucauuguagucuguguaaggcucuggaaaccucuucccuugagcaccuguggggaccacuagacgccccaggccuggccgugugcuggcuccugugccgucacgcucccgggcacuuugcagaguauagccaagcaggaagcauauggauggcugauucucucccugauggagguuugguuuuuuuccagauccuaaaggacacuucacugcagaaagugaaacgcaaccagagcuguuuggagccuugccugcgccagcuugucucgugccuugagucuuuuguggugggaaccaugaacuuguugagccaaccugugcuuuaguaucuugucccacuucuuaucccaagacccugacucccuuugugguacuguaccauuguuuuguaauccaacuuagagauacacuguggguucuagugugcuuaucuuugauuucagaaccaagaggacagugcuucuagcaacccauuugcacuccaaaacucugucacaccacccuugccgacauuugcacgggugaccacugccuacggcuccuaccaggaugccaacauucccuuuccuaggaccucuggggccagguucuguggagcagguugguuucuuuguuguucuuuggcucucaacucugagagaguguagcuaagaaaggcuuauauucuguauuaauuaucagaaaauguuugcuuuuuacuucccaagaacucagaacaacauauggugcaaugcuaaauugguaucugugaguauagccuaagaauguuuacagggaaccuggggagaugguucagcaggacagagcacucgcugcucuuucaggggacucaaguucaguucccugcacccauguccagcagcuuacagccaccugaccuuccaguucuaggagauccaacauccuuuuugggccucagcaggcaccuggauacacaaucgcauacacauagagagacacaugaacaugcauauaaguaaaacaaauaaauuuuuguaaaaaagaauguuugcuauaauccaagucuuuuuuuuuuuuuuuuuuuuuuuuuuuugguuuuucgagacaggguuucucuguguagcccuggcuguucuggaacucacucuguagaucaggcuggccucgaacucagaaauccgccugccucugccucccgagcacugggaucaaaggugugcgccaccacgcccggccugccauaauccaagucuuaacuauuuaguucugaucauccugaguuugugucugcuuaaagccuuaauucuuucaccucuccuagaucuagcagacccuuacuuuugucccuuuaaggguuaguguagucacaagccuuggcaguuuauggagaugugccucagguauacugaaauagagaaaaagccugcccaagcuggugguaagaaugcuuggcaugugugcaugccaauccccaguaccaccgaauuuauauauacauuuuaaguauaguuauuaauccuggcauggaggcucaugccuuaaucccaguacuuagaaugcugaggcuggaggcuugcuauaauuuccauuccagcuugcccuugcuagugagacccugucucagagaacaaaaggauuacccagucuugcugugggguucccguguccagcucacugacaguacucaugugucuccuuugucagguuaccugguguacuucacacgacccaugacgaugcaucgagcagugucucccacagagccuacuccuaggugagucugggagauauggcaggaaucugcaucucugagucucucuuugcaaaguucauuucaguucuucaguuaauuaaauuaacuuauuucuacuguauggugacaaaguaacuuucauucacuugcuguaauugucauauaagcucacccguucuaggucuuucuggucucuggcuggcuguuacaacucagcuguucuaacucaaacuccucuccaagcugacugauucaaacuggcuucucucagcuucucacugaacuuauucuuggucucaaaugaacucuagcaaucuguucuaaucuucugccuccuucucauucucugacccgucugucuucaccuguguccagcuuguucucucugcaaagugucucgggaaaacugcguccucucuccuguccuuucucuugaaaguuggguguauccuuucucucaaaucuuucucugauucgucacuuugucucucaaguagaaauaacuguuugggauuaaagguguguacuaagggucugucuauaauccacaucagagcagaugcuguuguuugagggggagggugucagguucuguauuagaccaggcagauggaaccuugauucaugaggacugagguuaaauacccaaaguccuaacacccagucuucaagggaaaccaugaguaguggucuggacuugggaccacaugcccucguggggaccuuuuccagugagucuuucauugacguguaauuggcaauguaaaaguccagaguuuacugcucagggacccacauucagaucaagauauagaacauuguccuaaccucuaaaagcuccuggucccuuugccaagucccugaagaaaccacuguccugaugucugccacccucuuuuaguuuugccuauuuuuaaacaaaauugaguuagacucaugcagcaugaacuguuuuauauuuggcuuacgcuguucaacuuaauguuauugaaccugauuugaguggcugcguggaucaauaguugcauuguaugaacauaacucagggugauucauucuucuguugauggauucuuggaucauuuccuguuuggggcuauuaagaguaaaaugaaauauacaagucucuuucuuucuuucucccucccucuuucucucucucucucucucucucucucucucucucucucucucuuucuuucuuucuuucuuucuuccugcauagauuuacuaauuucuugacccaaggaguggaauugcugauucauagggauaggcaugagguuaacuuugaggaagucugugcugaguggagagugcauuuugucuuccucucagcaaagccucaggauugaugacugcacagcuucucucuguguugccagcccuucagcuucugucccugugguggguagggaguauugccuuguggcucugauuugcauucccacaauaaugacuagcggugugagcagcuucuguguguggcucaucgaccauuugggugucgucuuuugugaugugccuguucaagugccugcacugucuuccuuauuugugguagcuaucuauuuugauugaacauccuuugcugaauauaugcauuggcucuguccuaagguaugguuggcuuuccucccuccuuaauaauguccagugaucaugaauuucaauuuugaugcugccuaauucaucauuuuuuaauuuuaugguuagugauuuuuguauuguaucaaaagaaaaaagccucagucuucaucgaggucauaaagaugccuggcgcaucuucuucugggagccuguaaacuccucgguuaagguccaugguucauuucaggcucuuugguguuccagcaugguguaaggguggacauguguuuuauuuaauagaaauaaacggugguuccagcaccgugugcagccugccuuccuuugcacaugaaaauuggccgucuguuucugcacccuaguuauucuuuugaucuauacaucucucaccaugucucaucacuccgaauguagccuucuaugcuaagucuugaaguuuggcgaugcaaguucucgaagguuauucccuuuaguuuuuuguuggcuauucuaggccuucacaccuccauaaaacugugucagcuuguuagugucugcagugucugcucauguuggaauugcaguuacacugacucugugcauucguugagagaaaucugauguuguaucgguguagaaucuugucaugccuuuuuauaguauuucuccauuuucuuguaucuucuuuuuauuuuuucuuaaagauuuauuuauuauuauacauaaguacauuguagcugucaucagacacaccagaagagggcaucagaucucauuacgggugguugugagccaccaugugggugcugggauuugaacucaggaccuuuggaagugcagucagugcucuuacccacugagccauauugccagcccaucuuguaucuucuuuuuuuuuuuuuuuuuuuuuuuaaagauuuauuuauuuauuauauguaaguacacuguagcugucuucagacacuccagaagaaggcgccagaucuuguuagggaugguugugagccaccaugugguugcugggaauugaacucaggaccuucagaagaacagucgggugcucuuaucuguugagccaucucaccagcccuuuuuuuuuuuuuuuuuuuuuuuuuuuuuuuaaauaauuuauuuauugauuauauguaaguacacuguagcugucuucagacaccagaagagggcaucagaucucauuacggaugguugugagccaccaugugguugcugggauuugaacucuggaccuucggaagagcagucgggugcucuuacccacugagccaucucaccagccccuuguaucuucuuuagugacucuuuuuuauuauauuuguuccuaaauuauucaacuauuuuuuuugagacagggcuucguuuaauuacucagacugccccaauuuuuuuaaaugcuuuuuacauuuguguguguguuggauucccuuuuucuucccauguccauauucucaguuucauuaaaugcuaagaauauacucaaguauagagaauacaguuaguauggguaauucucauuucaaccacaggucucucucagcccugucugcuuaucauacugguuugauugcaccaaugaagauccgcaccgaggccccugggaaccugcgucuguacagugggagcccaacucgcagugagaaagagcaggucuccaucaguuccuucuauuacaaggaacggguaaguguccgagccauugccuuuaguucuuaccccggcuggauucucguuuccugucccacucgugccacgcacaguaguuaaguuaguaaucccucccuggucuuucacuuuccuaauuaguuuauguaggaacagucauugcugugaugcucucaguuggucugcacuacuguaaacgauggguagagguggucagugcuuacacuagacugugacgugugucuuacacuguaguauaaaguaucuguccuggcaauccccauuaguugaauugguucccauauuucaaguagaauaauuugacuuugggucucccaugauauccugaugccugucaacagacagaaagcugaaagcuucugaaagcuggagaucuugauggaguuggagcuuuguaguuguggguguaaagcugauccccagaaggguuucuacuucuacuuaagucugcacuuuaaggucucauuugaguggaucggcuguacaaaugcuauguggacuugcccuuauuuauuuauuuuuuuaaacaugggggucucagucuguaacuuugcuuggcuuggaacucauagagauccaccugccccuggcuccugaaugcugggauuaaaggugugugccaccaugcccagcuuuucugggguucuuaaggaugcagugacccuaaaauacuuagcauugagcuggcaggagccugcagaucuggggaaugccuagaagucugucugcugucaagcugagaaccaggccucaacacugacaaucaguauuucugcugaccuaccgcacaaacguggccuuaagaauucuucagcuucccacaaaacagggauaaugacugucaguaauuagaauuugcuuuaacaacggaaucauuuaaaauccaagggauaguuuuuccaucaaguauugcaaguguccccacauguguugcaguggugugucccccagcuccuacugauggcugaccagcucugacugucucggggcuuauguggcugacaucaggggcagcagcugacauuugggacugaccaaucuugggcaaagccauccagccaaacagggauguggcucuaguuauugucaugccugccuucaguccuccacacucccucuccccagcucccggguggaauucugucccugugucuggcacagaccuccuucaggcacccaccaaacucuaucucccacaagucauucauauuaaaucaauuaguuccuuucccccuuuuccugcaaggcagcuguuaccugaguagauuugauaauugggggaguuagcuggccuaaaagccauguaaacuuacuguuagguaaaugaaggcuuuauuuaguaucagggcuaguuugaagagaucccagagucagaggcaauucuggaugccccuuugauucuugucccgugcugccacccaugcuugcaauuugauuggcuaaaacagacuauguagauauuuggcuuggugcucaugcaaagcccaucuguagucagugcccgagcuccugagccaggcaccagugaugcccacauucauaguuacaauggucuggccccuucccugcccacucuguguucaugaggaagcacgagagagcauguggcuaaccauccuagcagcuagaaaggacuaugaaauuucagugugggccagcuccuagaaugcugcuucuccacaggaaaugggcuguucuagucugcucugacaaggaaaguagccuuuaaguauuuuacauaacugccaaauaaaauggggagcacuuuuuuuuuuaaaucacaguguagcaugaaaccuuugcacugauguauaccauaugauguauaccauaugauguauaccauaugauguauaccauauaugcacagugaacuuagcugguuauagauguguagcuuagagaauucacaggcacccaagucaagaauggcauagaauaauuguggagguaaauugugggcacuugcuuauauuuaaccacuuucgaucuaaagguuucaugugguucaauguauuuacgauguccaaaacagaugucaguuguuuugugguuaauuugcaaccaccgcaccucucccugaggcuuccucaugcaguaaugcaguagucucuuuaagcugagcaggcugacggaguggagcagugggagccccaugcucuccuguguguggccucgcccucgcuguggaggccgaugaguccguccugaggacuguuuucuccucaggaggccugcauccguauuaccgaccacuuuugcucuggaaguauuuccagcuaacugaaauuuucuguguccacauuuuucuugugugcacuugaccucugccccugagaguauucggagagggaggcagaaggaccgagaugggccugcauuaaggccuagcaaggagcaagugcacugggcuccccaggucucgugcagccuccugcagaccaugguuuauuucucuuguguuuuuaaucugccugacuuagguugaauuugcauucacccaguguucucuagaugaaauuauguuugcuacuaagaacuuaaguguaagugaccuaaagaccugucaaaucucauauagaucagaaagcacagcacagauuaggccaaagaaauauuguuuauucuggaucuucuaauaaauauugagcauugaccuauaggcauuuuccaaauuuugcagccucucaucucugcuucaguuuccauuacuaaaauagcucugauguaaauaacugaagaggccuuuaaguuaauggaguaggaucugaucuccacaaacaguaugguauacugcuuaucugaugcuggaguacuagggagugcccucucagcuuagcuccuggguccccuggcauuguucaggaauagguuuugcaguccugguacuaagacauucagucaccaagcugcuccccagccgcacugggaacagagccuaggaggaacaagagugugcucugcuguguucuucacaccugugaggcgacggggaaacucuuugcuuguuucuccacuugcagcaggaccuuaggccugccagagucccucaucccuucuucuagguuccuuugucagagcccuguuggcaucagccuccuuauauccuagacagugacuagggggcaacaaaacugaagcugggcuugaggcagguggguugggggaggggaggggcaaaaaccccuccaccuguaggcucagccuuuccagucaucccaguucccauuugcagcauauauaucuauaaauccaucagaugugggggaaacuuucauuuuauucuauauuuuucccuuuuaauuuucuugguguuuuucuuccucuuccuggguguaacguuuucacgcacagaugucuccucgcucugcccggcgacguugguccauacaagcaauuaacgacuucccgguacugugcgcugugcaaaugcucuccuugacuaauccugucucuaccagaggcccaagaauaaaaugccaccugccuggcuuugaggaaccugaaugaaaggcuggcugguguucaggaccagcggcaguaaauuuuucaccuggcgggggcaggcaccaaggacugccuccuugccagucaggguauuucaaauggggacacacuuagggaucaccuaugggcuucuuugcgaaugaaacucacuacuggguucuuggaaggcacccugaccgaauggcuucagcucaccugauaccacuuggggcacuucugcaaauugcauggagcuuucaaaagccugccuuuggcauggggggagcagaggaagauagaagagacuuuugccauuuagcccuguuuugacagccucugucugauacagagaggggagaccuacuugcuucauuggcaggcuguaugaguugauuuuauccuuuggguauuuucuggagcaaauuuuccuucuuacccugguauuuugcauucauaauuaaauuugcuauggacauucuguguuccuuccuccuuuuccuacucauuccuauuggccauuuccccuccucugucuuccucucccgcccccuucauguuuuaguagugccaagguguccucacggcagccuugaggccucaagucaauuuuauuugcuauaaagaacguuuagagcaacacaucaacaccccuguccuagaaaaaccaguugaaaccggagccugaguagcgagaaccacuucuccacagcuugcaggucgagccaccagcauggccucuuuuccucaaacauuugcuucuauccggcucccuugcugaguuucacugguuucccgaagcccauuucccaccgcucuucacauaggagcucauuuggcuuccugcccacucugcugauuaugcauuguugaugggguugcugcgaagcgguugguggcuuauucuugggcuaauuuuacauuuaaccuauuuacuggcauugauguugccucagauuguagcaguaacaguagaggugcagucacgagcuggauagugcuugucacuuaguggcucccuccauccagcccccgcuucccuguccucuuugccaucuuccacaaccaccucccaggauguccacagggucccagagcuuaucgugcaauaaccugucugccuugcuuugucucucuucccucagucucuucccaugccaucuaugaggaagggcauuuucuguugauggagcacugaaagaccuugucucccagagguacccauuuaucaguacagaaaggaaucuaucuugagaccuaucagaaugggacuggagcagugcagaagggcaaagggcaaaguuuuagaccauggugcccuuccaugaccuggacagaguaaccgcaccucagccuuguagcuccuuguucuccauaagcagagaucccaagagaaacuuggugauguuacuugacagcuguacagacagcaaagaccccuaaaguacuucaagguauuaaggagaaaguuaggcuuagggaaaacagaugggguaggaauguuucuuauuacucaaaguguaggaaacucucuaaaaaaauucuucaucuucucaucauggacauccaggacccaaggcccuaacuaacaucuguuugaaaauguaucauaucuucauuuaggaagccuucuuacauuugaauuucaagaauaacuggccauuugguggcucacugaaugaucccuguaaccugaaggggagacguuagaacugccaugcuacaaaacuaaaaacaaacaaaaguacagcgaccacugcuuugccccugugcgcugucgagcagcgccuuacaguuauucuuugcuaaauucaaccagauaaguaaauaaaccaaaaccccacagaaacgaaaccauacuacacuuuugcguuugucucauacuacacuuagaauuucaucccugguggcagcuacaaucacagugacgguauguuggggaaucuccuccauugcaggcugagguagcugugugagguuccacagucgucuuguagacauccaauauguagcagauggaaauuccuggaaguuuguuguuuggaaauggacagaccaauuuccauaauucaaugagggauaauugcagaagguugcugaauaccacugccuuucuguuuccaaggaauuggcagcucagauuuguuuguuuuacugaucucuauaacccugcaauugggauugucugcagaugggagaagaaucuuacgacaucucuuuggacucugauuuuucuucccugaugccuaaucuuaauaaacucacaaagggucacauacacagacacauccacacacaggcaugcauggcauauucuuaagcccagcgggaagccuagcauucuugugugaaucuggcuuuuacccagggacaacacugugucacuguucucuuaaaacuaaagacucagccggguaugguggcacauaccuuuaaucccagcacuugggagguagaggcgaauuucugaguucgaggccagccuggccuacagagugaguuccagaacagccagggcuacacagagaaacccugucuugaaaacaaaacaaaaacaaaaacaaacacaaacugaagacuggcaauagagagccugguaagcaccgcuguuaacagcaaacaaacaacagggccuccuucagccaacggcccugaguuagcagcauacgcucacaaugccugagagggaagugacugggaaaguagucacagaaggaugcuuaagggucagcaucccauguccugaugcugaucugcuuaaagacagaccacacuacucacauuacuggcacauuagauuagugagggcuuaauuuuuuaccuuuguugauucuuaaaauaacagucaguacugaaaagcaagucagcaaaaguggacuuagcugggguaggguauauggcuuaggugguaaagugccugccacacaagcgugaggaccuguauuggaucccuggcaccaguauaaaagccagacccggugaucaggccuguggcuauagcccuagucuuggaguugggcagagacagauuauuggccagccaguccaccccaaucuugugaguuccagguucaguaagagacucugugccuauucccccaauaguauaauugagggggaccccagaaguugaccucugcacacacacagaggagcguagcagcuugauagaccuauuuaaauuucagcuccauaacugugaccuuguguaagguucaugucuccauuuacaaaauggagguuaugccccucucccacggagcugcagugaguaccugcuggcucggcaugaacaguccagagccagaacuaacacacacuaacaccaggaaagucuuuaaauccuaaaucaaauaccgggacacuuggacuuguuccaauaucuguugccaagugagcuagucuccuugcaaaugagcugcucccagcacaugagccuucauauaauuaguaaaaugcuuuuguuagguuugcuuucaaagucaggaaagcaggguuauuuucagugcgcucuaaaagcaggccccgucugcccuucacaaggucuccauuucuuucaauuguauaauuagaugagcuuuugugaguuguuaaccuguucaagcucuuaccccccccccuuuuuuuuguacuaaagagccacagugacuucauauucacaguguuuuuagcauccuucuguccaacccagaagauacacuaaauggucauauucccuuccaaauggaaucuuuuuuggcauagaaaugaaaagggaagcuuuuuacacuucuguguguuugugcacucgugugcacauggguaaaugugucacucuuggaagggcagaggacaaccggugagggucaguuuucucuuuccacuaaaugggcucuagggaucaaaucaugauugucaggcuuggcaguaacuaucagccaccacugaacgaccuguacucagaccacucacauacucagaccuguggguguguaguuuucgacuaauuaagcauuucugugcugcucuguaggauagccauauacuaaguuaucccugcagccggccaugcaucgcaugcuccuguggcuacuucugucuugucucaguuaacacugccuggcuccagcccacucugacauguccuucccuuaugugagcggccccaacuggauaaaaggauaguaguucuggaguauggacauaguucuucuucaagaaauuggggccuguaggagacuggaggcuuaccccauaauaacaggucaaggcuccccugccccaccccucccccuuugaagaaucaagagguguggauaauuaugaugaacaauucauagguguuucagcuaaccuacuucacuuacuugucuggaacccagguggcccacauuuaguaggucccaagacauauugauuaguaugggaagucgauucaguggacacuuagagcauugguugaaacgccuggauuuaggcguagacagauuccugaaagagugauuauacagaacucaggaguggaaacgugagugguguggcuccugaccacuuacgggcauucacagaaacugcaguucuagguugcaguguuaaguaagucugugcaucugcaucugugucuccucgcuguaccuuacucacuucagacuggauagcagagcucagcauuagcuaauaagacaagaaagacugacggcugugagacuaaauccacagcaaguaauuaacuaggaguagcuugccuagggccauauugaggcagaacacacaguaccuuaguuuucugaugucaaacugcaagccccuuuuaguugcuccuuaugccuccccuguugauaacuguguggcucccuugcuuaaucaagugucuuuggugaccucuuuuaacuuuuggaaauaaaauaggacauugcuccgauaacugguugucuuuuugaagaugccagauggggcgacacucugugacuuuuuguuucccacgacauuucucauuccucacagccacuuccugaggcagcucugggagcugaaacaugcgcccauggucucccaugucuguuaacuggguuuccccaacuaaguaucuuugaccuucagaaaugaucgcuuauagaaauaauucaggccugcuacaaaagcaaggucuuauguuacccagugucucugucuucagacauaauagccuugcagagcccacacugucgugucugaauuaaaauaucaacuaacccuguugaaacugucuaugaagaaaaaaaaaaaccuuugaaucguuucaggcaagaacuuugaaccuaguacugaacacccuaaagucccccuuccccguuugugggggaucuuuacuaacuucuuuaccugcuauuuuuaaauuaauuaauuaauucuggcuuccugguaucuauuuuugagcaccugcagaauguagauggcccugcaguaggugcuuguuuccccaugagggucuuggaucaagagcuuugggccauuuguuaccuuuuauuuccuacagaugcugauuucauguaauuguggggcacgauguaauuuaaagucucugcaaaugaccaaugacccaaauaugauguacugugcaacuguagguucccacucuccagaggccccguuagucacuucuggucaucucccuuagaaaucgaggagguggaagaguaagcgggaaggcucugacuccggcaaccgacccauuaaggcugcuggcaaggucaucauccaggaugucucgugccuccuucccguucauaaguccuugggagagcuguacauguaaguccaugggcccaggcggcauggggcacggcaccuugggagcugcagagcuuuguaaagucuuagacaacuuggggaaacucggugugguagcuucuugauagugacuaacaaauugccauaaacuguggcuucaaagagugugcauuucuuuuuuuuuuuuuuuaagauuuauuuauuuacuauauggaaguacauuguagcugucuucagacacuccagaagagggagucagaucucguuacagaugguugugagcuaccaugugguugcugggauuugaacuuuggaccuuugaaagagcagucgggugcucuuacccacugagccaucucaccagcccaagugugcauuucuuaccucacucuuuguguaggucaggcacccagcuuggugggcccuccuugcccccgaucucaccuaacugaaagcauaacuuugggcccaccgauggucucugcugaagcucaggguccagcaagcugaauuuagagccuucuuuuauugaaagacaauaggagcagaggcuggccuguaggucuuccaagcccuugaacacaucacagaaaguguuaucuuuugagauauacccacagcacaauacuuuuuagauggaaaucacaguuaguauguacacauuuaaaucccaaaccuugagaacucaacagaaaagcugguagcuaauuaauauuuuucuuauugccuccuccugaaaguggugaguauuuccgguccuccccaggugggaacccuaagcccugcagcaccugcucuaauuaacccuucccagccugucagauagaggagguguuuugagugacaaccaaagagacacuuaccuaggcugguaaaucaggaggaguucuugggaaguucaaguagaaaccuucuuagucuuguuuguuuuaauuucagauugaaugugaacgacacucaggagacaugucagaagaaugccacuucugccaugcuugugggaaggaaggaucuuguccagguacugucaaucuguguuggugagguucuggccuugacaauugucagcuagugacacugauaggugugcccacuauuugaaguuucuuuuuuauuuucuuugccagucugcccucccucccucccucccucccuccuuuccucucucccucucucuccuggaacucacucuguagagcaggcuggccucaaacucaggucugccuggcucugccucccuaguacugggauuuaaggcaagugccaccacugccaccuguggguaaauuuuguuauuagugcuaaguggggaagauccuuaaguggcuuuuuucccuuaaacuauguggguuuauuuuucaaugccacagugaucauugucgccuaaauuugagaaucugucuguaccuuugucauuucaccucaauuacuuuuuuuaauuuuuaaaaaaauauuucauaagaaaguuuaccagcguguacuucaagguagagaugcucaguuuaaacaugacuucauggggcuggagagacgcagagaaggcuggagcacgggcugcucugauaggaggccuugguucaauucccagcauccaugugguggcucacaucuguaauuccagccccaggggauccagcuaccccuucuggccuccucuggcaccaggcaugugcaugauagacauaccugcgggcaaaacacccauacuuguaaaauaguaguacauuguuaaauaguaaaaucugacaguauguguaagauguccguuuccuucaucuccggagguucccauguauuguucuuuuuuacugagacacguucugcacaucacuagucugcacguucugcacaucacuagucugcacguucugcacaucacuagucugcacguucugcacaucacuagucugccccuuacagugagauacuuaguuccuaguguugucagugcucucauuagaaaccgugcagaguguuuuuaucacccauaaaaagaaacucuugucuuucagucaguucuucccaucagcccugggcaaccgccaggccccuccugucugucuugcucucuguucucuacuugaugacaagacugagcuuuggaagucacuagcagcucucccagcagcucagaguuucccucauaacugagugagucagcacggaggccuucccuugauuuucauuugauuaaaaacaucccuaacagagguccuugguccugugaagguucuaugccccaguauagggggaaugccagggccaggaagcaggagugggugguugggagggggcggggagaggaggagaggaagggggaagggauuuuuggaggggaaacuaggaaaggggauaacauuugaaauguaaauagagaaaauaucuaauuaaaaaaaucucuaagauuuccauucaucuaguaaugaauaucauaucaucucucccagaaacccuuuaaaaaaacucccuaaugguuuaaucuauuuccgucagccccacccaccagacucugaacacuaagaaggcaaaauaagcuaauaggaauuagccaaggccagcucagaguccuagagaacaccccaggcaaguucucucaggccuucagccuuggagggguuuauagugugggaaccacaagaauuacccccaugggggauaugaaaucauugaagacugccccaccccaaagaacauucucucaacaggguuacagcuuuuccuuuaaguauucucccucuuccuuauucucuuccugcaugucuccguuccuuccuucucuccucuccccaacuccucccuccccagugcuuuucugacagaauugguauggaaggcuagaccagucucagugauguggggagacgcuugucuucaugugggcucugcuugacuucugggcccugacacucuuucugugugugauccccagcaagcugcccagacuuugugaacgucagggucccugcuauaaaaugagccauacuucugacuucaugaggaaguaaaugacauaaaaccugugacugcuccuagcugucuggacacccacagcuguaugugacggucauuugugacuugaugauguguaaagacagaaaugaccugauugacaaacagugaugcucaaagaauuuguauuguuuuucuuccugcccuugaugaagauguacuuccuguuuugugucccucgcauuuaccagugaagcagaugcaagggcacgcuucuguugaaagccuuuaggaaauguguguuauggagggagacucuaacacaacucaauagucagccauggcagaaaaccuguccugccaucguuaacuuuggcgaugagugugagcugcaugucuguacuuggagcaauacuggugugucacuuuuuguauguugcccuugugcuguaucuuacauaucuaauguuugccuuuccgaauuuuuauuugcuugcuggucucaaauuauagacuugacucaaaguuugugucuucuuccuuucggguuuagaauaguguguuccagguaguggguacgaugauuauauugcuuuuucaaaaccaaacaaaacaagccgggcaguggugguguacaccuuuaaucccaccacuugggaggcagaggcaggcagauuucugaguucgaggccagccuggucuacagagugaguuccaggacagccaggucuacacagagaaacccugucuagaaaaaaaacaaaacaaaaagcaaaacaaagcagaagagauuuuccaaaagcaguauucgauuuuuuuaaggucucaagggguugcucaucucuuucugaugggcagugaaggccuugggcuuacuagacauuuaauggacauuagaguggugauucuaagccccgugcgguuggaggccuugggugaucaucagacuucaugucaacagaaacaaagccaagguuguuuaguucuuggccuguucuuuagcuucaaaagagcccuaaaacuuuguaauggaggugacggcauucuccacccacggcacgaagagcagguccucagugggcugugggcugcucugguuuggucucugccgacccuguucaccagggaagcgucagaagaggccaagcacgcugaagaagcuggaccuuggacuaugauguguuugcucucugaagcuugcuuuguggaagguuauucuuccuuacauggcuuggccaugugguguggguugggguaaaacucgggauagccucgccuccaacucuuggccgucucagccugccaagggcuggaguugcaagcgugagccaccauguuuggcuuuuaaugaaaguuuuaaggcuaguguuucucagcuuuauaguaucgucagucacugaggacccuguuaaugcaucagcuuuaaugcaguaagucggaguggggcuuagcauucugccagcccgagccguuugcauccucguagugagguuucagacuguaggaagagggcagacagauggggccccuuugcagggucugugcaucucuucuguggcuugaacuugagcaucuuccuuuggucuguccagguuuggucgcuggcuacgguagcuacagaucuuugccuugggccgaagucugacccagauuuggaaacaccuugggcucgacauccauuugggcgacaacugcuggagucccuguagguucugagagcuaaaagugaggagaaugaguggaggggguuguagucuguaaacacauuaaauggucccaccauggugaggggagcagaggugcagaggugugaagggaagaaagcccuuugcuuuuagcacagaaacggccucuguguagaaugaacuucuggcagcaugaggcauuaaguaacauuugucacucacaagaguuugaaacccuuaugagucccaugcucauuggagugcuuuaggccuucacucacaccacugggcacacgggccuuugggcucuggagaugguaagugucagucauggugcugugugguuugccccaugggaacaaggacagagcuguguguugguauucauguucuaucaauacuaggauccuguuagacagcucauaaaagcaucggauuuauguccaacuuacuacuccaaaauacagcaagucagagcauauaaaauaauauuuaaggcauuaagugagccacucaguuauuauuccucauagugaggcccaggguccuggcagagaaaccccacugcuucaaguugaagcuugcuucuuugcuggucgaggcuagaccuggggcagcugaugaugcucccauugccucuuccauaggcagguuuuaaagcuugcuguaguuagcuuacagaugccucuugacagaauccuucucagucccugagcuuggauuugagcguggugguccugagagcgaaaggggaggaaaccugagguaaacguguuccucaccauucucacuuaguccaggaacagacauggcguggugacagcguucucugagcggcuccggguaguauaaggucaaagaaaggacacacauagaaacuuaccacaaaacugcuuguuuguuuguuuguuuuuccuggagcuggggagaccgagagagcacaagaguguguggaccaccucucucaggugcuaggucagucugcuugguucugcagacgcuguguugcuuuagagcccaugccugacugccagauaaagcuuucagauuccuagcuagguugcuacuaacaaaaguaaaugggacccaucucacaguuggggaggccguggaccuguaggaaguccuguuucugacaaggucaaggggaggguggaaaaauccuccagccucgccccuaguaggaguuuaauggcugguaagggguccuucccucauuccuaaucuuaguuucuucuuucuuucucuucccauauuuuacagacuggcucacuauugccaacuccgagauguucagaccuuggcuaugcucuguagcguguuugaagcccagucccggccucagggcuuaccaaacccuuuugggccuuucccuaaucguucuucuaaucuuguggugucccacagccgcuaugugaguucaugguguccuggcuucccuugaggucuguccccaccgcccaauguaacuuggaagugggaugguguucugaugccacuguguuccuccucccaucuagcccagcuucaccuccucgggguccugcuccagcaugucagauccaggguucaacaccgguggcuggaacauagguuggugaggggaucacccagcccacucuggacucuggcuguuccuaaggcguucugagggcuguucacauggaagcuuugugcugcacuuucaccccuacaaccuaccccuuauccuuccacguaccuuguccccacaccucuacccacggucaucugccaccuccaccauccaucucgucccauguuuccuuccaguggagagagagaaagcuagccugaaaccagguggccauaggguuucuuuaaugaaguaaauaucuuuuuauuuccuggauuaaaaaaaaaaauucagacugggcguggugcugcacgccuuuaauccuaguacucuggagcagaggcaggcagauuucuuuguguuagaggccacucuggucuacaaagcaagucuaggacagccagggcucuguugcacagaccuuaucucaaaaaaaaaaacaaaaaacaaaaaaccaaacaaaaaaagacaaaaacaacaaaaaucaaaacaacuuuuuuuuuuggaaaugaucuuaauuuucaugauuauaaaaauagaacauuagccagguguaguaauauacaccuacaaucccagcuucuuagggggcugaaacaaaaggguuacccagcccagguaucugaggauccuuugagcaacguagcaagaccuugccucuuagaaaauaauuccaguacucaggaagugaaggcaagaggauugggaguuuaaggcuagccugggcuauacagaaagauauguguacacacacacacacacacacaccuacucucgaauauacauguccaguaaagaauaaaaacuaucagagaaaaaaaguaaugauugcuaucucagugucucucacuuaauaauuccagaacauugucuucucuuccccaccacacccucccguguguguguguguguguguguguguguguguguguguguguguguguguguguguauguguguguguguguguguguguguguguguguacggguagucauuugguuuaugcuguuuugcauucugcuuuuauuuuauuuuauuuuauuuuauuuuuuuguuuuuuucgagacaggguuucucuguauagcccuggcuguucuggaacucacuuuauagaccaggcuggccuggccucgaacucagaaauccaccugucucugccucccaagugcugggauuaaaggugugugccaccaccacccgguucugcuuuuauuuuuaucaugagcauuuucucaugauauuuagcaggucuuuauaaugaauuauugcauagaauucuccuauaucacuacaucauaauuugcuugacuaucauguguaccaggcucucuuggugauaaaucccuagacaaugagguagacuaggaaagaggacuguagggcuccauccaucucucagagucuugaguuuggcuuauuuggcuuccggagaauccaguggacacacaguggggcgugggaggugggaggggcuuccuauuucugugccuccccggccuccaucuuucuucucuuuugcuuuucuuuagcaggaagagagacagaacacauaucuucaccuuggggggagucuucgccagaggagcuccgcuuugggagucugaccuacagugacccccgggagcgggaacgagaccagcaugauaaaaacaaaagguagccaucuuccccagaagggcugccaccuucccuguggcagcuacagaauucucagcuucagaauuacacucggggcucacgaagauggaguuuaggguuaaacgccauuagguaaggagcucccucuuccccuaaggaacugacgggaccuuuuggguuuauccaggcuccuggacccugccaauacccagcaguuugacgacuuuaagaagugcuacggagagauccucuaccgcuggggucugagagagaagcgagcagaagugcugaaguuuguguccugcccuccugacccucacaaagggaucggugaauaugacuuuguguuuccuggcaccauugggaaggccuuggacuguguuugcccauaaccuuaggguggaggguugagcucauucauaggcccaagauuccgagcguuugagucuuuucuaaccuucugaaaauggcagcuauauaaccauuacaggauucacuacuauaaugguggcaugucuuggacauaguacucaguguggacaggaaguagagaugauuauucauccagcuauuguuuaucaagcccaugguaagcacaguggagcccguggcagagaagaggggaaauuuaagcaauuagaaauaaugauagccauacuuuggcuagagagaugguucagggccgaagagacugguuguuguucuugaggaacuggguccaguucccagcaccaacaugguggcucacuuuggucuauaacucuacccagaggaucugaagcucucucagugcucuguggguacugcguacaugugcuuagcaagcaaacacacagguaccagaacacccauacacauaaaaugaaagcagcagacucagccgggcguggugucaucugccagcacucaggagacaaguggaucucuuugaguuugaggacagcccauucuacagagugaguucugggacagccaaagcuacacagagaaaccccaucuugaaagcaagcagaaagaaguacacuuaguaucauugcguuuaacucagauauggauuaaggaagagagacaacacuuuagugaugcucuggguuuccaacuagugaguugagcugagcauguaacaguguuaaaccccagauagaaacagaugggagaacuggagcucagggucuccaggggucacaaguggggcucuagaaaagucacucuacaguugguauguaagccuguuagagugcagguguuaucuaggcagagugagguaugccuuucuuuaagcccagcacucagaaggaagaggcagggggaucucggugaguuugaggccagcuaggggauacuuaguaagaccuugucucaaaaacaauaaaacauuaaaaaagcauauuuuauaugagagcugaggauggaaaggacgaaugcagggagcacagcggaggggcuucccagccuggacccuuagagaaacugagcgcucaguguccaagaggaagacaagaacucaggagacugcagugacuugaugagaagccagaguuuucuuccugcagagauucccuacaggaaggaauggaaggcuucagagggagcgggcugaccucacacagucucucucccuccuagacccuggcaggccucugcacagggacuuugugaaaagguguuaacuacacagggaaaaguaagguuagcaauaaauucaaagccaggaaaugggcaaguuauuggcagcugacuuacugccugagcaaaccaaacccugagcuuuuagucagaaaacaggccauuacagaacccugccauggcuuaggaaucgggccugccuggugcuccaggagggacucggagaugaaauuuaaaagcuggucuuguuugaugaaccuuggaggaugcucuaguugccccugccaggguauagaacaggccaugaacccagcagcagacuguaagcuuguucugcagagaacagagccacguuugcagacuggagagcuccacccacugcaaugagugcagaaagaucggggacccagaacgcuuccagaaaaagaaaucagcucagcuaugaaggaagagaaagugaacggcaucagcgcugacagcugacagugucccugggaaacucaguggccaggcagcagacuccggaaucuccaggaaaagaauuucuaaccuagaauucugagcccgaguaaucagcaguguacgaaguaaaguuugaguguaccuaagaagcaggacuagauucagcccaggaacugaagggaucagaaaagugaucaccaugacagaccuggagagagaccaggaccaacaggugcuccaggagcccuggcuccaaggagagaaguugaaaaaugucgaauauauuucacucuugaguauauuuauagaaggcacagacaucugagggagaguuugguaaugaauuauugauaaguacauagcaaacuaagcaaaugaaagaaugaggcaguuacuaauucugggagaaacaaaaugugcaagaaaggaaaagugucauagacauggcuugaauaauguuugcuuagguaaauaauguaugagccaaauguggucuagccacaacagagcuagggaagacagagccagguggugcugucuguggucgggggacuggagggagaaggaguuuccacucugggaagccaauagacagugcuuggauaugauacuuaagaauucacuuuguguugggcauggugggauaaaucuuuaaucuagcucuugggauacagaggcaugugggccucugaauucuagaccagccuggaccacacagugaauuuccugcuagcuagggcuacaaaaggagauccugccucugauagauagauagauagauagauagauagauagaguuuugcucaccuugacagcacauaacacacuaaaaugagaagaucuacagauaagguaaacaugacucuugcucaaggaggauaaauucguaaagcuuuuacuguuuguuguuguuucguggggugcauuuggggagcugggggggggucaagacagugucuucuauauggcugugacuguccuggagcucacuauguagaccaggcuggccuuaaacucacagagaccugccugccucugcuuccagagugcuagaaccgaaggcaugugccacugugucuggcugcauuuccucuuuucagucaguauaucaugggacuccuugcacaucagggguuauugcggcacgauuuauaauagcuuaguuauagaaccaaccucuguccaucagcagagaguagcuaagaauauggggcuggaaagacagcucgaugguucagaggacuuacugcucuuucagaggacccgguucaguucccagcacccacauggcagaucacaacugucuguaacuccaagauucugacacgcucacacagacauacaugcaggcaaaauaccaauacaaguaagauacaaauaaauucuuagaaaaaagaaaaugugguaucuauacacaguggcauugcaguaaagcaggaagagugaguggcguuagugcagggaguugugugccuggagauuauccuuccacgugaacuaauuccaugucuauaaucaaggaauuccacgugucucugccuuguggauucuagauuuuaguauacauaaaaccaugcaugccuaugacaugauaguagaaaugaaacugccuuagggauagaggagugagguagagaggaggagaugggccauacgggacagaauaggcucagaagugcauucuguauuuguaugaauauguccuuaugaaauacucauuuccagagaguagagcagcgggcaguauaaaguggucuuuagagaggagacagugaacaaaaacaguggacucaguagguaaggucuccucuagcgagugacagggaaugcugggcuuugacaagguucauaaaacucuguaugucauaugugucccuaguuuccauuugaaaaaaauaaacuagagcaauauuuauaagagaugacccuaaguagcaggguuauuuugguaagcuaugccuacgaauacaugcuugaaaaaaauacaaaaauacaaaauucuaauuuugacaaugugguauuuuuuucagagcuucuaaauacaugagaguguaccaagaagagauuaaugauagccgggaacaacuugucuuuugaaauuaguuuuuaggaaaacaugaaucacagugauauggagcugacguaugagccaaacccuuguugacaucuccugcucugaagcaccaugcgagacugcaggcgacacagagaaauagauguggguggugugugugugugugugugugugcacacgcauguaauucacagagcuugaaauaugagacagauaacugauacuaaacacuuuuauugcuaggugugagaauacaccccugcaguccuggaacuuggaaucaggaacucagguccggccucagauggauauugaguuugacagcaugaaacccugucucaaaaacaaaaaacaaaacaggauaaaaaccuaaagaacaaagagagaaugaauguaauauccuagggccaauauaaacaguauuacaggauuguaaaaagggagcaagaggggucugaaagagacucagacaaaauguuaacaugagcagugacuguaagcugcaccgaggagucaguccaucuggauuuggaggaaguagcugcacguggagaaauccagagcucagcaagggcuggaggaaauauacccuccagucucccgagacaacggccaucucccucuguggaaagaucaguuuccucucugcucugucuguaaguuaccagaucagcagacagaaaacaaaaaaucuauuaaaucagcuaaauguguuuacacauaccuguaauucuagcccuuggugucuggagaaggagaggagucugaggccagccuguguucuauagcaagagcaguguuaauucaaaacagaaacaaacacaagaaaggagggaagauauucaggaucugagaggaguuuguuuccauagggauaauuccuucacuaaagauucagaucugcccacauagauuucuuuacauuaaaaagauguuuauuuuuuaauuuaauuauauuuuaaaauucugguccuuuuuuuuuuuuuaaagauuaaaaaaguuauguguauaugccugaguugauuuuauguaccccgaauguaggaggccagaagagggcauuggauccccuaaaacugaaguuauaggugguugugagccuccaugugggcugagaaccaagcuccgguccuggaagagccacaagaagacugaaccacaguugucuucugaccucccacacaugcuguggcaugugugcaucuaugcacauaugccccaaacaagcacacgcaauaagaaacccagagcugguuuacaacaguaaaagacaguuugcaugacacaggaccaucgucuggggucaacuuagcgaggucucuccaugugugaucauuugcuacagucuuccuguccuuacgucucccugugcaucuuauaauccauacugagaucuacuguugggucuuuuuucuuacuaaguucuagagggcuaccuaaaauagucaucuagaccauuaaauagcgagcugagccauucauguuugauuucaaauuauauaacuuaagaugaaggauagaggggaagaaaagaaauaagauugaguuuuuuuauaguuuuacucuuuuuuuuuuuuuuuuucgguuuuucgagacaggguuucucuguauagcccuggcuauccuggaacucacucuguagaccagacuggccuugaacuuagaaauucgccugcuucugccucccaagugcugggauuaaaggugugugccaccaugcccagcuauagguuuaauuuuguaaagauuuacuuuuuaucugcauaaguauuuuuuaaagauuuauuuguuuauauauuuuaugcauauaacugcaugccagagagggaaccagauaguugugagccaccaugugauuacugggaauugaacucaagaccccuggaggagccaccauuucucuuacgcacugagccaucucuccagccuugccuacaugucuugccuacauguguacauacaggagguuuuaaccaccaugugaguccugaggaccaaacccagguccuuagaaaaacauuaguguuccucacugcugagccauuacuccagguccaguuguuccuccugucagaaaggagggaggagccaucagccucuggaaauuugcaaaaugcugguagagaugaaggugucucacaauccccauuuaagggcuuccauuuuuuuuuuuuuuuuuuuuuuuugggaaaugagaagagaggauagcuggugagagacagcagcagcagcagcagccaaggcacguggaagaaguuugcacacuauggcagagauucaguguuguagcuugaggaaggaagaaaagcaggguuacaccgugcccaggcccuucucugccagugagccuaaagucaaacacguuugauaagguuccuccagcugccucugcucuccagagcugaugugcggugggugggugggugcuguggcuaauucauggucucagcuuggccaggcguuaccaggaagggagauggagcugaggauauuugcaaaaaacagggucaugaacuuaguccagguacgccagguuggccaaagagaaaagugcagccaaaaagggcaaguagauuaaagaggcaggugggcaacagaggcgggugggcaacagaggcagaugggcaacagaggcaggugggcaacagaggcaggugggcaacagaggcaggugggcaacagaggcaggugggcaacagaggcagaugggcaacagaggcaggugggcaacagaggcagguguggacuagaguggucaaaaggcuagagaaagcuguugagguuugaucuguugcuaauguauugugaugcuaaauucuguacaguaggucuaggcugacaagugaagucucacauuuaccagcuuuuuauuuuucuuuuugguuuuucgagacaggguuucucuguguagcccuggcuguccuggaacucacuuuguagaccaggauagccucaaacucagaaauccaccugccuuugccucugccucuaccucugcuggaauuaaaggacuaaguucaugaagcuacauuuaccagcuuuuguugugcaaaucuuguuccuuaauuuaaagcuauugguuaaauaaaaaucgccacagccaaucacuggagggguuagagguaacagaggcuuuguuuuuguuguuucuuuuuguuuuuuguuuuguuuuuuuuuuuguuuuuuuuuuuugagacaggguuucucuguauagcccuggcuguccuggaacucacuuuguagaccaggcuggccucgaacucagagaucugccugccucugcuucccaagugcugggauuaaagcugugccaccacgcccggcuguuguuucuuuuuuuaauguauaugaguacacuguugcaguuucagacacaccagaagagggcaugggaucccauuacagaugguugcgagccaccgugugguugcugggaauugaacucaggauuucuggaagagcagucagugcucuuaacugcugagccaucuccccagccccaguagauacguuuuugcguuacgugguugaccagggagaaagaaaaugcaugaggaugagagagaaggaagaaaugacugaucugccagagccugacaggguccugagaggagucgguauccuuacccagccagacucagucugcuuuuauuagaacuaaugucuccucuugcuuugccccuguccacccauuugcagaguuugguguguacugcagucacugucggagcgagguccguggcacccagugcgccaucugcaaaggcuucaccuuccagugugccaucugccauguggccgugcgggguucauccaacuucugccugaccugugggcaugguggccacacgagccacaugauggagugguuucggacccaggagguaugucccacgggguguggcugccacugccugcuggagagcaccuucugaacuuaaaggacaguggcacuuccggaaaucccagaggacuccauaagugcuggagaaggcucucugcugcugcugguggaaaguccuagaaccagggccauccucgugauuuaggauggagaguauccucucacagacugucacagcauccgcucgugauccuguguguucccuucuccuuggcugccgggcacggauggugcuggaagaagggagggggacgcacagagcugacccuccuguacugucuguugaguccacaguggauguuuucaugaggaaaagcaccuguuuccagagccaucagagcuagcaucagccuucaagauucuguccuugaaccaggaauggacccuccagaugccaguacaaaggcacacagcagcugcaaaacagacuccugagccagaagacgcuggcucuuagugccauccacaagugagcuaugguaucugugacuuagaaguuggcaccuugaugauggccuuauaaaauacaauacuaaaguguaauauaugauggacauauauucagcauucuuuuucuugguacagggcuggaacucagcgccuugcacauacuggugagcagccauaccacugaguuacauuccagccccauaagaaacuuaagauguauauguuuucuguuucucuucaucugcuuuccuuuaacuaauagaaguuuguacuugugugugugugugugugugugugugugugugugugugugugugugugagugagugagugagugagagagagagagagagagagagagagagggagagagagaggaugaauaaggaaagugaccgucuuagugacucauuuugcauuguacuucugguugaagggaacuguuuuggaccggacuagaauuagucucaugacuuguaaaggaaaugccauuugacuuugaucaucugacagaggaaacggaaucugacauuaagguucucucuagccgcaagagucucauaauuauuucuucuagcacaggggaaaugagauugcauuucagcacugauaccagagucucucucugccucugggcaggcuggcugggcuccagggguacuuuuuacuugaacucccuugcaaacucaucaugauuuucagggguuucacuugucuauaccagggaagagaguuuaaaaaaaaaaacaagacccacuauacugaaaucucucucucuuagaaauuuaaauuccuugggccugucauaaggcucagugggcagaggugccugccacuaagcuuacuaaccucaguuuucucccucgcaugagccaccauagaagaacugacuccuaagaguuguccucugacuuccacaugugugcuuugauaugugaauguacacacacacauacaaaaaauguaauuuaacaauuuuaugauuccaaacuaauuaaccggagacacauaaguaauuugugucauuggauuaugguugcacguguuuguagucccuucacucacggggcugagguaagaggguuucaaguuugagaccauccugggcuacacagugaggugauggccagccucacuuauauaugaagacacuuacaagcaaacgucauaaagaagaucuggagagaucgcuuaguaaucaaaugcuuggcuagcauacaggaggugauguguuugauccucagcaacacacacacugacacucaaacuaaaacaaaacaaaauacuacauguuccauaauagguaaguguuguauaucacuuuguuugaaacuaugauuuaagacucaugaauggauuaggaaaucagucucguagauaaaaaccaacacuuucuauuuucaaggauuacuuuguguguguaaaucucugugucuucaaguguauguugugugggacagaagaggccaucugguuccuuggugcuaggauuaucagucuuuucaggacaccuugugucauguguguucagggauccuaacuuggaucuucaugauugcaaagucagaacuguuuugucuccagcccccaaacugucauauaaagaaaguaaaauaaugugggugagagacaaucguguacuaacacagucugauguccuuuguuuacuagugcgugcgcacacacacacacacacacacacacacacacacacacguacuuauaucucaugguggcaggugggccucaccucuccccuguauuacuaauuggucaugagacuccguggcauaagcuugaucuugaacuaugugccagguuugguaccagugccucagcagcacguguaguccggugugcugggaugggggaggaagggccgcagguaucugaguguauuacacuguacuccuccagccucguuugugucgacacugccgugaugcuggucccacaacaggcggacugaugugcacagacacagaucuguuggguccucugugaguucacaccauuuacagagagcggucucuuccucuaccccaccgugaagcuaauggaagcccugucccuguuuagaaugacauaguuuucuuguguggauuauuucuguaagaacauugucuuccaaaacaaaaaaaccuucuuagugacuaugaagucauuucaaguuuaacauguuucauagggggcuggagagaugguucagugauuaagagcacuggccgcucuuccagaugcaagucccaguaaccauaagccaggccacagacguuuguaacucccauuccggggaucagaugccuuucucuggccucugucagcaccagacaugcacaugcuauguagacaugcuggcaaaacacucuuuaugcauaaaauaaaaacaagacacuauguaac

SEQ ID NO: 4793 - RNA, 9030 nt, Mus musculus
uggguccucugggaagcagcaucucucucaaaccacugacucaagcucccgucugcccucccacccuuaggauaucguuguugaucaucuuccuuuuucugcuucaaugaauugggggcauaaucauguuucccuggggucguuucaggagagauuuagaaagccuuuccugagaaccccuugaaaggcucccuuggcaggaacaguguuguuagcagcuaauguguuuccccuugaugccccacuccagcugcauagacucaugguuugaagugaacagaucuuguccagagcacccugcugacugacccugcugggccugcuugccgacuccucucaaaggugagcccauacuuggcgggagacucugggcuaagagucaaguuucugggagcugggggagaggagcuggccugccugauacacaccccaccaaggagaaagcagaagcagaaagacagaagccaucuccucagagagcaguccccaggaaguagggggauguuccugggaguugggggagcaugaaagagcgauaguaaccuagucaugagaacuccaugcaaagauagaaccaggcuccuuccccucaggagaggcagaagguccccugcagggugcaugggcuggagcagaggcgcccccagccaggcucuacagcagccucaccucccucaccucucagagacucgguucugaaagggaagaaucacuaaguaguggccuguggaacagacauuguccacugcaaagacauggccugaggucuuuccacuccugguucuuccaccggccugagagguccaggccacacucaguccuugugucccaggcacagugucacagcagcaggcuacucccucccacacacgcacuucuggugcuguguaaccauuggaucugaccuucauuucuuccccaggguaccuuguuuaacugccccuaucccgcccccacccugccugugccuuugaggacuguguuggguguucucucucuuuuguuuuguuuaguuuguuuuugucccauccaacugaaaaccaucagccccuucccacuugaucccacauccaaaggcuuggggaucccuuuucuucucucucuucuuuguuguuuuuucuuuuguuagguuuauuuuauuuauuccaaguaaaugcccagaacagcugcuggugucaggcaaaucagggacauuggcucuuucuacccucaccucaaaaccugaugccaagcgagggagagugaggcagagggacuggaucccagcuccagagugcagguccagaaugccgccgccggcaugauguuuggcuuccaaugggccugccuggacugaaccagaugccccagccaaccagccuggucucagggggacacaagcugcugccaccgugcgauggagcggcaacucucagcaagaugaagcgggacugacuucuuccgacccacacagggacagccagccccuguuccugggaggaggcuccucggacacuggacagagcugagcuugggacaccagagagaacagggcacccuucugcacugacuuccagaaaaugguccucccugaggacacccaguggaugagagaagaaugaauugaccucuauccuuccccucacccucgacccaggagggaaagggcauuuucuuuuucaccuuugaaaggcguugugggucugucuuuaaaaaguguuuacaaacaacaaaaaauucuauaaaaaagucuugugucgacugguguuuucccuugugauguuuacagccugcuguuugcugcccagcuaaaaaccacucaugacagaagcaagcauagccauguccugacccuagcgcucugauggcaggugggcaggcgggcacacguuagucccucugcccagcgccccaguuggcucucugcaucacuaaccuuucuaccuuuggggauucguuuuuuuuuuguuuucuuguucuucugucccauuuuucuggcuugguuuugcacuuuucuccccuuaaauuuccuugauuuccuugccaaaaaagaggaagaugaagagcccaucguggacacuugcccucccccagccccgagucuccccugccuuuccuccuggaucugaucccaucagaggauuuaauaaucacaaauacacugaaaaaaaaaaugccuggacauuuuuccaaggccccugugauuuuuuuuucccccugaggaaauuuagacuuagcuaaaggacugugugcugcaacccccauuuucaggcgcacggaaauauuuuagccauucacacaugacaucagcccaugcaggauagguuucuguauuuauauauuaaaauccaaaaaaaaaaaauuacaaaaauguuuuaaaacuguucaaagcuuaggagaaaagcuuaucagucaagguguuuugauaugguauuaaaauaguguguaacaaaagaugcaccgugugauuuauuuuaaugaaguguuguuacacaaucaagguggaaggcaaaugccaguucccucuguccaccucucagcccacacccccucccucagcaccuguaauggcuuagccacuccugggcagaggcucuacauaguggcucggcugugucuuugaaguuuauaaauucuuaagcaucauggagugauugucagucuucugucaucucugguugugauaggaugcuacuggaaugauauucaggggcaaagcucuuacagccaccagaggauacaggcaccuggagaugccagcccaguccguuugcuuuucagagccucugccccccucccuacccucugcuugccuguugcuccgugcagagccaagugcugacucaugggcaugcuucucugaggccccggaaaaggcccugcucugggcuucuuccagcucacaguccuugaaccagaaccagccacucagccucauacaaguuagcaaauugcaggcugggcaggaaaccucggggcagagcagcagugcauaccugccugucuucuagccaggcuccaggagcugcauuucagggccuccugcagagccagcuaagggaagcucuggagggagauggcaccaccucucuaccaugaccauuuccagaccugccccuuguacugcugugucagggcccagucccagcaggcccacaaguuuggacuaugcuaccacccuugcccucagaugcguccugaagcaauugcucugugcaaggacauguguuggaggccagugggcaugugggcaccaaggcagggaggcaaguucagagaacuaagagugcuuuauuuagagccugagugucagacgccucaggaccugaacuguaagcacugucaauggccagaaacugggcucuugucuguacuggggcacuuuacuucuugguggaaccgugaacucgaucccuugcaugugaaguggggacagggucaugcggcucgguucaguuugugucggggaucugccccaaaggccuggcacaugcgcagcaggcuuccuuguagcuaugucacugcaaagggcacuguucuauucccagcaccuccagcuucugccuggcaccugugucuccccguucuauauauaauccuaccagcagagcuggcgggccagggcccagcccgcaaagagaucuccuugucugacccccgggccuggagacaggcuuugugugcccaccuuggcugugugagcucggcugcccuggcagugcuguggcugagucccgugguugaguugguuggggcggcgcugagccccacaccgggugcuauucuaggcucucuaggcuggugcucaucccauccccagugacuuccgcccccaccuggcacaccaaagcccucuguuggcugucauguccucugaauuuggacccagauugccagugccuggugugaggggugggugggacugggcuugucugggcuucccaagguggcacuugugugugucaccuuuuauccagacagcccuccagaauccuguguuguucguuccuacucugccuuucugagaaggaagaaaauccggaagagccaagggauggguucuuccccuuagcucugaggagcccagaaagccuucugagagcuccaggagccccuuuugaaaaccacccaucuaagccauuuaauaguauugaaacucauaggagaauguccuccuuaggagacaguggcugaaauauauaguugaaugauuucaagaaauguauaaucuaaucccauauggucuccccucccccaaaauauacaaagcaaauaaggcaaaaauguccauuguugaaucuucaacgacugauauuucagugaauauaguguauuuguucuuucaacuuuuucuguauguuugggauuuucuuuaauaaaagaaauuguggggaaauggcuguguauugaguuucccauuauuggaggguguauguaggagcccugcccaguggaacucaacuugggaggacuugaggugaacagacugucugggggugagggggguucacuggcgauauuucucaauggugaauucgggacugguguuuggguuucuucauccugaaguaguuugggagcaagccaaagaaucaugagacagaccugaaguuggacuaagaaagugucaggguggggggcaggaggcugcuucuuccuuuuuuuuuuccaacccaaguaccuagcaguagagaagaugguacuacaguugacugggacccacaaggguaaaaugccuagagacuggccacccuaaaagugucugcuagguuucugguguugcgcgcccucucguggacuucuggggaacaacugcaaguaccuccagaccagggcucugaccagggagucucaaaacugccaggccccaaaguaggcaagacccugacuuugaaaguaagcgcugguggauagagcuuuauaccauggauagggaugggacacaguagguuaguucaucuguauuucuauuguccaccauaacagcuugaagaaggugcuucaguuuccugguggggaagcugucaggugaccuccaccacuggcaggucuccugccucagguaugcaaaagcagaggggcugggacugacuuucuuccaaaacuugaacuccauccccuccccaggcuacaguuagucuggggaugggcccaaaacaaaugcuuuuuagcccaaggucaagagaccuagagggggaaaggaugcagcugcaaacggggcucacgugaccaaagagccggcccaacagugccggauggaacgguccucccucccucugcaaggaaaggaacgcuccugucaucauauauacagggugagucaugaugcagggcaccagcagaggagaggcccccacagacggaucugggaucugaucuuagcuuggaguagauccacaccaccucugccagccaggaagacaccccacugggaaacacccuggguuuucuaccggaguaaaaggcuccuaagaacaaggguagcagcuuucugugagagaguccagcucccucaccuucaucuugagccccagcuacagaggcuaccuggcaggcauagauagauagauagauagauagauagauagauagauagcaucagcccuuccauuucgugcucgaucguuggcaugaaggaaaagaccagaacaggggcgggcuuuguguucuggagauugccagccaaggguuacacauuccucauagcacuuugccuggguucaugagaccacggggauccaguguguuuuugagcugccgcauggucuccacgcccacggggcccacuuccucuuggagcagcugucgcuugcccaguccgaugccauguucuccagugcaugucccaccgagugccagggcccgccuaggaagccaauugaaggaacccccagcacuccucccucagccuccgcccuccccagcccccaacccuccccgguacaguccucaccugcccagauuuucugcaaaggccuugacccuccucugcuccucugcaucaucugggucgaccaggaggaugcagugaaaguugccaucacccacaugcccaacgauggcuccuaggggcccagagaacaguaagugucgccucuagucuccuugcccaggccuuggcuaaccccagcgccucccagacggcagugaaguagaacaaaaccugugaguuuugaagcuuuaaucuccuccuuggucucuaccaagaucucuggcagccgggagauggguacacacacguccguggaauaggccugaaucggaaggcaagccugugugauuccccccaucacccacugccuacccaaaguuaagggaucacuguggucaagccuaggaccaauccaaggggucuugaugucgcggagugacacaucugacccacuggucuucuucgcuagcccaggucuucacuacuccccuggaucuaagccuggaccccaugcagggucccagcagccccacccuucugaacuucugcauaaucugcccagccgucccaucuagcuagacugccuccuuccucuccauuucuuccccaggaggcccuuccaauguuuagaauuccuaagugcucaacacuauaccugaggcugacuugugaacuccuaaguuuggagcaaauuaacaguucuuucucucuagacucuggaauagcugggugcaguggucuauagccccuuguccucacacccacucagccagcccuuggugggccucagucuucucuaugugaguggguagaucccaccuccagccccagcuucagcucaccuuacuuccuggacucagggccaaggcugcauaccaagcauugugccgcgcugcccaaaguucauugcgcuuuucggccuccuuggcccaggagaagugagagccaccauuauccugagugauugccucuguaguaggcacagaaaggcugaugguuagaccccuacacugggacagccucagaccucacagcgccguguccccggcgcaccugugcgcugcagcuguuccgccagugucugcugggaaccguggaacuccaggaaaagcgugggugccacggggcaguuaaguuugcugugucuguugcaggcauccaucaugacaucaucuaggaacucuggaaccagggagagggcugaucaggugaggccuggccuucuaagggggccuuuucgguggaacccaccccccuggcucaccaaugcgagccacgggcacugcagccuggaggaucugaacugugcuguccacagccgcuugaacacuggggaacgcacagguggcagccaccguugcuuccggcgcagggugcaggcgcagggugguugauguaaugaugcccaggguccccucagagcccacaaagaguccugugagauuguagccagcugcacucuuccugggcccaggaacauacaagguaggugagcgcccaggccgugugagcgacuacaacuacagaagucaccauagcuagaagacagguuuggucugaucuccugcagccccagauugucaucacagaguuugugguuuaaugacccagagaggccuugcacagggagagccaacuccagcugagccuccagaguugcagggugcuccugagugucacuuaccgauccaauccaggaggcccugcaacugggucaggcagugcucaccuguaauggcggccccggccugcggugugaagcagccugccgucaggcagcacuaccuccagguuaaucacguugucccgcaugguuccauagcgcacagcauuggugcccgaggccccgguggcugccaugccacacagagaagcaucugcgccugggucuagagaaugaaaugcuggagagggcaacugcagaggcccuuucccucuugugggaaagauggggcccugugaaaucccucagaccacgcccccaagcccucggucagguacucugugguuaguccaaggccuaccaacaggaaaccaaaggccacugucacgcagguggguauugagagcuuuacgggugacuccaggcuccaccaccacggagaagucuucuguauucagcuccgugaucugguccauaugggucagguugaugcacacuccacccugguagcaagggagucaaaaacagcugcccaaccuaggucucuaggcccgaggcagcccgcuagagccccauuuuauggcugaggccugcagcaaccauaccaaagcucugggauggcaggugaagagagcuguaaauguguccuguauaaugggaccagacccagggcacccccacuauaccugcacagcacagacuccccccucaacaccggugccugugccaaaugggaugaugggaacaccuugauuguagcacaggcuugccacucggcugaccugguccacauucugaggccaaaccacagcaucaggagguugacaccuagaagcaggcaggcccagagguuugaaaaggauggaagcuucucacccucucuuauccaggaaccugcaaugguuuaaggacccaaggacagggaccucagcagaucagggcagagagcaccucuccguguaaggaugccagaacuccaaacaggugaccagagagacagggacccucagucccuucugauaccugugcaucgauucaucaugcccguguugcucucugacugcagaagcaguggacacgugggggcucccuacaacugccuucagagccuccacaaaguccuggcugaguccacccugcaggggagaaaagugcgagggggucaucggaaagacagucggagggagccacagaccugcccuguggccgggugggaagaaugaggggcuggucaaccugcaaggugacgucacugagccccgaggacauuacgucgggcucuccacccucugggaccccauccacaaguagacuuauaccugcgacccccuggagcagaaacuccuccagggagacagccucuggguggccacccgaaggagcauggccauagccagaccgcagcuaaggggagaauaacuaggcggagaggaagccuugccagccugccucucgc

SEQ ID NO: 4794 - RNA, 27834 nt, Mus musculus
gucacagcuccgaggacucugggaacggccgcucgcuccacaaggugcacgcuugcgcaaaagcgcuagcgcucgcccuucccccaccugcagucgcgagugggugacaagagcccccuucuccgcgagccucgugacccggaaccgcgaguggaggcuagaccccuccagguaugucugcaaggccgggaugcgcgggcccgggaggaaggucgcgucugcgccggagugggagucucaacuucgacgccuugcgggccgcggcgaccccugggcguagggucgggccucgagcucuucugagagucggucccuaugggcuguucgcggucggcguguguggggucggaggaggacgggcagcucccgggcucagccucccuuuggggggagacgcgccacugcuggccgucgcggggcucaggccgcgcgggggcgagucuggaagccuggcgggcgggcgcgcgcuugacccuccacgagggugugggggcggggcucacggugcuagccacgcccccacgguggcuuugcgggcuccuggaaccuccuuguuccuggugucugguguuuccaguuauauugucacggaauuaucacgucuaucccguuacuuccgguuugagcgucaguauaacagauuuuucuuuuucuuuuuuuuuuuccuaacauuggcuuuucuuuuuuucuaauauugacuuuucuguuuagcuuggguaaaaguuuucauauaaguauguugccgagguccagccucagcuugaggugaggaugguccugagaaaggggugagugggaguggugcugacugaauaauauaugagucaguaguggauacaagcugucaguucauguguucucuugucagaaacugaacccagucuuuuauuuacuaaagauuuauucauuaaaucuuuuuaccgcuguuaaucauuuucuaaaaaaaaaaauccaugguuacauaaauuccaguaaucccgaaccuccaacccccguuucuuugaaaugaaagcuaagcaaaaguacauuuccuuaucucuuaaacacaguguucucuucacgggcagcagggcacaguucuugugguuucuuauuguuugaacacagucuguucuucacggcagcugggcauagcuuuugcgguuuccuggcacagcagacagucauuaaaguggcuauaagaacagaaaagugacagacuacugagguuaaaaugauuucuugccgggcaugguggcgcacgccuuuaaucccagcacuugggaggcagaggcaggcggauuucuacaaagugaguuccaggacagccagggcuacacagagaaacacugucuccaaaaaaaaaaaaaaaaaaaaaaaaaaaaaaaaaaaaaaaaaaaaaaaucucuuacugggcuggagagauggcucagugggguaaaagcacugacugcucuucugaagguccugaguucaaaucccaacaaccacaugguggcucacaaccgucuguagugggaucugaugccuucuucuggugugucugaagacagugacaguguacuuacauauauuaaauaaaucuuuacaaaguuuuaacauuuucgcaaguaaagcagguggcucugucugaucucucucuaggcauugaucucuccagucccuccaguagcaaggagaaugaaggacuaacuuuuuauaugcauaucaucuuuuaauucucuaaucuuuguuuccauaucuuaacaauuccauagccucagguccaagauugacaaucucuccauaaacguuaguucacuagccugcuguacuuucccguuaaacuacacucuccuucuaauacuaucuguuucugcaucauacacacguuuuccuccuauaagauaagcccaccugucauuugcuuguuuuuuuacagauuccuuuuuuuuuaaaagauuuauuuauuuauuauaugaaaguacacuguagcugucuuaaugagggagucagauuucauuacagaugguugugagccaccaugugguugcugggauuugaacucaggaccuucggaagagcagucagugcucuuaaccacugagccaucucuccagcccccagaauacuucuucuuuuccuauccaugccuuuuuuucuugagaccacuuuaacucucuaucguugauguccccaaggucacccuggcuaacuaaugcagcaggcauuggaucaggguacacguaucuccucauacaauuccaaguuuaaagauaagucacauaaugagugcuuuuuaguaaggaccaucuagguuuuucuggccuuuguaguuauguugucuagaucuuuccauggccuuaaggccuguuugucccuaguccccugcagccccaugaccacccccauuccugugaaccgcuucuguuucaucuguuaagaagugauuaguucugaguaaugggggaggcguauucaccagaaagagaaauugaaaguaaaauaaagacagcagaucagcuucagggcaaccgcaaccaucagcacaugguauccacaaccagguaaugcuccugggcaggaacucugucacgccgccccuuacgcagcccugccagacucaguaauacauauuauaccgucgccucugccuaauccuccccugcuagccccugcuagccccugcuagucccuuugucuuccuaguuucauuucuauacaugauuuuaggcaucuauaaaucuaggaaccacaaaucagaaagcauguuuuugguuuuuuuagaguaauuuguuuaauugacgauaaccaguugcaucccuuuuccugcaaaugacauaacuucuuuuucuuuuucuuuuucuuuuugguuuuuuugagacgggguuucucuguguacuccugguuguccuggaacucacuuuguagacuaggcuggccuggaacucagaaauccgccugccucugccucccaagugcugggauuaaaggagugcgccaccgcugucuggccuacuucauucuucuuuauagcugaaaaaaaauccauuguggaguuagugagaaggcucaguggguaaggacucuuccagccaauacaaaaacucugaguuugagcccuggaacccauccguacaguaggaggagagaacuggaggaccuacuccugaaaguuccaugaccuccacaugcacaugaagaauuaagaauuccguuaugugcccggcauggaggcacccgccuuuaaucccagcacucgggaggcagaggcaggcagauuucugaguucgaggccagccuggucuacagagugaauuccaggacagccagggcuacacagagaaacccuaucucgaaaaaccaaaaaaaaaaaaaaaaaaaaaaaaaaaaaagccguuaugugugccauguuucuuuauccauuccucugguguuacaugccuguguugguuccauaccuuagcuguauugaguaaugcugaaaaaacaaacaaacugaaaacuauugcugugcaggugucugugauauggggaucuuuaggugaagaaucuaggacugguguagcugaaucacguggaagaagaaucauuagucucuggagaaaccucuagacugacucccacagcuggacugguacauucccacuggcaggggguagauccaucugucuacauucuugccaauauuucuugguuuuauuuauuuguuuuuaaugacugccauucucacuagggugcaauggagucucaguguaguuuugauuuguguauccaugaugugagguugaacauuuuucuacuggccauuuguauuuuaucuuuuaagagccgcuuguuuugaucagaguuauggugggaaguagggaucuugcuucaaagccuggucuaucaugacaggcaauauuuuugagaucuuaucuagcucagcuauccagguugcccacuugguggccgucucugcccagguauuuauuucccuugcugguguuuuuagugauguuacaagugaguaauagcaucagugcuucuggcacaauaaugucagacccuugguuucaugggggagcuuuuggccauuaguaacccuucuuuccaaggcuauacaugggcguguagcagcaaagacccacacuugguaaacacuugcucaaguugcagaaguccauuagggcaggagagauagacgugcuccaggggccgagaggucaguggucgcauggcauucccugugccauggucuucucggcucccccuuccacauucugccuuuucuuucuuuucuuuucuuuucuuuucuuuuuuuuuuuuuuuuuuuuuuuugguuuuuugguuuuuugagacaggguuucucuguguaguccuggcuguccuggaacucacuuuguagaccaggcuggccucgaacucagaaaucugccugccucugcuucccaagugcugggauuaaaggcgugcgccaccacgcccggcucugccuuuucugucccaagcggggagaaagguagcauaauuuaagauuggcagguuuuuagggugaggucaggagugucauagcuagguguaaugcuguguuaaucuucuguugcuuagccagcggugugccuuuaucuuuggggggcugucaggcuuaagcuuugaucuucacccuuaagcaagacaaacuggaccaggugguucugaggucuuuggagaugguuucuggagggauguggaagaauuuggaacuuuggguuagaaaacccuaugcuguaaccagaccguagugggccauucuggugggaguuaagaccauaacaccaagagaaauguaaggagcuggagagauggcucagcaauucagaguguuuccugcuuuugcugaggauacaguucaguuucuagcaaccauguugggugacucacaaccaccuauggccccagcucuggggaguccaacacucucuucuggccucuucaggcccccacacauagauggcguacacucauaaacacacacacauaugcaaaaguaaaaacaaauccuugagaaacacugauagugaaggguacugagguuucugagggaggcagggacuucucugaaauggggcuagaggccauuuauagccaguucugccugagaacugagcugcuuucuguccugagaacuugaaugaggcugaauucaacaguaauggacuaacuuguguggagcacaucugaagacaggaugggggcagaaaacggggauuagugauuaagauacuggcugcucuugcagagacaugggcucaauuuccaacaaugucuuccagaugacaugcagacuauaucaaggauacugcucacucuucuuauccuaguguacugugagacagcugggcagcaaagagagggagagagagggggagggaaggagggaggaaggggcaacacugugugguuuggugggaaagggagggaguuuaaaguuguaggcugcaaggcagaugcauagaaaagagcuacaauuguuagagacuagcaucauuuaaaggagaccugcucugcauugagacaauaggaaaagugcucuaggggcuaagucccgcccuaagagaaguuccuguuugucccaaggcacagaucaccuaaaaggagagacccuaaauuaaggaugccacugaaggaguccuuuguuugaaaaccaccaccuggggagguguuuccuccagauaagcuuggaaggcaggcaggcugacucaaguauggcccaaggggaccaagcuacuucuccagcuggaggcaaguuuugacauugugguaaagguaauagaugcaagaguauaggguuccgggaggcucaugcaaguuuguagaaggcugcugaggccaaccagaguggccauugugggaagccgugaagguugucaggaucaaaggaaacuccaauucuucaaacuccaaaagauuguccaaauagucaaaaaaugagcucaaccugcucaaugggaggauuucuggaaguuaaauaaaagucaauauuucuuaggaacuugugaaacugguucccauuugcccaaaguaauuucuccuaccuauggcagagggucauauggcuaccugugacaccuaucagcuuaucaaagcccaugguggccuccaggcccccucacuaacaaguaccuuuuauaagcauuuaacaccacugccuggcuuuuucuuuucgagacaggguuucucuguguagcccuggcuguccugguacucaagaccaggcuggccucgaacucagaaauccaccugccucugccucccaagugcuaggauuaaaggcaugcccauuuuuaaugauuuguuuuuuauuuaugaguacacugaaacugucuucagaaacacacuagaagagggcaucaaaucccaugaugcuugugagccaccaggugguugcugggaauuaaacucaggcuucuggcagagcagauccaucucuccagcccccaagacaccaaguuuucuuagccagagcaacuuuauugauuugagcaacaaacugaccauccagggaugcagcauggacucaggagcugauauuuggaacuuuggguuagaaaacccuaugcuguaaccagaacauagugugccauucugcugggaguuaagaccccuacuguucugguugagcagguuuuaagcucagaacucaugcucagcauguguaagacagaucaaaaucauaaucagguggaucaucuaauauuacaggaaaggaaccauagcagguucuuaauaauagguuucugggaacggaguaagaagugagucaugguuucuaugguuggaacauggaaggaauugggggaaaaaaagaaacagaacacaucugagcccuuggcuugaccuuaaaugauauucaagcccuagcaaaugggugucuggcuuaagauggcaacacucaugccaagcuucaucuuucaucgcccacaccccauuuuuauguaaguagaucaaaccauugaucaccuucuguauacaaaggguuauauuguauucuuaugagcgucaguuuaauagauccuauucauucuugaaugagguuaauaagggcauugauuauaugcccugugaggaggaguaaagacagacaagucagaggaccagauagggucauaaauagggaguuuaggcugggagaccuuuuuuuguuuuguuuuguuuuguuuuguuuuuguuuuuguuuuuuugagacagaguuucucuguguagcccuggauguccuggaacucacuuuguagaccaggcuggccucgaucucaaaaauuggccugccucugccucccaagugcuggaaucaaaggugugcgccaccacugccuggccugggagaccaauuaaacauguuuugaaaccaauucuaggaccauucauugucuuucuuguucucucuacaguagauuuuguuugaccuuggcuaaagcauccuuuguggcuccagagugauuaacauagaaacaauaagccucucccaaagccugcaaaguccccauuucuauagagcagcaacgcuaaucuucuguucuguaggguuacuucagcugaagagucugucuaguucucugguuguuaacagacauaugggagaccaagccucacaccccaguuuuuacagugauaccauuuugcucacucaguuugauucacacaggacauacauaaaaagaugaucccuauagagaccuuucaaacuccaaaucucuacaaccauaccaaguaguucuaacuccugaggcccaggauagugaggcacugggacuggcccuauaguuuccuaauccagcccauaauaugcagagaucugucuuaaaagcuagaaggacucauuagggcacgcguagcacccugguuauaauggagccugucugaguguucaguacuucucagucauaaaccuuaagcugacaguaguuuaggcuagacagggauuugaaaacccaacagcuaagaaucaaaauuuggcuagucuuuagcgggucucgcagaguaaguagucccaucagugggucuuccagggucuuuuuccuccagcgccgcccuggggugaggaugguggggcggggcggggcuggcgaauccaggaguaaaguccaucaaccuugacagucauuggugugaucggguggggugauagcaacuuguuaggacccuucaaguagggagucagagaguccacuugaagccauuuagcccugaccagaucaccaaacuggacaccaugcaggacagugggcaagggcguacacagcucucaacugggaaaacacauuguccugggucuuuuguaggacauggacagacuagaguaaguguugguuagauauuucugcaacuaauguggacuucagucuagggcacauuuuaggaggucuucuucacauaauuacauaaggagucacuccuucaucuagggaguauuucuuuuucuuuuucuuuuucuuuuuuuuuuuuuugguuuucugagacaggguuucucuguguaguccuggcuguccuggaacucacuuuguagaccaggcuggccucgaacucagaaauccgccugccucugccucccaagugcugggaucaaaggcgugcgccaccaccgccuggcuuuuagggaguauuucuaacucuuaaaagagcaaaggggcgaggcaugguggugcaggccagccuggucuacaaaaugaguuccaggacagccagggcuacacagagaaacccugucucgaagaaaaaaaaaaaaaaaaagucugguagaauuugcuaaaaccuagcccugggcuucuuuggguggggagacuuuuuaaugacugcuucuauuuacuuaggagugaugggucuauuuaaguuguuuaucugaucuugguuuaacuuugcaagaaaauuauuuauuucuuaaauauuuuccaacuuuguggguauagguuuuuaaaguaugacuuaaugauucuuuggauuuccucagugucaguuguuaugucuaccuuuucauuucugauuuuguuaauuuggauaaucucacuauuccuuuuaauuaguuuggauaaggguuugccccucuuuuugauauucucaaagaaccagccaacucuuugucauugauucuuuguauuuucuuuguuucuauuuuauugauuucagaucucaguuuaauuauuuccugcugucuauuacuaacuccagcauaucacuaauuucuuuaugaaggcacuuauguuaugaacuuaucucuuagcacugguuucauugugucccauaagauuggauauguugugcaaucauuuucauugaguucuaggaagucuuuaauuucuuucuuuguuucugccuugacccaauaguuguucaguagaggguuguucaguuuccacgaguuuguagauuuucuuuuuuuuuuuuaaagauuuauuuauuuauuuauuuauuauauguaagcacacuguagcugucuucagacacccuggcagagggcaucagaucucauuacagaugguugugagcuaccaugugguugcugggauuuuaacucaggaccuuuggaagagcagucagugcucuuaaccguugagccaucucuccagccccgaguuuguagauuuucuauuguuucuguuauuguugaaggccaacuuuaaucuaugguggucugauaggaugcagucaguuauuuucauuuucuuguaucuguugagacuugcuuugugacagaguaugugaucaguuuuguucuccaaaagcuccacgagguguuaagaagguauauuuuuguguuuggaugaaauguucccguagauaucugucagguuuacuagguuuauagcaucuguuauagcaucuguauagcaucuugguauagcaucuguauagcaucuguauagcaucuguagguaucugucagguuuacuagguuuauagcaucuguuaacuccaggguuucucuguuugguuuuugucaggaugaccuguccuuuggugaaaaugggguauugaagccuuccacugagugugugacggucagugugugauuuaagcuuuacuauuguuucuuuuacaaauguggauaccacuguaucaugguccagcacaguggggcucagaaccugaaggaggauguguggaaugggggaaagaagacuugaaccaacaagugcagcucacacacccuggcacugagacaccucaggccaccuuuauuuauuuacauccauuuucucauguacagucucuuugaagaacuuccucuguauaacaauaaugugcacacuggacuuuccccuuccuccuucuccuuagucuccaugguuuccuucuaacccauaaacuguaccaagaaaggagaaacaugcuucagcaagcaguuacuaucuaacccagcucagugguacuagccaagugaccguggucgguauuaauuuugguuacagucuagagagaugauaaacuacauacccaggaaauucugauuuaauuauuggcaccaagcaucuccucauauccuaaucaggagauagaauucuucuaaugcucaaagcuuucggcagauuaguaaccugaaucaguuccugguccuugcuuggcucgccucugaacacuccuguuaagucuuggaaccaaugcucccuucucaccuuuuaauaaucaucuaguuguuauuuggacaaauuggugggcagauugcugucagaacuaaguucucaucagaagaaaacaucugaacuuuagcugauguacccagaccagggccuuguguugacucaaccacaucaccaucauuaacaaucagaggaguagugaucuguuccacucccaugaugcucagcgacaaacaagaaugaaccacaguccaagcuuccuuuuucugauucugggcaagcaucugucauagacagaguaaagguaaagacuugcacuagcaaagccaggaaugcaaacacaaggcaaaggugaacuaagcguucccucaggaaagaccacaagauacugcaugcauauccccacagguccuugccguguggagagcagccugcauuacacucaugugccuuucccagcagaggccugcucaccuccaccuuuguguuuggggcauaaauguuaagaauuggcaugccauuuugguggauuuuugcuuugaguauguaguguccuucccugucuuuuugauuaguuuuggguggaauucuauuucguuagauguuagaauggcuacaccagcuuacuucuuggguucauuuguuagggaagucuuuuccaacucuuuacucugaggucuaugcuugauuuugaaguuuuugaaguguguuucuuguaugcagcagcaggagggauccuguuuuuucuguuagucuauggcuuuuuggggggaauugggagauaucacugaccaaugauuguuaauuucuguuacuuuguuagugggggugguaguagaugugugugcuuuccuucuuuugcuuuugcuaguguagauuaucauggauauaguuaaguuccuuggguuggaguuuucuuucuccugucccauguaggguuggauuuguagauagguguuguuuaaauuugacuuuaucaugaaauguuuucuccauuaugguaguugaaaguuuuguuggguguaguagcuugggcuagcaacugguccuuuagagucugcaggacaucuguccaggcccuucuggcauuuagcgucuguauugaggagaaguggguguaauucucauaggucugccuuuauauguuacuuguucuuuuccccuuguggcucuuaaugugcuuuuuuugucuguauguuuagcguuuugauuauuauguggcgagcagacuuccuuuucugguccaucuauuucguguucuguaugcuucuuguaucuuuauaggaggcaucuccuuagguuagcaaaauuugcuaugauuuuguugaaaauauuuucugggccuuuacgcuggguuuucuucucuuuccucuauuccuauuauucuuaggcuuggucuuuuuauaguguccuagguuuccuggauguuuuguuuuaggauguaucuguuucuccuauugugucuuuagugccugagaucuucugucucuuauucuauuggugaugcuugcaucuguaguucauguucacuuaccuagacuuucugucuccagaguuccucccuuuguguuuucaggucuugagcacuugguaccugcuuguuucccuggcuuucuguacuggguuaacucauugccacucuaaggccgcugucaucuucauaacguugguuuuaagaucuuuuucuugugcuucagcuguguuggaguuuuuuggauucugucaccucuguggucuucugcccugugugaccugugauugaacagggagucucugcccacguugaggacuggaacuucugguggcuggcuuggucucuugcccgagucaggggcaggaauucuggcggggugugugacuucugguccaggagggaguugucuuccuucagagcugguguggccuaugguugggaagcccauguccuuuauuuaauacuaauuuuuguuguuuucaucuauguauuaguuugucuuguauguaugcuccaugugcgcuggugccugcagaggccagaagagggcaucauguccccugaagcugguauuauggugguugugaaugccuggugugggugauaggcacugaacuucaguccucuggaggagcaggaaaugcucuuaauccuugaguuucuucaccccuccauuuuuuuaucauuuuaaaaaaguuuaugugauagguguuuugucugcguguaugucugagcaucacugccuggugccugagggcucuucuggaacuggaguuacagacaguugugaucuaccauguggaugcugggaauugaauucugguccacuggaagagcaguggauguucuuacggcaccucucuaguucccaaaggggguagaaaauaacaccugcagcaauguacuggcugguuuugugucaacuugacacaggcuggaguuaccacagagaaaggagcuucaguugugaggaaaugccuccaugagaucgggcuguggggcauuuucucaauuagugaucaaggggggagggccccuugugugugggaccaucucugggcugguaguuuuggguucuauaagagagcaagcugagcaagccaggugaggcaaaccaguaaagaacaucacuccauggccacugcaucagcuccugcuuucuccccugcuugaguuccaguccugacuuccuuuggugaugaacagcaguauggaaguguaagccaaauaaguccuuuccuccccaacuugcuucguggucaugauguuuuguggggaauagaaacccugacuaagacaagcaacuauaauaauguguccuggaucauucuagauauugguaauuugugucuuccuugcuucauuuuagaauuuuguuugguugggcaaggucuugccacauagccaggcuggccuggaacuugugauccugccauagcccgucaaguacuaccccaccaccaccaccacacccagcugcuuucccuuuuucuuggccaguuugguuaguuuuuuuggugugacugauuuuucuucggagcagcuuuggcuccauugcauuccaacguguuuccuguuugagauugguuucugcucucaccucauugcuucuguccucauggggcuugccuugaguuaaaugcacucaagguuagggugggaaugagcuaaggucauuaacugaaaacucauagcaccagguauugauuguauccauuccugccacccuagcacuugguagccugaggcaggaggaucacaaaauugagguuagccuaggcuagaugaugagauccuaccucaaaaaguaaauaagaggagcagguuaguguauacagcaacucucucuuaauugcuuuaguugcucuuucuuagauauucucauuguuacuuaauuccuugcugggagcuguuuuaaggauccagucaagcaugcuaagaauucuuuguuucaguuaguguuuuguugcagugguaaaugccugagagaaacaggucaaaagaggauguauuguguggcuccugguuucaguaaacggccccuugaucccauguuuuuaaaucuaaggugacacugaacaucacagugggacauaguugaacaucacaguguguuacagacugccuaucuccucucacuucuuggcaaucaggaagcaggaagacaggaagggcuggagauugcuuuuaucuccugggucaugccuuggcaaccugcuuccucuaugucccaccuccuauuuuccacuaaggcuaccauaaaaguccauuggggauuaaucuaugaaugaagggggagcucuccugauucaaucagugacugaaugugaggcaggggugagggaaggaccugggggcuaagccuuugauuccugagccuuucaggggucaccucauugccagaccuugacagcuguacuccaagcccuuagcauucauccuuuuuuuuuuccuuguaauuuccaucuuugccgaaguuccuuauucauucauauuugccauuaaagacuaguguggggcucuuaguugcuuuaauuugcugauagcagccuuaggaauugggguucuggguucugucuuuuucucuugaugauaggcuggguuuuuuguuuguuuguuuuuugacaggguuucucuguguagcccuggcuguccuggaacucacucuguagaccaggcuggccucaaucaaacucacaaagaucugccugccucggccuccucagcauguaccacugccaccuggcagaugggaugucuuauuccugccuuuuugugugugugucucaucauguuugguugaaagcagguauugccagcaugcuuuuucugaagaggggguaguagucugagcagaccauucggguaucaagcaggucagauccauaauaacaagguuccuuuucuuuucuuccagcugugccuuugugcuucugugccuucaccccaacccagaaaaugauggggucccaggugaguugucugcauaguacucauuugguguuucauuucacucuuggaauguuauauuuauagaaaaugaaccagaaagcauaaugaguuagaucagggcuagaaagcccuuccuguaccuuaauguggaucauagugggguuugccccacaccagugcuaugaagggcagagacaggaggauugcugaagcuuucuagagucuuaacuccauggucagugagaaccccaucugcccuugacauuccggggaggaccucauguuuuaaggggcggcagaggcucuugagggacauuguuuuaguaucuguaccuuagauaaucacugaucauugcuguuacauuauauaauaaagaaaauaaggaaggaaacaaaaacacauucuuaacaagauauggcagaaacacucaagucaaucaaaaucucuucuguagcuggucauggaggccuuagcugguauuuagcacuguuuuccuccacucucagccagcaggccgcggcucucuuccuggaggagugacucaugcuuccauuccugaggggaaugucccucugucauccugccugccuuagguugggguaguuucccacggacuuucaucacaggacaugguagcaacaagagaggcucuaaaggaccuccuacacuccagauaaaaucuuucuuaccuccacugaggaggagcaauacaauuuccucuugguaaucuggauaagucaccucucuuaacucuucuuucauagucugcuggcuucggggcaucagaagccuuaaggaggaagucugcgcuucagucgagugagauguuuguugugucucauugcuagagaacuucccccaacuggaaccaaaacuucuacaccagcagaacuuaaggucauaggaacaggaagcaaaaaaauuccuagugggucacuggggugacaguaaguggaacuauuccauuuuccacuccuugauuccuggaccuauggaucuuggcuuugggaaaaaaccuagcauauauuggacacugauucaaagacagaaucagacacugauucaaagcauacacucucuuuaggagagcccugcccuagcccuccaugcugcugcuaccuaauuggcacuauaacugugucuccaaaggccauuccaucuuucuaucaggccagcugcuucaggaugguggggaacaugguaagaccaguagauuccaagucaugggcccauugucaugcuucuuuggcugugaagugaguuccuuagaaacaauacuguguggaauaccacgaugguggauaaggcauucuccacagauggugguuuugacaaaagccuuaugugcaggaaaggguacaucuauaaccagaauaaguaucaauucaaagcauuguccuuuucacagaggaagugguucaguguaaucagucugucaccaggucacuggcuggucaccccagguaauuguaccauaucuugggcuccguauauuggucucugcuguuggcugugcucagcagcagcuguagccaggucagccuugaugagugaaguccguggugagguaugcaccauagccacuuuguucaugugcccuuaggggaaugacaggguuggcuggggaaagaggcugacuguccacagcacaggucauccuaucugcuugguuacugaaugccuccucugcugaagucaccuuuugaugggcauuuacauagaacacaaaaaucuucacacccuuuacccauuuggagaggucaguccacauucuucuuucccaguguuuuuuucucaccaucucuucaaccaugcucuuuccaagucccugaccauccagccaaucuauuggauacagcccaugaaucagugaacauggccauuuuucuucccaaacaaaaucuaugauggcauguacugccugacguugugccuacugugacaauuugccuucacuggugucuuucaggguugucccagagggggucguaaugcugcagcuguccacuucuggguggugccugcauaaggugcagauccaucaguaaaccaggcccuagucuucucuucaaaccaaucacagggcacaugacaugagacuauaggcgcaugccuggcaguagauaguauuguaaugagaguagaaaccauagacauuuggagaacuucauguaccuuguuugugccuucaggaccugcucaggccugaucguguguagaccacuuccauuugauaguggauugcugcugugccugcccuacuauggcacaguggggcagauaacacccagcucaugauagacagcagcucagggcgcaugguaacuugguaucccuuugucagauguucaguuuucacuaaggccaauugcagaccaacagcugucucucaaaagaauaguugucugcagauaaugguagguagagccuugcuccaaaaucccaaauguuucuccugugauucaccuacaggggccugccagaggcuccagacagcaucccugucugccacugacaacucauauaccaucaggucugcugggucauaugguccaagugguagggcagccuggaacuguugaagagccuuguguuccaggccccacacaaagcucgcagcuuucugagucacccgauacaugagugggaauaaucacccaagugaggagugugcugucuacaggauccaaauagacccucuaagcccugugcugccucuugguggugggaggggccgcugcguaaugcaucccuaaccuuagaaccgaugucucugcuggccucgcaccccuagacucucaagaauuucacugagcgcacgccuuuaaucccagcacuugggaggcagaggcagguggauuucuuaguuugaggccagccuggucuacagagugaguuccaggacagccagggcuacacagagaaaucuugucucaaaaacaaacaaacaaacaagaauuucacugagguagaaggcccuuggauuauaguuuauuuuccaucucugauguauguauguauuaccaacaagucugaagugguugcuaccuucuguucacucugucuaaucagcauguccucaauauggugaaccgauauuuugugaaauugaugaucaagauccaauugaaagcuucaggcaggcaugguggcacaucuaaucuccgugcuuuggaggcagcugggugugaguuugaggccagccugguuuccagagcaaauugcaggacagucaggcuguacagagaaaccucugacucgggugcuggaaauucagcugaaaagaaauuguuuuuggugaucuuauggacagguacuaggaaaaggggcauuuaauagaccaauaauugcaaaccgugugcuaggagauguguuaaucugcucagggacaccaccccugccugcauccuucaaguccuuaauggcggcacacauuucugcaauuccuucaggaugugcuacuguuuuugauuuacuauuuucccugaccgaggcaacucuaaaggcuuccaguuagccuuuccaacaguaauagcucucauuccacaggucagggaaccagugugagaauucugccaacuucuaaguauaugcaccccaguuauacauucugggacuggggaaauaaccagaggaugaguuuggggacccaguuggacuucaaccaaaacuccaugaaucaucugaccuccauaagcucuaacuuuaauuggaggacaacaauguuuuugggguucccgcaaucagcaagaaucaguauccaccaauagacccagauaaucugauugcuuccuuucccccacuguacaguuccccuuguaaaaggccauaggucccucuggggaacgacuggagaaaggcuaagaguaacauuuuuaggcauuuuauuaagauccuucauccauggacuucugggucugcaaacuggcucaaguaugggaaucaguucacaggcagagauccccuuuugccaugauccaguguagccuuucuuuuauuuguuaagagauuuuccauuuguacagcugcuuuaaaaaaagaaaaaagaaaaaagaaugcaguaggcuucuuaccauuucaugccagaaguaccaugguugauuaaccagcaccaaagguccaugagaguuaugccauuauaaaauucaccacagauuagaccuauauggacauugcuuugccugugcuucccauuauaacuacagucaucuugucuuuggugacucagugcugccaccugcugcuucugcuugggggccugauuagacucaggccuggucaacuugcauucaauucauccaacugagcagcaacauccccaacccuaaggccuggcgcaaggaaaggggcaacaacaaagcuuaucaaaugugcuggugccccucuugccauuuugcaucuuaugggauuagugaaggacauucgugauuaacugaguuaccaauaaugcguugauaucacacuaaaaaaaagcacguccccuuggaguuaugucgccagagugagugcaggugggguucucucggccugccugucccuguguguguguagagucuguaugugcaauaugugucuuaugugugggaguggucugucccuagcaaaggguuugcucugucucuauugggcagcccagaaagcacuacauggcaguggggaacuuuacugaaaucuaaguuuuacaagggauucagucccugaauugagcugacuccagcugacagauaacacauuaacuagagauuaugauuauuuaacauuaugguggguuuuagggaguauuugcugcuuucggcagaugguacacaugcauugcccugggucggggcauuuaaaauacauaagauuagagcugugcauuagcucagguuguaaaaguugaugacuuaguacacccaaggcaucuaauguuuguuaucacauuguucucuuaaaggcaggcuaaaguucgaggguacaguaacauugacagucuuaaauuuuaagggaccuuaaaauauauuagcugugaaguuccagucucuuagaauguaagauauucucagaauauugcauugccauguguccugguguauuggagcccagaagaggguaucugauucccugggacugggguuacaguggucaguugccaaguggguucugagaauccagcugggguccugugaaagaguagccagugcucuuaaccacugagccaucucucagcucugucagauaaguguuuuucaaagauguucuuagucuguacuguauuuuggggguuuuuuugguuguuuuuugauuacucaggggguuaacuuugguuuuguuuuuuggguuuguuuguauguuuguuucuagacaggguuucucuauguagcccuggcuaucauggaauucucuacucucauagaccaggcuggcugcgaacucaagauccuccuaccucugccucucuugugcugggauuaaagaugugcaccaccaccuggcuggguuuguuuuguuuaguaguauuguggaggugagggggagagaauccugcuguauagcugguguugacauggaaacuguguaguuggggcuugccuugaaaucaugguacuaccucagcuucucaaguucugggauuauaggugugcaccagcagagcaaaugacaucuuuuggauuuauuagagcauaaaacucucucauucucauuaauguuguaaggggcaugguguccacacccuuagcccagcagcucaggaagcagaggcagguagccucuguaaauucagcuccagauagugcuacauaaggagacggucuuaaaacccguuuugugugugcuacggcaucugagccuugacuuucaggaguugguucuuccaucaugugaguuccagggauugaacccaggucgucagcauugaugacuggcuuaccaccgagucaagcugccagcccucuuuccuuaugccuuguguaauaacaguguacacaguaaaguacuagggagggauauacucugcuaauaguguacuugccuugcauccuugaggccucgggcuugaucucuaguacccccaccccaaacccagaaaagaaacggucugcagugugagcgcuugugcauaccuggguuaagaagcggcugccagcucccugcgaugccagcucaguugagcccuucuuggggaguuggguuuucuuaaguuacauuuuaaaaguuuugugcacaugguugggggcuuaggggaugugugucauaguguacuccuggaggucggaggacaacuuucaagggucaguuuucuccaccacaugguaaggaacucagucuucaggcuugacaguaagcccuuuuacccagguaacugucucauuggcccuuuguguucagauugcauuagcugguggcaguauaagggauagucuuacuggcagacagcaauacuuaccuaagcuguggcucauagucuaguuguagcuuucccgaaagcucacagaacccucacugagaaagucacuggcaaggucaggauaggaaguacagggcucaaugcugcuggugugucaggccgggucagagugugcauccagugcucaguguuugacagcacuguuugaugaggcagaugcucucuaucuucugcuucuggcucuaccacuugacugccagcucucgggaguugguuaaaagcaggcagaucuguuagauggauggaguauccuuaccugauccaaggcaucuugguguagaaggaggagagaaauguccuuaguuagcacauguccaggacagaccagagcaaguacauguaagaauccgcacauagagccggucgugguggcgcacgccuuuaaucccagcacucgagaggcagaggcagacggauuucuuaguucgaggacagccuggucuacagagugaguuccaggaucagccaggacuauacagagaagcuuugucuugaaacccccccccccaaaaaaaaagcaucugcacauaggcugaguuaaaaucugguacaguggcaucgaagaucuugaugcuaggccuuaaaaugccugcuuucaaauuccucccaaccauacuagaccagccuggugucacuagaguagcugcuguuuugcaaacucuggacacuucccucggcucuccuuuuuugaauuauuguuuuauugcugcuuuuuccuuuuuuuuuaaagacugggucauuuuauggcagugguucucaaccuaugggucucaaacccuuuugugggucacauaccagguacuuagauuuuauaacaguagcaaaauuacaguugugccguagcaacaaaaaaacuaugguuuggggucaccacaacauuuuccuuugucauuugauguaggccucugcaucaguguggauuugucucuuucuagcuuuuauuuuugaucccugacuagauugaaauguguuauguagaccaggcuggccucaaacucagcuagaucccccugccuuuaccucccaagugcugggguucaagguguguacuaccacaccuguccugaguaauguccucacuguugagagccgugacaaacaccggacaaguagcacaguugggacugugaacauggccagaguaacuuucccugugcccuuuccaucucccaaagcuaaccacucuagaaggaacugugucauuucagggauccguuucauucacugauguaacuguggacuucacccaggaggagugggagcaacuggaccccucgcagaggauucuguacauggauguaaugcuggagaacuacagcaacuuacuuucaguggguaaggacagcuuuggggaugauaggaguuguagacaguguaguuagaauggucaauucagaauucuccaagggagcuacagaaggaaaauggcagaugugauaucugaggcuuugaacaguuugaguacauuugagguuuacaggauuuuguuuguuuuuaaggcaggaucucaauuauguggcccuagcuggucuugaacucagagaucauuagccucuaacccuccugccccagugcugggcaaaagaugcacacuguggaaggauucaucuagcccagccuagcuuugaacucuguauguaagccgaguguaggguuccugauccucccaguuggacucucaagcaaucacagacaugcacugcuauccugguuuuauguggugcugggauggagcccagggcauuuuagguaugguagcuaagcacuuugcuaacagagcuacguuuccagccuccuuuggaacuaucuuucuuucuuucuuuuuuuuuaaagauuuauuuguauguauguauguacacugucacugucuuuggacacaccagaaugcguaggaucucauuacagaugguugugagccaccaugugguugcugggaauagaacucagagccucuggaagagcagucagugcucuuaaccucugagccaucucuccagcccuggaacuauuuuucaauuccaaaaaccuuuagagaugacuaagagcucaggauggcuuguaguuuugaucccuggcacacuuccaaauacuccucucuccagauuuaucagugcuugccugacacauuaguacugggaguuuuaguuauguucucaauuuaccagaaugaugaccuuguauuuaacccgugggaaugggcacagauuuuucaauacaaaaaugagaugguuuuagacagcagcaggauccuaaggaguagcuaguauacaucagggcuuuuaaaggucuagaccaaggcagagcacaaacucuuaaaucugcucagguaaaguagggccacaguagaaagaugaaaacgcaaccaugcucagcagccuugauguaagaaaagcuguaaacccagcauaugauugugucauaaggacccagacuuuccauuuucaauacagugaacucggggaucuuuauuguugguaugugagacagucucucuacauaguguuggcuguccuggaacucacuguguagaccaggcuagccucaaacucagagagaucugccugugucucuuucccaaguccuggaauuaaaggugugugccacccugccuagcuaacucagagaucuugcuaucuacuugagaggugucuccagagacuugaacaccacaugagaaaaggaaagguuuugaguuauuugggggcuagugagauggcacaauggauaaagggcccuugccauaaaaaacaucaugacuugaguugaacccuagaacccauggaaaagucagagagacaccugacucuguagagucuucugaucucuccucucuccccauguuuuguuucuuuuuggagacagagucuggcuguguaucccugacuggccuggauucacuguguagaccgugcuagccucaaacuuguagagauccaugugccuggauuaaaguugugcugagauuacagguguggaccguaaugccuaaccguuauuguuuuaaguuauuuugauguaagaggugugguucaguugguagaaugcuugccuagcauacacgaaguccuagacuggauugauuccuuagcagacccugaaucaaaaagauuuaaaagucagaacuggagagguagcuccgugguuaaguguacuuacugcagcugggaagugguggcguaugcuauccuauaugcugggaagugguggcguaugccuuuaaucucagagcuggcagaucucugugaaguugaggcuuccauggucuacagagugaguuccaggacagccgaagcuauagagaaucuggaagaaaaagaaaaaagaguacuuacuugcugcucuucuagaggaccuggguucaguuuccagcacccauaucgugguucacagccaccugcaacuucaguuccugggaaucugggaccuucuuccuagccucugugaguuuuaggcacacacacggugcacagccauacauauauacaaacgaaacacccacauauauugaaaaaaaaguuaauugggggccaguaguuaaaacaaaugucuguaauaaagaguauagcugggaauuuuaggccagucuggucugcauacugaaacccagucucaaagggggaagaauaauggaggugcacagagaagacugacaccagggucacuguuagauaggaugaagcgucagucucuauccucuguuccccaggccuggucacucagugucgccuacaguguuuucuggucacucaguguugccuacaguguuuccuggucacucaguguugccuacaguguuuccuggucacucaguguugccuacaguguuucuugguuucuaggcuagcuguuuguuguccuugagaguacugggaaaucuucaucccugaaacugcuaguuuucuuucuuuuuuuuuuuuuuuuaaagauuuauuuauuuauguaaauacacuguagcugucuucagacacuccagaagagggagucagaucucguuaccgaugguugugagccaccaugugguugcugggauuugaacucuggaccuucggaagagcagucgggugcucuuacccacugagccaucucaccagcccgcuaguuuucuuaugucaucuuacacuuaaguuuauuuuugauugugaccacagggaugaagagacaggaucucuguguguaguccagacuggguuuaaacucaggcguccugaguguuaguuaggauuacaggcaugagcuggaagcuuucaccuuuguuuggguuuuuuuauuuugggagggggguguuuguugcccaguuuuuaguuucauugguuaguuuuuuccagacaggguuucacuaugaagcccugacuguuuuggaacuugaugugaagaccaagcuggccuugaacucagagagauccgccugccucugccuccugaguccugggauuaaaggugugcaccaccacuacccagcuuuuuucugcccacuuuaaggucauuuuguccucgggaaacacacacagcagagcuuaagcgaugaagacggcucgcaguagggauuuuguggugggcacacuuguggggauuuuccacuccaacagagagcuuaagaaccuuucacugugcuuuguccuagaaguguggaaggcugauggccagguggagagggaccccagagaccugcagaggcagguggggucacuuacaaccaucaagaaccaaccaccaacugaagaaagaggcagucguuuuggaaagacauuaacucugaacacagacuuuguuucauuaagacaaguucccuauaaauaugauuuauaugaaaaaacuuugaaguacaauucagacuuacuuagcaguagaaacuguguaagaaagaaaggagacgggugugguggauuuggggaaccacuucuguaccugaagcaagagaaaccccacgcuggacuggaauacucagaauauaauggaaacggaagggcucucagccauaaggaugccaucuuuaaacaucggaaaauuaagagcuugguucagccuuuugucuguaacuacugugacaagaccuucuccuucaagucgcugcucguuagccacaagcggauccacacgggcgagaagcccuaugagugugaugugugccagaaaaccuucucccauaaggccaaccucaucaaacaucagagaauucacaccggagagaagcccuuugaaugucccgagugugggaaggccuuuacccaccagucaaaccucaucguucaccagagagcgcacauggagaagaagccauauggaugcagcgagugugggaagacauucgcucagaaguuugaacucaccacacaccagaggauucacacaggagagcggcccuacgaguguaacgaaugcgcaaaaaccuucuuuaagaaaucaaaccucaucauacaucagaagauucacacgggggagaaacgcuacgagugcagcgagugcgggaaguccuucauccagaacucgcagcucaucauccacaggaggacucacacuggggagaagcccuacgagugcaccgaguguggcaagaccuucagccagaggucaacgcugaggcugcaccugagaauccacacgggagagaaacccuacgagugugcggagugugggaaagccuucagcaggaagucucgccucagcguccaccagaggguucacauggcauaguccugaggcucaggcaggcugcugcagaaaaccugucaggccagaauucuucagugaagggggaagcccucaugaagaugcugaaggaacuugggaaauucuauugagauguaaucaaucucaaaaaauuaaaaaaaaaaaaaggauaccuaagaauauuauacugagggcuggagagauggcucggcgguuaagagcacuuccggagguccugaguucaguucccagcaaccacaugguggcucacaaccaucuguaaugggauccuaugccaccuucuggugucugaagagagagacaguguacucauauaaaauaaauaauuuuuuaaaaaaagauuauacugaaaguuauaauauccagcuaaagaguacauauccaaauauauguauguaucucaguauguguauauccagaucaauuguaaauagacauacccagcucuguuuccaugaguguuuuuggcuuuuugugcuucuggggaucaaaucuggggucuuaucugugccagacaagaugcuuucuuuuuuuaaaaccacugaucuauaucugcaguccuccgugaauuuuuaaaaaucuugaaugacuugaauauucuaagaggaauuaugaagcauauauagacaguaccuuagaaauuuuuauguaaggauaugccacaaaacacaaauuguuuuaaaucuguuuauguaaguuaaauugcuacuggaaaucu

SEQ ID NO: 4795 - RNA, 63235 nt, Mus musculus
ugcuaggcuccggcagccggaagucccgccuguggaguagucgucgcugccgccgccgccuccguuguuguuguggucgcuucgccgaaguccgcggcucgaagagccggcuccgucgcuucccgucgccaugaaguggauguuuaaggaggaccacucucuggguaagcgcggucggccugcggggccccagaucgcggccccucccccacucccgccgcccugccgggcccgcugggucgccaaggccccggcauccuggcgccucccacggacccgugucgcccuacguggaucucgcugggaguuccugaggggaucuguggcgagggacuccggggcuaggacucggggcguacgcacgcaggcagguugcgggcggagaagggcggacaggaagaagggguuccggcagcggcggcccugcuguccggcaagugcgaaugucagccugguuuucuucuuccccagaacacagaugcguggaauccgcgaagaucagagcgaaguaccccgaccgaguuccggugaguguggacuccccgcccccucaccccgcugucacccuuagcgucuaggagaggugucgggcgggcgcgcuaggccgugcaacaguugagaacuuaaggucucaagguguagcccagagaccgaggacagccugggguuccgccggcccaagcuuggggcuuaaggggcuggugcuguccaggggcaccagugcugaaucucccgaucuagggcagcaagcugcuugcagccucucggcucccucaccaauuauguaaggaaccguguucuaggacagggcaacaggucacugccacuuuggggaaugaugguggagggagacuggcauuugggguuggauacgguagcauccuuucaagguagucaucuuuaacgcuggaccuuuaacuucgaguuucucuuuacccugauucugccauccuuguuugacuaacaaaucugaaaugcucucguuuugccucuaaucaauaaguauguugcuuuauuucugcuuucugcccuaguuggggcgaucguuucugauaucacuauugauuuuugaaggacauaaagucuuacuauuguagugcuuugcuuguaaacagucccuuugagaagcaggaggauaaauguuaacuguucagagagaagcaacaggccaaaugaaaaugucggcucuuggguggcuguaguuguauagcuuugcccuuaguucauccauuucuuuccaguguuguuggggauuggaaugcucuaacagggucuaucuauggaucaaaagaugacagaugaaacccuagccagaucaaucuuuucaucggccuagauaaaauguuagagagcuacccuugcagugggguggcacgugccuucagucccaacauucaggggucagaggcagcugaucucagaguuuggggacagccuggucuacaguuccaggacaucugggacuaacagagagacccugucucuggaagaagauagaaagcuuuguagcugugcuucucuuacaaacgcugagaucagaaaugaggaauaucagucagcucugggccuccagagcggggcuucuugagcugugggcauauugauuuacucaucugugccguuucccacacacugccuuguccacacucugcucaucagacuggagcaaucaagcccuguggguaagugcuggagcucgcucucccucgccgucccucucacagugcugggaaccagguagcagccuuuguggauuccaggcaaaaguugcucuguggaggacuggccugagcuucugacccgucuuucccaggugaucguggaaaaagucucgggcucucagauuguugacauagacaagaggaaguacuugguccccucggacaucacuguggcucaguucauguggaucaucaggaaaaggauccagcuucccuccgagaaggccaucuuccuguuuguggacaagacagucccacaguccagguaagaaguguuugcuagcugggccuguggcuuggaaauccauucgccgcuuauaaaacucaaaccauaggagguguucuuaguacaacuucuuccuuuccuuuuccuuccuuccuuccuucuuuccuucccucccucccucccucccuuccucucuuucccuaucccucccucuuucucucuuuugguuuuucaagauaguuuauuuccuccuuuuuuuaauuagauauuuucuuuauuuacauuucaaauguuauccggaaaguuccuuauaccuccccccaugcccugcuccccuacccacccacucacacuucuuggcccuggcguuccccuguacugaggcauauaaaguuugcaagaccaaggggccucucuuuccaaugauggccaacuaagccaucuucugcuacauaugcagcuagagacacaagcucuggggguacugguuaguucauuuuguuguuccaccuauaggguugcagacccccuucagcuccuuggguacuuucucuggcuccuccauuggggccccuauguuccauccuauagaugacugugagcagcauccacuucuguauuugcuaggcacuggcauagccucacugaagcuauaucaggguccuuuccgcaaaaucuuucuggcauaugcaauagugucuggguuugguaacugauuaugggauggaucacugggugggguagucucuggauaguccauccuuuugucuuagcuccaaacuuugucucuaacuccuuccauggguguuuuguuaccuaucccaaggaugaaugaaguauucacacguuggucuugccucuugauuuuucuuguuuugcaaauuguaucuuggguauucuaaguuucugggcuaauauccacuuaucagugagugcauaucaagugacuuuuguggguuguuucuuuuauguagccuugguuguccuugaacuuuuaaaccaggcugaccuugaacucauccugcugccucccuggaauugaaggcaugagcuaccacacccaacuuuuuuuuccgagacaggguuucucuguguagccccagcuguccuggaacucuguagaccaggcuggccuugaacucagaaauccaccugccucugcauaccaacugcugggauuaaaggcgugcuccaccacacccagcuacuuucacuuuuaaaaaauuuuuauuccacacccaacucuuaauuugcauaucaauagcuuuaggggauggcuaagggcauuuauguuugaauuaauuuuaagaguaucugguguuauuugauguauaugggugugugcuuguaucuguguaaaguucagaggacaacaucuggaguugauucucuuccacauuagcacucagguuguaaggcuuccugacuagagcuuuuacuuuaagccuucuagcauacaucuggagacagggucucucacugaaccuugagcuuacugaucuaaacauagguccacuugcucacagaguaagucaucuccccagacccagaucuggacuuuaacaugcacccagaaguugacuaagauacccuguguugaccuggccuccacacacacaugugcaaaccccaugcccucaacaaauuacuccucaaauccuucacaacuuuuuuggccauaagccauagguagaacugaggccugcgaugagggucucaucuauuuuuuuuuuuuuuacagauuuauuuauuuuaucuguaugaguacacuguaggugucuucagauacaccauaagagggcauuagaucucauuacagaugguugugagccaccaugugauugcugggaauugaacucaggacuucuggaagagcaaucuguguucuuaaccccugagccaucucuccagcccugggucucauugauucauuuaaacuguuuccuuuucucucuaccagggaccagaauuuaggcaggggccauguagcucacagccuguuuuuaacuccccuggggaaggaaaaucgacuagcuuggcugagacuugguuacuccuuucccauuaaugacugggcauuuaaaacccugagucauauuucagcuuucaugugucuccccaguggggauuccuuguuacaucuaauuuagugaccuaaacuagcuagggggcuagccuaguuuguaggaacaagauucacugagaacuacaaaagaugccagaugugguggcauacuggaccacaugcacacacauacgcauacacacacacacagcucuuaguuugauugggaauuaaagaauuccuauacagugacccugggcucuacagugacucuaucaaaaaaaaggaaggaaggaagggagagagagagagagaaagagagagagagagaaagaaagaagaaaagaaaaaguuccaaaagagagcuaagucaaauuuuauaucuuauuucuauuaaggugaaagauuggcuauugucuugguacuguuucuuuguaaaucuuuguacuaucuauuucuggucucugguagagaggaaguucgggagaauagcagaagcuucagacaagccaauaaauacuuggccugaggggauaggaaagccagagccugaagacucagagccugagccacugggugcuaccuuucugugccaccuauagcucuggaggucuugucaucccucugccucucucagccuucauucagaggcucuugggcacuuuguugauggcugugcacuuuauuuuaccaggaggaagcuggggcaucuguggggccacucugcuccccuuaagguagaaggaaguaaauccuugauggauuccagaccuugcauggcaccuuggugauccugcuuuccuaccucuggagaggaaguaggacacgagcagcaguggcacugguuuaguguccuuagugccuguccucuggcacuaaguggggacccaggucagggccuugucuugccaggcaaguguucuacuaagccaugcacucagcucuagaagggaacggcucaggccucucuaauggacccuaaugucuagggaugggaauggcuucugugucuccucacccuucuccuguugucccugaaguauaaaucgauuggaagugaaguggugcgacagaggucacaucagagccguuuucacuccagguucuuucuagaaaaacacgagaccauuuuuauuucuucuauuugccuuucuagucugcugagucuacccuaaagcagguuacauucgacugaagugaucuagggccuagugaucagaccccagaaaccaaauucugguuccucaggacagagcaugaaggccuuuaguacuuaaggucccaguuacugacuuuuugcccuacaggcuaaucuguauuucuuuggggguuuuaaaaaauauuuguugcugggcuguaguggugcaugcaagugggucucuguaagucccauacagccucgugaauuccaggauagccagggcuacguagaaagaccuuguauuagacaaaaagaaaagguuuuagagccagggcagugcugacugcacgccuuuaauccaagcacuuuggggaggcauaggcaggugaaucucugaguucaaggccagccuggugaauuuuagggcaacuaaggcuacacagagaaauccugucuuagaaaaaccaaacaaaugaaaacaaagcaaaauguauuugugggccagguuugggguaguagacacuuguaguuccaguucuuagcaggcugaggcaggagcaggcuaccuuggagaauauaguugaggccuccuccaaaaaucaaaucccaaacccaaacuggagaauaaucaaaagaggcacguggcauuucagacccaugcaaaugucacuauccaucagagcccaaagggaaguacagcagggucucuugccuaaagcuguggugacucagcuucaccaucuccucaaagucuggcaguuuccuuagggaaccccggagccuccgacauucaugccaugcuugcagcuugcacaguggcuggggagaugagcagagagagaaaaggaaucuaggcgugcaggagcccugguccuucugccaugauugacaggcugcagaggggcaguggugcuugagguugaauagagugcaucgguuauggggagagcugagcccugggcuaagcacggagagucucggguuaguauuguaguuuugaauacagaugcuguauacacaaagaggcaagccugaagggguuguccuuuguuuuuugaguuacuguuguuuuuugugguuuuuuuuuuuaaagugagaucucaaaaaaaaaacaaaacaaaaacagccaggcgguggucacacacgccuuuaaucccagcacuugggagggagaggcagguggauuucugaguucgaggccagccugcgcagugaguuccaggacagccagggcuacacagagaaacccugucuggaaaacaaccacacacacaaaaaaagauaucucagcugccuuuucuuucucuccuguuuuugagacucucuacauaccucuuaguuguccuagaacccaacauaaaggccaggccaggccucaacugccuguuugauguaauauuagaaaguugaauucuaccugagugcuuacaucaagaaucuggcugagcacagaagaggaacuaugccuucaugcaggcagaacugagaacgcauuggucuaccaguuucccaggcaugguaguagacgggaaacccaggucugcucuuuguuuauagaaguuuaaaguagagacaggaagcugaguguuauggugcacaucuuuagucccagugcaggagacagggaggcagagcucugaguucaaggccagccuggucuacauaguggauuccagauggcagagccacauagacugucucaaaaauaaaacaacaaaaacaaacuaaaaacaggaguguguuauugaguacacauccucagcuuguugccagcuuggccuggagagaccagugcugcuggagguggcaguugguugguucucggucuuaaagucugguaagaugucuuagggaccaucuuguugagaagugugcuuaaacuuaacaguugugaucaauucuggguaaacacuucucucagaaauggcuauuggucuggugaagguacccagcagguaaaggugcuugcuugguggccugaguuugaucucuggaacacacauuguggaaagagagaacuggauccuacagauuguccugaccuguacacacacauaaaaacaauuguuuuaaaagaaaagaaagguguguuuuaggaguggcagaagaugucagagaaacaugugucaagccguccccacucagcucuggguauuuugguuuggguccuguuaaaaguucaccucacaaccagugccuuucaagguucaccguggugggcaaagaguaccugccuuaccccacuguccucccuugcugaaagacagcaaaacacaugagcugcacggcagauggcuggccagguggucaucacaccgccagccuauuuaugacucagugucuccauggccugccuuugguucagaguugaaggcaauuccaccgugaguggugcucacaugagcccuaggucagccuuccccaguucacaggacgauagagaaggaagcuaaaacuaaugccauagugagucccgcaccuggcucuuacugagacuuggcguuacuguuggucaguuccuccacuggagaaaggguguugccuggaucuuugugacuugaauggaggcacagggagcaagcagccuuucagggaauuaacugggauucuucuuagcacuugagacaucaucucaccauagguuggcuccaugguuuacauuugccauuggcauuuuccauuucuuucuuuuuuuuuuuuagaauuauuuauuauauguacauuuguacaccauuucuuacauuugccaauuucgauuuuucuucuuuuuuuuaagaauuauuuauuuuauguauaugaguacacuguaacugucuucagacacaccagaagaaggcaucagaucucauuacagaugguuguaaaccagcaugagguugcugggauuuggacucaggaccucuggaagagcagucagugcucuuagcugcugagccaucucuccagcccugcauuuuccauuucuuuuuuuuucuuuuuuuuuugguuuuucgagacaggguuucucuguguagccaaggcuguccuggcacucacuuuguagaccaggcuggccuggaacucagaaaucugccugccucugccucccuagugcugggauuaaaggcgugcgccaccacgcccgggcuugcauuuuccauuucuuucuuuuuuuuuuaagauuuacuuauuuauuauauguaaguacacuguagcuguauucagacacuccagaagagggagucagaacuuguuacagaugguugugagccaccaugugguugcugggauucgaacuccggaccuuuggaagagcagucgggugcucuuacccacugagccaucucaccagcccgcauuuuccauuucuuaauuccugagaaucaagaguuagaagguagcagugccccacauccucagcauuguucuuucuagagcuccagcaggagagugcauuguacugaagacuuugggugucuucuccauacaccuuagguaggaagccuugaaauugugguuuggcuuacuugaucuaacuguccagcgggucugcagagcuugccuggcagguauguuagagcugccuccgcuuuaggacuccugaccgaccauucugauggccaccucagugcaagugcucaggucuugucucugagagggaaggccaucugcccugagcuuuauagaacagguccuaggcuaacauaugccugccucugcuauaaacuaucuccuacgcagggucaguauugccugcgucugcuucauuugagugaacuuuuauugaugggacauuuguuagucuguaugaggcacacuguuccacggaagauccuugccaaagguacaaggaucugauguuaggucauugggguuggccuacuucacuggguagucacaguacaggugguggggcacacuugggaggcagagccagauggaaccaaguucaaagccagaucuguuuagaguucaauuuccagaauagccaggcuacagauggggucaggggugggggaccugagucccaccacaagauuucaugucauucauggagaugcuuacaaagcgcucuagagaucccaaaggcagcucagguugccaugaaaaucaacacagcagguucucaugagccugcuuccucuaccccaggacugggcuuccaugggaauggcaggcaaacuucaugugggucuuaacaauucuagaagcuccuuaauccucagcaaguuaaacaugggugaacuugcaagugcaagaccagccugggcuacaugaguugucauuucagcauguaaccuaacuugcuuuauuuugaaaucuuguguuuugccacuuagcaagccucaguucagaugccacauuucaguugcuggauaaaucuggugauuucuguuuuagaaguagcuaaauaggguuuucuucccuuaacuguaggauuuugauuagacaauguguucagagauguuugcccucuuuuuguuauuuagauuuuaauguaugugcaugagaguuacccaaauguauauaugugugcacugcaugucugcugcccagggaggucauuaaaggauaucagauugccuggaacuggaguuacagaugguugugaacugcccuguggguggugggagccugggucuucuguaagagcuacaagugcucuuaacugcugagccaucucuccagugcauccagaguuaguucacaaauuccacauuaagagagccucacauagagaacuguugugacuggaaaagacaacaggcuugcuuucugucugucuuucugucuuuccgucuuuccgucuuuccuuucuuuccuuucuuuccuuucuuuccuuucuuuccuuucuuuccuuucuuuccuuucuuucuuucuuucuuucuuucuuucuuucuuucuuucuuucuuucuuucuuucuuucuuucuuucuuucuuucuuucuuucuuuugguuuuuucgagacagggcuucucuguguagcucuggcuguucuggaacucacucuguagaccaggcuggccucgaacccagaaauccaccugccucugccucccaagugcugggauuaaaggugugggccaccacugccuggcauaacaacagauccauauuuaucccccacauuauuacuuacuaaucuacucacacagccauucaugcuaagcuuguaaauggggugggaagugaaaaagggaagcaaaaacucccccucaauuaaugggccgcaucccuuguuuacauaugagucucaguuaaacaccagcaacaaaggccaggggugaaucgaacccugaaucucuuuauuuccccauugguccuugguaugcaaugcauuuaguuguuuuggagacaaggucuuaugcagcaaggcuggccuagaauuugauaauggagccacaggugaccuugaauuuacaauccuccugucaguguugggauuauagguuugagccaccauuccuaggcuuuuuuauguaaugugggauggacuggugucuggucugaacccauguuguaacuauacuauucaagaacucuaccagcugagcugcaucucuuuuguguccguauuuagacaacuugugccacagcgacuuguucuugggucagauucuuccugcugguccugguugacuuaccacuugugcucauacuucuucagcauggucacguggccagcgcuugcaugugguugcaguagguguuacuacucucauugagacaacucaguuuuccggcagucuguuuugcagcauaaggcgagcugggccuccacccccagguuuaguuaaggaauccuauuuuuggagguucuucggaagcuugagcagucuuauuacauuuuauucuuuugaaauaauggggauccagccuaggccuucaccccuguugggcaagcacucuaccacugaaguacauccuuggccucgggaagguuucuuugggucccagguaccgugggagcuuugcauuguacauaaggaucauaguguauaagaucucuggggacucgagauuauggccugaguguguucauaacaaggauccacauuuaucuuugacuuugagucugaguuguaaauauuuaaauaaauacgaagagaacccaacauguucccugugacagugggaugauccuuuccaucuccaaggaguuggcuuccuuacagguuucaacaugagugcagggauucuaggcaugugcugggccugcauccuaauuuguugugaucucugcccucuuuuugugggcccugugccugcuagguuaauguugucagugagccaccgccaccccucagcccaucuucaguuuuccuugccucuguuuucuuuccguagagcagauugcaggucacagcagguaccggaauuauuuuuaccuccuagccaccaaccacaaagcguccgauccuuaggccucauuuuuccucuugauaccaggacucaauucucacucauuuuuuuuuuuuuuuucucuuucaagccuaacuaugggacagcuuuacgagaaggaaaaagaugaagauggauucuuguauguggccuacagcggagagaacacuuuuggcuucugaggcccuugcugggcuaggugcgcccuuccugcuugugucucuuguaaauaacuggcuguucucaguuacucugccagagccuccacacagaccuacuagugcauuuguaacuggauuuauuucuuaauauauuggaagguuuuguuuccuuagauuaguaaauuaucauacagaguuuuauuuucaguuuucuuuuugugcacuguccucauggcuauuugcuccagggaaccuguccucugggaaucauauuuaaugaagauauuuccguaaugaagggagguagguguggugguaaagggaaaaggaggggcugaugcauaguucuggauuauguugaaaguguuagauggcuaaguauuaaaagcacccagauuaaauccuuagcaaucagaacacuugcuucacuagauuuugccaacugcaaaucauguuggacugagcuaaucuauucuucuuucugagacuauuaagguaaauaauuaacaauaaagccuccuuauaaaggcaucacggugugaccauguccgucauucaccuccacgagucaggaguggcuccugccugucaggcuuggagaagggcuugcaggggagagagaggccuagccuaggaugggaagugcugguugauaucaaaaggggauugguuuuucaguggucaauacagucaacagguucagauuucaggacuguaaaaagguguauacugcaaagucucgcuuuuaccacuuuuucugaucucugcugcuuauggaaaauuguauggguuucuucucaguauuugaguagcaaaauuuuaaguaugaauauacuuuuuaaaaauuauuuauugguguuuugccugcacgugugucugugugggugcggucuggauuuggagcuagacaguugugaacugcuaugugggugcugggaauugaacccagguccuguggaaaagcagccaguacuaguaauugaagagcuaucucucuagcuccauguauacauuuuuuuguuuacauauguaaggcauguguguauguuaguaaagcagaggggguugaagagauggcucagcaguuaagggcaauggguccugagcuuaauucccagcaaccacaugguggcucacaaccguauauaaugugaucugaugcccuuucccugugugcagguguauaugcagauagggcauucauacagauaaaaauaaaucuuucuuuaaaaaaauaaaacauguacuuacacacuggauuuuguuuugagacaggguuucacuguauaguucaggcugggcuccaacuuguuaucugccuugguuuggcuuucauuaagucuuuacuuacauucuagccugauauacacacguccuuuauaugugcuguguucuuuugagacagggucucucuauguaguccuagcuguccuagagcuuguaaugaaucaggcuggccuugaacucagauccucccgagugcuggagucaaagguaggcaccaccaugccugguacaaacccuuguucuuuaagguucucgccagucccuuuaaucucucaugacaauagaugcuuguuaggacacaaaagcaucuucaagaaaguggcuuuacaucuuccacagauggacuguguuuggugacuggugacuguagccuuacaucagucaucaggauaaggaaaccaauagaacccagugagggaucuaaguaagggccuguagggaaaaugagaaucauaaacuuaauuuuuaaaagauuuacuuauuuauuaaauguauaugaguacauuguaguugucuucagacaccagaagagggcauuagaucccauuacagaugguugugagucaccaugugguugcugggaauugaacucaggaccucugaagagcagccagugcccuuaaccacugagccaucucucuaggccaagaaugaugaacuuaaggaauuugucuuauuugauguguauggcuguuuugucugcauguaugucugugcaccacuuguaugccugggguaucagauuccuuagaacuaacuggaguuacaaaugguugugauuugccguguggguccucuggagaccaugcucuuagccgcuaaguuaucucuccagcuccugcucuugguuuuuugaugucucauuuguagccccagcuggccuggggcugaagggaucacuugccucucugccucuugagugucaccaauaccugucaagaccuuuaauuucacuguuaccaggauauauuauuagcaggcuaacacagcucucugauaucuuucaacuggaauuggaagaaacauucuuaucacaaagaucuuguaggguuguuuuuuuuuuucccuaacuugacucaagaaagaaagauguauguuugucuuugcugguagugugaagcuagaagcaaguagacccuucucucgggugaccaaugggaaagggaaacucaggcccuuguuauggggcuucuuguuuguggucacaugcaccuguuuucaaaacaaaauccccaaacauugauuggauguaccaaaugaagacucagaugcuguggugaaagccacaaggcucagagaggcagagcacacccggcugagccuccuccuccaccaacaucccagaagaugaaaagcuccuccaggcugucugucagcucccagccccuccuuucuccuuccuggguuuucuuauguucacuccugccaacuggcugcuuccucugccucuuuacuuuguuuaguucuuacagaaagcucuuggguuuaagggugugucuuagggcugagccacaccagaacaagaaacagauuuuuacaguucacauucucagggguucacaccgugaccaaauccugcaacgugcagcaacuuucugagacuggccuaggcuguaaaaaggcacuuuauuguuugaguagcauagguugguugguucaccggcuguaagcauuauaugauaaguaagauuaaaccuccuuucuugguuucuuuuccuguguugacuucauucucagacaagugaugcuuaucugcuuugcaccucuagugagggaagaacacuuuuguguuuugacaguuuuucuguccugguauccccucuguagaccaggcuggucuccaaagaucugcuugccccugccucccugggauuaaaggaauauaccacuacugcccuucuaguacaaaccaaaguuccuuggacugggugugguagcauauaccuuuaauucuggaagcagagagacugauaccugaguucaaggccagccaggaucaggagcuaguuucagggcauccagaguuauauagaacaagauuuuuuuuuuuuuucugagacaggguuucucuguguagcccuggcuguccuggaacucaauuuguagaccaggcuggccuugaacucagaaauccaccugccucugccucccgagugcugggauuaaaggcgugugcuaucacgcccagaguuauauagaagaaccauuugugugugugugugugugugugugugugugugugugugugugugugugugugugugugugugugauucuuggaaggcugaggcagggguuaucauugaggccaaguuggaucgacagaccauuucucaaaagucccuugaaggacucuggccuugggccauaagcaguccugcuugggauggcaagucuccuucggaagagaagagcagaagggagacguagcuuuccuuuucgucuauuucuguucuaaccacaaacccacaaaugcaccugggaagaagcagcaugacaaaucuccaaaggcaagugucacugaagcugacuagauuucuuucuuuuucuguuuuuuuuuuuuuuuuguuuuguuuuguuuuguuuuucgagacaggguuucucuguauagcccuggcuguccuggagcucacacuguagaccaggcuggccucaaacucagaaauccaccugccucugccucccaagugcugggauuaaaggcgugcgccaccacugcccagcugacuguagauuucuuaaaggcaucucauaucccagguuggucucuagcuuacuaaguagccaaggacuaccuugaauucugucccuccugagugcuaggguuacaagcagguaccaucacauuuggaauggagcccagggcuugcacuuggggcgagcacucucccaauuuagcuacauccuuaacccuguuuuugaguuuaaguaaguaguucauggcuaucauauacggagcaccuauuggauaccagaugauugauagacauuaccauguuuuuuuccaaaacgccuguaagguaagagucuaguuuucagacauuguagaggugacagaacugagacaccaaaugagacuuaggaagaauaaccguguucagucauccccugcuuguuccuauuacaauguccccaagaagacuuggcccuguuuagacuaccuaacagcccaucugugcaguagugagcuguuuaaccauguggacucgacaggauuauacugugcaggacguggggcacaaucugaggaaagggucaucccagccugucugagcuuacaaagacacuugucagugccacgguuggaaguguugaaagggaggggcuguugauggagaguguacuucagcggacccagguucgguuaccaguagguggcuuauggcgucucacaccucuggacucuucaaacuuaccagcauuuauaugcacacacacauaauuaaagguaaaaaucaaacuguaaagacaguguugaaacagcaggagaacaucagcugcaaagcccaccguuuggguuggagaggugucuuggguaggagaacauaccacucuaccaggagauccuaguuugguucccagcacccacacagggcagcucacaacugcuuguaacuagccucgggggacccagggcccacuuuuggccucuaacaaacccucucccccauguccaugaaaaaauuaaaaucuguagggauaggagacauggcucugcagguaagagcauuggcugcucuggcugaggaccugggcuugcuuccaagcacccaugugguggcucacaaauuaucuguaauuccuguuucagaggcuccaaaauguacacacaaggugcacagacauacauagaggcaaaacacccauacauacaaaauuuuaaaaaucuaggcugugccuacugccuaggguuuauaauuccagcuacucgagacagagggucagaaguccagccuaugguuauggagugaggcuuugucucaaaauuacuauuuuuuuaaaguagaguuccggggauacaacugagauguagaugccucuaggcaugaaacccuaaauuaaaaaaaaaaacugugggggcuggagagagggcucagcgguaaagagccuuacuucucuugcagaaggucugggcuugggucccagcacucacaagauggcauggagacaccugucacuccauccucuggucucagguaccaggcacccauaaaguacacauauauguaggcaaaacauuuauauacaaaaaguuggggguuuuuuuuguuuuguuuuuucgagacaggguucucuguuuagcccuggcuguccuggaacucacuuuguagaccaggcuagccucgaacucaaaaaucugccugccucugccucccgagugcugggauuaaagguuuguaccaccaugccuagcucaaaaaguuuuuaaaaagaaagauggaagccgggugugguggcacaagccuuuaaucccagcacucaggaggcagaggcaggcagauuccugaguucgaggccagacuggucuacaaagugaguuccaggacagagaaacccugucuccaaaacaaaacauugacaccaaaacucccagcacucaggcugaggcuggagaagugccauaaguugaggccagcuugauccacagaguuguguuuuaaaaaagacaaauacccaauggcacaaaggaagauggcuaaugagaagucagauccaaagcagaacuuacuuccauagcucaugcaacacagcuagaaaaacaguucacugugcccaugccaggaagucugggaagcaggcaguccucacuuuauagauuaaacgauaaagccuaaguaaggagcaaacccuaacuguaugcauaacugcuuuuuaaagauuuugaauaucaaaagaagcuaugaaaauuggaacccaguggaacaugacugcugaacagcagcgugguuguguguggugcuggaagcagacccugggccucaaacuugcuucacaggcugccaugggccaaucacagccccauuacagagucugauguucuucuauaccagcuauagccaacuagaggacagaguaggaaaaaaaauguugugggcuggggagaugggucagagguuaagagcacugacugcucuuccagagguccugaguucaauucccggccaccacacgguggcucacagccaucuguaauggguuccaaagcccucuucugguguggugcucauauauauaaaguaaauaaaucuuaaagaaaaaaauguuuuacugcuggcaggagcaaaaccuagaaacauuuagaaauaaauuuaacacagacauuugaggagaaaaauaagcaaacaguauugcaaggaggcacaaacagaucuggaguaaaggaugcggcauacuugcaucugaguaaagaugcagccacaucagacaugugucauuaaugccacuucaauaaaagucccccagaaaguccagaauaacaaggaauguaagauacucgaagcgggagagaccaggcccaguagacaaaggacaacaucaguaguagcaguaaugaagaacuaauccagcucuccaaggcugagacggguaugaaucugaggucagucuggugggcucuugagaacagaacaacccaaagcuauggugugauacagaguagaacaugagaaacugaccguguuuacaauauaaacagcacagaagcuggggguacaugguacaugccugaaaaucuagucauccauacagucuccuccaucacugcugguaccuugccuugccugguaaauguguuacuuugaauuuguauauguacaugcaggugaguguguguguguguacucauguacauauggcagccaagggucagccaccucagcuccuuaggagcuauccaccucuuguuuuuuuucgagacaguguuucucuguagcccuggcuguccuggaacucacuuuguagaccagguuggccucgaacucagaaaucugccugccucugccuccagagugcugggauuaaaggcgugggccaccacguccugcuuaccucuuuuugagacaggguguuucacugggaccuggacuggcccuuuaggcuuugccuacuggccagugagcccggugguccuccuguuuuccuaguugcugugguuacugguaugcacagucgcaccuaguuuuaucaugcuuggcuuuauguggguucuggagacugaacucaggucuuccuguuugugugguaaguauccuaugggcuugggccauaaacccaacacuuacauguuucauuucauuggguuaaauaaggucauuuagccgggcgugguagugcaacaccuuugaucccagcacuugggaggcagaggcaggcggauuucugaguuugaggccagccuggucuacagagugaguuccaggacagccagggcacacaaacaaaaacgucauuuuauuaugcaaguauguaaaguagguugaguguacccccuuguccucuccugccccccaccauagucucuuuguucucccacuuuugcuucuacacauaugugugugauuuuguguuucuauacagcacagugggaggcaacugugcuguauagaaacacaaauuuucccacaaaugagagaaagcccugaacuaauuuuuuauuauuauuauucccaguuguacccaccauccugcacaugguauaaauuuuuguuguuuuuuaauggcugaaaauaauggacacugagguugcuucaucacucugcuccuguggacacuacuguacuaaacacugaucugcaaguaccucugcuacaccaaccuguacuaaacacugaugagccaguaccucugagccagugaccuggagucuuucagugaacuugucaguucccucaagccaccacugccugcaccucaccaguuaucuuccaauuacugcucuauggccccugcuacaccauaaaauccuggccuccuggcugucgucucuguccuguaucuuugguauagaggacaaggagcucccgaggaguaaugucuaucccaugaccucuccccaagucuccagagcgcugagcuggcaggcuaaagccauugucccuugcaggaugacucagaugcacagucagcauccucccaaacccgccugggcucugucauguucuguccgcaucucuacccuuauaggaugcccucuaccuuacaugcuuccccucagaacucccauaugugccacuugcuagucccugagccuuccgggaaggcagguacccuagaacacaccacccaagguuacuguguccuccccuccgcugggcacuggcuuccaucacagucgccucccacugugcuguguucccugcgaagucaacggguccgucaucuucuagagcuaaggagcaucguggggagagcgugcgucuucccagaccucagauacagagcucacaccccucuccuuucccucaucccugccuucugaggaguucuucugagcagcauuuggaggcagccaauagaaaugcuccucuugggggaggagguuugaggguggggcugggaggauggaggggccugugaucuggccuuaaagugaauaaucaaugaaaaaaaaaugcuucuauuuuaaaaaaaauucuacauuggaccgggucauagaaaaguuuaaaaagugcagccauuucuccuucucaaggagaaagaaacugacaaaacaaaauccuuguggguggcugggugacaaagccacagaguuaaguaggaggauacauguaggucugucaucaguggcuucaguacgucuugcuggguccuagagugaagcagaugugggcagagcagcgcccaccagcaugcaggcaccugccuccaccaccagguuuguccaguaggcuuccacugaggguaagcuuuuagcucuguaagucuagacagcagauuggacacaguugcuucugagcugaagggcagacccagacuggaagcucccaagcacaaaucacugucagugcaggagacagcccuccucucaaaccugugcuguauaugaccgaauuucacccucccagccccgaugccagugcgcgaggauucugacacucugaggaugauugauuaccuuccuaggauccuaaaccaguacauccuagggccacauuccacucuaacccagugccagacucaccgggggucugcuagguuagauggggaggaggccugcccuuguauauauuccacaggaauguacguaugcuuuagaucuagcaugggucuagaaugggucugcuuugggcaugaaguacacucuaguuuaacgugaguuuugguuucuugaaaauuggguuugugagccuugcaccaauuuuauacuccauuguuuuagaauucugaaguauuucaagcaaaaaacuaaauuccuguggcuaucuaucuaccuaccuaccuaauuuuuugagaccguguuucucuguguagcccuggcuguccuggaacuugcucuguagaccaggcuggccuuuaaaucagagaucugccuguuccugccuccugagugcugguguuaaaggugugagcccucccucccccgcagcuauggcccuuaucguaaucugguuaguuguuauacuaaacuaugguaagggaggugcuucauaaacaacagauugaucccucauaugucuggaagccaggaagaacagauuaaauauguguauuaauuaguuaauauguggguuaauuaacagauuaauuagcgagacacaaucccuguuucucgauggucaucuucuaacuacguuguaacugguggggaucuuucugagguauuuauugauuuuauugaggcagagucuuguaugacccaggcuguccuuggacagggcagguaccauuauggcaucacaccaaucccauuccugagggcucugccugaucucccucaaagauucugucaugugcuaccacugucauauggggaguuaggaucacgaccuaagaacugcagaaggagacagacaucaaggcagagcugggcuuucaaguagaguuuggaagguaauaugaauguucccagcagagcucuuuucucucccuuccuccucugccuggccagucucccaauacaggaguuacugauaagcuucuauagagagacauuccugacagcagugguuagcugaacaacauuauuacugcaggaagauaccagugggaaggacaguucucacaagaggcaaaaauaaaaccaaaaccaggaagaugcugaaccuguguauaggaggaaugaauauaaauaucuggaaggagcaggguccuaagacuucaagaaacacuuuucuucucaacgaaacccaacucgaggcagacggcacccaaggcuaagcauucaucugcuguccagagaaucggggauaccuccggguacauuuccucagcaguucccccacaggcucacuguaaaggccugcugcugaacggaagacagagcugggaaagggcucugugauaccgcccaguggccagguugguuucacugcugaggggcccaccgugccucccuucgagacaccucuggguucaaagcgcaucucauucuccuggcugccuggacagaugcccaccacuguuuccauugugagcucuucccuugggaauacggccaguuucaagggacguguacuugagaccaaugucuggcaguuuggguuccuacuuggagugacuuuccgccucugccucccccccgccccccaaccccccagccucugccacacuuggacaccggaaagcagugccaaucagacuugauuugaaagguugguuccuaacccuugcugacucauccgaauaagggcaaaacagcaaauccacaccagaguccccaggcugcuagauuaacacaaaagucccccuccccuccccccaucacuaguauaacugaggccauaggcaggucagagggucacagcaucagagugucuuccauucaacagcaggccuuuacauugaggaaaauuccccagugcuuuacuuaggcaauuaagagguuucuucugccuccguuuuugagccaggguauuacuccuuagcucuggauggacugaacuccguaggccacgcuggccuugaacucagagguaugccugccucugccuccuaugugugaaucuaagguauguaaugccacaccccacccaauuaagagaugcuaaaaaguggaacuagggaaagcucugagccaagugcuugcuuagcaugcggaaagaugcugaguuugauucgcagcacacaacuuuuuaaaaaaaugagaaagccuacccuacacuugaaaacacuugcgcagccuaguugcugguacuugcuuuuguagaacagaauggaggucacaagucaaagguuaaaugccuucccagcauacagcugguuguugguggcagaguugguacuaucaugucauuugcauccauggcuguacucaaauuuauucugauuccaaguaauaaggacuuuuuuucuaacacauucuaaauugagguauaauuacauuuaaaaaaacaacaaaaaaaaaaggagcacagaaaacuguagaccuucauaaacuuccacaagaucugcauuccucuauuuaauacccuaaguaaaacccugacuguuggccaggcaugguagcacccaucuguaacagcaguuuggggaaacuaggaugggaacaucacagaguuagaggccagcggggggccuccucccaaaacaucaccaaacaaacaaacacuaccaaccaagcaacgugugguuuuguuuuuccuagugcaggagacugaaaguagcaacuugcacgcauuaccaagugcugccucccacccacuguccccagucuaaauaaauacugacuaaaaaggcugccuacuccagcucugaagcgucucugacucauuucucucuguccuuugggcuacaggaccaccugaaaaucauuugggaucuacuuggauggcuuuacagggaaacaggcugguucaguuacagacacagcuaguuuuaauuucgguuuuuugguuuugcuuuuguuucucaggauagaagguagcccugaauguccuggaacuagcucuguagaccaggcuggccuucaacuuuuaucagcuggaauugaaggcacgcaccaacacugccuagcuugcuuuuuuuuuuuuuuuuuuuuuuuuuaauguuuuuaaaaagauuuguguguaaagucaaggcaacuaugauucugcaaaaugagguauacaaugaacuauucugcucagaaaauacuuucucuccucgaccucggccucccuggcucugagcucaggcacagucaggaugguguggcuguacauccggagccugccuggcucuuucugaaucuagccacucccuuugguuagccagcucagugccuuugggaagguuugcuugggcuccugaacaaacacacacacacacacacacacacacacacacacacacacacacacacacacacacacacacacacacacacagacacgauacacaaguucugguuuuauugguggcaggauggcuguuguuuagaaacuggaaaacucuggcuuaggaaccuuguucuaggucuggguggaggcagcuuuccagcagccacagacacaagcaggucagacagggggccugcaccucuccagcuggcaaccagggcagccccuucuucuccacagcaacuuccucagugagcucaugccuggcacuggggaauccauaaagcauggcauuugacguggcaucccuccauccugaagaagaacuaugugcgcacacaggugguggcagacacggcugaaucagauuagguucugaaaauucugaggaaaacucucucucucucucucucucucucucucucucucucucucucucacacacacacacacacacacacacacacacacacgcagagucauaacauuagacccuauuuaggcacacacguaaauguaaucuuuccuccagagccaaauuugccuuuuuuuuuuuuaguugaagacacaauuuuguggaauuacgcauggguuagaguugcuguuccaauuccugugcagcuucauuucugaggggcuucuaguuuuucuacaguuuaaaauauaaaauccuucacauuaauuaaaaaagaccccugggugggguagcacuggugguugggcuggagcauuugccuaccauauggaaggcccuuccuaguuucucugaugagauggggcaaaggguccugcuggccguccuguuccuggugguggucuaugggcaccaguggaguggauggauggggaguggggacacgcaugaauguccucauauucucugauuuuaccaaagaaaccagguuugcugcagccagggcccagagaggacacaggagggacacaggucaaaugauaaucagagccaccuuuucucuagaggucuucauggguuuggcccaaggcucacacuggacaauguugccugacugaggauaaacaggauacgugggauaacuuauggagagggcugcuuucuggcuugggauuuuaggaagauaaggaguuccagggcagccuagguuucagaagacacagucugagaccaagcaagcaagcaagcaagcacuugccaggauuacagagaugugauguuaaggcauacauacaauucuaaacuuuucuuuuuuggggcuuuaugagacaggguuucucugucucugacagacagcuuuggcugacauggaacuccaaguguuggcauuagaggcaugcaccccaaccccccaguguaaacuuggguuuuaagagcauaaacuaggaugcaggcuguuggauguuuaaauaccaccuuuagcgcuuugagacaguaagugaagcucaagggaaguugccuuuagugguuagccuucaguguuuucuacccagaugccagugacuaagggugugaguaaacuugacagauuauaacuuuaggaguaaaaauauauuacucuuugagacccuuucuuccuacuggguuuggguugccuugucuagucuuacugcaacuugcuaggccaugguugguugauauccacuggaggccugcccuuuucugaagagaaauggaggaguggauggggguaggggaaggugaggugggggaggaaggacuaggaggagaggggaggggaaagugcagucaggaugugaaauaaguaauuaaaaaauguuacuacuucacauuuaauucaagucuuuauaauauaaaaaucucauaaaagaacacugcaugguggcacacaacuuuaaucucagcacucaggaggcagaggcaggcagaucucugcauuugaggccagcccggucuacaaagugaguuccaggauagccagagcuacacagagaaacccuguguggaaaaacaaagcaaagcaaagcaaagcaaagcaaaacaaaacaaaacacuauaaaccacagugacauugaguagcaagcagagcuucugcuuccaggugggaauaagcugagugcucucuccuaggugacaguuaaacaggguuagcugcuacgucguuugcugauuuguuguaggaaauuaaggcauuugggaacugaguuaaaaagaaaacaauuuagucagaacaggaaccugguaagauugcucagcugauacagcugcuuacugccacacacacaccgugacagugugcccccccccccaccgugacaguguggcccacacacacacaccucgacaguguggcccacacagauaaagacacuaaagacaaucaaaccaggcauuugccucaugugguuuugugcaggcuggagccuucauucuuggcuggcugucucugugugguaggaaaagacgguggcuacuggcaguuacaagacuauaguggaccucaugacauugcucagaagagaauccaggaagcaaaguuugaggugacacuuagaggcagaggugggaagaucagaguucaaggucacccuuggcuucauguugaguucaaggccaggcugggcuauagagagagggauccggucucaagcaaaagguagaagggagggggaggggaagggggaaagggaaaggagagaaagagaaagagggguggggaaugaugguggcuucaaagugagacugucucaaaaccaaaacccaaacccaaacccaaaccaaccaaccuuucuugguaagucugagaacagagcuuuccgaggcuaguccugugcugagccugaugguaaagcuaacuccaaccaugucuaguugcugaggacugggaagugaugaugguuacaaaggaaggcugcaaacaggaaauacaugguuuucaugaguccgggagaggcuauaaagcuuccagcacccuaagaugauuucagcccaaugcguccuugcugaaucaauguaaggagaucuacaccagagcugcugcaggcuacuuuaaaagcaucugaugcuguauuuuaaagaaccaauaaaacacaauugaaggcagccaucaagagcauuacugagaggcuauuuuagcacggagcugcuccagucaaguauagauugcugagguucugcgguccauuuaugacaccagagaggugcagcgagcgcucugggagaaggcagcucauucuccugggauuuaaccaccagaaaagcagagguucguucagcaugaagggagaggcagaccgauacgaaggguccugauaccagcaagaguucauuuaaauuggugguagucggguggguuucugauccaggacgcaaacggcuguauccugcggagggcaccccaggcuuccugguaggcggacgcagcauccuuguacuccugauagguguccagcuucuucguuacccuaaugcacacaugccaucaagcacaguccugacugagugcucgcccacccucagagcgacggagcggcaggggaggagcagagggagcacucugucccuccacuccacagggagugcauguuaaagcaacacaggcuuaagcagguuagaaucacacaacacuggcuuuguauggcccguguacaaucagaucaaagcuuucuuuucucuguggugcugaggaucacagaguuucguguacacuggacggucuccuccuccuguaaucgagcugucuaccccagcccugacuuaggguuucuaccagagguccuagagacgaaaaccuugacgguuuuuuaugcuaaggacaugacaugacaccuccacucuccugcuaugugcugcagcugacauccuuuagccucucagguggaaaaugccccguacucugaguagcuguaauucugaggagauuuucuuuagauuuggaccaggaccaaaaugugggugggagugcucugaguccuugucuuggccuugaguucugcccuggcuuuguggugugagcuggaacucuccagugucuguuuagcucucacucuuucauccccuucaguacuggagccaguucaucacuuugggcugggcggguggcucagccggcagggugcuugcugaucagcacaaagcucugccuuugauccucggaacugagcaagccggguguggagcauacuccuaauccuagcccuuggaggcagagacaggaggaaggcacugccgaggucauccuuggcuauguagcaauuugaggcuccuuggccucaggagacacuaacucaaaggggguauuuuuuuuuucuuucuuucuuuuuuuuuuacuuucuagcucauuacccugccugccuuuagcaagaauccuacuuaguauacgucuacuaagaauuacucuagccuagcuuugaaauuagcuuagaaggcagaggcaggcggauuucugaguuugaggccagccuggucuacaaagugauuccaggauagccagggcuauacagagaaacccugucucaaaacaaaacaaaacaaaacaaaacaaaaauuagcuuagaauuuuuuuuuuccauucugcuccuggcucaaagucuccacuuguucauguacuugggagcugagcccaguuucuuuccccuccaauaguccucuuuaccaucuuucaaaacgucugaagaaaucuuucuuuacuacuucugcagcacauucuucucauucacagaagauauuuuuguuuguuuguuuguuuguuuugagacaggguuucucuguauagcccuggcuguccuggaacucacuuuguagaccaggcuggccucgaacucagaaauccaccugccucugccucccaagugcugggauuaaaggcgugcgccaccacgcccggcagaagauauuuuuuuaauuaaaaauuuuauuuuaugccugugagcguuuugccugcgugucugccugugcagcacgcuugugccccaugcucauggugcgcagaagagggcguuagauccccuagaacugcagugagcccccagaccugaguccugggacuuggacucuggaggaggagccaaugaucuuaacuacugagucaucaucucuucagccagacuccccggagaguuuuauaaauaaaauuuguuacugguuguuaaaaccaacuaaacuauaagccaggccugggccaagcacuuuacaugcagcauuuucacuuauauucuucucagcgauccugugacauggcuaauuauuauuauuauuuuuuaaagauuuauuuauuuauuauauguaaguacauuguagcugcccucagacacuccagaagagggagucagaucucguuacggaugguugugagccaccaugugguugcugggauuugaacuccugaccuucggaagagcagucgggugcucuuaccuacugagccaucucaccagccccgacauggcuaauuauuauuaauuuucuuaccaucgaauaaccaagacucugauaaucagucuucauugucaacuagauuggauugaaucaccauggaaacuaaccucugggcauguccgugagggugcugcuuucugggaaggucugacucaggugggaaggcccacccuggaugugggcagugccacacgugggcuggggucccagacaacaaaaggaaaaguggagcugaccacccaugcuccucugcuuccuaauucuggaugcaguauaagcugccaccucaccuuccugccacuguggacuguccccuccaacugugaaccaaaaaagucacccuuaagugguguuuaccagguccuuuuuuauuacaacaacaacaaagauaacauacagaggcuugccuuacuaauguauuuuauccuguuucuucacuccuguucuucuucuuuuuuuuuuuuuuuugguuuuucgagacaggguuucucuguguagcccuggcuguccuggaacucacucuguagaccaggcuggccucaaacucagaaaucugccugccucugccucccgagugcugggauuaaaggcgugcgccaccacugcccggcuuucacuccuguucuuuacucuuauuauugauuauuaauuauauuauguguaaggucguuuuucuuaccugaguaccaugcguaugcagugucuggggaggccugaauauggugucagacucccugggauugagguuacagaugguugugagccacuauguggguacugggaggugaaccuggguccucugcaagaguagccagugcucuucuuagcuucugagccaucuccccuauuuuauuauguuuaauugugucugucuguauguauguguguaugcauguauguguguaugcguguauguguguauucguguauguguguauguguguaugugugcacgcucacaugaugguacaggagugcgguggaggauacaggcuccuggggagaagaccacagguggacagagacuaugcuucuugcaguaaguacugauuucaguuuuauuuuaguaaguuuuguuagugaagaggaggaggaggcaugaauugauaauuucagacuaugcuccuauagcucaucacagaggccuuggcuuccaucccagcauccugucagccaaucaggcaaaugauaaaaugggggaaaaaaaccaaaaacccaccaccaccaccaccaaaaccagugcugucauccuggcacgugggaggcggaagccggcaaacugcucuggguuugagcuuaagcuggcguaaacugugaguuuucguuucaggccaaccugagcaaugagauccuaucucaaaucaaguaaauaaauguguaagaugaaaacccaaccuuccccuuccccuuccugcaugaacagccuuuccucuaacugacccugacacaaaucugacaacuucccauucucucuggguaagcaguaagcacccacuggcucacugagccuaauaagcucaccaaacauaagcuagaaccagaggagaaaucuuuacagacaggaggacagagggacagacaauaucaccugauggagucuggcugcucgucaucugcaaugcugcucagcagcuucuggaaugaucuaaagaguuccaccuugcugauucgggaucuguucagaaaaaaggaggaaagaucacuuccaguugagcaggaaccaggacucaucacagcgcucaccugaauaaaguggccuagcagaaucuauacacaaacaauuaaccagggcuauacagagaaacccugucucaaaaaaccaaaacaaacaaacaaaaaacuucugcugagacccuacagcugagacgcagucuccuggggccgaauuauuauaacuaaauacuaggcacauguucauaaagccccaguuaauuaauuacuacucagaaaauuauuacacgaacaaagucaccccuaggccuucugcauuauauguuacaguuguuuaacuuggucuucuuggacuccuaacagcaggagcaggggcuguuucugacucuuuggucagcuuuugggaccuuucucucauacuggguugccuuguccagccuuaauaagagggaaggugcccagucuuacugcaacuugcuaugccaugguugguugauauccacgggagcccugcccuuuuuucaagagaaacugagggguggauggggguggggggaaaggagguugcgaaaggagacagggaagagaggagggcggggaaacugcagucaggauguaaauaagaagaaauuaaagggcuggaaagauggcucagugguuaagagcacugacugcucuuccaaagguccuguguucaauucccagcaaccacaugguggcucacaaccaucuauaaugggaucugaugcccucuucuggcaugucugaagacagcuacaauguacucauauacauaaaauaaauaaaugcuuuaaaaaaagaaaaaauauaauuaaaauaauacauuaaaaaagaacagucaccuauuaaacauuagaaagaacauauucaaugguaaaggcaacaaaauguucacuuuucauauaccuagcaauuuuacuaugaauauaauuuuaucaguuggcuauauguguugacuaauaaaauaauuaaucucagucaagacuucagauugaaaaauauuugcuuguuuuugccuccugaguguugggacugaaaguguguacuaccaaaccugguguauuacugaguaucaacgaagcauaugggaacauuucaugcacaagaaacuucuaccaugucacacucuauguccuggagauccacgucaaggcucaacaggccacccagcugacuagaaggaggccuauggggaucuauuuagcacuguuauggcaacacaaugcaaaggcaggugcagagucuaaugcccucuugggaggacaccugggaagguucucgacaauccguucccuggagaaccaagaggaacucugaagggguuuuccugcuuaagucaucucauugguaacgguaagauguugcccacacauacucggcacucgggcuaaggccggguccagaccagagccuuucgggcuaugcugucagcagcucauuccccacaccaagagguauguuuauaaggcaaauuagucugggagcauagcucaugauggaugacugcuagccugcacacgggccuggcuuggauaggguggacggccagaaaccuguucuguuuggaagcuugcucuaguaaagcaagccuugccuuagguuuuauuccacagcaggacaugaaagaaagaaaacuaaauucaagacuucaaagcccuagccagaacguuuauucaagguccaugauucaugcggcuugcuaguuaggagggcuuuuagggcuuagagcaaagaacaaaggaaccaacuagccauaaagauagggaagacauacaagaauguccggacuggccuggcgccucccuaucucccgcccuucugaccuaagcuaaauguuaaccagaugcucugcuguuaccucaaucuguacguacagucugcugauguuaaaaugaaccaaucaugugaaaccgcgccaauuccucccccagccccagccccuuuucuauaaauaccccuagcuuuugagccacauggucgaauccacugccuccugcgugagauacguuucgacccggagcuccgccauuaaacuaccucguguauuuccaucaagaaggucucucgugauucuuugggugcacgccaaaucgggacuugaguggggguuuccccacuagguucuuucagacacaguaaccacaugaguaaugcuuucaggagagcuaugcucgguagaaacuacugaauuaccugaggacccgaaggaagacuuuuucuaaguggcugcugcuggcugcugcuuucuaagagaccuggguccuuuuagcagagagaaccacaugcaaggacaggaagcccuucccuguggguuaacacugcugauuauugcaaaagaaagcacaggggcuuuuagauuauuuuauuucauuuauuuuucuuucuuucuuucuuucuuucuuucuuucuuuccuuccuuuuuuuuuuuuuaauauuucaucugggaguugggggagagggauuuaauuugauuaaaauauacuguaugaaauucucaaagaauuaauaaaaacacuacuacuuaaaaaugucaaugcauggugguggugguggcucaugccuucaauuccaucacuggggaggcuagccuggucuacagagcaaguucuaggagagccagggcuacacagagaaacccugucuccaaaaagccaaaacaggcugggcaguguuggcgccgggcagcagaggaagguggaucucuggaguuugaggucaccuuggacuacagagugagguccaagaagguaaaggcuuuuacacugagaaguucugucuccacaaacaaacaaaaaacaaagacaucucaaaaaaaaaaaaaaaaaucccucaucugacaucucccugucgcccauacuuaaguagcuugaaaauaaaaccucucaccugggcuggugagguggcucaggaggaaggugcuggcugcucagagugaugacccguccagguuggauuucuggccucuguacauguacuauggcauguguaaaugugugcacauucaugugcuaugggauaugugagugcaugcauaggugcauacaaaacaaacaaacaaacaauguaugaauguaguuaaaaucucucagcccggguuggugagauggcucagcaguccagagugcauauuggcuuuacagaggaccucaacucgguucucaguaccagagucugguggcuccaccuccucauucagcagccccuggccucuguggucaucuucacccaaguguagacucucacacacacacacacacacacacacacacacacacacacacacguaaaaacaaacaagcaaaccccccugcucauccuuuucagugagcuguuucgugaucuuuccagaauauucuagugucucaauggacacagaggcuguuuuucuucgggauaaagagaauuagccucuacuaugcagaguaaaaaccaagcuucuuaacaugagcaucuuuuaugagguuauugguauuucccauuguuuuacacacucccuucuugagucuaacaaugccaucugagguccccagagaguccagagggggccucacaaugcauucacuuagggaugagcggugaggggccugcuucuucuagcagcugcugguccuaggauagagugagcuggaaucccuguaccaguaauguucaaaggucauuagguggcuacaagggaaaucaauuuugcaaaaugccauuucgcucaguucugacacugcuuaacuuugcuuuacaguuggcaaguaagcugggagaggcugagugcuuugccuaguuaccccugggagaaaugguaccagggucugauacuggccccuucaguccccaagguuuugcugcccugcagagucuuccuucuaauucauauucugucugucagucagucugucugucucuauccuuaucuugcagauaaggauuaaguucucagccugccuacugucaugcucccacuaugauggucuuggacucacccucugagaccuaagcugccauuaaaagcuuccuccuguggguugcccuggccauggugcuuggucacagcaggagaaaaguaacuaagacaaguggucuacccacgaacucucguugaacagauaaaagaacauugcagcccacagaacagcuggccuugcccccaacucauacagacaauaggguuagaaggugacacacuccaggucacacagggaacacugacacacugugacaggcuggagagcugcaccauagcacuggagaggugauccuccugauucaggggguagcgguagcugaguuggccucuagaagugugaggguaaagacucuaagagaagccacagucagcagagugggggccaaagaggagacugagucagucccaaacagauccagagcacagcaggaaacccgccccucuaccacaggaaacacaagaaacaaagcacagaccuuuguaacccugauuccuuagauaagcaaccaaagguacagccaagcaaaagagaaaguacauaaauuugaccuuauuaaaauucaaaacuuuugugcaguaaaaggcgcuaucaaaacagggagcagcagagaggacucagugguuaggagcacuggcugcucugccgaauccugguucaauucccagcacucucaagauggcucucaaaacuguaacucuaguuccagggacucugacacccguuucuggccucugugagcacugcacacacauagugcccagacauauauggaggaaaaagaccuacacacauaaaguaaaaugaacaaaauccuuuuuaaaaaaguaaaaagggcugggucuggaggcacaugccuaggugggaggaucucugugaguucaaggccagccugguccauagagaccugaguuugguccuugggauccacaagguggaagaggagaacugaaccccacaaaauguauucugaccuccacacggucccccaaaauacauggauguaauuuaaaaauuaaaaauaaagacaaaucaguuacagaaugggcaaggaacgagagcagauauuucuccaaagaagacuacaaaugguuagcaagcacacagcacauaaaagaugcccguaguaucagugacugggaaaugcagagcgaaacaaggagcagcccuucagaccugacagcaaucacaagcguggggcaggaugcaaggcagcuggggcuccucuccaggguucgugggaauggccauggcacaggugcugggaagaugguucacucauccuaaaaagcuagccaugugguaaccacauggcccgcuauuucacugguauguguguucccuaggaggaauuacagcauacaagacagguaccugguuguucacaccagcaccauuuguaauagcagccuggagcagaacguccccaaggccucacugaagagaggagaggccaaugagggguaagcaagcugcucacccaugcagugaacauggcgccagugcacacagcgagugcgcugugagacauguuggguaggugaggcagacacagaggaccauggggaaaccacggggaaaccacgggaaagggcugcauuuauaggaaguauccagaagacagaaacagagaaaguaaguguagcaaaggagggauuuccaagggccaaggaggaggaggaugugagggaggaggaggagggggaggagggggaggaggaggaggaggaggaggaggaggaggaggaggaggaggaggaggaggaggaggaaagaguaauuaguuuccuuuugggggaaaugaaaaagucucagaauuggauaggaaggguugaauucauagcuacccucuccccagccccagaaagcuguaccuggcccuagggcuuccaaucucuuucuuuguuguucccuguggaaaaccauuggcuguaacauccaagggcugcugagggacagcgcuccagcugauagcuaggaagagaggaauccugggguuaaaaccuggccagaggcuucucucggcagugggcagcagguagaacagagcuagaacuggucaaagugcagaguuaauguccacucaguguagccccgaaugggacaacugcaucaauccccacuuccaaggcucggggcgcacagcaguggaagaacgaacgacagagcuggggggagggggacaggcugggaaauguucucuggacaguuauggcugccucgccagcguagccaugguuaucugcaaaauauccagccaagcugagucaacauuuguucagacagcacuaacuggagaccgggggcuacaaaaagugcaagcaaaccccaagccgaaagcaaagcaaauaaaccaguugucaaauaguucacaaaaauaucucugugauucuacagcagcaugaaagcugucuaugacaucaaaaucaaguugggugugaugcuuggcucaccaggguucagugacaucaaacgguucacgauuauuacuauagcuuacgguuuacuauacuuauuuacagggggagaggcauacacaggucauggugcacaugugacggucagaggccaugcuaaguggagguggguucuucgcuccccuuauaaguuccuagcuuacaauuucuuugaaaauuuauuauaugcuagguacagaauuauaaauuauaauauauauaugcauauuuauaauauuuaaacauaauuucuuuuuguuuguuuguuuguuuguuuguuuucaagccaggguuucucuguauagcccuggcuguccuguaacucacuuuguagaccaggcuggccuugaacucagaaauccaccugccucugccucccgagugcugggauuaaaagugugcaccaccacgcccggcuuaaacagaauuucuuaauucucauaauagccaugauaagcaauauucuaaucuaaaaauaaaguaggccaagacaggguaagugaccuggucaggaccucacagggcaucuuccaaggaacacacugggguucccacuguccuaggcuucgugaugcugaccaguugggguucccacuguccuccgaggcuucaugaugcugacccgucuagggcagucugugaugcuccaggguaaacaagccaaccgggaucccuuaccugccccacaggggacgagucggccuggacugucaccucuuuuccugugcaccgcacagcggcucuguucaaacaguaaacccgacugcuguauuuccaguucuugaacuccaaagccucuggguaaaaccaagguuuccucacaccuaaguucaaaggaaaaugcacucaguuuagcuggaccuagagaaaaggcucucagagcucaguguccaagccuuccgagaaccacagggcccaggagcugggugaguuuguuuuacuugcugaggagggacaagugagccaugucagauuucccacagugagaacuuuaaaauaaaugaggcggugguggcauacacauuuaauuccagcacucaggaggcagguggaucucugugaguuggaggccagccuggucuccagagcaaguuccaagacagccagggcuauagaaagaccuggucucaaaaaaauaaaauaaaaaaacaaaaacaaaaagcaagcaagcaaacaaaccaaaagcaaaacacaaaaaccaaacaacaacaaaagaagcuuuuaaauuuauuauuuauuuauuggagagaggcucccggguggccuaggauggucacgaaccugaauuccggcagaggaugacccugaaauucugauccucuugccucugccucgugagugcgggguuacaggugugcacuauagcuuacccuguuuuaugaggugcugaggaucaaccagagagccuuacuuaugccugccagcaagcaguuuaccaacugagcaacgcacccccauccccagcaagaauuuuauggcuuaaaagaucccauccuaccggucugaggcauagcuacaaacgaaguuaaugcccaucggugggggucagaaaucuaaaauuuuacucucauuuugagaaacuuaaacuacaccuuguucacacaggcuuucuaggaaauccuucaaacaacccaaacuaaaauaacccuacacuauaaaaguuguauuuuuccucuucugaacaagccaggugcucacaugacgcaaauccagugcacagaugggaacuucagaucucagaaacuuuacaacuauuagcagccaacaccacacuccaugcccuuuccagugccaggaacgacucgccuuuugugguuauuucacagcaacggagucaaacguguguguuacuucacuuagcuugauacuuaauggcucacucacauggaugcuguagcauguaucugaacacuaacuagucuuuuuuuuuuuuugagacuggaucucacauagccagguuagccuugaacuuaauguaacuucaaguccuuucuaacagagaacaguacugcuuguuuaaaugcacaaugcuuuuuuguuugcuuacuuucuuaaagauuuauuuauuuauuuuauguauaugagaacucugucgcuguccucagucacaccagaagaaggcauuagaucccauuacagaugguuacaagccaccugugguugcugggaauugaauccaggaccucuggaaaagcauucagugcucuuaacugaugagccaucucuccaagcucuguuuguaugcuuuuuaagacagggucucagauguauacuggcuguccuggaacucacuacguaaacuaggcuggccucgaagcucacgaagguccaaaugccucugccuccuugagcacugggacuaaagacguaugucgccucgccuaaauguuaucacuggauaggagggaaagaagaauagauggggagagagaucuuugaaucuaauuuuuuuucuuuuguuucuucuuugagcacaacuagcaaacugcaaccaacccccuagaugaccaccgaccaccaaccuugccucuugaggcccuagcauuuauauacucucugaaaaguucccagaauuccaaauaucacacaauggaagaaacuaucugcagcuggcaaaaccaugucucugcuagagcgcgauucagacaguccuaagcagccccauagcccacaccugggauuaaaaugaaagcacagucuuagaauguguuuuuucugaguuuuaaaaagaacccaaaaucccaauauugucacuguagggauaaaaacuaauauuuaguuuuuaaaaauuguuucuuguuuguuugcaugcuuuuuuucccuuucuuuuugagacuggaucucauguagccuaggcuggcgccucaaacucuuaucuauagagcuaaggguaacuuugaacuucugaucuuccucuccaccccccacccccccaccccaccccgcaaaugcuaagacuagaagucuaugucuccacugucaccaucaugcccaguuuuauguugugcugagauccaaccuagagcuuuccauugaaauuaggcaagcgcucuuccaacugagaugcaugccccagcccuggccauuacucugcuuacugcggaaguacacagaagaaagccgauaauguacagccuuaacaaagaagagaagcgcccguaccaccaugacucagaggugauuaccgacgagcagccuccuacagcuuuccguacuggcauauuuuaggacaagacagagcuuacuucaucuucuaaauugcucuuuaggccucacaaacaucuuuuacauuaaauauuuaucaacacuauuuuuaaccaaaaaaaaaaaaaaaaaaaacccucacuuaauuuucaacuguagaacauuucuuuuuucuuuccuuucccuuuaaguuacugugcauauaaugcaaaccuaagacuuacacagucuuaauuauuucuuuacaaaaagugacaagaugggaaacugaagagucuaugggugcagacugcuggcuucucgcuccuccucugcugcccucccccacuccucucaccugccagucaaugcucuccucauggcuuccuggcuguacgggcacuucccgaugaccacagcugacagguagauaggcuucuccaggaagugcaucagcagugcgcccuggcauccgaggacauuccaccuugccaucuugucacugcaggacauggagcauguccugucuccccugccagguuuuacacgaaguagccccaccuggugguaggcagcaccuggcucucucaagucuccaguuucuccaggaacacacuuggcucccguccuguacacauccaccacucugaagcuaccugaagcuauuccauuggcagcaucugguuccuccuuggugagaucagagcugcugacaucugguuugacuggaccacuuuccugggucccauggugagcuacacaauuggagagugaccuggcagguguucccagccucaucuucuuggcuacaggacuggcgggaucuucacaguuccuuuuaucuuuagaauccucuagauucucagucucuuguacaggugaguuguuggcccaacuucugaugacaggacagcaaggcuguucuucaaacucgagcaucgggaugauggaggcauccccaccugcacaagaaggagccccugaaccaguaauucucagaaugaguccccccgaccagugacagcaaugugccuuaugaguuagaaaugcaaacugugaggcuggagagacagcucgguggcagaggauugccuggcauacuggagaucccaaguuuguguucugucugugugugugugugugcacacgcgcacgcgugcguguagagcaaauuauugggaccuugggaccuaauauacaugcugaaccagaaacucugaaggugggacccagaagucuguuuaauaagcugaguaggccauucugaugcaagcuuaaagacucauggccuuaaaacaaggcaauguguuuucccugcugagcccagaugaauuaagagggagacaggcgauaagccuugguaaagcauaggccuaaggggcauauggccaggucuugauugcaaccaacauuaaaaaaaaggaaaagaauaaauaaaaaccccaaaccgcaugcucauaugcaggugugcacauggcauggcacauguguggaggucaaaggacaacugccagugccaguccccacccuccucuuuguuugagacaggauccuguucccugcugcauacgccagaaauccauuuugucauaggagugcugggauuauagguauggccuagugugucuggcuuugugcagguucuagagauuuaaacucggacggaauggcugauggcaaacacggagaccuccauggacagucuucuuuccucaguaacacucgggcuggagaggggugcucagugguuaagagggcuugcuguccuuccaugggccaagguucgguuccuagcacccacaucaggcgguucauaaccuguaaucccagugucagagggucugcugguacuuguauguaggugguacacauaaacacccacauaaucauaacguaagcaacaauaaggaaauguaucuguaaaaguuaacaguauauaacauauaaacaaacacgugucggacagcaaggugcaggcauucaagcccacaucaaucucaggucugcaggaagcuccuuccuagaccccgcagguuacaacuucucaugagagaacuggaaaacugaccacugaaacaaacauugcaaggaauuucuaccacaaggaaguuuagaagcccugcuuuagaccagagucucucagugucuacacucaugagacuuuuguuugucuucucuuuugagauaaggccuucuguaacucguacuggccucaugguaagcacuuuaccgaguuccagccccuagccugacaacuacugauuuacaaugagcaagguaucccaagggcacuuguggccugagagccuguaagaugccuuggaaaacaguaauggcuuauuucauggcugaguaaauucgacaaacauuaaucaaaauauccucaucuuggggauuuuaugauguauagucucacagaaaagacccaaaauaagcuacaagguccaguccacaccaguguuucugaaagcgccggugucucccugugcuguuuuacagaguccucaucucuucugugcccacagaaaccaaagcaaaccugaggucaggggaaagcgcagcacucccuugagaggaagcucuuucuucaaacaccagcccaaugugugcugccuucccagugugcaaagcguacuuguagucuuuauaaccacagaguggcaaaggaaagagggacagagaaggagaaaugucgcaggacaggccgccuggcuggcugacuuccagagaccuuacaaggugacagaaacuuuggagaauccacuggggcccaccuccuacucuguaggcucagagaugugaucucgacagaugccugagugcgggaggcugacucacaccaauaaaacacaaaggcaagcguggaaaguagcuaaccgagacccacgguauucccuaguaaugagaaguaaaugucaggggggccagagucgcacuuguaggcagcgugcucccuuccuacagauaagccacgggcgggggagugccacacugugcaaggcgcaccacauuguaagguuacucaugaacagagggaguugugucagugguugaagaauuuuuuccagcaaaacaauucccagaggccuuaagaucaacagaggacugccaacuucuuacuuaagaucuuaaaaagcaaaacaaaauccaauuaucacaauuaacaaaaggaagaaagaaccuaacccccacccccacaaccaccccccagcuguucuuccucccacuucucagcacacagucaucauucccccagagcccugaggagaaccuggacgucaucucugccuucauccuuccuaagcaaucacgaggucagucacuguccuccugaagccggcuuacacuuacucaacugucuccaucgccuuagugaccgcugcccuccccagaucaccauacucucaccuuaaaacaagauucugagacccuuuacacuugaauuaccuaccacacuacuacccacucuugaguuuucuugcuuugcacagacacccgcagagcagcacggccugaguccccuggucugggaagucccucaggaggcugacauccuggauaaaccccccagggcuuuacucaggcuaagcaagcacugagucuucuucauugcuugauacucagugucccuauuguguccaguguuagagaacaucgguucacgacaggaccgguggcucaccucuguaaccucgggaggugcaggcaaggcggacuaauagcaggacugggcuacaaauacaaacauccccagugugcggaacaugccuaaauucccuacacuugggagacugaggcagaaagauggcucagaguuucugguucggcauguauacuaggucccaaggccagccaggacgacuuagcaaaaaccugugucacaccagugagagggcucaguauguaaguguguguaaguauguaagugagagggcucaguauguguauaaaugugugagagggcucaguauguaaguauguguguaaguguguaagugagagggcucaguauguaaguguguaaguaugugagagggcucaggauguaaguauguaagugagagggcucaguauguaaguaugucaguguguaaguauguaagugagagggcucaguauguguauaaaugugugagagggcucaguauguaaguauguguguaaguguguaagugagagggcucaguauguaaguaaguguguguguaaguguguaagugagagggcucaguauauaaguauguaagugugugagagggcucaguauguaaguaugugugugaguguguaaguauguacauaugcaaguguguaaguaugugagagggcucaguauguaaguauguaaguauguaagugagagggcucaguauguaaggguugcucguugcugccaagccuaaugaacugaguuccaucuccagagcccaccuggugggagcagagaacgaguaacuacaaguugucugucugucucuguguauauacagcagcacauguauauauguguauauacaacauacacgcacagucucuuuuucucucgaaauauauaauuuaaaaagucucaaaaaaugucagguggugguggcgcucgccuuuaaucccagcacuugggaggcagaggcaggcgauuuucugacuucgaggccagccuggucuacaaagugaguuccaggacagccagggcuacacagagaaacccugucucgaaaaaccaaaaaaaaaaaaaaaaaaaaaaagagagagagcgagagagagaaagaaauauauacuuguucaaugaauagaugaaugaaugaaaugggcuuuaagauuaguuacugcaguaagacuuugugcuuuuugagccccuaauaauucuacuguacuuuuuuuuuuuuuaaagauuuauuuauugguuauauguaaguacacugucgcugucuucagacacuccagaagagggagucagaucucguuaaggaugguugugagccaccaugugguugcugggauuugaacuccggaccuucggaagagcagucgggugcucuuacccacugagccaucucaccagcccucuacuguacuuuguagggguuaaguuugaagaugcccaccccugacuuugagaacuaacaguguaagacucuacacugcccuacaucugcccuuugcuuuccccagaagcaaugugacuguguauauaaauagucgcugccauuaguuuuagcuguuuuuagccagaauuaccuuuggagaaacaucucugugagggagacaagcacugggaagcaggcaacagaacaauacucccaagguuugaguauacuuacaggguguguggcuagagaaaaacacaaacgacaggucaggucugagccuccacaguccucuuugggucccuggaacaaagaugcuauccucuuucaggacggcugccaaauggagcugauggagaagguaucugagaggcacaagauaccagaaugaaccgguaggcuggugacguagcucaggggaccuuacaugcugagggccuagcgaaugcgacagauaccccuuggcuugauccccuugcgcuggaaaaucaguuaaauggagaaaaaggauaaacagcacacuucugugguaaagagagcucucagguuggauaacugcaggagagggcuaaauagaaugagacuggucgugaccuggccuuaugggaaugauagaaaugagaccguugagaagguuggaagcucucaggcuucacccugaccugcugaggucagagucugagaaggcuggucauuuucuccacucccaccccugugcuggguuugaacccagugccaggcaagcgccccaucacuaagcuuaugccccggcccagaaaccuggguuuagcaggugauucugaggcuuaugcaggcuagagagccacuaacuuaugcccugguaguucugcgagacaugaucugcauuagcgccagcuuccuagaaaugcaaaccccguuccaagaccgagacuauuuggggaguguagcuuuaccucuggaaacuccuucuggcuaugaucucagcauggcugucauugaggauguccccuguggcaaagacaggacauauauuguaaugaagacguggcaucgagagccuggaagaacauccagcaggcccccacgccagcacucaggaugaccauguuacccuuggagggcacugagcuuguguuucucaauauaugggaccauaagacacuuuggauagggggaaagccuacaggauauaggaagaagugggcgugguggggcaugucuuuaauccuagcauuugagaggcagaggcugguggaucucugugagugugaggucagccugguuuauacagggaguucuaggccugccagggcgacacagagagacuuugucucaaacaaacaaacaagccagcaaaaauauacaaaaucguuuagccacaagaugucaagaauaccccugcccaugugaugaugaccaaaauacucuggacaaugccaaagacaccuugaauacaaaauugccagugacugccagguccacaguaguauauguaacccaagguuuaggcaggaacaccaugaguuccaggccagucugaaugacauagcauuuuauagauacgccuggccuauauaguaagaucuuaucucaaaauacuaaguauaagcaaaacaaaguaccucuagucgagaaccacugauuuagagaaaugauuuuuuaagugcuucaagauugaaucuagggucuuacgcagccaggcaagugcacugccccugagcuacugccccagauucucucaauuuuuaaaagauaucuaucuuauuguacuuuuauuuauuuuguauauaugugccauggugugugugcaugugacacaagaugcauggugacaucagcggacgauucaaagccuccuucuucuaccgugugggcucagggaaucaagcuuaccuugaggcucggugacaggcagggucucaccuugaagcucuagcuggccuggagcucaucagaacgccauagaaauccaccagucuuggcuucccaagugcugggcuuacaaccaugcaccaccaacccugacacuuacucuauuuauuuauuuuugugacuuggggguuucacuaagcugguuaaguucuucuucaacuccaccuguggcccaaacaggccuugaaauuuagauccucccccugccucagcuuccuaagccacugagauuacaggcuugugccacccgguuacagaaaucuugcgucugcaacucagggauggagaucucuuauaccacggcaucauagucaugcucacggugacacauuuccacagcggacgugacacuguccuggaauacaggagugacggcuaggaggacggaagggacgucagcauucuugcugaugccgaaggccuguucaugguugcuugccggcuuccgaagcuccaaggcugccccuucucccuacuaagcccgacugccuuccagauguagcgugggaugacugaacucaggaaccuuugguucaaaccugagagcgcugacugccuuucagaagcacaagccuggggauuuccgccccgauuuggauuucuuuuccuucuuuucucuugaggcagagaauuuacuaugcuggucuugaacgucuuugccacagcgucuagugugggguugacagggaugcaccaccauguucauguucagcucuggauucucauuuuuuaagaaaaugaauggucagcuggguggcggugcauaccuuuaauuccagugcuagggaagcagaggcaggcggaugaucuccguggguucgaggccagccuggucuauagaguuccaggacagccagggcuacacagagaaucccugucgcaaaaaaacaacaacaacaaaacgaagccaaagaacggucuucggauccugaggacagucaguggugaaugaagggucagccacucuaagcagcauggccccauuuccuugacaaggucaguauggacuuagcacagagacuacuguuuagagcccagucuuugcuuaccgcucucucgcaucuuggacuggccuaugcauuuuguuccuguucccauugagacaacuuccuuugucacugagaggaaaaaacaaaacaaaacaaacaaagcauuaauuaagcgaguggacucucagaggcugaacacuuccuaguguuucgguuuaauaaguccacauuccuccguucucuggaggauucucacagauggagucaacgggacugcaguucccuuggggugguuugucgccaccagaaguacugcgccaccuggugggcaaaauggggaaaacaccuaacauaguucccauaacccaguaaguugcaaugguugcugacagggagaaagaaaggggcucucaccuugcacuuccuucucagggaugucacaagcuugguuagcugaagccugaaucuucaccacagcugccagcaagguccacucacgauuuggcucaggcuuccccugcuugggcagucugacguuauagugugcauagcacagcugagcgaucucauccgcgguccacauagguggagcuggagcugaggccacuauagaaagccaaaucuaucagaacagaaaggagaaacagcguaguaagauagaaccucacuccaacacuccagccaucucuagugaagccccacggugcucagacuaagguuguuuuuuuuuuuuuuuuuucuuauuaaccucccucccuucccaucuuuaaugaagagugaagcccaggggccgggcgugguggugcacgccuuuaaucccagcacuggggaggcagaggcagguggauuucugaguucgaggccagccuggucuacaaagugaguuccaggacagccagggcuacacagagaaacccugucucaacaaacaaaacaaaacaaaaaacaacaaaaaaagagugaagcccagaagacaagcuauuucuucaagaucaacacaaaugauaaguuaaugaauguggccauucuauguuuuacacuguccucucagauuucagcuugcuuugggcauguuagcaccuuacaagguuucuuuugagacaaauguucuuuuccuccguuucuaaucuaccucacuccagcaaauuuccaaagucucucacugaaagcucucacagcagcuguguuuaagggugugggcauggaguuauacuuucuagguuucaaucucaguuuuaauacagaugaacugugugauuccuggguaauuaguuuucacaucuguuaaaacaugacuaauaguauuuaacauuuuuuuuucuagacagggcuuuucuguguaacaguccuggcuguccuaggacuugcucuguagaccugggugcccuggaacgcacagagaucaccugccucugccuccuuugugcuaggauuaaaggcacgugccaccuagcuaguauuuaacaucucuuauaaauacuuaaaaaggcaaaugucuauauacugugauuagcauucagaagauacaacauuuggugaucugggaaauuuguauugguggcagaagagaagcaauguaacgggcacaccaagccacuuccauacaaccuaacagaacauuaugcagaucagaucugaaagaggccuacaguuggcagaagaaauucucucacucuuggcuguuagcgcucacuggauauagcucgacuucagucgauuauauaaaaagcuccguagaugagcucacgcgauggcuagagauggcagagcauuuguagaauaaacaacagaauuguuuuuuuuguuaguuuguuuuuuuucugagcucugaugcgauguuuuggcaagguauuucuaagacuucugcaaaaugcaggcacauuuugcaguaaaugguaaugacuauucuggcaggggcugacagagauuguaacuuucaagucuaacgcagagaagucuuguauuucuagaaggaaucccagaauccuguuaguuccugauaggcaucacagaaguuuauuuuaugaagguagccaucugccauuaaauucgagguacacauuagaacuacaaaacaaggggacgaagcgguccaaacuacaucacgucauucacgcaguugucgaacguuucgauauuuuggguccgcuguaauucaucucuacaaccccagggcuccuucauacgaagcagcucacaacagguauugcuuuggcuaaaaauaacagugcaaagguugaaaaaacaaacaaacacuucuuuucccacccuuccuaccgcagggcuggagagccuagcagggcugagaccccuccccgugggagcaguggacacagguccucacagucuccccccaccgcccuccccucggccaacuguguagagcuaaccccgagacgccgauccggagucccucacacccuauuauccacgcgccgcaaccuccacgcgaugccccucuaccgccacgcucguuuaaccagguugcgcagcggaagugacgcccuagagggccgcuccggucaagcucugcccgcaaagcacgcuggucuuuguagucugugggaacggugcaaaggggaggaagccgccuccgcagcaaagaccgacuuagcucgcaucucaucaaaauuuugaacagaacuauaagcagauccucugacaguuucucaccucagucaugggcuuggaugaccuggcccucacucauuucucucauaacccauuguuauucuucaaaucguuucuuuuuuuuuuuuuuuuuuuuucgagacaggguuucucuguguagcccuggcuguccuggaacuuacucuguagaccaggcuggccucgaacucagaaauccaccugccucugccuccggagugcugggauuaaaggcaugagccaccacugcccggcucuucaaauacagucuuauggacauauaugcauguauauauuuuaaaagauuuaugugcgugugccuguaucaauugucaauuugugcacauaugugcaugcaaaugcccaaggcagcuagaaaaggguauugggaacuggaucacgguugcaagcugccugacacacgggugcuggguacugaagccugguccucuguaagagcaucaaucccuugcagcacugagccaugucuccuguacugcagucuaagucugccuccagccaaaaggaaccugcacuggaucuggucugguucucccucaacucugcacucaagcccuaaagaaaauaaaagggauuuuuauggaagaagugacuugacuuuuguucucugguuguuuccaguauuucagcacaauggcucauacugaauagacagacauuaauauacauuuauuagagauucugacugcagguggggccgagaaguuggcuuaggaguuaagagcacacccugcucccauggggcugaccuucguuuuucagccuccgugcugggcagcuuacagugccuguaacucuggcucuaagggacccaacaucucuggccucagggcaccugcacucuaaaugcacacacacacacacacacacacacacacaauugauaauaaaaauaaaucuuaaaaagaauacaaugacagagcucuaauuagaccacucaucagaccagcagcccgggggagaaaaaguaacacugcauggguaaagagagaaaugauuuauuugguaacgaggaauaaaaagaacuucuuuaguucuucucucuuguggagguuggacugcaguggccagauggacggcgccacacaggaaucgcucccucagaccagaucugcugagaugcagacaccauaguugcaugugccuucuagacagaggggcuggccucugugcucucugggguuucaguggucgcugcaguuuccuucuuguccucuggcuucauggcaggaaacagaaguacuuccuagagaagaggaaagagaagcacuuccugagaagagcagagcaucugccgagguucagaagcaccaggagccgggcucaguggaacucaggaggcgggggcaggcagaccucugcgacccgacuucaaggccagccuggucuccauaugguuaaguuccaggacaaccagacuauguaguaagaccccgccuuucaauaacagggcacuauggauuuuucuccccacuauccuacuuuugcuguugccugauguuacaaaaucuagaaguacgcauccagacaaggacacagaaccugcuagggucccaugccaaaagaacguaaaauugaguucccggugcuagagauggcucagccauuaagagcacuuguucuugcagagggccgagaugugguucccagcagauacaugguggcucauagccauguguagcuuguuuuaggggaucugacaucucuucuggccucugcaagcacaagggaugcuuuugguguaaaugagccacauguauuuuuuuguuuuacaagugacccucagcugaguggugauggcgcacgccuuuaaucccagcaaucagaaggcagaagcagggggaucucgcauuucgaagucagcuuggucuacagaguaaguuccagagcagccagggcuacaaagagaaacccuauguggaaaaacaaacaaacaaaaaaaaaacaaaccaaaacaaaacaaaccaaaagugaauuuccuccuaggccuccaccaacauaaucccuguguucuggagguagaggcaggaauaugaguuauaucaaagucacuauaaacuacugauggccuuccaagagagcccaggcuacaugagauccugucucacaacaaguaacaacaccaguaaaacccgucuucacaccucacagaacggacugauuuaaggcaaaccauguagugagggcucagcguuucccuggacacugaagaaaagcaaaccauuaguacccccuccugucucaagcaggaaagacuaaaaucccgcagagccacacgcucgccagucuccucccguaaaguggaaccucuugagccucugcuuucuuucccagguccucuacgcuguccccagcacaguggagucuggggaagcaggagcugggcggccccugcguacauaccuugauauuguuggaaucggugagaaacauggugagccgaucaaugcccaugccccagcccgcugugggaggcagcccguauuccagggcaguacagaaguucucgucuaugaacauggccucgucaucaccggcagccuuggccuagagaaaauaagagugaaauguucaaaaggauccaaaucaucuagucugggaucuagucagcgguccucacccuuccuaaugccgugacccaaccacaaaacgguuccagcguuucuucauaacuguuauuuugauguuaugaaucauaauguacaugucugauaugagaccaaaaagggcucaacccacaguucuaggcaaucucaguguccauaugaacagacucuaacuuucagaaggggcaccagaggugcccaggacaauuucugaugaacuugcuggaaaaugauuuccagagaccucaggaugaaacccauuuuaaguagaaugugaugguacauaucuguaguucaaauuacuaggagggcugagacaaaggauugccaagagcuguaggauagccugguuuaaauaacuaacucuaggccaaccaagccugaacagugagaucuugucacaaaaguuaagggagccaggcagcccucauuauuuuauacaaauaauguacaguaauuuuuaaaaagacagucucugucuucuuaaaucugcuuggggauuugagacuccauacagcuacuacaguauggaacuaaagcaucuuucucuaguuccugaaaucagccaccauggcagagguagccgggacuacauagacauucuguuucaagacacaaagugaaacaaaacaauaccugcccccuuccaaaaaaggggaaagcuauagucuaagaaaagguaugccuagccaggcagugguggcgcacgccuuuaaucccagcacuugggaggcagaggcaggcggauuucugaguucaaggccagccuggucuacagagugaguucuaggacagccagggcuacacagagaaacccugucucgaaaaaacaaaauaaauaaauaaaugaaugaaugaaugaaugaauguccuuguuaaauguacuuuugaggugucgaaauauaggcaaucuucaacucacuauauguguuguauaauaaaagccagugugaguggcugugguaugcagcccuguauccccagcccucagaggcagagacaagagggucaaggauucaguguggccuuggcuaccccagacugucucaaaaacaaaaagagcagcucuauuugaaugggacuuccuccugcaaagccucuuuauggagcuggagaguuggcucagcgguaagagaugcucuuccaaaggauucaaguuugauugcaaaugcacacuugcgugcgcgcgcgcacacacacacacacacacgcacacgcacacgcacacgcacacgcacacgcacacacacacacacacacaugcuacaauacaaaaguugggaagcuucccuggcuuagguaaaacaccaagaaaguguccagcaacacaggguuaagggcggugcuuccuggugugaggguaagcagaugcuagucucacucacucacucaccuuggccugcuccucaaacagcugccucugccgcacggggucauucagcucaguauaggcauugcauaucuccuucuucaugacaaacagcucaaagcgcuccgugagacccucuuuggagcggugccuggggacgcgagaccacagaggaugaauauucagagcucucauaaugcaauaccugacucaaaagucaaaacuggaagccucaucaacuuccgcacugaucucugguaccagagccaaggugagagagacaagagacuugacugcacuccugacaggcacggggacggacuggacccaggcccuucugcuuugcucucauacucugggcucccacuuguuuuggucaaggacauauuggcaaacgucuggcauauauuugcuuguugaggcuuguucuuuugggaugccugccuugagaaccgaaccaccaugcugacaacagacuacugccagagagaucaugugaagaggcccugacaggauuuccaucuuagauauuguaucaaugcaugucgcagaaagaccaccaccaagucaacacaggacaucaaaaaaccucuaucacuuuauaccauuaacuucuguuuuuuuuguuuuuuaaaaacacuacugaagcugggcgugguggcgcaugccuuuaauuccagcacuugggaggcagaggcaggcggauuucugaguucgaggccagccugguccacaaagugaguuccaggacagccagggcuauacagagaaacccugucucgaaaaaccaaaaaaaauaaaaaaaaaauaaaaauaaaaaacaaaaacacuacugaaggaccagagagacggcucagcaauuaagagcacugaauguucuuccagagguccugaguucaauucccagcaaccacaugguggcucacaaccaucuguaaugaggauccaaugcucucuucuggugcaucugaagagagcaacaguggacucauauacaauaaauaaauacuuauuaauaagcaguggugaagauugagccuaggccuagacucacguuaaguaaauguccugcugcguagguacagccgcagaggcccacgcccuacuugaggguuucugcagugacaagcuguaucuuaccauuuggccaaaggacucaugaucugugggugaucacagaugaagguagggcugaugcaugugacuucgaggaacucgccaacgagcuuaauaggaaaacagagcagaguuacacguggcuucucaacaccacugacaguccagcccaagggaagguuuuaacucauacagaugaguucaccuuguagcuuuuucaaaggacagaguuuugaguaacauaauaugcacuauuuggcagaagagaaauauuacauuucaaagcucccuuuugcuuauauuucuuuuucccucauuaauuuauuuuauucacuuuucauccugaucacuguguccccacuccuggucuccuccgcagugccccuccuccucuccucugagaggguggaaguccccugggaucaccccaaccuuggcacaucacgucugucucugcagggcuaggugcauccucucccacugcggcuggacaaggcggcccaguuaggcaaaugggaucuggggauggggauugagccaccccuucccuggccuugguuugcuaagugaguacucuaucaccgagcuacauuucccaauccaauucagaguuugaauucucccguuccucuguaaggcuucccugcgaagcugcaggggaggagucucccgggggauccaugcccuagggaucagggugcugguaagcacuggacgagcacaaguauggucucuugccuuaucaaggagccuggcugugguccgagguggggggcauucaacagcuuuugcaacacaaauaucaucaagaauuuuccgaguuucugugacagaaaugugugaguuaggacagggaacaucacuguguaaaaugucuauaaauacaacaggugggacauuuuagcuuuaacccaaauaaaucuggagcugaccaagaaggcaggccacaugguggaguauuguauguuaccuucaguuucaaagagacugguuucuggcagcuucacaccuagggcuuucucaagcucuucuaccaugcugauucuucggaaggguggggugaagucgaccucguaggcuuggccuuccggcccaucugggugguaggugaucuuguaacugccuguaaugcucuucaccaucccugggaagaaagcagcccucucaaggacggagaacagaaguucuccucuacaggcagcacggccgucuuccacccgaguaugagcugaaggcagcaggacucaccugacagcaucuucucugugaucuccaugaggucaugauagucugcauaggccauguagaacucacagguggugaacucaggauugugagucaaaucaaucccuucguuccggaacuggcgcccaauuucauaaacccggucaaugccaccaaccaccagcaucuaccaaaaccacacagccacagucauguguuaauagcccuauaggcuccuaggaacuaacugcuuuucauagcuuagguacgcuuuccauucaaaaugcccagugcccugcuaucuuuagacaucaacuugcuucugauuuuauuuggcugggcaggacucccgagucucuuccugugucuuugcuauuucuuauuuguugggucugaguuucuccaaagccucuccaccugccagacacacuagugacacgucagcauggaagcuaccaaaggaagguguagguguuacacggaacucacuguggugaagggaaccagaggcagccaucuuucaaacagguuacugaaauucuagugcagugaccugugcccaguaggugacagagugauaugauccaguaucauuuccaggcaggacuccuuggccuuuaagguuauuguggcuuucuuacacaggugaauaaauuuugcucuaacuuguuacguaucugcaacuaagaaucagucuuugguauuuauacggauaauuugaagagauuuaguuuacuuuucuagaaagaauuuaagaccagcaaaaguucuuuuaugaaagacuaaacagagaaggacugggauguaguucagugguggauuucuuucuuuucucuugagcuagggucucacuguauggccuucacuggccuagaacucacuguauagguaagaguuaagggaucugcucgccucugccucugccuccugagugagccauuaaagguguuugccaccguggcaguuguagagaguguuugaagaaggcaggcaggcaggcaggcaggcaggcagacacaacugagaucuaaccccaggaaaacugcagcuaaagcuuugggauugaguuaaagcuuuaaccagaacagggucguguguacacguguacaacacgaugccuacaauccucagcugcuuccaaggacaucacaacccccaaacuacagaacuggagccuucuccuggcugcuuuaucuaacuucacugcuccuuccugcagacuggacuggucuggccagucauuuuuccagccuccuucuacuggaaggagacaggguguguggcuauugacuaccuugugguagaguucuggagcaauucucauauacaaguucauguccagcucauugugauaggugaugaaaggcuuggccacagcucccccgggaaugauguucaucaugggaguuucgaucuaaaacagacagaaacaaacaguucuuagauaaccagaggccuugaggacagugcauucuuugcauguagcauagacuaggccugucacauaacaaagaagaugaacagacuaucugacucauuagaaccgcaucuccauuccuuauauuacagaguacuguaagugcugacaggcuguaagagaacuauaaaugaaugcugcagcuuuuaggcuuaauuuacugugguaguuugaaagaggaugguccccauagguuuaaauguuugguuucuaguugguaaaacugcuugggaaggaucaggagaagguguggccuuuuuggaggagaugugucacugggcaugagguuuuaagguuucaaaagccuaugccaggcccagugucugugugacugucuuuucuuucucagucuuucugccugcaaccuguggaccaggauauaagcucucagccccaggcccgccugcuugugugcuggcauacuucuugccaugaugauucuggaccaacccucugaaacuauaagccagccaccaaguaaacagugucucggucauagugucucuucacagcaacagaacaguaucggaggcauuuacaguauuuacuaucuacauccuuaaagaagcaucagagggcuggagaugcucagcuguuaaaagcacauacugcucuuagagagaacccaagugcucuggccucgaaaggcacuggcauucccauguacaaaccuacacauacauaaaugucguaaagaagaaagaggcuaagaguuauagaagacgcugggcauccuccccauccuuugcacaugcacacagacacaugcaccagcacgcaauguacacauaaaaaagagcagguuuauuaagagugcacauagcaugacuacaauuuguauuuaaaccaaaaaauaaaacucugccgaaacauuuacaugugcacuccauauguagagagaauacaugugcauuuagaguauccaugugugcauauaccugccugccuauaccuccuaagugcuuggacuaaagggugccacgcuaccuggcuucuaaagagauuuuuaaugcuacagacccuccagcgucacugaaaguggcaucauuagcacagggauggugcauucuuuagaaagccugccccaugagcacuaaacagguagaagagacacugcucgggcaugacggacccuggcaggguaugcuguguaaaggaaagacgggaccgugagagacaagcacagccaaaacggcgccguuccagguaaagaccccuucgcccucgucaccucuaggaagcccagcucauccaagaaacuucuuauguaugugaugaucuuagagcggacgauaaauuucugccucacaaagucguucaggaucaaguccaaguaucuuugacgauaccguguuuccuaaagcaaaagcagcgagcgguuagaaaccggugcuuucugugauggcuacaggaggaggcgcgcauccgagaucagcuguggggcuuaccuugucuuugaggccaaagugaagaugaggcagcaugugcaagcagggggacagcagcgugaucuccugggggaugaugcucagcucgcccuucuugguuuucccgggauugcccucaacuccaauuaugucuccccggcgcaguuuguuauugauaugaacaaauuccuccucugauuuguaauuccugggugaaaggaaagguaacugaaugcauagcucuacaaaugaauacagaccccugccuuccucaggaaaccuucccucagaauacagaccccugccuuccucaggaaaccuucccgcagagccagaccccugccuuccucaggaaaucuucccgcagagccagaccccugucucacucaggaaaccuucccgcagagccccugcuuuggggacaacugcuggaggguuuccuuuauguuuacuguacuuuaaggaaggacagacuuucauuguuaggucuuuccacaaccugccacucaacucuacccaaccaugucucacuccucgauauccuaacucuaaacgacagugggaaaauaggaccacacuagccugugucuucaacugccugucuguuacgcugcggugugacacaagucguuuuuuaguuuguuugguucuuguauuuuuuuuuuuuuugagaugguuucucuguagcccugucuguccuagagcuugcucuauagaacaggcuggccucaaacucaagagauccaccugccuccugagugcggagauuaaaggccuaugccaccaccaccaccagcaauacaagaucuguaauuguguauuucuguguaccuggaguuggccaugacuuguaacuugacccccucuccucgcaggucauagaagaugagcuucccuccagaggcccucuuggcguggaugcggccuagagaggaaacaaugaagccauugagaggagaaaccucuugagcucucugugcaacacggaucacaacaaucuggguguggcucggggucugcagccugcccucuucuucaugucagugaccuucacuaaaccagucaaggcuguacaggaagaccucucuaaagacggucaguggauucuuggacgauggcagugguauugacaacgcggguuucgggucuuccugaaucuuuacauaaaaauucaguagcuagggacuagauaggcuaagccaagcccauuaguaaccgucaugcagggaaaggccaggcacaguagcacacuucuuuccucccgacacuuggaaggcagagcaguuuccagccaggaggucccucagagaacaucccuuccccagaagcgucuacucauguagaauuccacccaugccccagggcugcucuauucucugugaguagauagaaaggcaccgucuauccccaccagcugggacagugcagcaugagaucucaaguuugaggccaggcuagggcacacagcaauaucuggacucaaaaaaaccaaaaggggcagagggugcaagaccagcccaggcccuccucuguguuagcauagaagccugcccuugugagcugagaggcgagugaacugucagggaccugccuaccugccacuuugagggugacaucagucaggugguccccaggcugcaggugacuauauucuuggaugaacugagugagugagauguccacguggaacuuguguggguacggauccuccccagugaccuucagcugcuggacggcuugacuucggaucuuguaguauugcuguuaaaaaaagaaaaagaaaaaagagcuaguccuucugaaguggaacccugucagguguggcuucuucagcagaguaucacauuaauuacguuccuugucacaaugacagaauaccuuacaggaguauucuaguuuaagagaauaugguuacagcagggaaagcgagacagcacaguggcuuguccaggccuucagagguuuaugaccgucaucucugcagaucgugcaagacacacacacauguugggaagaaugaagcugaaccacaacccauuaagacucgacagcagggggcuggugagauuggcggcuggagagauggcucagaccacugacugcucuuccaaagguccugaguucaaaucuuagcaaccacaugguggcuuacaaccacccguaaugagaucugacgcccucuucuggugugucugaagauagcuacaguguacucauacaugaaauaaauaaaauaaaccuuua

SEQ ID NO: 4796 - RNA, 25407 nt, Mus musculus
uguuacuacuucacauuuaauucaagucuuuauaauauaaaaaucucauaaaagaacacugcaugguggcacacaacuuuaaucucagcacucaggaggcagaggcaggcagaucucugcauuugaggccagcccggucuacaaagugaguuccaggauagccagagcuacacagagaaacccuguguggaaaaacaaagcaaagcaaagcaaagcaaagcaaaacaaaacaaaacacuauaaaccacagugacauugaguagcaagcagagcuucugcuuccaggugggaauaagcugagugcucucuccuaggugacaguuaaacaggguuagcugcuacgucguuugcugauuuguuguaggaaauuaaggcauuugggaacugaguuaaaaagaaaacaauuuagucagaacaggaaccugguaagauugcucagcugauacagcugcuuacugccacacacacaccgugacagugugcccccccccccaccgugacaguguggcccacacacacacaccucgacaguguggcccacacagauaaagacacuaaagacaaucaaaccaggcauuugccucaugugguuuugugcaggcuggagccuucauucuuggcuggcugucucugugugguaggaaaagacgguggcuacuggcaguuacaagacuauaguggaccucaugacauugcucagaagagaauccaggaagcaaaguuugaggugacacuuagaggcagaggugggaagaucagaguucaaggucacccuuggcuucauguugaguucaaggccaggcugggcuauagagagagggauccggucucaagcaaaagguagaagggagggggaggggaagggggaaagggaaaggagagaaagagaaagagggguggggaaugaugguggcuucaaagugagacugucucaaaaccaaaacccaaacccaaacccaaaccaaccaaccuuucuugguaagucugagaacagagcuuuccgaggcuaguccugugcugagccugaugguaaagcuaacuccaaccaugucuaguugcugaggacugggaagugaugaugguuacaaaggaaggcugcaaacaggaaauacaugguuuucaugaguccgggagaggcuauaaagcuuccagcacccuaagaugauuucagcccaaugcguccuugcugaaucaauguaaggagaucuacaccagagcugcugcaggcuacuuuaaaagcaucugaugcuguauuuuaaagaaccaauaaaacacaauugaaggcagccaucaagagcauuacugagaggcuauuuuagcacggagcugcuccagucaaguauagauugcugagguucugcgguccauuuaugacaccagagaggugcagcgagcgcucugggagaaggcagcucauucuccugggauuuaaccaccagaaaagcagagguucguucagcaugaagggagaggcagaccgauacgaaggguccugauaccagcaagaguucauuuaaauuggugguagucggguggguuucugauccaggacgcaaacggcuguauccugcggagggcaccccaggcuuccugguaggcggacgcagcauccuuguacuccugauagguguccagcuucuucguuacccuaaugcacacaugccaucaagcacaguccugacugagugcucgcccacccucagagcgacggagcggcaggggaggagcagagggagcacucugucccuccacuccacagggagugcauguuaaagcaacacaggcuuaagcagguuagaaucacacaacacuggcuuuguauggcccguguacaaucagaucaaagcuuucuuuucucuguggugcugaggaucacagaguuucguguacacuggacggucuccuccuccuguaaucgagcugucuaccccagcccugacuuaggguuucuaccagagguccuagagacgaaaaccuugacgguuuuuuaugcuaaggacaugacaugacaccuccacucuccugcuaugugcugcagcugacauccuuuagccucucagguggaaaaugccccguacucugaguagcuguaauucugaggagauuuucuuuagauuuggaccaggaccaaaaugugggugggagugcucugaguccuugucuuggccuugaguucugcccuggcuuuguggugugagcuggaacucuccagugucuguuuagcucucacucuuucauccccuucaguacuggagccaguucaucacuuugggcugggcggguggcucagccggcagggugcuugcugaucagcacaaagcucugccuuugauccucggaacugagcaagccggguguggagcauacuccuaauccuagcccuuggaggcagagacaggaggaaggcacugccgaggucauccuuggcuauguagcaauuugaggcuccuuggccucaggagacacuaacucaaaggggguauuuuuuuuuucuuucuuucuuuuuuuuuuacuuucuagcucauuacccugccugccuuuagcaagaauccuacuuaguauacgucuacuaagaauuacucuagccuagcuuugaaauuagcuuagaaggcagaggcaggcggauuucugaguuugaggccagccuggucuacaaagugauuccaggauagccagggcuauacagagaaacccugucucaaaacaaaacaaaacaaaacaaaacaaaaauuagcuuagaauuuuuuuuuuccauucugcuccuggcucaaagucuccacuuguucauguacuugggagcugagcccaguuucuuuccccuccaauaguccucuuuaccaucuuucaaaacgucugaagaaaucuuucuuuacuacuucugcagcacauucuucucauucacagaagauauuuuuguuuguuuguuuguuuguuuugagacaggguuucucuguauagcccuggcuguccuggaacucacuuuguagaccaggcuggccucgaacucagaaauccaccugccucugccucccaagugcugggauuaaaggcgugcgccaccacgcccggcagaagauauuuuuuuaauuaaaaauuuuauuuuaugccugugagcguuuugccugcgugucugccugugcagcacgcuugugccccaugcucauggugcgcagaagagggcguuagauccccuagaacugcagugagcccccagaccugaguccugggacuuggacucuggaggaggagccaaugaucuuaacuacugagucaucaucucuucagccagacuccccggagaguuuuauaaauaaaauuuguuacugguuguuaaaaccaacuaaacuauaagccaggccugggccaagcacuuuacaugcagcauuuucacuuauauucuucucagcgauccugugacauggcuaauuauuauuauuauuuuuuaaagauuuauuuauuuauuauauguaaguacauuguagcugcccucagacacuccagaagagggagucagaucucguuacggaugguugugagccaccaugugguugcugggauuugaacuccugaccuucggaagagcagucgggugcucuuaccuacugagccaucucaccagccccgacauggcuaauuauuauuaauuuucuuaccaucgaauaaccaagacucugauaaucagucuucauugucaacuagauuggauugaaucaccauggaaacuaaccucugggcauguccgugagggugcugcuuucugggaaggucugacucaggugggaaggcccacccuggaugugggcagugccacacgugggcuggggucccagacaacaaaaggaaaaguggagcugaccacccaugcuccucugcuuccuaauucuggaugcaguauaagcugccaccucaccuuccugccacuguggacuguccccuccaacugugaaccaaaaaagucacccuuaagugguguuuaccagguccuuuuuuauuacaacaacaacaaagauaacauacagaggcuugccuuacuaauguauuuuauccuguuucuucacuccuguucuucuucuuuuuuuuuuuuuuuugguuuuucgagacaggguuucucuguguagcccuggcuguccuggaacucacucuguagaccaggcuggccucaaacucagaaaucugccugccucugccucccgagugcugggauuaaaggcgugcgccaccacugcccggcuuucacuccuguucuuuacucuuauuauugauuauuaauuauauuauguguaaggucguuuuucuuaccugaguaccaugcguaugcagugucuggggaggccugaauauggugucagacucccugggauugagguuacagaugguugugagccacuauguggguacugggaggugaaccuggguccucugcaagaguagccagugcucuucuuagcuucugagccaucuccccuauuuuauuauguuuaauugugucugucuguauguauguguguaugcauguauguguguaugcguguauguguguauucguguauguguguauguguguaugugugcacgcucacaugaugguacaggagugcgguggaggauacaggcuccuggggagaagaccacagguggacagagacuaugcuucuugcaguaaguacugauuucaguuuuauuuuaguaaguuuuguuagugaagaggaggaggaggcaugaauugauaauuucagacuaugcuccuauagcucaucacagaggccuuggcuuccaucccagcauccugucagccaaucaggcaaaugauaaaaugggggaaaaaaaccaaaaacccaccaccaccaccaccaaaaccagugcugucauccuggcacgugggaggcggaagccggcaaacugcucuggguuugagcuuaagcuggcguaaacugugaguuuucguuucaggccaaccugagcaaugagauccuaucucaaaucaaguaaauaaauguguaagaugaaaacccaaccuuccccuuccccuuccugcaugaacagccuuuccucuaacugacccugacacaaaucugacaacuucccauucucucuggguaagcaguaagcacccacuggcucacugagccuaauaagcucaccaaacauaagcuagaaccagaggagaaaucuuuacagacaggaggacagagggacagacaauaucaccugauggagucuggcugcucgucaucugcaaugcugcucagcagcuucuggaaugaucuaaagaguuccaccuugcugauucgggaucuguucagaaaaaaggaggaaagaucacuuccaguugagcaggaaccaggacucaucacagcgcucaccugaauaaaguggccuagcagaaucuauacacaaacaauuaaccagggcuauacagagaaacccugucucaaaaaaccaaaacaaacaaacaaaaaacuucugcugagacccuacagcugagacgcagucuccuggggccgaauuauuauaacuaaauacuaggcacauguucauaaagccccaguuaauuaauuacuacucagaaaauuauuacacgaacaaagucaccccuaggccuucugcauuauauguuacaguuguuuaacuuggucuucuuggacuccuaacagcaggagcaggggcuguuucugacucuuuggucagcuuuugggaccuuucucucauacuggguugccuuguccagccuuaauaagagggaaggugcccagucuuacugcaacuugcuaugccaugguugguugauauccacgggagcccugcccuuuuuucaagagaaacugagggguggauggggguggggggaaaggagguugcgaaaggagacagggaagagaggagggcggggaaacugcagucaggauguaaauaagaagaaauuaaagggcuggaaagauggcucagugguuaagagcacugacugcucuuccaaagguccuguguucaauucccagcaaccacaugguggcucacaaccaucuauaaugggaucugaugcccucuucuggcaugucugaagacagcuacaauguacucauauacauaaaauaaauaaaugcuuuaaaaaaagaaaaaauauaauuaaaauaauacauuaaaaaagaacagucaccuauuaaacauuagaaagaacauauucaaugguaaaggcaacaaaauguucacuuuucauauaccuagcaauuuuacuaugaauauaauuuuaucaguuggcuauauguguugacuaauaaaauaauuaaucucagucaagacuucagauugaaaaauauuugcuuguuuuugccuccugaguguugggacugaaaguguguacuaccaaaccugguguauuacugaguaucaacgaagcauaugggaacauuucaugcacaagaaacuucuaccaugucacacucuauguccuggagauccacgucaaggcucaacaggccacccagcugacuagaaggaggccuauggggaucuauuuagcacuguuauggcaacacaaugcaaaggcaggugcagagucuaaugcccucuugggaggacaccugggaagguucucgacaauccguucccuggagaaccaagaggaacucugaagggguuuuccugcuuaagucaucucauugguaacgguaagauguugcccacacauacucggcacucgggcuaaggccggguccagaccagagccuuucgggcuaugcugucagcagcucauuccccacaccaagagguauguuuauaaggcaaauuagucugggagcauagcucaugauggaugacugcuagccugcacacgggccuggcuuggauaggguggacggccagaaaccuguucuguuuggaagcuugcucuaguaaagcaagccuugccuuagguuuuauuccacagcaggacaugaaagaaagaaaacuaaauucaagacuucaaagcccuagccagaacguuuauucaagguccaugauucaugcggcuugcuaguuaggagggcuuuuagggcuuagagcaaagaacaaaggaaccaacuagccauaaagauagggaagacauacaagaauguccggacuggccuggcgccucccuaucucccgcccuucugaccuaagcuaaauguuaaccagaugcucugcuguuaccucaaucuguacguacagucugcugauguuaaaaugaaccaaucaugugaaaccgcgccaauuccucccccagccccagccccuuuucuauaaauaccccuagcuuuugagccacauggucgaauccacugccuccugcgugagauacguuucgacccggagcuccgccauuaaacuaccucguguauuuccaucaagaaggucucucgugauucuuugggugcacgccaaaucgggacuugaguggggguuuccccacuagguucuuucagacacaguaaccacaugaguaaugcuuucaggagagcuaugcucgguagaaacuacugaauuaccugaggacccgaaggaagacuuuuucuaaguggcugcugcuggcugcugcuuucuaagagaccuggguccuuuuagcagagagaaccacaugcaaggacaggaagcccuucccuguggguuaacacugcugauuauugcaaaagaaagcacaggggcuuuuagauuauuuuauuucauuuauuuuucuuucuuucuuucuuucuuucuuucuuucuuuccuuccuuuuuuuuuuuuuaauauuucaucugggaguugggggagagggauuuaauuugauuaaaauauacuguaugaaauucucaaagaauuaauaaaaacacuacuacuuaaaaaugucaaugcauggugguggugguggcucaugccuucaauuccaucacuggggaggcuagccuggucuacagagcaaguucuaggagagccagggcuacacagagaaacccugucuccaaaaagccaaaacaggcugggcaguguuggcgccgggcagcagaggaagguggaucucuggaguuugaggucaccuuggacuacagagugagguccaagaagguaaaggcuuuuacacugagaaguucugucuccacaaacaaacaaaaaacaaagacaucucaaaaaaaaaaaaaaaaaucccucaucugacaucucccugucgcccauacuuaaguagcuugaaaauaaaaccucucaccugggcuggugagguggcucaggaggaaggugcuggcugcucagagugaugacccguccagguuggauuucuggccucuguacauguacuauggcauguguaaaugugugcacauucaugugcuaugggauaugugagugcaugcauaggugcauacaaaacaaacaaacaaacaauguaugaauguaguuaaaaucucucagcccggguuggugagauggcucagcaguccagagugcauauuggcuuuacagaggaccucaacucgguucucaguaccagagucugguggcuccaccuccucauucagcagccccuggccucuguggucaucuucacccaaguguagacucucacacacacacacacacacacacacacacacacacacacacacguaaaaacaaacaagcaaaccccccugcucauccuuuucagugagcuguuucgugaucuuuccagaauauucuagugucucaauggacacagaggcuguuuuucuucgggauaaagagaauuagccucuacuaugcagaguaaaaaccaagcuucuuaacaugagcaucuuuuaugagguuauugguauuucccauuguuuuacacacucccuucuugagucuaacaaugccaucugagguccccagagaguccagagggggccucacaaugcauucacuuagggaugagcggugaggggccugcuucuucuagcagcugcugguccuaggauagagugagcuggaaucccuguaccaguaauguucaaaggucauuagguggcuacaagggaaaucaauuuugcaaaaugccauuucgcucaguucugacacugcuuaacuuugcuuuacaguuggcaaguaagcugggagaggcugagugcuuugccuaguuaccccugggagaaaugguaccagggucugauacuggccccuucaguccccaagguuuugcugcccugcagagucuuccuucuaauucauauucugucugucagucagucugucugucucuauccuuaucuugcagauaaggauuaaguucucagccugccuacugucaugcucccacuaugauggucuuggacucacccucugagaccuaagcugccauuaaaagcuuccuccuguggguugcccuggccauggugcuuggucacagcaggagaaaaguaacuaagacaaguggucuacccacgaacucucguugaacagauaaaagaacauugcagcccacagaacagcuggccuugcccccaacucauacagacaauaggguuagaaggugacacacuccaggucacacagggaacacugacacacugugacaggcuggagagcugcaccauagcacuggagaggugauccuccugauucaggggguagcgguagcugaguuggccucuagaagugugaggguaaagacucuaagagaagccacagucagcagagugggggccaaagaggagacugagucagucccaaacagauccagagcacagcaggaaacccgccccucuaccacaggaaacacaagaaacaaagcacagaccuuuguaacccugauuccuuagauaagcaaccaaagguacagccaagcaaaagagaaaguacauaaauuugaccuuauuaaaauucaaaacuuuugugcaguaaaaggcgcuaucaaaacagggagcagcagagaggacucagugguuaggagcacuggcugcucugccgaauccugguucaauucccagcacucucaagauggcucucaaaacuguaacucuaguuccagggacucugacacccguuucuggccucugugagcacugcacacacauagugcccagacauauauggaggaaaaagaccuacacacauaaaguaaaaugaacaaaauccuuuuuaaaaaaguaaaaagggcugggucuggaggcacaugccuaggugggaggaucucugugaguucaaggccagccugguccauagagaccugaguuugguccuugggauccacaagguggaagaggagaacugaaccccacaaaauguauucugaccuccacacggucccccaaaauacauggauguaauuuaaaaauuaaaaauaaagacaaaucaguuacagaaugggcaaggaacgagagcagauauuucuccaaagaagacuacaaaugguuagcaagcacacagcacauaaaagaugcccguaguaucagugacugggaaaugcagagcgaaacaaggagcagcccuucagaccugacagcaaucacaagcguggggcaggaugcaaggcagcuggggcuccucuccaggguucgugggaauggccauggcacaggugcugggaagaugguucacucauccuaaaaagcuagccaugugguaaccacauggcccgcuauuucacugguauguguguucccuaggaggaauuacagcauacaagacagguaccugguuguucacaccagcaccauuuguaauagcagccuggagcagaacguccccaaggccucacugaagagaggagaggccaaugagggguaagcaagcugcucacccaugcagugaacauggcgccagugcacacagcgagugcgcugugagacauguuggguaggugaggcagacacagaggaccauggggaaaccacggggaaaccacgggaaagggcugcauuuauaggaaguauccagaagacagaaacagagaaaguaaguguagcaaaggagggauuuccaagggccaaggaggaggaggaugugagggaggaggaggagggggaggagggggaggaggaggaggaggaggaggaggaggaggaggaggaggaggaggaggaggaggaggaaagaguaauuaguuuccuuuugggggaaaugaaaaagucucagaauuggauaggaaggguugaauucauagcuacccucuccccagccccagaaagcuguaccuggcccuagggcuuccaaucucuuucuuuguuguucccuguggaaaaccauuggcuguaacauccaagggcugcugagggacagcgcuccagcugauagcuaggaagagaggaauccugggguuaaaaccuggccagaggcuucucucggcagugggcagcagguagaacagagcuagaacuggucaaagugcagaguuaauguccacucaguguagccccgaaugggacaacugcaucaauccccacuuccaaggcucggggcgcacagcaguggaagaacgaacgacagagcuggggggagggggacaggcugggaaauguucucuggacaguuauggcugccucgccagcguagccaugguuaucugcaaaauauccagccaagcugagucaacauuuguucagacagcacuaacuggagaccgggggcuacaaaaagugcaagcaaaccccaagccgaaagcaaagcaaauaaaccaguugucaaauaguucacaaaaauaucucugugauucuacagcagcaugaaagcugucuaugacaucaaaaucaaguugggugugaugcuuggcucaccaggguucagugacaucaaacgguucacgauuauuacuauagcuuacgguuuacuauacuuauuuacagggggagaggcauacacaggucauggugcacaugugacggucagaggccaugcuaaguggagguggguucuucgcuccccuuauaaguuccuagcuuacaauuucuuugaaaauuuauuauaugcuagguacagaauuauaaauuauaauauauauaugcauauuuauaauauuuaaacauaauuucuuuuuguuuguuuguuuguuuguuuguuuucaagccaggguuucucuguauagcccuggcuguccuguaacucacuuuguagaccaggcuggccuugaacucagaaauccaccugccucugccucccgagugcugggauuaaaagugugcaccaccacgcccggcuuaaacagaauuucuuaauucucauaauagccaugauaagcaauauucuaaucuaaaaauaaaguaggccaagacaggguaagugaccuggucaggaccucacagggcaucuuccaaggaacacacugggguucccacuguccuaggcuucgugaugcugaccaguugggguucccacuguccuccgaggcuucaugaugcugacccgucuagggcagucugugaugcuccaggguaaacaagccaaccgggaucccuuaccugccccacaggggacgagucggccuggacugucaccucuuuuccugugcaccgcacagcggcucuguucaaacaguaaacccgacugcuguauuuccaguucuugaacuccaaagccucuggguaaaaccaagguuuccucacaccuaaguucaaaggaaaaugcacucaguuuagcuggaccuagagaaaaggcucucagagcucaguguccaagccuuccgagaaccacagggcccaggagcugggugaguuuguuuuacuugcugaggagggacaagugagccaugucagauuucccacagugagaacuuuaaaauaaaugaggcggugguggcauacacauuuaauuccagcacucaggaggcagguggaucucugugaguuggaggccagccuggucuccagagcaaguuccaagacagccagggcuauagaaagaccuggucucaaaaaaauaaaauaaaaaaacaaaaacaaaaagcaagcaagcaaacaaaccaaaagcaaaacacaaaaaccaaacaacaacaaaagaagcuuuuaaauuuauuauuuauuuauuggagagaggcucccggguggccuaggauggucacgaaccugaauuccggcagaggaugacccugaaauucugauccucuugccucugccucgugagugcgggguuacaggugugcacuauagcuuacccuguuuuaugaggugcugaggaucaaccagagagccuuacuuaugccugccagcaagcaguuuaccaacugagcaacgcacccccauccccagcaagaauuuuauggcuuaaaagaucccauccuaccggucugaggcauagcuacaaacgaaguuaaugcccaucggugggggucagaaaucuaaaauuuuacucucauuuugagaaacuuaaacuacaccuuguucacacaggcuuucuaggaaauccuucaaacaacccaaacuaaaauaacccuacacuauaaaaguuguauuuuuccucuucugaacaagccaggugcucacaugacgcaaauccagugcacagaugggaacuucagaucucagaaacuuuacaacuauuagcagccaacaccacacuccaugcccuuuccagugccaggaacgacucgccuuuugugguuauuucacagcaacggagucaaacguguguguuacuucacuuagcuugauacuuaauggcucacucacauggaugcuguagcauguaucugaacacuaacuagucuuuuuuuuuuuuugagacuggaucucacauagccagguuagccuugaacuuaauguaacuucaaguccuuucuaacagagaacaguacugcuuguuuaaaugcacaaugcuuuuuuguuugcuuacuuucuuaaagauuuauuuauuuauuuuauguauaugagaacucugucgcuguccucagucacaccagaagaaggcauuagaucccauuacagaugguuacaagccaccugugguugcugggaauugaauccaggaccucuggaaaagcauucagugcucuuaacugaugagccaucucuccaagcucuguuuguaugcuuuuuaagacagggucucagauguauacuggcuguccuggaacucacuacguaaacuaggcuggccucgaagcucacgaagguccaaaugccucugccuccuugagcacugggacuaaagacguaugucgccucgccuaaauguuaucacuggauaggagggaaagaagaauagauggggagagagaucuuugaaucuaauuuuuuuucuuuuguuucuucuuugagcacaacuagcaaacugcaaccaacccccuagaugaccaccgaccaccaaccuugccucuugaggcccuagcauuuauauacucucugaaaaguucccagaauuccaaauaucacacaauggaagaaacuaucugcagcuggcaaaaccaugucucugcuagagcgcgauucagacaguccuaagcagccccauagcccacaccugggauuaaaaugaaagcacagucuuagaauguguuuuuucugaguuuuaaaaagaacccaaaaucccaauauugucacuguagggauaaaaacuaauauuuaguuuuuaaaaauuguuucuuguuuguuugcaugcuuuuuuucccuuucuuuuugagacuggaucucauguagccuaggcuggcgccucaaacucuuaucuauagagcuaaggguaacuuugaacuucugaucuuccucuccaccccccacccccccaccccaccccgcaaaugcuaagacuagaagucuaugucuccacugucaccaucaugcccaguuuuauguugugcugagauccaaccuagagcuuuccauugaaauuaggcaagcgcucuuccaacugagaugcaugccccagcccuggccauuacucugcuuacugcggaaguacacagaagaaagccgauaauguacagccuuaacaaagaagagaagcgcccguaccaccaugacucagaggugauuaccgacgagcagccuccuacagcuuuccguacuggcauauuuuaggacaagacagagcuuacuucaucuucuaaauugcucuuuaggccucacaaacaucuuuuacauuaaauauuuaucaacacuauuuuuaaccaaaaaaaaaaaaaaaaaaaacccucacuuaauuuucaacuguagaacauuucuuuuuucuuuccuuucccuuuaaguuacugugcauauaaugcaaaccuaagacuuacacagucuuaauuauuucuuuacaaaaagugacaagaugggaaacugaagagucuaugggugcagacugcuggcuucucgcuccuccucugcugcccucccccacuccucucaccugccagucaaugcucuccucauggcuuccuggcuguacgggcacuucccgaugaccacagcugacagguagauaggcuucuccaggaagugcaucagcagugcgcccuggcauccgaggacauuccaccuugccaucuugucacugcaggacauggagcauguccugucuccccugccagguuuuacacgaaguagccccaccuggugguaggcagcaccuggcucucucaagucuccaguuucuccaggaacacacuuggcucccguccuguacacauccaccacucugaagcuaccugaagcuauuccauuggcagcaucugguuccuccuuggugagaucagagcugcugacaucugguuugacuggaccacuuuccugggucccauggugagcuacacaauuggagagugaccuggcagguguucccagccucaucuucuuggcuacaggacuggcgggaucuucacaguuccuuuuaucuuuagaauccucuagauucucagucucuuguacaggugaguuguuggcccaacuucugaugacaggacagcaaggcuguucuucaaacucgagcaucgggaugauggaggcauccccaccugcacaagaaggagccccugaaccaguaauucucagaaugaguccccccgaccagugacagcaaugugccuuaugaguuagaaaugcaaacugugaggcuggagagacagcucgguggcagaggauugccuggcauacuggagaucccaaguuuguguucugucugugugugugugugugcacacgcgcacgcgugcguguagagcaaauuauugggaccuugggaccuaauauacaugcugaaccagaaacucugaaggugggacccagaagucuguuuaauaagcugaguaggccauucugaugcaagcuuaaagacucauggccuuaaaacaaggcaauguguuuucccugcugagcccagaugaauuaagagggagacaggcgauaagccuugguaaagcauaggccuaaggggcauauggccaggucuugauugcaaccaacauuaaaaaaaaggaaaagaauaaauaaaaaccccaaaccgcaugcucauaugcaggugugcacauggcauggcacauguguggaggucaaaggacaacugccagugccaguccccacccuccucuuuguuugagacaggauccuguucccugcugcauacgccagaaauccauuuugucauaggagugcugggauuauagguauggccuagugugucuggcuuugugcagguucuagagauuuaaacucggacggaauggcugauggcaaacacggagaccuccauggacagucuucuuuccucaguaacacucgggcuggagaggggugcucagugguuaagagggcuugcuguccuuccaugggccaagguucgguuccuagcacccacaucaggcgguucauaaccuguaaucccagugucagagggucugcugguacuuguauguaggugguacacauaaacacccacauaaucauaacguaagcaacaauaaggaaauguaucuguaaaaguuaacaguauauaacauauaaacaaacacgugucggacagcaaggugcaggcauucaagcccacaucaaucucaggucugcaggaagcuccuuccuagaccccgcagguuacaacuucucaugagagaacuggaaaacugaccacugaaacaaacauugcaaggaauuucuaccacaaggaaguuuagaagcccugcuuuagaccagagucucucagugucuacacucaugagacuuuuguuugucuucucuuuugagauaaggccuucuguaacucguacuggccucaugguaagcacuuuaccgaguuccagccccuagccugacaacuacugauuuacaaugagcaagguaucccaagggcacuuguggccugagagccuguaagaugccuuggaaaacaguaauggcuuauuucauggcugaguaaauucgacaaacauuaaucaaaauauccucaucuuggggauuuuaugauguauagucucacagaaaagacccaaaauaagcuacaagguccaguccacaccaguguuucugaaagcgccggugucucccugugcuguuuuacagaguccucaucucuucugugcccacagaaaccaaagcaaaccugaggucaggggaaagcgcagcacucccuugagaggaagcucuuucuucaaacaccagcccaaugugugcugccuucccagugugcaaagcguacuuguagucuuuauaaccacagaguggcaaaggaaagagggacagagaaggagaaaugucgcaggacaggccgccuggcuggcugacuuccagagaccuuacaaggugacagaaacuuuggagaauccacuggggcccaccuccuacucuguaggcucagagaugugaucucgacagaugccugagugcgggaggcugacucacaccaauaaaacacaaaggcaagcguggaaaguagcuaaccgagacccacgguauucccuaguaaugagaaguaaaugucaggggggccagagucgcacuuguaggcagcgugcucccuuccuacagauaagccacgggcgggggagugccacacugugcaaggcgcaccacauuguaagguuacucaugaacagagggaguugugucagugguugaagaauuuuuuccagcaaaacaauucccagaggccuuaagaucaacagaggacugccaacuucuuacuuaagaucuuaaaaagcaaaacaaaauccaauuaucacaauuaacaaaaggaagaaagaaccuaacccccacccccacaaccaccccccagcuguucuuccucccacuucucagcacacagucaucauucccccagagcccugaggagaaccuggacgucaucucugccuucauccuuccuaagcaaucacgaggucagucacuguccuccugaagccggcuuacacuuacucaacugucuccaucgccuuagugaccgcugcccuccccagaucaccauacucucaccuuaaaacaagauucugagacccuuuacacuugaauuaccuaccacacuacuacccacucuugaguuuucuugcuuugcacagacacccgcagagcagcacggccugaguccccuggucugggaagucccucaggaggcugacauccuggauaaaccccccagggcuuuacucaggcuaagcaagcacugagucuucuucauugcuugauacucagugucccuauuguguccaguguuagagaacaucgguucacgacaggaccgguggcucaccucuguaaccucgggaggugcaggcaaggcggacuaauagcaggacugggcuacaaauacaaacauccccagugugcggaacaugccuaaauucccuacacuugggagacugaggcagaaagauggcucagaguuucugguucggcauguauacuaggucccaaggccagccaggacgacuuagcaaaaaccugugucacaccagugagagggcucaguauguaaguguguguaaguauguaagugagagggcucaguauguguauaaaugugugagagggcucaguauguaaguauguguguaaguguguaagugagagggcucaguauguaaguguguaaguaugugagagggcucaggauguaaguauguaagugagagggcucaguauguaaguaugucaguguguaaguauguaagugagagggcucaguauguguauaaaugugugagagggcucaguauguaaguauguguguaaguguguaagugagagggcucaguauguaaguaaguguguguguaaguguguaagugagagggcucaguauauaaguauguaagugugugagagggcucaguauguaaguaugugugugaguguguaaguauguacauaugcaaguguguaaguaugugagagggcucaguauguaaguauguaaguauguaagugagagggcucaguauguaaggguugcucguugcugccaagccuaaugaacugaguuccaucuccagagcccaccuggugggagcagagaacgaguaacuacaaguugucugucugucucuguguauauacagcagcacauguauauauguguauauacaacauacacgcacagucucuuuuucucucgaaauauauaauuuaaaaagucucaaaaaaugucagguggugguggcgcucgccuuuaaucccagcacuugggaggcagaggcaggcgauuuucugacuucgaggccagccuggucuacaaagugaguuccaggacagccagggcuacacagagaaacccugucucgaaaaaccaaaaaaaaaaaaaaaaaaaaaaagagagagagcgagagagagaaagaaauauauacuuguucaaugaauagaugaaugaaugaaaugggcuuuaagauuaguuacugcaguaagacuuugugcuuuuugagccccuaauaauucuacuguacuuuuuuuuuuuuuaaagauuuauuuauugguuauauguaaguacacugucgcugucuucagacacuccagaagagggagucagaucucguuaaggaugguugugagccaccaugugguugcugggauuugaacuccggaccuucggaagagcagucgggugcucuuacccacugagccaucucaccagcccucuacuguacuuuguagggguuaaguuugaagaugcccaccccugacuuugagaacuaacaguguaagacucuacacugcccuacaucugcccuuugcuuuccccagaagcaaugugacuguguauauaaauagucgcugccauuaguuuuagcuguuuuuagccagaauuaccuuuggagaaacaucucugugagggagacaagcacugggaagcaggcaacagaacaauacucccaagguuugaguauacuuacaggguguguggcuagagaaaaacacaaacgacaggucaggucugagccuccacaguccucuuugggucccuggaacaaagaugcuauccucuuucaggacggcugccaaauggagcugauggagaagguaucugagaggcacaagauaccagaaugaaccgguaggcuggugacguagcucaggggaccuuacaugcugagggccuagcgaaugcgacagauaccccuuggcuugauccccuugcgcuggaaaaucaguuaaauggagaaaaaggauaaacagcacacuucugugguaaagagagcucucagguuggauaacugcaggagagggcuaaauagaaugagacuggucgugaccuggccuuaugggaaugauagaaaugagaccguugagaagguuggaagcucucaggcuucacccugaccugcugaggucagagucugagaaggcuggucauuuucuccacucccaccccugugcuggguuugaacccagugccaggcaagcgccccaucacuaagcuuaugccccggcccagaaaccuggguuuagcaggugauucugaggcuuaugcaggcuagagagccacuaacuuaugcccugguaguucugcgagacaugaucugcauuagcgccagcuuccuagaaaugcaaaccccguuccaagaccgagacuauuuggggaguguagcuuuaccucuggaaacuccuucuggcuaugaucucagcauggcugucauugaggauguccccuguggcaaagacaggacauauauuguaaugaagacguggcaucgagagccuggaagaacauccagcaggcccccacgccagcacucaggaugaccauguuacccuuggagggcacugagcuuguguuucucaauauaugggaccauaagacacuuuggauagggggaaagccuacaggauauaggaagaagugggcgugguggggcaugucuuuaauccuagcauuugagaggcagaggcugguggaucucugugagugugaggucagccugguuuauacagggaguucuaggccugccagggcgacacagagagacuuugucucaaacaaacaaacaagccagcaaaaauauacaaaaucguuuagccacaagaugucaagaauaccccugcccaugugaugaugaccaaaauacucuggacaaugccaaagacaccuugaauacaaaauugccagugacugccagguccacaguaguauauguaacccaagguuuaggcaggaacaccaugaguuccaggccagucugaaugacauagcauuuuauagauacgccuggccuauauaguaagaucuuaucucaaaauacuaaguauaagcaaaacaaaguaccucuagucgagaaccacugauuuagagaaaugauuuuuuaagugcuucaagauugaaucuagggucuuacgcagccaggcaagugcacugccccugagcuacugccccagauucucucaauuuuuaaaagauaucuaucuuauuguacuuuuauuuauuuuguauauaugugccauggugugugugcaugugacacaagaugcauggugacaucagcggacgauucaaagccuccuucuucuaccgugugggcucagggaaucaagcuuaccuugaggcucggugacaggcagggucucaccuugaagcucuagcuggccuggagcucaucagaacgccauagaaauccaccagucuuggcuucccaagugcugggcuuacaaccaugcaccaccaacccugacacuuacucuauuuauuuauuuuugugacuuggggguuucacuaagcugguuaaguucuucuucaacuccaccuguggcccaaacaggccuugaaauuuagauccucccccugccucagcuuccuaagccacugagauuacaggcuugugccacccgguuacagaaaucuugcgucugcaacucagggauggagaucucuuauaccacggcaucauagucaugcucacggugacacauuuccacagcggacgugacacuguccuggaauacaggagugacggcuaggaggacggaagggacgucagcauucuugcugaugccgaaggccuguucaugguugcuugccggcuuccgaagcuccaaggcugccccuucucccuacuaagcccgacugccuuccagauguagcgugggaugacugaacucaggaaccuuugguucaaaccugagagcgcugacugccuuucagaagcacaagccuggggauuuccgccccgauuuggauuucuuuuccuucuuuucucuugaggcagagaauuuacuaugcuggucuugaacgucuuugccacagcgucuagugugggguugacagggaugcaccaccauguucauguucagcucuggauucucauuuuuuaagaaaaugaauggucagcuggguggcggugcauaccuuuaauuccagugcuagggaagcagaggcaggcggaugaucuccguggguucgaggccagccuggucuauagaguuccaggacagccagggcuacacagagaaucccugucgcaaaaaaacaacaacaacaaaacgaagccaaagaacggucuucggauccugaggacagucaguggugaaugaagggucagccacucuaagcagcauggccccauuuccuugacaaggucaguauggacuuagcacagagacuacuguuuagagcccagucuuugcuuaccgcucucucgcaucuuggacuggccuaugcauuuuguuccuguucccauugagacaacuuccuuugucacugagaggaaaaaacaaaacaaaacaaacaaagcauuaauuaagcgaguggacucucagaggcugaacacuuccuaguguuucgguuuaauaaguccacauuccuccguucucuggaggauucucacagauggagucaacgggacugcaguucccuuggggugguuugucgccaccagaaguacugcgccaccuggugggcaaaauggggaaaacaccuaacauaguucccauaacccaguaaguugcaaugguugcugacagggagaaagaaaggggcucucaccuugcacuuccuucucagggaugucacaagcuugguuagcugaagccugaaucuucaccacagcugccagcaagguccacucacgauuuggcucaggcuuccccugcuugggcagucugacguuauagugugcauagcacagcugagcgaucucauccgcgguccacauagguggagcuggagcugaggccacuauagaaagccaaaucuaucagaacagaaaggagaaacagcguaguaagauagaaccucacuccaacacuccagccaucucuagugaagccccacggugcucagacuaagguuguuuuuuuuuuuuuuuuuucuuauuaaccucccucccuucccaucuuuaaugaagagugaagcccaggggccgggcgugguggugcacgccuuuaaucccagcacuggggaggcagaggcagguggauuucugaguucgaggccagccuggucuacaaagugaguuccaggacagccagggcuacacagagaaacccugucucaacaaacaaaacaaaacaaaaaacaacaaaaaaagagugaagcccagaagacaagcuauuucuucaagaucaacacaaaugauaaguuaaugaauguggccauucuauguuuuacacuguccucucagauuucagcuugcuuugggcauguuagcaccuuacaagguuucuuuugagacaaauguucuuuuccuccguuucuaaucuaccucacuccagcaaauuuccaaagucucucacugaaagcucucacagcagcuguguuuaagggugugggcauggaguuauacuuucuagguuucaaucucaguuuuaauacagaugaacugugugauuccuggguaauuaguuuucacaucuguuaaaacaugacuaauaguauuuaacauuuuuuuuucuagacagggcuuuucuguguaacaguccuggcuguccuaggacuugcucuguagaccugggugcccuggaacgcacagagaucaccugccucugccuccuuugugcuaggauuaaaggcacgugccaccuagcuaguauuuaacaucucuuauaaauacuuaaaaaggcaaaugucuauauacugugauuagcauucagaagauacaacauuuggugaucugggaaauuuguauugguggcagaagagaagcaauguaacgggcacaccaagccacuuccauacaaccuaacagaacauuaugcagaucagaucugaaagaggccuacaguuggcagaagaaauucucucacucuuggcuguuagcgcucacuggauauagcucgacuucagucgauuauauaaaaagcuccguagaugagcucacgcgauggcuagagauggcagagcauuuguagaauaaacaacagaauuguuuuuuuuguuaguuuguuuuuuuucugagcucugaugcgauguuuuggcaagguauuucuaagacuucugcaaaaugcaggcacauuuugcaguaaaugguaaugacuauucuggcaggggcugacagagauuguaacuuucaagucuaacgcagagaagucuuguauuucuagaaggaaucccagaauccuguuaguuccugauaggcaucacagaaguuuauuuuaugaagguagccaucugccauuaaauucgagguacacauuagaacuacaaaacaaggggacgaagcgguccaaacuacaucacgucauucacgcaguugucgaacguuucgauauuuuggguccgcuguaauucaucucuacaaccccagggcuccuucauacgaagcagcucacaacagguauugcuuuggcuaaaaauaacagugcaaagguugaaaaaacaaacaaacacuucuuuucccacccuuccuaccgcagggcuggagagccuagcagggcugagaccccuccccgugggagcaguggacacagguccucacagucuccccccaccgcccuccccucggccaacuguguagagcuaaccccgagacgccgauccggagucccucacacccuauuauccacgcgccgcaaccuccacgcgaugccccucuaccgccacgcucguuuaaccagguugcgcagcggaagugacgcccuagaggg

SEQ ID NO: 4797 - RNA, 17918 nt, Mus musculus
auggguaaagagagaaaugauuuauuugguaacgaggaauaaaaagaacuucuuuaguucuucucucuuguggagguuggacugcaguggccagauggacggcgccacacaggaaucgcucccucagaccagaucugcugagaugcagacaccauaguugcaugugccuucuagacagaggggcuggccucugugcucucugggguuucaguggucgcugcaguuuccuucuuguccucuggcuucauggcaggaaacagaaguacuuccuagagaagaggaaagagaagcacuuccugagaagagcagagcaucugccgagguucagaagcaccaggagccgggcucaguggaacucaggaggcgggggcaggcagaccucugcgacccgacuucaaggccagccuggucuccauaugguuaaguuccaggacaaccagacuauguaguaagaccccgccuuucaauaacagggcacuauggauuuuucuccccacuauccuacuuuugcuguugccugauguuacaaaaucuagaaguacgcauccagacaaggacacagaaccugcuagggucccaugccaaaagaacguaaaauugaguucccggugcuagagauggcucagccauuaagagcacuuguucuugcagagggccgagaugugguucccagcagauacaugguggcucauagccauguguagcuuguuuuaggggaucugacaucucuucuggccucugcaagcacaagggaugcuuuugguguaaaugagccacauguauuuuuuuguuuuacaagugacccucagcugaguggugauggcgcacgccuuuaaucccagcaaucagaaggcagaagcagggggaucucgcauuucgaagucagcuuggucuacagaguaaguuccagagcagccagggcuacaaagagaaacccuauguggaaaaacaaacaaacaaaaaaaaaacaaaccaaaacaaaacaaaccaaaagugaauuuccuccuaggccuccaccaacauaaucccuguguucuggagguagaggcaggaauaugaguuauaucaaagucacuauaaacuacugauggccuuccaagagagcccaggcuacaugagauccugucucacaacaaguaacaacaccaguaaaacccgucuucacaccucacagaacggacugauuuaaggcaaaccauguagugagggcucagcguuucccuggacacugaagaaaagcaaaccauuaguacccccuccugucucaagcaggaaagacuaaaaucccgcagagccacacgcucgccagucuccucccguaaaguggaaccucuugagccucugcuuucuuucccagguccucuacgcuguccccagcacaguggagucuggggaagcaggagcugggcggccccugcguacauaccuugauauuguuggaaucggugagaaacauggugagccgaucaaugcccaugccccagcccgcugugggaggcagcccguauuccagggcaguacagaaguucucgucuaugaacauggccucgucaucaccggcagccuuggccuagagaaaauaagagugaaauguucaaaaggauccaaaucaucuagucugggaucuagucagcgguccucacccuuccuaaugccgugacccaaccacaaaacgguuccagcguuucuucauaacuguuauuuugauguuaugaaucauaauguacaugucugauaugagaccaaaaagggcucaacccacaguucuaggcaaucucaguguccauaugaacagacucuaacuuucagaaggggcaccagaggugcccaggacaauuucugaugaacuugcuggaaaaugauuuccagagaccucaggaugaaacccauuuuaaguagaaugugaugguacauaucuguaguucaaauuacuaggagggcugagacaaaggauugccaagagcuguaggauagccugguuuaaauaacuaacucuaggccaaccaagccugaacagugagaucuugucacaaaaguuaagggagccaggcagcccucauuauuuuauacaaauaauguacaguaauuuuuaaaaagacagucucugucuucuuaaaucugcuuggggauuugagacuccauacagcuacuacaguauggaacuaaagcaucuuucucuaguuccugaaaucagccaccauggcagagguagccgggacuacauagacauucuguuucaagacacaaagugaaacaaaacaauaccugcccccuuccaaaaaaggggaaagcuauagucuaagaaaagguaugccuagccaggcagugguggcgcacgccuuuaaucccagcacuugggaggcagaggcaggcggauuucugaguucaaggccagccuggucuacagagugaguucuaggacagccagggcuacacagagaaacccugucucgaaaaaacaaaauaaauaaauaaaugaaugaaugaaugaaugaauguccuuguuaaauguacuuuugaggugucgaaauauaggcaaucuucaacucacuauauguguuguauaauaaaagccagugugaguggcugugguaugcagcccuguauccccagcccucagaggcagagacaagagggucaaggauucaguguggccuuggcuaccccagacugucucaaaaacaaaaagagcagcucuauuugaaugggacuuccuccugcaaagccucuuuauggagcuggagaguuggcucagcgguaagagaugcucuuccaaaggauucaaguuugauugcaaaugcacacuugcgugcgcgcgcgcacacacacacacacacacgcacacgcacacgcacacgcacacgcacacgcacacacacacacacacacaugcuacaauacaaaaguugggaagcuucccuggcuuagguaaaacaccaagaaaguguccagcaacacaggguuaagggcggugcuuccuggugugaggguaagcagaugcuagucucacucacucacucaccuuggccugcuccucaaacagcugccucugccgcacggggucauucagcucaguauaggcauugcauaucuccuucuucaugacaaacagcucaaagcgcuccgugagacccucuuuggagcggugccuggggacgcgagaccacagaggaugaauauucagagcucucauaaugcaauaccugacucaaaagucaaaacuggaagccucaucaacuuccgcacugaucucugguaccagagccaaggugagagagacaagagacuugacugcacuccugacaggcacggggacggacuggacccaggcccuucugcuuugcucucauacucugggcucccacuuguuuuggucaaggacauauuggcaaacgucuggcauauauuugcuuguugaggcuuguucuuuugggaugccugccuugagaaccgaaccaccaugcugacaacagacuacugccagagagaucaugugaagaggcccugacaggauuuccaucuuagauauuguaucaaugcaugucgcagaaagaccaccaccaagucaacacaggacaucaaaaaaccucuaucacuuuauaccauuaacuucuguuuuuuuuguuuuuuaaaaacacuacugaagcugggcgugguggcgcaugccuuuaauuccagcacuugggaggcagaggcaggcggauuucugaguucgaggccagccugguccacaaagugaguuccaggacagccagggcuauacagagaaacccugucucgaaaaaccaaaaaaaauaaaaaaaaaauaaaaauaaaaaacaaaaacacuacugaaggaccagagagacggcucagcaauuaagagcacugaauguucuuccagagguccugaguucaauucccagcaaccacaugguggcucacaaccaucuguaaugaggauccaaugcucucuucuggugcaucugaagagagcaacaguggacucauauacaauaaauaaauacuuauuaauaagcaguggugaagauugagccuaggccuagacucacguuaaguaaauguccugcugcguagguacagccgcagaggcccacgcccuacuugaggguuucugcagugacaagcuguaucuuaccauuuggccaaaggacucaugaucugugggugaucacagaugaagguagggcugaugcaugugacuucgaggaacucgccaacgagcuuaauaggaaaacagagcagaguuacacguggcuucucaacaccacugacaguccagcccaagggaagguuuuaacucauacagaugaguucaccuuguagcuuuuucaaaggacagaguuuugaguaacauaauaugcacuauuuggcagaagagaaauauuacauuucaaagcucccuuuugcuuauauuucuuuuucccucauuaauuuauuuuauucacuuuucauccugaucacuguguccccacuccuggucuccuccgcagugccccuccuccucuccucugagaggguggaaguccccugggaucaccccaaccuuggcacaucacgucugucucugcagggcuaggugcauccucucccacugcggcuggacaaggcggcccaguuaggcaaaugggaucuggggauggggauugagccaccccuucccuggccuugguuugcuaagugaguacucuaucaccgagcuacauuucccaauccaauucagaguuugaauucucccguuccucuguaaggcuucccugcgaagcugcaggggaggagucucccgggggauccaugcccuagggaucagggugcugguaagcacuggacgagcacaaguauggucucuugccuuaucaaggagccuggcugugguccgagguggggggcauucaacagcuuuugcaacacaaauaucaucaagaauuuuccgaguuucugugacagaaaugugugaguuaggacagggaacaucacuguguaaaaugucuauaaauacaacaggugggacauuuuagcuuuaacccaaauaaaucuggagcugaccaagaaggcaggccacaugguggaguauuguauguuaccuucaguuucaaagagacugguuucuggcagcuucacaccuagggcuuucucaagcucuucuaccaugcugauucuucggaaggguggggugaagucgaccucguaggcuuggccuuccggcccaucugggugguaggugaucuuguaacugccuguaaugcucuucaccaucccugggaagaaagcagcccucucaaggacggagaacagaaguucuccucuacaggcagcacggccgucuuccacccgaguaugagcugaaggcagcaggacucaccugacagcaucuucucugugaucuccaugaggucaugauagucugcauaggccauguagaacucacagguggugaacucaggauugugagucaaaucaaucccuucguuccggaacuggcgcccaauuucauaaacccggucaaugccaccaaccaccagcaucuaccaaaaccacacagccacagucauguguuaauagcccuauaggcuccuaggaacuaacugcuuuucauagcuuagguacgcuuuccauucaaaaugcccagugcccugcuaucuuuagacaucaacuugcuucugauuuuauuuggcugggcaggacucccgagucucuuccugugucuuugcuauuucuuauuuguugggucugaguuucuccaaagccucuccaccugccagacacacuagugacacgucagcauggaagcuaccaaaggaagguguagguguuacacggaacucacuguggugaagggaaccagaggcagccaucuuucaaacagguuacugaaauucuagugcagugaccugugcccaguaggugacagagugauaugauccaguaucauuuccaggcaggacuccuuggccuuuaagguuauuguggcuuucuuacacaggugaauaaauuuugcucuaacuuguuacguaucugcaacuaagaaucagucuuugguauuuauacggauaauuugaagagauuuaguuuacuuuucuagaaagaauuuaagaccagcaaaaguucuuuuaugaaagacuaaacagagaaggacugggauguaguucagugguggauuucuuucuuuucucuugagcuagggucucacuguauggccuucacuggccuagaacucacuguauagguaagaguuaagggaucugcucgccucugccucugccuccugagugagccauuaaagguguuugccaccguggcaguuguagagaguguuugaagaaggcaggcaggcaggcaggcaggcaggcagacacaacugagaucuaaccccaggaaaacugcagcuaaagcuuugggauugaguuaaagcuuuaaccagaacagggucguguguacacguguacaacacgaugccuacaauccucagcugcuuccaaggacaucacaacccccaaacuacagaacuggagccuucuccuggcugcuuuaucuaacuucacugcuccuuccugcagacuggacuggucuggccagucauuuuuccagccuccuucuacuggaaggagacaggguguguggcuauugacuaccuugugguagaguucuggagcaauucucauauacaaguucauguccagcucauugugauaggugaugaaaggcuuggccacagcucccccgggaaugauguucaucaugggaguuucgaucuaaaacagacagaaacaaacaguucuuagauaaccagaggccuugaggacagugcauucuuugcauguagcauagacuaggccugucacauaacaaagaagaugaacagacuaucugacucauuagaaccgcaucuccauuccuuauauuacagaguacuguaagugcugacaggcuguaagagaacuauaaaugaaugcugcagcuuuuaggcuuaauuuacugugguaguuugaaagaggaugguccccauagguuuaaauguuugguuucuaguugguaaaacugcuugggaaggaucaggagaagguguggccuuuuuggaggagaugugucacugggcaugagguuuuaagguuucaaaagccuaugccaggcccagugucugugugacugucuuuucuuucucagucuuucugccugcaaccuguggaccaggauauaagcucucagccccaggcccgccugcuugugugcuggcauacuucuugccaugaugauucuggaccaacccucugaaacuauaagccagccaccaaguaaacagugucucggucauagugucucuucacagcaacagaacaguaucggaggcauuuacaguauuuacuaucuacauccuuaaagaagcaucagagggcuggagaugcucagcuguuaaaagcacauacugcucuuagagagaacccaagugcucuggccucgaaaggcacuggcauucccauguacaaaccuacacauacauaaaugucguaaagaagaaagaggcuaagaguuauagaagacgcugggcauccuccccauccuuugcacaugcacacagacacaugcaccagcacgcaauguacacauaaaaaagagcagguuuauuaagagugcacauagcaugacuacaauuuguauuuaaaccaaaaaauaaaacucugccgaaacauuuacaugugcacuccauauguagagagaauacaugugcauuuagaguauccaugugugcauauaccugccugccuauaccuccuaagugcuuggacuaaagggugccacgcuaccuggcuucuaaagagauuuuuaaugcuacagacccuccagcgucacugaaaguggcaucauuagcacagggauggugcauucuuuagaaagccugccccaugagcacuaaacagguagaagagacacugcucgggcaugacggacccuggcaggguaugcuguguaaaggaaagacgggaccgugagagacaagcacagccaaaacggcgccguuccagguaaagaccccuucgcccucgucaccucuaggaagcccagcucauccaagaaacuucuuauguaugugaugaucuuagagcggacgauaaauuucugccucacaaagucguucaggaucaaguccaaguaucuuugacgauaccguguuuccuaaagcaaaagcagcgagcgguuagaaaccggugcuuucugugauggcuacaggaggaggcgcgcauccgagaucagcuguggggcuuaccuugucuuugaggccaaagugaagaugaggcagcaugugcaagcagggggacagcagcgugaucuccugggggaugaugcucagcucgcccuucuugguuuucccgggauugcccucaacuccaauuaugucuccccggcgcaguuuguuauugauaugaacaaauuccuccucugauuuguaauuccugggugaaaggaaagguaacugaaugcauagcucuacaaaugaauacagaccccugccuuccucaggaaaccuucccucagaauacagaccccugccuuccucaggaaaccuucccgcagagccagaccccugccuuccucaggaaaucuucccgcagagccagaccccugucucacucaggaaaccuucccgcagagccccugcuuuggggacaacugcuggaggguuuccuuuauguuuacuguacuuuaaggaaggacagacuuucauuguuaggucuuuccacaaccugccacucaacucuacccaaccaugucucacuccucgauauccuaacucuaaacgacagugggaaaauaggaccacacuagccugugucuucaacugccugucuguuacgcugcggugugacacaagucguuuuuuaguuuguuugguucuuguauuuuuuuuuuuuuugagaugguuucucuguagcccugucuguccuagagcuugcucuauagaacaggcuggccucaaacucaagagauccaccugccuccugagugcggagauuaaaggccuaugccaccaccaccaccagcaauacaagaucuguaauuguguauuucuguguaccuggaguuggccaugacuuguaacuugacccccucuccucgcaggucauagaagaugagcuucccuccagaggcccucuuggcguggaugcggccuagagaggaaacaaugaagccauugagaggagaaaccucuugagcucucugugcaacacggaucacaacaaucuggguguggcucggggucugcagccugcccucuucuucaugucagugaccuucacuaaaccagucaaggcuguacaggaagaccucucuaaagacggucaguggauucuuggacgauggcagugguauugacaacgcggguuucgggucuuccugaaucuuuacauaaaaauucaguagcuagggacuagauaggcuaagccaagcccauuaguaaccgucaugcagggaaaggccaggcacaguagcacacuucuuuccucccgacacuuggaaggcagagcaguuuccagccaggaggucccucagagaacaucccuuccccagaagcgucuacucauguagaauuccacccaugccccagggcugcucuauucucugugaguagauagaaaggcaccgucuauccccaccagcugggacagugcagcaugagaucucaaguuugaggccaggcuagggcacacagcaauaucuggacucaaaaaaaccaaaaggggcagagggugcaagaccagcccaggcccuccucuguguuagcauagaagccugcccuugugagcugagaggcgagugaacugucagggaccugccuaccugccacuuugagggugacaucagucaggugguccccaggcugcaggugacuauauucuuggaugaacugagugagugagauguccacguggaacuuguguggguacggauccuccccagugaccuucagcugcuggacggcuugacuucggaucuuguaguauugcuguuaaaaaaagaaaaagaaaaaagagcuaguccuucugaaguggaacccugucagguguggcuucuucagcagaguaucacauuaauuacguuccuugucacaaugacagaauaccuuacaggaguauucuaguuuaagagaauaugguuacagcagggaaagcgagacagcacaguggcuuguccaggccuucagagguuuaugaccgucaucucugcagaucgugcaagacacacacacauguugggaagaaugaagcugaaccacaacccauuaagacucgacagcagggggcuggugagauuggcggcuggagagauggcucagaccacugacugcucuuccaaagguccugaguucaaaucuuagcaaccacaugguggcuuacaaccacccguaaugagaucugacgcccucuucuggugugucugaagauagcuacaguguacucauacaugaaauaaauaaaauaaaccuuuaaaaaaaugaauguagauucacagaaugaauuuaaaauacaagguucaacagaauuaaaaaaaaaaaagagguucacccaaaauaacaaaacuuaauugcugcagacagucucucuuguggacugcacuugcguggugaagugacuuucuuaauuauucuucuggccacacauuagacucuucccuugggcaugcucagcaaaccuauaaagugcagcuaugaaguaguuuaccacagggguugugcgaugguuuguauaaacuugggccagggaguggcacuaccaggagguguggccuuguuggaguaggugugucucuguggguguaagcuuuaauacccuagcccuagcuaccuggaagggaguauucugccagcagccuucauaugaagaugcagaacucucaggucugcaacaccaugccugccuggaugcugccaugcucugaccuauaagccagucccaacuaaauguugucauuaaaaaaaaaagaaaagggcuggagagauggcucagugguuaagagcacugacugcucuuccgaagauucugaguucaaaucccagcaaccacaugauggcucacaaccauccuuaaugacaucugacucccucuccuggugugucugaagacagcuacaguguacuuacauauaaaauaaauaauaaauaaaaaaaaaagaaaaagguuguccuuuauaagacuugcauuggucauggugucuguucccagaaguaaaacccuaauuaagacagcuuggcaacuuuuuaaaaaucauauguaugcaugugugucuguguggagguguguguguaugcaugugagugucuguggaggccagaagaggaagcuggaguaacaggugguuguuagcaaccugauguggguauccucuggaauagcaguauacacuuaaccaccaaggcaucucuccuuuucuaccaaggcauguuuccuuuucuacuguuaacaguggcaaauuagccuuggagugauacaaacaaaggguguggcugugcuuauguacaaaaccaggaagugggggaggagggugcauuuggcaugaggaauguauuuugccaacuaauagacacucuagucuaucuugagggaagacaccccuacugucauuguuacaggcucagcuacuuccaccaaguaguuacuuagggcaacuagcccuacuuggacuugaaacucaggguuaaucccagcacuugggaggcagaggcaggugaauuucugaguuugaggccagccuggucuacaaagugaguuccaagacagccaggccuacacagagaaacccugucucaaaaaaccacucagggccaggcgugguggugcaugccuuuaaucccagcacuugggaaacagaggcaggcggauuucugaguuugaggccagccuggucuacagagugaguuccaggacagccaaggcuacacagagaaacccugucucaaaaacaaaaccaacaaacaaaaaaaccccaaaaccaaaaccaaccaaaaacccccacuaccaacaacaaaaaaccaccccgggcuaugccagugacaaacggcaugcacugcucucccaauucucuuguugguucaaguucuuauuuaucuuguuagucacuuggucucuccugcuguuuguuagccacaagccucucagaagcucuguguccagucaucccaguggcccagggggacucacauuuggguccagagucuccuccucagcacccacgccauugucagccgugugguugggagcggaagcagucugguuuagcuguuucucacucagcucuuucugcuuggccuccuucucugccaguuucuucucagcuuucagacgccucuucagcucacuguugggaagaugacagcacccagugugacagcugccucaagaacccucugucagaagcuccacugccacuuuccaaacgcaugagcagccugggaaaguguuccugcugcacgccacacccacaagugaucuuacuccccagcucuaaccuguuagucacuaagcuauuugagggaacaagacaaaaagaaaaccuaagcuuugaacaaagacgcagcaggucauuuccagucuccacuuggcaucagaaaccaacuggaaucaagauacucaaaggugaagaagcccauauuuaccaguuuaugcgagcacugaacagagauuucccagaaaagcugcaggauaaacuuuuaagcccccugacacuagauacugcauccugguaguuuggcaucccuaagaagaccaagucccccuugaagguguaagguaauaccucuggcucugucagcuuucuggcucuccuagagaagugggcuagacuguagagaacuggucuucagagcuugaagacacaaucucuucaagagauaauuccagaacaacugucaaagacuggggggggggggggauuggggauguggcccgguugguagagugcucgccuggcaugcacaaagcucugggcuugaucucuagcaccgcugaugugauacugcacaucuguaaacccaggacuugggaggugcagguaggagaccacagguguaaggucaucuacagcuacgcaguggauuugaggccagccugagacccagcucagaacaaaacugguccgacacuaaccaggauggacugcuauccgaagcagcaggauacagguaauaucaugcuauguuuguagucaaacugccuagcacuaaauucuaaaacacuaaccacuugaauggcauugagcaaaugacuuaucaccaucuagaaaaaggaaagaagccacccucucaccaguugugaggacugagauguuaauaagaaaugaucgggucccagaguguaauuagggcucaaaaguggguucuaugccucucacuacuuaacucuucacauucugccuccaggacagaacccagacaaggcuggauccaucucuaaucaagucucucaucauccaaacuucacacauguuaccugaaacucaaaacaacgggggcaacucugugacccuugaccugagcuugcuaucugaauccaggaaaaaauaaacucacuuagacaagaauaucuucguuauucaaagagaauuuauggauggaucauucuuuacaacugaucagucuucaauagugaaucauggcaaaagauucuaagucauuguauauugucuggcuuuagaauacacccuucacuuuguuuguuuguuuugcacuauuggagcuugaacccagggguccaaguaugcuaggcaagaggucuaacccugaaguacccccaagcuccuuuuuaauuuugaaaugggacugcuaaauuguuugaucugccccugaacuugcgacccucuucccuuggcuucccaagugcuugggauuacagauauaaaccacugacugcucuuugcucuaucuuuguuuuuccauaugaauuuagcaaaauuuaaagaaagaacuuaucuuuuuuuuuuuuugauuuuucgagacaggguuucucuguauagcccuggcuguccuggaacucacuuuguagaccaggcuggccuagaacucagaaaucugccugccucugccuuccgagugcuggaauuaaaggcaugcaccaccaugccccguguaaaaaauaauugugaaagcuucaaaacaggcagaaauuuagucuuucuaauaaauacaaucuaucucacuuucaucuuucuaacaguccguggucuaaucagucuguaacucagugaacaagcuuuuaagauaaagucucuuuuccgcuucauucauuugcucuuguagauuauaaggacagucuaaaaagagacccuaaagguagcacuaaaacuaggucaaaguugauaaacaaaccccaggaagacaaaaagaaggggaaaauaacuagcauuugaaauuccuuaucucaggcagggugguguagcacaugccuguaaucuuagugugggaagcuaaaacagaacgaccuuuaguuuagggccagccuucauuacauaguaaauuugaggacagccuagccuauauagcaagauccugucucaauaaacaaacaaaaaacaaaaaaacauuagucaaaggggagaaagagaaagagaacagaaaagggacuacagggagaaggacucugaacucauagaguaagaggggagucuuggcuugggcaagagagcucuguuucuuuagcacguccagagacuuagccagcuaaaagacccugaaggaaagauucugcuccuggagcaauaaagaagguaaugggcaccaaccuucuucuaucagaaaguggcugguccuuguggagcguugugaaaggagcaagguggcccagucgaaguucccucugaccccauucugcccaugagguuuggcgcagggccccccuaacaagccugacagcagcuugcaucaacauggcggaacacccuggaacuacugauuaccaccaccuagcaggaaacagagacguguagucagaggggaccaauagcauacacccgcuccucccgcacuccuggggaggggagccaugauuuguacuaacgugcaaugucccucugaacuucagucccuccugacuaacaucugcaauguucuuaguccugucauagaaaaaaacaaaacguuucauaucugggauucgaaacccaaaugccagcuggagagagauggcucagugguuaagagcacugacugcucuucugaagguccugaguucaaaucccagcaaucacaugguggcucacaaccauccguaaugagauuugaggcccucuuauggggugucugaugacagcuacaguguacgcacauauaauaaauaaaucuuaaaaacaaaacaaaacaaaacaaaaaccccaaaugcaagucaauagccuagcugcagaaaugcucacaacuuccuacaguguggacggcaacauguggggcucugaaguguggucucucccaugaggauggacuccuggcaacaggaugauaaugaaaaugccaaaugcagauuuuagacaggccuagcuacuugggagcuugggaaggaacaugugagggaagggcagguccucagacaccauguuuacuuguuaucaacacgauggccucagagcuaccaggaucacacucuacuguguuucaguaacuugaggaaucuuucauuugagaauaagugauuugggcagacagaccaucuguuuuuaacuuugggggacuuucuggaauaaaacaguccucaggaaaaaaacuucaagaaaugccaaggacaauuaggaaaaagaaggggauaucauauuauucacaugcacaaaaauuauuuuagcugggaacguaaaaacugguucauuuuaaagccagcucgccgggcgugguggcgcacgccuuuaaucccagcacagaggcagaggcaggcggauuucugaguucgaggcuagccuggucuacaaagugaguuccaggacagccagggauauacagagaaacccugucucgaaaaaaaaaaaaaaaaaaaaaaaagccagcuuguggugguacaaacacuuuggaggcaaguagaucuagaucucuuaguuugaggcuagccuggucuagggcagccugugaguucuacacagggaaacccugucuuauaaaaacaaaaaacaaacaaaacuaccugauuucauuaggcaaccgaggaucacagauuugguauagacuucccuucagauaucugucccagugcuucagagcaaugcuaggaagcacacgaggaacauauauuuucauuagcaguaccccggaaaucaagagccuugugcauggaagcagccauuaagccacacccacaaccgcugggaacucccauuuucucauaaacccagggccguaguuucugacuuggaaaugugggcaugaacauuucucuugcaagauuacuacugagauuagacaaaguuuguauagugccagcgugguguuuaacggguaaauuaaagucaaagguauauuuaagaaaaguaacuugagggcugggugugguggugcacaccuuugaucccagcacuagggaggcagaggcaggcagauuucugagcucgaggccagccuggucuacaaagugaguuccaggacagccagggcgccagggcuacacagagaaauccugucucgaaaaaccaaaaaaaaaaagaaaagaaagaaagaaaagugacuugaaagcagcaguaaggcuuccuuaaauuaccugaaaacugagguacuuucuuucgcuugugacucaaaauuccaacuacugauuuaauaaacucacccauccuccgcuaaggaauccacuaaacugcucacacaaaggacaaccaaccagggagccugcaacccauaaauuuaaacauuuucuuuaaaauccuucuaaaccacacaaagcagaaacacagccauaaaaaggaaacccaguuauuaucuagaagguuucugguauuucccucggggaucaauaaggggauuuauuuauugcuaggguacuaacgaaagcagccaugguaugugacagcuuaaacuaguuauuuccuacagcuuuggaggguacuauguaguuccaggcacuaagaagacauucaagucauugcuaguguucugugggucaaguggacuagaguguaguccuaaaagcaaccaguuaaagggaggguaaucuuaucugccuacucaauucugggauuuggaguguuuuacaaagauacccccagcagugcaaagggagccugguguaucccgcuaaauaaggccacuugcucccgugucacagauccuuugagugacacauauggguagguacacuauuguuucagaacguacccccuuuuaacacccaaggugcagaauaaccuuggauaggccaaggauaauguaaagguucuucuuuuaagaacaaagauauuuaaccauuuuccagucuauccguugggggagugguucaauuaaaagagcauuucuuagaagguagggaaaaguuaguuucacuuuucuuugcuaccauucccgguuucugugcuggcuuucccuagguaugcucgucccuacggcuaggaccagggaacccaucagccacgcaguugauccuccuggggcauccuggaggcuguagguucuacggcacugcaucucugucccagcaugugcucacccaccggaaaagacaagagggaccccaggcacagucgccuuggcgggaaaacuccaggcacuucccaucggaacacugcaacaagagacacuuagagaucuucaacgacacuuacuucuugcuuaguuucugcucgccauccacuuugacuucacucuccugcagcguggccaucuuccccacuggcccgacccagaaaaaaaaaaauuaugacuagcguagaacuagaacuuccaggucguggcucuaaguccugccucu

SEQ ID NO: 4798 - RNA, 9906 nt, Mus musculus
cgggaaagagggcgggcccucggccggacucucgcugcgcaggcgcagugcugggcuccuccggcggagaguccgucuuaguggugucguuucugcgcuuuacuuguacagcggggcgacagguauggcggaggcgauggaucuggguaaagaccccaaugggcccacucacuccuccacucuguucgugagagaagacggcagcgccaugucguuuuacgugcggcccagcucggccaagcgccggcugucgacgcucauccugcacggcggcggcaccgugugucgggugcaggaacccggagccgugcuucucgcccagcccggggaggcgcuggccgaggcuucgggcgacuucaucuccacgcaguacauccuagacugcguggaucgcaacgagaagcuggaccuggaggccuaucggcugggccugacggagcaggcguccgauccgaagcccggggcuuccaccgagggcuccacggaaccggagccgcagccccugaccgggcgcaucgccuacaccgacgcggaagauguggccauccugaccuacgugaaggagaacgcccguucgcccagcucggucacaggcaaugccuuguggaaagcgauggagaagagcucgcucacgcagcacuccuggcagucgcucaaggaccgcuaccucaagcaccuacggggucaggagcacaaguaccugcucgggaacgccccggucagcccguccucccagaagcucaaacggaaggcggagcaggaccccgaggccgcggauagcggaggugaggccggcaccuucggggcuccggggggcggggcugccugccugucagcgagcgucuuuuugggcgccguggguggcauagcucagccccucuucucuguugagguccgaagcgaaagugcaccguuuccucuuaucccuuguuuucugguuuuaauuugucuuuucauuuaacuuuuccuucccguugacuggauguuuguucguugauggauuuggguuugggagggcggggaacuugagucucuucgcugugucgcccaggcuguccccaaacucuaugccugaaauauucuccugccuucggagugacugagacuacggaacaguaacuaguuuacaaaaacggcucuguguucaaaaggaacacaguacaguauauauggaaaucuucuacccuuccuacccaccauacccaggagguaacaggguaaccuguuucuguuuucagaaauuucaaagauauuuucccuucccccuuuuuccuuccuuccuuccuccucuccuuuucuccuuuuccuccaccucuucuugcgccuccuccuccuccuccuccucuucuucucauccuccaucuuuuuuauuugagaaaaggccccuggccguucauuuuaagauauugccuauauucuggucuuacucaauauaaacuaugugaauggcauggcaggucaguuuacuuuccguauuuuggcuuaacugaauguacuucuauauaaagaggaaaguugcuuuguggucuucuuaggugaggugaauuucuaagcacuugagguuaagaucuggcugugauuaguguauaguacaaaggugucgcuuuuuuuacuuaggucguguuguaaguuuguuuuuugagacagccaggcuggccucccaagucuaggcaauccucuuaccucagucucuagagugcuggaaucacacagcugagccaccaugccuggcuaagauaucugccuuuucuguaaccaguauugacagcuuaaauggcagacauuuuugacuuuaaggcaugcuuucuccauuugggcuguguguguguguguguguguguguggggagguaaaaucuauuucucuaguucagcaugcuuaaagagcacugagugcucuuccagaggucugaguucacuucccagcucacagccauccuuagugggagcugaugcccucuccuggugugucuguagacagcuacagugcgcugucagugugccagucucuugcucuccagguuccugaguauucucuuugcucugccucccccuucccuccucccucuuuucuucucccuucuuuccucccccucuccucucauggcccaguuuaguguggacccuuccagaugccucuggcuacacucucccucauaucuacaauaaaccuccaccauacuuaaaauccucguguccucauuuauuucuuuuuuuuuuuuuaaauuccuuaauuuuuauuccugguaccacuaccacaauuuacagggcaauauaccugauguaaugaaaagaaaaagaaaaagacaaagcuacaacagauaaaagaccucaggaauguacaucuaauugacacuacauugcauuaaucaauagcugcacuuuuugcaaacuguggcuaugacaguccugaacaagaaggguuuccuguuuaagcugcaguaacuuuucugacuauggaucaucguuccuucuguggcagauuuuuacaguuccucuaaugcauuugggacgacugucucaaaguaaccugcagcuuuccugacaacuccucgcucucucuccugcuaagaacuguagccguuucuguuuuauuuuaaaaccuucugcuaccauauccaccacuuccaccuccagauccauagccaccaccauagggacugccugagcuucuuccaccaaaacugccccccuucauggguccauaauuugauuguugcuguccacuauaauuuccaaagucauuauaguuuccaccaccaccauaguuaccuccaccaaaauuuccuccuucauuguaaccaucauagccuccuccuccaccaccauauccaccacccugguuuccauauccugguccaccaccuccauaaccuccucuacuacuguaaccaggaccaccaccauaguugccaccaucaccuccaaauccauuauauccaccaucaccaccuccauaacuaccucugcugccaccaccuccaccaccauagccaccucuuccuccaaaguuuccuccaccaccuccaaaguuuccuccacgacccauaaaguugccagauccaccuccacgaucucucugugauccagcagaccgcaucucuuguuuagaaagggccuuuuucacuucacaauuaugcccauuaauagugugguauuucugaacaacaauuuuaucaacugugucaugaucaucaaaaguuacaaaagcaaauccucucuuuuucccacucugccugucuuccauaaccucuaugguuucaaucuugccauacuuuucaaaguagucucucagguuauauucuuccguauccucuuuaauaccaccaacaaaaauuuucuucaccguuaaaugggcaccaggcuuuacagaauccucucuagagacagcucucuuugguuccaccacacgcccaucaaccuuguauggccgagcacacauugcagcauccaccucuucaacacaagaguaggucacaaaaccaaagccucuggaacguuuuguuuggggaucucucauuaccacacagucuguaagugugccccauuucucaaaauguucucuuaagcuaucaucugugguuucaaagcucagaccaccaauaaauagcuuccucagcugcucugguuccuuuggaucauggcccuccauuuugagaccggacucgccucuuccaacucgaguucaauaugggaccgagagcauccucauuuauuucauuuggccuagaacucacuuagagccccagacuagccucuuaacucaaaaccuuccuugcgucgugcucccggguccugggaguagugguuauuuuuggaaacaagugugagaauuauugaguaugcaucucuuacgcucucuguacauuucugaauaauaaacaggaauuuucuaaaaggaaaaaaucugcgugcacagaacugaugcagacggucuaugcgaaugagcuuuguugcucugcuguucuuuccuuuaauagagccacagaacaagagagcgccagacuugccugaggaggagugugugaaaggagagaucaaggagaauggagaggcagacaacaagcuguuugaggaagccgcuccggaguucggagaagccgugguaucugaacuuaguuuacuuauucccucccccugccucguucucauuugcuuauuaaccugggcuuuccauccacccgaggccaggaacauacaagacggaagaggagagaaauagaugugaccuggcuuuaggcuucacaaagccuuuaauauuuggcaggauaggauaaguggcugagggagaaaaaucaucacaccgaauagggacaauuuuauuuuaguuuuugcucugagacaagucucacuguguggaccuggagccaugggugggucucuucagcccagaucuugugaauuuaaaaaaaaauuaaaauuuuuuauuacaauuuuauuuauuggauaauaaguccauccucuuugucuaccauguagagccccgagaauaagcucaagugucuggccugguggcagcugcuuuuaccugcacagccaucuugcuggcccugaauuaacacaagagaaagugguuauggagucaugguggcaugugcuuuuauucuagugugugggagaggcagguggaucucugaguuccaggcuagccuggucuacauaagugaguuucaggauagccagagauacauaguaagauccuguuuugggaaaaaaaaaaaacaggaaaaagaaagaaaggaaggaaggaaggaagaaauuaugauucaguuuucuguucccuccugccuuccuuacuucucuuccaggcuggccuuccugcccugcuuaaaugcauuuuccccuagaacugaggccugaauccagagcugcacacaugcuaggcaaaugcucugcgagugaacgauacuccaagccacauucugcccuuuccucuuaaaguuacuggccagccugucacagugcuguuugucugugaccccagcacuuuagagaugaagacaggaggaacaggcauuuagggucauccguggccguauuaucucugaagcuauccugagcuacuuugucuaaaauuaagaaaacaaaacaaaaaaccuaccccagugaauguggugguacaugccuauaauucugcacuugggaguuaacugaggagggacucagaagucaaaggugagggcuggaaaggggccuuagaggguuagagcacuuguugcuccuacagagggcccagauuugaugcccagcacccauaaggccgcuuauaaccgacugucuguaucuccagacucagggaccuauugcccccuucugacuuuuguggguaccaggcaugcacuuguacacauacaaccaggcaaaauacucaaacacauaaaauaauaauucuaaaaaaauguuuaaauuaauucaaaaaggggaagaaguuaaagaucauuguuugcuacgaagcaaauucaaggccagcugggcugccugaaacaucgucucccgguacagccagaacggcccugagcuuaugggaaugcugggguuacagggauguaucaccacacccgucuaguauuuaguauaaaagaaggaaauuaaguuuguauaaaugguaagugacuauuacugauggccagaacuaaagaauuucuguguuuuguaguuuugcauguuguuuuguuauuugaugauuuguucauuuccuaucaacugucaaacucagcaguucucagacacagcucucauguaacaugcuuugugauaugccuaaauguccuauagcuuggaaagccuaguagacucauacagcaauauugaggacuuagucacaggcuucauugaugaacacagcaugccugguuccugcuuuuauggaacuucacaucuuagucacaggcuucauugaugaacacagcaugccugguuccugcuuuuauggaacuucacaucugcaagugcauugaauaagagaucuaauggcauacagguuacacauguucucucucucacacacacaccaugcauucuguauuuuauuuuuuaagaauuauuuauuauauuuuauguauaugaguguacuguagcugucugaagacaccccagaagaaggcaucagaucccauuacagaugguggugagccaccaugugguugcugggaauagaacucagagccucuggaagagcagucagugcucuuaaccacugagccaucucugcagcccacauuccauauuuuaaccaguuaaauauauacguguagauaugcacgacaugcugcccuuccacguauucuccacaugcaugucuguacacaugucagcauggauaaauacaaaggagagggacugaagggagccuggggugauggugauggugauggagauggcugugugaagagccagggagcgauagucagggagagagauacguguuccaagagcucaaggcuuaauaaauaggaacugguuucucuccuuguucuuucuagguggaugagagcccugacuuugaaauacauauaacgaugugugauggugauccacccacacccgaggaagacucagaaacacagccagacgaggaggaagaagaaccaaaaguuucuacgcaagaagugggaacugccauuaaggugauccggcagcuaauggagaaguucaacuuggaucuaucaacaguuacacaggccuugcugaagaacaguggugagcuggaggccacguccuccuucuuagagucggggcggagacccgacgguuaucccauuuggugcagacaagaugacuuagauuugcagaaggacgaugacgacacgaaaaaugcacuggucaaaaaguuuggagcucagaacguugcucggaggauugaauuccgaaagaaauaaacagacaagaggauggaaaagauaggugaugauguaagcaccugugaccauugacaccgaccagcaggcgaucgugucagcaccaguggccagugaccccgccggugcugcuguagccacgcaguguaauguagcaggauaaaacaaaagacacuggaauuagagccguccauggcaaguauccccuguuuaugauaggcaaaucuaagccagagagguuggucuguguacuagucauuuuuggauggacugugucccccguuguacaggugccaggagccaagugacaaagucaaaguuggaaaugaaagggcauuugacuuggugagggaauaauucuugucuuuuggcagaaguugcuuuagcuggagggucccaaaccaagagucuagaagaacgauuuaguugcagagcuuguaccaugacucccaaacuaucccaucccccagggaccucuggauucuguguugacugaguugaaaaaccccauagucaucuugcuauaaaucuuugaaaucucuucuucuuccuuggcuguugcuuuuugacucugagucaagucucuauagaacauacuugcuuacuuaccacucaguuuuguguacauaaagcccuaggcuugaaggagcuuccauccuuuguacauuauaaaugaugucauguacaaacuucacagucaagaaucaaaggaaaaaaucaaguuacacacacacacacacacacacacacacacacagucuuaaaacucuguucuagaaggcugugauucagugucucacccuuguagcuauccucggacacuguugguuggauacuguuaauugugauaugucaauuuuaaaauuauguggaacauacguuuucugcugaaaauuaugcuagacuuaaaauugaguggccuugguccacuuugcuguguuguuuuugucauugaaaauaaauaaaacuuuguguugagucuugucaacaagcauuuucuuugauuuuauauaggaaacaguuuagguaaauuuucauuuuagaauuaauaagccuugaaaagaugauccucuagguggagugaagggaggaugugucucagucaggguuuguauaccugcacaaaacaccaugaccaagaagcaaguuggggaggaaaggguuuauucaguuuacacuuccacauugcuguucaucaccaaaggaagucaggacuggaccucacacagggcaggaaccuggaggcaggaacugaugcagaggccauggaaggugcugguuccuggauugcuuucccuggcuugcucagcuuuucuucuuguagaacccaaaccacccaacagcccucccccuuugaucaauaauugagaaaaugccuuacagcuggaucucgugaagccguuuccucaaaggaggcuccuuucccugugaaaacuccagcuugugucagguugacgcacaaaaccagccgguaccgugugcaucagaacuaugaaaagaggcagaaucaguugaaauucugcgaguugaagagaagcaagccagaggugugucacaggugugagccccaucuccagcagucuggacacucaaacuucacacucaccaacaggaaucugauacgugucuacgcgaagcauucuagaguuaaugucuuaguuuuagguaaucuuaaaacuuaguuuuaguuuuuaguuuaccuaaaacuagucuuaguuuuagguaaucaaaggaugugagaacagaggucuccuguuuaccaccuaaguguauuuuggaacuagaugcacugaaaaaaaaaagguuguuuguuuagagagaggaacuuaugucuucuacuuucuaaaaaacuucuaguagagucugguauaagugaaauguuuaaccugagcccuuuucugaggauguuuuaggcaugugacacacgucaguaauguaauucucacuacucuggugacuaagaugggaauugagagggguuauaugguacgauuuguuuaaaauguguacucuuuuugauaggacucuaaaaugguucaaaauuaacugucuuaagggcuggagagauggcucagugguuaagagcacugucugcucuuccagagguccugaguucaaaucccagcaaccacaugguggcucacaaccaucuguaaugggguccgaugcacacuucuggugugugucugaagacagcuacuguguacucguauaaauaaaaauaaaucuuuaaaaaaaaaaagaaaauucuguuuuuguaaaaaaaaaaaagacagcuacaguguacuuacauauaauaaauaaaucuuuaaaagaauuacugucuuaaauaaaugauuuauuauguucaggccuuaguaaaguugccaucuacugguuuuauagagcuagaauccuauuuuugucaaauauuguccagagaucuguuauucccuacgucuuaaaagacauagaaaccaaaacacaaagcagcuuacaacuugcuauauauuauauauauauccugacagcuuaaucuggauugcgucuggaaccaacuaagagacaugccuccgggaugguccgugaggucauuuacaggaaggacuaaccagagagaagagacccucagaguggauagcgucuuccccuguaguggcccaggauaugcauaggaggcaacaagcaguacugcuucauuugccugcccugguuucuugcuggcgaaugcauguauaccauuguugcugcugcugcugcugcugccauuggaacccagcuuauucagccuuucaaaguggacugaaaacuaugggcucuccaaggaguucucugggccuucagcuucagcuuaggacugcugagacaccagguuuauggauugaguagccacagugcucugggcacuguuggacuagccagcccuugcuguguaaggcagucuacaaaaugaccauguauaguacauauucaucuuauuggcucuguuccucuggaaaacccugauuaaaacaggcaugcucuggcuuucugcuugugcccuuuauuccucuaggaaugaguuuauucuc

SEQ ID NO: 4799 - RNA, 1373 nt, Mus musculus
gccuucagaucaugcaaacaauaugguguugacgagaacggccccagaguugggcuugcacaaggguaagcacgcaguccccuggaugcugauuggcaucagggugccauagaguugugcaagguacaagcugcacagccaacuguaaugagcugugggagaguuuucuucaaacuggugaagguaauggggcaaagaaucccuuaccuuucuuuucaggagcuggacagaaguugguguuacaggcucugagcaccggaggcuucugauggagcagacaacuugaggaaggccggccuugcugcaugcaguggacagagcgagucuggacuccucccccgcagguuacugugcacugccagagagagagagagagagagagagagagagagagagagagagagagagagagagagagauaguucagcugaguucagcuggacagcauccuuucugaggucggcggcaucaaacagacggaagcacaauauucaggaccaagaugccugcagccaggucuaggcauacaggccaagucuauucagcccagugugaacuguguggucuaucagaaaaaucuugaacaaaggcuauuguaucaccugagaguauguguccccaguuaaaggguucaacaggagguaggcuccagaaauguuuuaaaaacucagaaacaaauucagacaugaccagggauggagucccagaaacccaggcaaccucagucaaaugccagaauggaugggguuaguuugaaacagggaccauaaaggacauacacuuugggaugguguucagucagguuuugagguagcauaguaucuaacagccagggauuuuuacuguccaauuaaaaagaaucuaggcucugaguuucucuuuguccucaacggcuacaggaagaauugauggaucuucagcagaaggacagacaaggacauacugggggaggggcaacacugucaauggaucauugcucuguugcuuuacaauggacugcaggcagcugacagcaucauuucguacaaauacugcucuguggccugguguuugggaggaaagaggaugcaguuaggaaucaucccaacauucaaauacagacguaugauuuccaccaaauuguauguauguauauauagcauuuagguguaaugucagccuuuauuauacaaaaacaggugucugaggugggaaacaucuggcuuccugguauuuguuggcugacuucugacuauauuuacuuguucagauaaaagcauaugauuccccuguguaaaaaugucuucauaauaauuacauguaguaguguguuucacaaaccauaaaaaagaauuuguaaagguuaaauaaaauuacaaaauuuaagaagccua

SEQ ID NO: 4800 - RNA, 4112 nt, Mus musculus
auggauaguuuuuauuuauucacgucugagguucuguugugugugaaaaaggacucauuuucuaacauuacauauucauggcuugggauagaugggauaaggaacuuauuauuaaugugucacugugggaaacuuacucuaguucauuugcgaaccuuguuaaaucugguguggucagcaggcagggugaagcucuggaugcagucuccuaacagaggacagagaggcagcuucucuggguucaguaaaacaaguuuaaaucuucauaggcucuugugggguuguaauuuuaaagaaaugggucuuuuuuuuuuuuuuuuaagauggcagagauuguguugagacaagugcuccaaucucauccuuucuuaauuuugauuuucuaguuuucugagagacuacuuaagagagcuccugaaggucucuucuuuccugccagccucuucugacacucuucugggucaaguucuggcuuuaucugcccauguuuucaucccucugauccauucccugaaaaccccggaguccuuaauucaaagcuccuauggacaccacagaacuccuugccugggacaaacacggggccuauuaaugcaccaucuuguaaauccaggcugcggggagaagagccagcagggaucuggcgcaaucugcuucugugugagcucaggcagaaggaagcauaugcugcaagcagcucucugcaaagacaggcgcugcucccuggcagggacagccuguggguuuggcgacauccguggggccuugccacguuuccucaguuuggucgagccauagcaaguggucagccaagaugaaccaaguccuucucugugaaaagaaagcaaauuaagugcacuggggugggggugggggguggggaaaaaagugccuuucaaaaacuggaagaaucuucuaugucaggcaucagaguccgagagcaucuggauuaucgccagggccgugccaucccggggaauuuucuuccccggaaauaacuucgcucucccuggagaugacaaaaggacaguuguucauagucaccaaggcucaugagaucaaggcuagggucuuaggagugcaagugaggggcaaaggaaggagaacccuuagaaagcauccuccagcagcgcucuucauaaugcaaaacauuuguuucuugccaggaucccauuggcgguuccccucguauuauauugccauuuauauuggaaagucaggcagcgcgaaacuguagucuauuaagaguuugugagugugugcguguguacacagugaaauaauaucuugugcaaugugaagugacagucaaaauuacagcuccucucuugccgcaaggguacuucucugccaaguauaguaauauuguagugucguucaagguugucagcaauucuggcucgcucugcagagagucauaacagcacgcgcagagaaggagcuuccugucaggggaaauacuauaauuuugauauauauuuguuggugccaaacugcaauuaaauaggagguguuggaaaggggguuuuauuuaaccagcuugaauuuguuaauuaauuagcgaaaacuuauauuucgaaugcuucaagaaacagcuucaugauguccucacaagcaguuuuguuuuguuuucaccgcuguuucuuuugguuagucucuuagagaaaacaaaaugcuucccuccaggaaaacaggauacaauuggguaugggauuuuucacaggguaaauggcccggaaaaaaaauaaauugaugcagaauaaaauuuuugugcaguauaaauugugcaggaaaauuuugugucaaggggaaaaggauuuccagccacuaaagggaugggggaaaaaauaaagcaccuugaauaaugucacguuaugguucgucuuugcggugcaguuccccguucauauuuagaguuggacuucagugacagccgcugagacucuuggagagauccuucccaacggagugagcuugagcccugcuagcuguagcuacgauaaagacauuuucaggaaauauguguguguguguguuugugugugugugacguuaucagaucacaguguuugugauuguaaacuacuagucaaucuuuguagaaucuuucauccuagguauguuauguggaguaguaacacuuuuuuuuuuuuuuuuggaugcaaaagcuuuuuuucugaucuuccaaaaagaaaaagaaaaagaaaaaaaaaaaaaagaaaugagcauguccucagaguguacucuacacuguuauucagaugaaaacuacauucuuuuuugaguaaguaggaaaaaaccaugggagacugaaauagcaacaauauauuaaaagcucagagacaguuaugugugaaaaagacgagcaagaccaugugguuucaaaaaagcaccauugaggagcuuuaaaaaaaagcagugugagauggugguggggcagauacucgcuccuccuauugaacauuuugcaaauuaagugaguuuuacucuucaauaaaauaggaaucuaauaacauuuuauaugaucauaaaaugugucugcuuuugucucuaucuuucaugaaaagaagaaauauucccaaaguauauuagcaaaaauaauuaauaagcaaccucucagaguuauuuucugagguuaauuauuacccggagaaaucaauuucaauuucuucccuuugcaagacucacugaggcgcguuugcaccucggcauuuccaaaaaggcagaguccacuccugcacgagaaagugccugcgcugcccgcugugauuuauccuggcagucguacuguuucccaccccugccaaggaagauacaacagagccauucagcuccaacuuaguugcccaucagcgccuucguauuguuaaacuaaaagccagauacacucgaaugcugaugaaauaaaguagcuugccucuuccaucuaacccuccccagcagcccuggcugacguguccaggaaagcagggcgaaucggcucuggccagggucgcugcuccugucuuaggacccaagugaagaagaaggugugugugugugggggggggggggggugaacguaaaccuggaagugugucuugaugggaaccaggaaaucauugccugucuuccucauccaucgcaggagucagcagcagcacgcugaccucucaccggccugcaggauuuccugaaccaugaccacaauggccuggucuauucuggcugaucacagcagacucuuccccaagacuggggacagaguggcagugcuaggaauuucucuucucuccccaguuucuuccauugcuaggccuaaaaugacagcaucaguuuccaugguuggauguaguauguauguauguauguauguauguauguauguauauauauaaaauuuggaauggauaucuggaaaugucacuccaugguagugugcccacagcaucuguacaaggccauuguuacagcauuccaaguaagucaguuucuuuucuguugcugugauuaaaaaaaaaaauccucugauuaaagaaauucagaggaguaaggcuuuguagaggcucacaguucagggguauagccugucgucacagguaaggucaaggcagcuagagacugaggacgcuggucacaucauguccacagucaggaugcagagggaugauagaugccagcacuugccgucccucuaauccagaaucuccugcucugugaauggucccagccaugguuuagaugaguuuucccacaucaguuaaccuaaucaagauauaacaccaccacuaccaccaucaccaucacuacuaggcaugcucagagguuaugaggugagcccccuuuucccaauggccccccuuccccccuuuucccauaggaguguagcucagugggagcaugguugccuagagugcauaaagacacguucauuccgaaacacugaagaaaacccagccucguagcuggagugaugauagccauuaugugccucacccauuuuaagaucaacauacucaccaugacauucagcaaagaacgcaauagcuucacaggagccagcgagagaagccauccaucaguccaucuggacacugcauucuuaccugugggguccugauccacugugggug

SEQ ID NO: 4801 - RNA, 4112 nt, Mus musculus
cacccacaguggaucaggaccccacagguaagaaugcaguguccagauggacugauggauggcuucucucgcuggcuccugugaagcuauugcguucuuugcugaaugucauggugaguauguugaucuuaaaaugggugaggcacauaauggcuaucaucacuccagcuacgaggcuggguuuucuucaguguuucggaaugaacgugucuuuaugcacucuaggcaaccaugcucccacugagcuacacuccuaugggaaaaggggggaaggggggccauugggaaaagggggcucaccucauaaccucugagcaugccuaguagugauggugauggugguaguggugguguuauaucuugauuagguuaacugaugugggaaaacucaucuaaaccauggcugggaccauucacagagcaggagauucuggauuagagggacggcaagugcuggcaucuaucaucccucugcauccugacuguggacaugaugugaccagcguccucagucucuagcugccuugaccuuaccugugacgacaggcuauaccccugaacugugagccucuacaaagccuuacuccucugaauuucuuuaaucagaggauuuuuuuuuuuaaucacagcaacagaaaagaaacugacuuacuuggaaugcuguaacaauggccuuguacagaugcugugggcacacuaccauggagugacauuuccagauauccauuccaaauuuuauauauauacauacauacauacauacauacauacauacauacuacauccaaccauggaaacugaugcugucauuuuaggccuagcaauggaagaaacuggggagagaagagaaauuccuagcacugccacucuguccccagucuuggggaagagucugcugugaucagccagaauagaccaggccauuguggucaugguucaggaaauccugcaggccggugagaggucagcgugcugcugcugacuccugcgauggaugaggaagacaggcaaugauuuccugguucccaucaagacacacuuccagguuuacguucacccccccccccccccacacacacacaccuucuucuucacuuggguccuaagacaggagcagcgacccuggccagagccgauucgcccugcuuuccuggacacgucagccagggcugcuggggaggguuagauggaagaggcaagcuacuuuauuucaucagcauucgaguguaucuggcuuuuaguuuaacaauacgaaggcgcugaugggcaacuaaguuggagcugaauggcucuguuguaucuuccuuggcaggggugggaaacaguacgacugccaggauaaaucacagcgggcagcgcaggcacuuucucgugcaggaguggacucugccuuuuuggaaaugccgaggugcaaacgcgccucagugagucuugcaaagggaagaaauugaaauugauuucuccggguaauaauuaaccucagaaaauaacucugagagguugcuuauuaauuauuuuugcuaauauacuuugggaauauuucuucuuuucaugaaagauagagacaaaagcagacacauuuuaugaucauauaaaauguuauuagauuccuauuuuauugaagaguaaaacucacuuaauuugcaaaauguucaauaggaggagcgaguaucugccccaccaccaucucacacugcuuuuuuuuaaagcuccucaauggugcuuuuuugaaaccacauggucuugcucgucuuuuucacacauaacugucucugagcuuuuaauauauuguugcuauuucagucucccaugguuuuuuccuacuuacucaaaaaagaauguaguuuucaucugaauaacaguguagaguacacucugaggacaugcucauuucuuuuuuuuuuuuuucuuuuucuuuuucuuuuuggaagaucagaaaaaaagcuuuugcauccaaaaaaaaaaaaaaaaguguuacuacuccacauaacauaccuaggaugaaagauucuacaaagauugacuaguaguuuacaaucacaaacacugugaucugauaacgucacacacacacaaacacacacacacacauauuuccugaaaaugucuuuaucguagcuacagcuagcagggcucaagcucacuccguugggaaggaucucuccaagagucucagcggcugucacugaaguccaacucuaaauaugaacggggaacugcaccgcaaagacgaaccauaacgugacauuauucaaggugcuuuauuuuuucccccaucccuuuaguggcuggaaauccuuuuccccuugacacaaaauuuuccugcacaauuuauacugcacaaaaauuuuauucugcaucaauuuauuuuuuuuccgggccauuuacccugugaaaaaucccauacccaauuguauccuguuuuccuggagggaagcauuuuguuuucucuaagagacuaaccaaaagaaacagcggugaaaacaaaacaaaacugcuugugaggacaucaugaagcuguuucuugaagcauucgaaauauaaguuuucgcuaauuaauuaacaaauucaagcugguuaaauaaaacccccuuuccaacaccuccuauuuaauugcaguuuggcaccaacaaauauauaucaaaauuauaguauuuccccugacaggaagcuccuucucugcgcgugcuguuaugacucucugcagagcgagccagaauugcugacaaccuugaacgacacuacaauauuacuauacuuggcagagaaguacccuugcggcaagagaggagcuguaauuuugacugucacuucacauugcacaagauauuauuucacuguguacacacgcacacacucacaaacucuuaauagacuacaguuucgcgcugccugacuuuccaauauaaauggcaauauaauacgaggggaaccgccaaugggauccuggcaagaaacaaauguuuugcauuaugaagagcgcugcuggaggaugcuuucuaaggguucuccuuccuuugccccucacuugcacuccuaagacccuagccuugaucucaugagccuuggugacuaugaacaacuguccuuuugucaucuccagggagagcgaaguuauuuccggggaagaaaauuccccgggauggcacggcccuggcgauaauccagaugcucucggacucugaugccugacauagaagauucuuccaguuuuugaaaggcacuuuuuuccccaccccccacccccaccccagugcacuuaauuugcuuucuuuucacagagaaggacuugguucaucuuggcugaccacuugcuauggcucgaccaaacugaggaaacguggcaaggccccacggaugucgccaaacccacaggcugucccugccagggagcagcgccugucuuugcagagagcugcuugcagcauaugcuuccuucugccugagcucacacagaagcagauugcgccagaucccugcuggcucuucuccccgcagccuggauuuacaagauggugcauuaauaggccccguguuugucccaggcaaggaguucugugguguccauaggagcuuugaauuaaggacuccgggguuuucagggaauggaucagagggaugaaaacaugggcagauaaagccagaacuugacccagaagagugucagaagaggcuggcaggaaagaagagaccuucaggagcucucuuaaguagucucucagaaaacuagaaaaucaaaauuaagaaaggaugagauuggagcacuugucucaacacaaucucugccaucuuaaaaaaaaaaaaaaaagacccauuucuuuaaaauuacaaccccacaagagccuaugaagauuuaaacuuguuuuacugaacccagagaagcugccucucuguccucuguuaggagacugcauccagagcuucacccugccugcugaccacaccagauuuaacaagguucgcaaaugaacuagaguaaguuucccacagugacacauuaauaauaaguuccuuaucccaucuaucccaagccaugaauauguaauguuagaaaaugaguccuuuuucacacacaacagaaccucagacgugaauaaauaaaaacuauccau

SEQ ID NO: 4802 - RNA, 6870 nt, Mus musculus
ugagauucacccaucucugcuguauggccuuuauuuacuaaggcaggaagcgcagucaugaaacccacaaggggcagaagaaugaaguucagauuaaaaacacaaacagccaacauccuggugucuuugucauucuuuggcagcaacaaaacccauccuuuauuuagaccguuccucuggccuggcaggaaccacgguaugcgggccuccgguucucucccguguuggguggcaacaacucuccugacccuugggcugcucuugccaucucccuagucccaugucacucuccccugccuccucagucacuguuaaacgaccucuagaucucucuuugccgcccuguauuaccauuagaagacauccaccccgagaaauugcucaguuccuguuuuugauuaauauuuuaucagccacaggaggaaaugguauucugcagcaacacuaauugagcagaagagaugcucucacaagcuuagguuaaaacagacggggcggacugcaacuucggagacugugugagccuugggauauauagaguccagcuucagcaccgagggguaugguagggugaaaguccaucacggucccaacaaaaagcaagcaacauucuuccuugaguaguaucuuagaacauaguagugguggugacagugaugaugaugaugacgauggagauaaaucaugauaaagccuuuuguaaaaagcaaagaacauaaauaugaacguuaugguauauaacgugugugccacucuauguaaauuugagguuacucagugaacagccaugaccugggucccugcgucacucaauugcuuaaagccagcucacccuggucuuuauugaaaugguucuauagcagaggaggcagaguagcuaucaguuaccuugccauccgguaauuaccgaaucauaaacauuugaagggcugaaggucacgggcuuagaagcgacccucguccgacucuuugugaauucuaaauucaugcauucucugucuggauggugggauuuugauucucacuauacagucugaugugugcggguguggguguguguuuguguguguguggguguguguguguguguggggggguuauccaucacuuuuauucuccugaaaagacuuuauuuccuacgguguaguacaggcuggauggaaauggcuuuaucacuccgugggcugacuguauuagaaagaugugcuguuuacccucacucccgauguccacuagaggcuucugauuuaugggaaggugagccuagggcagaggaaccagcugcucgaagauuccuugaaggagacccaggcucucaagggaggaggggaaugcgggauuggggaguggggaaggcucagaguacagccagcagcaggaguuugggggccacgaaauuccagguaagaacauagcacauuuaaagaagcagcaggggugcgcucuucuaccuucccuggauauugcauugguguguggugcguggcccauggcgcguggugcgugacccguguggcucagcuuaagcucuacacucaaggcuguguucucaggugucucucggaagccaucaucacauccuggcaauuccaauuugccuggcuaucaacuccgcagcagauaaagcacacgugugucauccugcaaagcaucccuuccuaagacucucgagggcucgagucaguccacgcgccucccugguucucgauacaguugccauuguuauuauagggcugcugguauuguugguaggcugauguuggagucauaauggggauuucuaucuuuuggugguuagauauguccuuuucucccacaaggcacuucauuuuuaaccuucuuccauuaaaauccagcuuaauuaguaagauuuaaugaaccagaaaguucauauuugucuuuuagcugaugaauuauuagcagcauguaacggauaauauuuaaaauguaauaaaaagaaguuuaaaauaccagcucuuuacucucuggugacaauccagagccaacuggaaaagauuuuccugugagaaauagcccuuacauuuuggucuguauugauuccugaaauagacuguggugacucgguuuuguaggggagagggggcccgggaagcugccaacaauguguucucucauuguccuguuucuaggggacaauggugucuuggaguaaaaugaugauguggcugcccugagccuccaaggcuacaucaucucauuccuccucccugacccucuccauccccguccguccuccgugcucuuggcagggaaucgcgguggccuaaccagagccuucuuuaggagcuuuagggaggcaugggcuauuuuaagaagguacugaauauaaauuuucccuccuaaauggagauggaaaacacagaggcaugguuuuauaccaucugauuuggacaccguaguuuaugguugcgaagcacacgacccaucugccugcgacauccaaucagcagcucccgcuucuguaauuuugaugaaagaccuuugucaagaguauuucagugcaggcauagcacacagcccugguuguuaacauggccuuggguguccacauuggaguagaggaugcucagaccguaacugcacugcggcagaggaaggaguggaggaccacuccugacacugccugccucccucccccagccuugaagaauggcucuuugcuuccaucuacgucaaggaaucuggugagugguaggggaguugggagagucagaaggacaggugauguucuaagcauaggggccagcuccauuguucugccagacuccagugugcaagcucagacuuacacaaacaagcaugacuuccagcauggcaccaguuccugaagugcagacguggucucauaccacccuggaccaacccuuguugaccagaaaagcucacugccauaguguggcauccccuaccaaugccuccuaagaggacagaaccccgaauugcauguguagcaggaaagcugcugcuauccaguguagugcgcacaugaucuguucuucuugcagggugacuuuaaggcaggucugcacuugaaccucucuccuccuggaguguuuggcacaaaacagcuuaagcauacagcagaacacacccuggguggaugcuuuagagaccccuacgcuuuauaggaaugggaggcuccgugcaacuagaugauucugaaucagcucgcucuucuuugaagcugaugccaggugcgucucuuagauuugauccgugucccuuaaucaguuuuaacuaucuccaauuacauccguuucagccucguagugucucugaagacaaccuuuuaaagcaauaugugugaugacauuuggucuuuaugauggcuuggugugaagacuuguuugucuagcgguucucaguugggugauuuggcuuucgcuuaauauuuggcagugucuggagcgaaaagggacuaggggcagaagcuccagccaucacccauuggauggagaucaaggcuagguuugauacuacuguauacaggacaucccuguaccccuaaacgucagcaccgucuagguuacggagcucuguacguccagugugggaagguucaagguguguauguccugggacaaguugacagggcuuauaacauggcgcuagcucuccuucaaccucauuuacuguggguaauuaggagaaauuaaacagaagacugcugucacccggugccuaucugcaaagcauccaaggugcuaauuagaguguuuuguugccaguaaaaacaagagucagaguccaugauugauucaugauuauuuuaaaauuaaugccgcuauuaucauacaaagccgcgguaaguggggguaggagacccuguaccgggggaugcuaagucaacauugcaguaaacacacaguaaacccauuugucucgggcuuaauacuuuguuguuucuucuaagcacuucuuagacgcccaugggcuuuuuaacauucuuugaaaguuguaauuuauuaauuuuuuuuuaauuuggcuugcaagagugaacuuuagugacggcucugaagagagugaaaagaaagagcuguuuguguaucagcagcucuggagcuuggacucuaaaagucaacccagcagggaaacuuggaguuccuagacucugggcuuucucacaccccggaggaggagucagccgcucagcaaccgcgaugccccgugacccgcucagacauguccucacauaaccugguggagguuagcugucacaccaaaccauuugccuaugguccuugaguccccuuuguuuuauuuuauguuucguuuuauauuuugcuuguuuugguuuuguaucuagggacucaguugagacaaccucucauugcuuccauaaaacaccuuaucggauuaguccagggaagggaaguuuuauuuggguucaugccuuuggcccauuauaguggggggcggggagugcagaguucaugaccaugagauuauauagaggauguguuuuaugucaggaagcucugaaugcagagagcuuggaacgugaaccccaagacgcagccuucggaggaaacuuagcugaaacagaaagauaaugaauggccuacuugugggcagauugucccaacucugggcuuuuaaaucauaauuuuccugaaaauuguuauguuuagggcuaaugccccgcuuaucaguuuccccuuucucucuucuucgacuuguauacagggaaucagacucgagccgugugcguuagggaguaguacuccaccacagagcuguguccccgagcucucucaagcuuuugagacuguccuugaucacacuccaaagcccagucaggccuugagucugugauccuccugccucagccucccgaguuguugagguuacggguuuccaccgcaagcugcuuuguaccaugaagccugcagaccucucccgcugcuucucccgcugcugucucuuucccccacccaucuccuguaccaggcauggggacuagggacagacacuagaucucuuuggugagagaaugucaccuggugguucugccucuugcagcagagaugagugauucguagugggggacuacacuagguuaggucuccguggcccaggagacaguuguaugggaaucagccugcuuugucuucccugucugcaacucagcuccaacuacucgcucugguggugcuggggcuggguaagguuugguuucuggaaagagucaggaaagaagauauuuaagcccuccaccaaguaagauuuugauuguguccgaugccucugaccucugaagucgcuguuuaaaggaugccuuccuaggcucauaguuugauacuuugaaugugggagaucagaaagccaguggucucugucccaagaugcacucaagaauucuacaaucucuguucccacgggagucgggaaaaggacuggagggaauccgacucuaguacuuuagagcuauagcagagcauagaacuugcuagagcccaguuuuccuggguauaaaguagagaugagucuccaggguaaccugccgugggccaguguuuucagacacucuaagagacugggaccugccuugaggacacuggaguagcuggcucccaagcagccuuugacugcaacguugccugccaguccacaaguauuuagcuuugagcaugcucugaccugggucugagauguggaacagucacuugacaguuuuugccauagcuugcuccuaccccuuuaugucccccuugcagauagggcugugcucauggcuacugaauucuuccaugagucucaauauggaaccaccaccaccaccaccaccaccaccacauauguguacagcaaguaagcauggagauacuuccauucagcuugcuggauuggggucucagaggccaauagucacagugggaaggaaaagaagccaucggcuccugcuugcuuagguggauuaucuuucucuuccuuguaucaauucauaaaacccaaaggugcaucucuacaaucacuuacuagacauuuaguguacgcuggccucaaggccaagucuuugguaugcuaauuucaaccgcccucccuccccauuucucucucucccaguuaggucugucuguucucuguccacucaucuguugucugacuuaauccuuggagccagccauugauauccgacauauauuucuuggcgggcaaguaaaggccacauccucagaaaugucuccuaagugugugaguguuuguguguguguguguauguguguguguguagcucauuuucuuuuuaaaaaauauaacauuuuauuaauuauuugauaauuccauauacccauaacaaucucuuucgaucauauccaucccuacuccucccagcuccaccccaacccuuuuagcuuuauguccauuuuuuuuaauaacacacugaguccaguuuuuguugccuaugcauucucccaugugaggccauccacuggauugugguagaacauauauacuucuaaagaaaaccgucucucuuccccagaagcugucaacugugaguaguccgcagcuggagguggggacccacgaucccccuuucccuauccuugcuggaguauucacuggcuuugccucucgcaggcagccacagcguucgugaguucaugagcgcaucagguccuguccuuaugaggaguuuguuuucucaccgacucucaccagugauaccugcuaucagaacauugacccuuguauuagucaggguucucuagagucacagagcuuauggguagucucuauauaguaagggaauuuguugaugacuuacagucuguaguccgacucccgacaaugaucagcagcagcuguggauggaaguccaaggaucuagcaguugcucagucc

SEQ ID NO: 4803 - RNA, 1532 nt, Mus musculus
aucuuccugccuucccuucuccaggguugagauuaugaguguuagcuacuaugccugucauuuuaaacauggguuuuagagauaaaacucagcucccuacacucagaagacaaacacuuuaucaacugaaucauguccucagucuguggucacuccaagaagaacuuccaucaggcacaugccaugagccuuuuggaagagugggaccauugcuucauucaugucugaccaccaguuccuccccucugauacuauucauaggcuuguagggucaauggggaaacuuggaggaagggaagcugugggaaccagaauuugccuaugacuaaucuuugaucuuccauugaaauugacucuugaggaagcucuuugaaaaaccuaagaucagguuugucucuuucuacuucagugaauuucccaaugugccacggagaacaauggagucaaagugucuagugguguguggauaaugaugagugucauucgaauuaaacacacacacacacacacacacacacacaauuuucauuggcaaaauaaauaaaauucuaccucuuuaacauaaaauggucaaauguauaguaguuggaaauggccagacuuuguuucugaauaucagcccccuaugcauccaucagucccccuuguaaaguauugugauauguucaccugggucuugccuuccugcccuuggaccaagaaaugagugagcuuucagacucuucugucuucagucaaccgggucucuaaucuugacccauccguuccauaacccuaauggagacagguugucaaugugucuagaauaaacaguuucaugcaggggaguugaggacuagauuaucagagacaaagaaugaguaaccagagaggccagaggagugucuuuggugacaaugaggugugugugggggggggaggagcagagagaaggggauauugcagagaacaaaugggcuagaguuguuccucaggaaaaaauucucuauguaagaucuguaucuucugcccaucuauggugaugaguuucucauuguauauaauaauuaacuuuucaauuuuacauguuauccuaaagagugauugaaaguaaacaaaaacaaaacuuaaagacccaauuuuuaaaaaaugcccacaguaaaagaauuaagcauccagaugacuaaccaauaaccgacccaauuugagacccauccugugggcaagcaccaaucccugauacuauuaaugauacucuguuaugcuugcaaacaagagucuagcauggcuguccuuugagaggcuccauccagaagcugacucagauagaugagacacccacaggcaaacagcgggugaagcugggggacucuuauggaagagcugggggaaggauuuugggccgugaaggggaucggaacuccacaggaagucuaauagagucaacuagccugaacccuuacgacucucagaaaccgaagcauuagccuagcccucuccuucauaucugcuacauauguggauucugaauaacuggagcaggaguuauccca

SEQ ID NO: 4804 - RNA, 4506 nt, Mus musculus
guuuuuuuuuuuuuucugcaagccucagcucuucuuaggguuuugucucccaacacccuucauacagaagcaaugucaguuugcauuugugggcucaugcagcccagaauggcacaacugcagaaaugacucaauuagagagagagagagucuuaugugucgcaaaguuugcagugggcucaucugugucaaggaaaaacauguuagggcagguuuuuguuuuuuuguuuuuuuaaaucaauuauacauuucaagagacugccuggaacuggaaaaaugguucugcucuugcaggagacccaaguuugcuucgcagcgcuccaagcagacuucuggucccugagggcaccuguuuguaugcaguacacauuagcucacauaggcacacaaacacacccauuaaauaaauaaauaaauaaauaaauaaauaaauaaauaaauauuuaaagcucuuaaaggaguagaagccuaaguuuuuuaacuauauacguauauuuuuaaaauuacaacccagacucuacaugugccccacccacccaccgccccaugcucuuuacagcagaugcaggcagaguuugccuugacccagacuccaggccccauguuuagucccaguuggaacuuugcagaaugcucaguggcaguguccucgaugcacacaacauagggagugaccuggccugguagacaggccugauguggucuauaguacaguacaguacaguacaguacaguacaguacugugcugucccugaugugagcacagaauuuucaaauccaauuuuuaguggaugcuaacagaaugccuucauauucaaccagaagggagccuuuggggauaucaaguuggugugauaucacaugaccagcaagaaugaucuuaggaaaacugaaaaucagauuggaugguuccuuauugcuaguucaagaccacccagugcuguugucccuugcuacacugugagcccaaggcucccgaaaucucuauagaaccaugugauccaacuccugcuuucucuccaagccugcuguagccucucugucuugccccaugugccccucccucugcagacuuaaacaagucucuguuccuuaaacaagcugagcccaucccuaucucaggcuuuuguaagcuggggauggauuucucccucagguuucuggggcugcuuuccucacugcacagcuuguacccaugggcuuacacaugcauucccuaaacgagagcuuuuccuuaaaacauccccucuaucacuauguuccaagaccccaugugucuucaugacuguaagcaaugcucagauccugacuucaauuuuacccgucucuccuauugaauagaaaauuuuaagagaggcccaugaucauucuguccagcucacaucggcaucaccaacaggcagagggacaaacauuucuagaucaagugggcguggucaacaggggacaagcuagcauggcugaaacaggggacauuggccuugcacugcucucuaugcacaccuguguuacacaugcaugugugcacauuccugucaaaaagaaugcuugcccaggaacucaucuguuagaucaggaagacauuguuagcuggguugggaaguuuuuguuuuaaacucagaucagugaggagaacuucuaaacccacagcauagaaauucacauuuaaggcauagguagauugaugccaguguucaaauauuccccauaaucuguucacucgggcaagcuacucaccuugcugagcugugccuccguuuuucaaugaauggaaaaagaaaucucccuuguaguaucucccuuguaggauucuuuuuuuuuuuaaaucaauagaaaaucuuuauuauucaguuggagacuauacuggguguucgugaucccaauguagcccugggacuuucucagggugauuuuucuuuuuuuuuuauuagguaauuuccucguuuacauuuucaaugcuaucccaaaggucccccauacccacccccccaauccccuacccacccacucccccuuuuuggcccugguguuccccuguacuguggcauauaaaguuugcaaguccaaugggccucucuuugcagugacggccgacuaggccaucuuuugauacauaugcagcuaaagacaagaauguucaacauccuuguaggauucuuaagaggaacauuauagagcagaguaguuuucacagugccugggaagaauagagggauuaguugacuucaccaugggugcaauuacuguccuuauuccuagucccaaaucaaagcagaaaucaaucaaugagauggcucauugagucaacaagcuugcacggagcccagugguccgaguucagucaccuggauccaccuaguggaagguaagaaccaacuccuuuauguuuuccucuggucuccuccacacauacacucuagaagcccaucuacacacagagaaugcauuaugugucaauguaaauauauuaauauuaauaauaacuaaguaggauggaggauuucugaggugacuugcugcugacggaucugaguggucagggauggauuaauguaauaaauaggaggggagaguaaagaaggcaaguagcucuuagaaccugucuucaucaacaucuugcagauacugacagggcccuucuuacugagcauaguccuguccucgcuuccuccuaggaaugccuagaugacacuucacucugauggcaacguuuacugaaaggauaacaaaucauauaagagagaggugguagaagacacucaaugaagcagagacuugcucaccuaagcaugcccugcuuccuucccagguuguuuucugacaaaccacacagagcuaggaguucugucucuuuccccaacagugaucacacaugauagugcacaaccucaucagacacagcugugugcuugacaaccucacccuuguucuucuggcauacugacagacaggugugucccaggauccuucaguguagggugugucacaugcccaugcucaggccaaugaauggcagggucgugacacagagaucuuucuggucugaugcaggagaaucauauguauuucuuggugauuuuuccucccaucuguuagaugaacugcaaugacuucagugaccaggagaauaacauaauguggaaggagacugccucucccaagucuuccacuggaggagauucuaggaguuuugaagaagcccccauauuugaaggccaaaggaacaagaaauaaguuuugcuuauuagaaauacauuuuugucuauuacagcaacuacacuaccccaacuaaauacucuagccuugguaaaguauuguccaaaagcuccaucacaauaucuuagccauauaaauauuuuaaaagauggugggcagcauugaaaagauaaaugaaauauacauaaacucuuacuucuggaagggcuacugaagccaugaguguuaagucuaacacaacagcagauaaccacccaugcuuagacucaccaguauacgaggaaggcagcaguuuugguucccuaauacacaggcuuugcucugccuguauaagauaugaugugucuagagagaaccauacuguggcaaauguagacaguaacaaagagaaaugaagggggggagcauuuuaaaggaaucaccuaaacaccaacaauuaaaguuagaaaauuguucucagaaagggagaggagguacagaacaggagaaggaaaucucuucaauaucuuaggauagaguuaaaggagacuaugaaagaagauuuacaauuacaguuuuuaagguacccaaauaagccuuagggauuccacugccucacauuuaacuguacaguuaagaaauuucaaucaagauacuaauuaggaauuuuuuaaugacauguuaaauucaaagaucauugggauaaauuaauaagcagaagaaccuauaaaaaucuaucugauggaggaauuuuuuaauaaagaacuccaguugauaggugcaacggugagguuacugacucuucuaucugcuauucgaaugcaaucauuaaagagauuguaacaugggugaaauaagugaauucaggaaugaaacagacuacagagccccaaauaaaauaagauacacaggagaauacguaguguaucauacaaguaauauuuccaauuaagauaaaacagaugacugagauaacuggauaucuacauuuuugcuaguuaccuacguacauuuuauuuuaaaauuacaugaaauauuuaaaauuuuggaauaagaucuugagagucauaugccaaaugcuacaggaaaauauuaauaaauuugguuacugucauggcgaguuuuaauugucaggucaauacaacuuagaaccaucagggaagaacaucucaaggaaggacugacuagauuagguuggccugucggcacauccaucgugggcuguguucauuucguugaaugauaugggaagauucugccccaaagaagcuguaccauucccuggguuugauccuauucugcaucaucau

SEQ ID NO: 4805 - RNA, 1379 nt, Mus musculus
cuuagacauaaaaaaaucauuuauuuugucuuauggugccagcagguuugaguuuguaaugacagaagcagcauggcagaaagcaguagaugcgguggcuggaacugguggccaagagcucccagccucaacugcaaauacaaagcagagaguuaacuagacaugacuugaagguuuaaacucuuaaaacucacccccccacccccagugacaacgcugucuccagcaaagccacacuuccuaaaccuccccaaagaguaucaccaucuggagaccaaggguucaaauguccaaaaguaacaggggccauugaagcaccagcggguacauagagagaguagacuacuauuagcccuaagaaagaaucaagaccuggguuaagucuccaagacacagcagagagaggccagucucacaacgauguguguuugggguguguuggggaauuucacuucccugcaucuacaacaaaaguuaauuggugggcacccaggaaccaccaauaccagucaguacggagggggaccucagugagaagaaugagauugcuccacacuggcacagagguugugugcuucucacucuuuugaaugucuuaaugaaccgcagaauuagaccuuucaaauggguguguucuauuacuggcaccugaccuacaugucaauaaggaugucuuuuuccuguggucuguacacagaugugugugauaagugugugugugugggggggggguguacucccucuuguacuuguaacaaggccagaaagcaccaguuauccugcuguaucacucucccccauguuccuuaagauggggucucucacugauauuuggaaagccucagugaguccucuauccaaccccaagugguuugcaccaccacacuuaguuugccaugugagcgcuggggauuugaacuuaggacuuccuacuugugucacaagaacucuuagucuuggaaccaucuccuagccccagagcuaucuuuuuaaggaaacauagaggggggcagugauaaaggcaucugauuugacuuugccuugacaggucuuuucuugagucacuauccuccaugacaauuugcuugaaauugaaagagaaauaaaauuuggaagaugauauuucuuugugagauauauuuaaaccuguuucuuuuuguuuaaacuuuccaguccucuuggcuaugaaacuguuaccuuugacuccaaagauauugacaaaacaggcaggcuuggguccacgaagucuugguuucuuguggaaaggguguggugugucuuguggcaacuggcuuccacagacaguccucaguguauagagagaagugcucuguuuccuuuacuuagaaacuuaucuagccucuccauccacauaagug

SEQ ID NO: 4806 - RNA, 1105 nt, Mus musculus
uagcccaauucuuguauuuuaauggguggaaguuggguaauugucugcucuugggguaugaagaccccccccccaauaggaguaguggaaauauacuggcuucucuguggucccaaucacucagugagucacggcuguggaucagcacugaggaaugucagacaccugaagcaagagcuugcaucgaguucuccccgagaaccucaggagcuggaucacaagguaaucuaacagcacaaagauuaacagagauaacugcgguaaguuggcuuucaauguaaagagauagguaauagcuguggcaacccgacaugauguauuuaccaggagaguugauugucacuagggucugugugucccugaagguagaccauccccaaacagcucugauucugcgcaaacauugacagggaugccuucguuugcacaccaaagcuagcugcucuuccccaagacuuaacaauguaaaaaagaguacccaaagcuggccaaaccaaaaagggcaacuucacguggucuuuucauggcugccaaccggaaccucggcgaucugacuguguagugcuaauaaacucaguggcuacuugcaaggagcuugcccuggacccagauggguagauccauucccccaacacagacagcaugcaagaguuuucucuuuuucagaucuccucauagcucuuugcaagcuucgacaggcugcaggaagccuaguugaggcccagaaaucccagguaugagucaucuggaugagucagauguggcccuuugcuuucuucaggcugugguuugcucuuaacagagguugcuuuguucuuuacccaaccgaguccugacucccucugcacucuggggaaggagacccgacacugucaaguccacuuuacagaaggcagaauggacaugccuggcuccagcuucaaauaauguucugaagcaauccauggaauaggugcacagcaucugaagggccugagagcugaauuugcucccaggcuaagaucugaguugucccuguaggauguaucaucucagcgagguaguauccuuaguugcaaggcacuaaaaaacauccauccacucagagaaucauguaugaagccaa

SEQ ID NO: 4807 - RNA, 907 nt, Mus musculus
auuccuuuccuuuuuuuuuucccacaaauaggacuuuuuauuugucacuauuaaaaaucuggauuuuacacugaucugauucuuggacuggcgguucauauccgucagcucgcucaaccuuagcgcccgucucgucuccagcugcuuugccagagcugccgccuuccccaugcagcuccaugagauugcccaauucaaacuuggguuucuucagcauuuuuacuuuucuaacaaagacaucaugaagaggauaaauggacuggcaagccuuuucuaugucuuucccaaugcugucuggaaucaguuuauuaacuacuuccuucaagucauuggucugcaccacucgggucaugauuuccaucaucuucuuccggaucuggcggacuugcuggugcugcgcauaggaugucuuucuuaucugguuguuguguuucuuagcgaauccaacacagaaaagucagagcaaauacccaucggucgucuugacaucaaugugagcuucaaucauggucugccacuucuugaccauggagcacauuuugucccggguaagauccauaccauggaaguuagucagacaguuuuugcccugaacguccucagugauuagcuugaauuuucuaaaugcaacuucaucauucuguagaucggcaaggcucacuucaaacacacuacccuugaggccaucagaggcaauuuuaguuccuugaguccucgucuuccuagugucuucccgauauuccuaauauugaacauggcuggagcuuucacaucguaccagucuuucuuagaaaauggaucgaccacuuucuucuuagcucccuucuugccaccuuucgucaggcgcuuguucuugccgaccgccauggugccgaccgaagagccaaaaggccagaauuccuuuccu

SEQ ID NO: 4808 - RNA, 18942 nt, Mus musculus
acaagcaccagcgccucaggguagcgaaggcuggcccauuuauuuauuuuuaugaccucaugaagucggucagcaacccagauaaagugccguguggguucugcaggaguacugggggagguuuuguauaccugagcacaaggcuuuccuugaacaccgaguaaccaguuaggcacaaucuuacaugucaccugucacuuuauacuugucuauugcucagcagaaaucgcagauggcuuccccucuaugugucacauucuugucugucugaaagcccuucaaguacacagcacaucugcaggcuauaagcaagcuugacuguuaaugaauucguuuccacucugaauuucuagguuggauguuggcagccagacuggcagauguuuagcggggacucugaggucugucugcccaucuguagccggaccucagacagcuuggggccccuuuggaaaaugauccuugggucccacgucuucucacccucuucgucuugcauccccagguugaaaggauuguggacaagaggaagaacaagaaggggaaaugggaauaucuuauccgauggaaaggcuacggcagcacggaggacacgugggaaccggagcaucaccuccugcacugugaggaguuuaucgacgaguucaacgggcuccacuuguccaaggauaagagggugaagucagggaagcaggccggagccuccaagcuccuccgcgacgcccgcggccugccaguggaaagacucucccaucggccucuggaacccgggaagagcaaaccaucuucccacaagcggaagcgcgucaacucuccccuguccaggcccaagaaggggucuucggguaaggcuccagacagggccaccaagacuguguccuauaggacuacccccaguggcuuacagaucaugccccugaagaaggcucagaacggccuggagaacggagaugccggcucugagaaggacgagucacacuuuggaaacgggucccaucagccggaucuggaguugaacgaccagcuuggagagcaggaggccagugacugcgacgggacccacuccgcgcugguggagaauggaguuggucuguggcuuuucuuucucucaggguuggguuggucuuggcugguggccagcuugugguguuguuguuguuguuguuguuguuguaggcaggaucuuaugugguccagguuggccucaaacucaccaaguauucuaggauggcuuugaccccccugucuccugccucugucuccugggugcugggauugcaugcaggcacuguuagauccugucucagguaaagguggaacacggggcaugcuggguaaggacucuacucaccaagccagccaugucuucagcccuuuggucugacuuuucuuucaaccuagggaaauaucuaaguugcuacccaccuucugucuuuaacucuuagcuaccucuuaguucugccuuucuuggucucucacgucaaggccacggacguuugaccucaagccugugcugguuauuagacaccuuugcauacagggauaucaagccccaggugcuauaugaggccugcgguagguuacaaaggccuaacuacagcuaggccugucaucccagcuaugugagaggcugggguaggaggauugcaaauguaaggucacucgggacuacagguugagugcaugaccagcuugggccacuguaaugagauccugugauguaaaggggacauccaauccccccuauacuguuaaauacagaaaaaagagagaauccuacuacacuguaggauaccccaggcuguagucaccacaccagauccacauuccuggggguggggugcagcccaacaucccaggagacagaaguccuccccagagggccugcaccuccccugggacucacagccuuuguccagggaggggcugccuugggggcuguccuccuguccacgccauuuacagauggaguucuccaagcuagcgcaugaugggagaugccugcucuucuggugucaccagcguaggcggagggccguuccucuuagguggaacaugacuaacuuccagcuguguccaugcaugggacauaggacaguacaacuccugucgugcuucuuuaauuucuuuauccagucucuauguucagaccaggcuugcccuggacucacgguugcccagacugggcagagcuuccuuuauaaagccgccaaucccuuucaagaugauagauacaguucucaugagcuuaucucaucccacaggcuuugccucuugguacuguuaaaugggauacagaguuucaagcugugacucucgggggagggggaaccccaacacccagacuauaguggguugguccuaacugcagcuccaaccccgcccugugccggcucucuugccugcuccuuucugcccuguccuggaagcaacguagacuguagguagcuugcguuaggacaugaauuccuccucuuacagucucuggaggcggugaacccugagcuucucaugcugugacauccucaguggccagacugcgccuucacaaagaccucaguggccugugucuuugggcaagcugugugcuccagugucaugcccccuccauucucaaacacccuuguguauacccacaggcaucuucauauacagagaucagagccugaagucucaggagcuucaggaaauaccuaaugggcacacaacagugcaugcccagugugcagggcccucagaugccccugauggaaugagagugaacacggaugcagaggugcaggugguaacgagcaggcuaggucaugaguuaagugcccgucugugaugaugcugaguguggggucuggaccguucugaguaugcuccguuggggagagcuugccaucuuuaggggaaccugggcaauugcuuagagcuuccuccugcuccagagaggaaucucacccuaacgcgauuuauuuaggcaucugccccagccugacucaugcuuccaucuggggaucccccagugcugauaugccugugcuucgagcauauggaagcgcuguuugucuuaaacauucaucucucgggggaagaaguagcuuguguaaacgaggcuuggcauaaacauccccguuugauguucgcgugacagcugcuagcaguugcagaaucccccucccccauuggugcaggaaggggcggucaggggaagccucuuaggcucaugggguacaagagcaggagccugggcagggucccaguaacugagcugauaacacucccccugccagacuugcagcuucccuaagaguaagcaggagcacuaagggaggaugguuugcugacugacugccagacagcagugugaugcacagggugggugucucuccccaugcccugugcugcuuucugagguggagugcaacuguuagccuuuugcucuggcgacccgccuugaaugccaacucgcuaauggggccagauaccucaucaccugagaaacuugcuagccagccgacccgccgaagucccugcgcguuuguagcuauucuggaccuuuuuccuccucagucuggugucuugcuaucuucuccagauaauguauauucacacaucccagggccccagcuggaagggagaggaagcugccacccaccucuauuguguuuguagccgucccaaacuuuuugcuuaauuacauccuuucgaguuggcgcccacaagcucccaugaggauaggcuguuggucucauauuucacgugucuaauaucccccuggauaccugugacaaauguaggcagaucccacaguaucugauggacugucuuaggcggagaggcuccaggagacuggcucuugauggguaccucggcggcuucuguguguuagacucuguaccaggaugacugggccgugucauuugccaucggacaccagagcccuucaguucaagucugacucucggagcaccgguucaggaccacugcccugcuagccgcuggcuagauuagagagaugcaaagagaggaguaagggcccaucuuuuguaacuuaaaaucuacccucggccaagcuggugggcucggacuuuuagguugaguaagcaccagagguugaaccuccauggauggagucccauguaauacauggaacagcauugccguauuuauauacaacucgaauguagucacucgugggagaaacggcuccugccucagucacccucugacacuuggguugcagcuagcuuauuacccaggggggucaagcacugggggaagcggaggcagcauccuugccauugagagcagucugagauucagagguguagggagaccaaacaagucucugucaugcuccuggccuuagggaagcucuguugagggcagugccacauacagguuaggcauugaauuauuuuccuccuaaucuuucucugacccaaaccuaaggaucuagugccauuugaccagugggguguaggacuuagggguucccccuguuugcccugcagaagcaucccagagggcuccugacugcaccucagggcaguguuugggauaugggguguucacuuuuuaaaugucuuucccccccucucucgaugacuuaacuuccccauagaaagaaguaacuuauguaauaugacuuccuuaugguauaggaacaauccacagcccagggcuccaguggguggcacauucuggguucacaccaugccucuccccgcugaagcucaagaugaauauggcaugcauggcucagugcccaccucuguucccucuucuccuggggugacaaacgacucugcgguccacggaccaucugccucaguaucccucugggagcuuguuagaaugagcuccgccccauccgagugaauggggaccuggggcggcggcgggggggggggcgggggggcaggugugaaucacuccugucaaacgaugaguuuuaauagcugaguguggauggccgcccccacggacgugugugguugugagcgauggcucauagacgccucgcugccagaucugggauguucucccgcauuuuuaaacuuguaagagcaugguuuuuuuaaaaaacaaggucucuuccuugacuguguacuucccacauaagggauuucucucuguuucugucugucugucugucugucugucucugccucucugucuccaugucucuuucuuaagaaagauaggcuucagcugugcugagcagcugucccuuuagggaucccucccucuccugcucuggugggaacuccccuguccugacuguccacagaggccacagccugguucuuuuaaagacccauuugugcuuuaaccccuggggacacuccaccuccccagcagguacccucauucccuuugagcccuagagcaaagcauggcugcccagucagugcucuccaagggcccguggacccucaagccccgugcccacaguucucugauuuccgaauaucauuucucuacauguuuggugucugucugucugucucccaggccuuccgugauucacuauucccugcauuguucccgcccaugcauguccccucccagacaggugggcauccuuugccauuuuccauccauccauccucugacaggaugccagccuucucuuccaggguguucacuucaaccuucacacucuccaugcgguuauugcuuucccuuaucugcagaucagaaccgagguggacauuuaaaaagcaacccacacuguccucguggggagaacuugggaccugacaaaggcagagcuagacucagcacaccuggagggugggcuggaaacugaacagagccaaguugguacuguuggccuaggaaccccauuuuggaaaccaccaccauugacuaauaagcugugggugguaggugaaaacauaggcgguugugagagcccaggggccucgccgaagaguaggcguucuuaugccugggaccuuccaguugccuuugugacucguugaaguaugagggagaacguggaaugggagaagcaggguaaaggagcuauauugugagauucugauguucgcaaaggaugcucugugguccucgugguggcuucuagaggcagcuguuacacccauauuaaagugcaggaggaggcuacagauggcacagguugggcucaggagacaagcccaggcaauuuaaccccagagcugaccucgaaguaauacccaccuggcuuugggggcagcgaaaagcaauuuguaaacccugauuacccacaaacauaacugggguguucuucucugacuugaaucugcaaaccuuugauaagauuaaguucacaaaaaguacaacuuaaggaugguuguuagagugcuugccugaugugugaagucuugggucagagccucaggugcugcaugccuauaauugugaugcucugaguguggagcccgggggucagaaauucaagauaauccuuggcuaccuagcaaguucagggacagccugaacuugagucuuucucucuuucccucccucccuccuuuuuucaucccuccuuccuuuauccccugcucucuuuccucuuuccugcccucccuuccucucucucucccccucuuccuccaacacaaaguaaaauaaauauaacuuaagacugaacuuacucuuagaaagcuccagcaggagccugaggcugaguggucaguucuauguuccagaauggauaauguaaaugaggauucuagagcgagugggcgggcugggcugccccugacucaugcagacucugcagacucuuggaccagagaacacauuccagguuucucuggugggucucagacaggguggauuuccagacuggucagggagacaaaggaaaauugucaguuggucucacucugagcccaguggucagucgucguccucagugacccucuggcuucucucaguccccucaguacugccucaaaacuguucuagacauuucuuacucccugcuuugaucuugaaaccuggcucucucagccacuauugcuucccagagcauugguuuuguccugaaagaggcacagggucaucugauguaggaugacuuuggguaucuugagugacagcccucaaccugccugugaaaccuggcccacggcuguucuuuuugcuuuuguccagugccagcuaccuaugcaaaaccagcaccgaccaggccuuuugguguucagagguggggaguuuucaaagccaguaguacaagggcuuaagggcuuuaugcuuugcccuucgauguguggcaaguaacuggugcuaauggaugcauuuaagcccuuugugcugugaagcuaaauucuggucuaaguuagccacugcacucuacagagggugccgggcuagaauggaaaaaucuaaagcucucuaaguaggagcaaccaaaccgcuggcaaacccaagagggaaauugacuuucuccaguuaggucauggccuagauuuuuuuuuucaaguuuguuuauuuuaauugcauucauucaucuaacuaucuauugucugucucucugucugucugucugucuagccagucacucagucucuuuguauaugcaccaaucucugucucucugucuuucuguguguguguguguguguguggugugugugugguauguguguuuguguguggugugugaugugugugugauguguguguauguggggugugugaugugugugugaugugugugugugugguguguguguguguguggugugugugauguguggugugugaugugugugugugugauguguggugugugugugugugguuguguguguguguguguguggugugugugugauguguggugugugaugugugugugugugaugugugugugugugaugugugguguguggugugugucugugugucuguguguggugugugugugugauguguguguguguggugugugaugugugugugugugguguguguguguguguguguguggugugugauguguggugugugaugugugugugguguguguguguguguguguguguggugugugugaugugugguguguguguguauguggugugugugugugguguauguguguguguguguauguggugugugauguguggugugugaugugugugugguguguguguguguguguguggugugugugauguguggugugugugguguguggugugugugcaugugguguaccauagggugauucuggaggucagaggacaacuuucagcagaaagucagcucucuccuuccauacugugaguccuguagauugaacucaggucaucagguguggcagugagcaccuugaccugcugagucaucauauuggccugcauuuauguuguuguuuuuuuuuuuuuuaaauaaacuuuuacuguacuuuuaaagucauuccaaguaaaggaagaaacacauguucuuaguguggcacagcuaauuccuugaacuguauuuuucuuuuucuccucccccuucuuuuuuuuuuuuuuuuuuuuuuuuuuacaaaaaaccuuaaaacuaauucauauauguuauaaaauauuccaaguacaugucucccucuucuccaccucaaaccuuauuuagaggucauuucuguuacuauuuuuuaugguuguuucuggacucuuuucuagguauauuauucauuauuuuauguaauuuauuaacauauauguaauaguuaaguagcuauucaaauguugguugauugagccaugaaaagaaauaacauuuucugcuuauuacuuauugauuggcaaucaucagccauccaccauccaucuguaucuguuuguaugucuguguuugucugucugucuaucaaucucacccaucaucuucugucuauguauuaucucccucccucccucccuccuccccucccucccucccucccucccucccucccucccucccucccucccucccucccucccuaucuaucaucuauuuacucuguuagcuucagcugucagcuugacacaaaccuagaaucaucugagaagagggaccuccaaccgaagaucugccuggcucugguuggcccauggcuaugccugugggacauuuuucuuaauugcuaauugguguaggaggacccagccccacuguggguaguaccaucccuuggcaggugggccuaggcuguauauaaaacuuaguuaagcaacauacaggaaccaugccagcaagcagcuugguccuccauggucucugcuucaguuccugacuucugguuucuccuuaaguuccugccuugccugccuuugaugauggacucuugacauguaagccagauaaaccuguuucuuccccaaggugcuguuggccagcauuuuauuacagcaacuaggaaguaaaccgggacucauccauccauccauccauccauccauccauccaucaucuucaagacuuccugacgugacaucucaguagugaccggagguagcaguuggaccuguaccuguucuaucacuggcuuccuccuaaacucugagucaguccugucccccuuucugggcaaggacauguaaaucuacucugcuuuuuagccacagagguucuuacagcaugcagggacuuaacugucucucuucgaugacacacaggcugcugcaggguacauacucuugccaacccuggccacagccaaucuguuuuggucuuccaaacuugguuguuuaauuuuaguuugucggcccgaguguauguucucugugcucccaagugucuggccccaggaacugcccaggcacgggcauaugccaacacagaggaugcugggcagucagccaucuaugugccgccucagauagauugucuugcuucucugggaaucacugaugaaauacauucaugcuucauaagucggggcaaaaaaauuaauugaauuaauaauuuauagagccauuagaauaccaccugccgugugauagauguuugaugauagcuaacucuuccuuuuuguaauguucuauuuuuuuccuauuuugaucuuugcauuuuccucuuuaguaauuauuuuauauaccauguagacugacuccuuaacacauauauuauuaagcuagcaaauacacguugagugugugcucucuuagacacacaaugguggcacuaaggggaaccuggggaagaaaccguugggagaagugacaucagagccagcguaggggaagaggccucuuggaggaggugauaugugagcugaagauggcugaaugagggagggagaagcugaggauggcuggagauccugacagugugacaagggcucggaccaaggacuaguguuggaugagggagucuguguagucagcacugguuuaaagacucucucuguagaccucccugucucugcuuucugcaugugugggucccccugcuuccuaaauaccagcccucuuuagcauaguagcugccguucauuccacaggcaccucucccacagggagugacucccaugggaaccuucccugacucccagccuggaucagugcucauuuaucugugcgcccagaccucaguuucuucacugacaacgugcgccuccucuugcagugcccauagcucgguuauuuccuuauugaucacucuuucgucagugagccccaaugcaugagaacagcaaguuaauggaagaaggauggcucaugauuucagaggguucagucugggaugguugucccuauguacuuggguaaacacaucaccauagcaacaagagugcauggcagagaggaugucuucaccucaugauggacaggaaacugcaggaguauuggaggggcuggggggaucagguauaaccuugaaaggugugcaccuagugacccacuucuuucaguuaagaccucagcuccaaaaguuucaggaaccuuccauucaacccaggagccuguugggggaaauuuccuagucagaccaaaucuguuuguguaauuguguaauuccaugcucaguaaaaauccccauaaggguagcgugauggccacuugucuuagaguuggaucuccaacaccuugcaauccacccccacugcccccaguuagcaggcgauuucagaaacacagcagacacugaaugaaagugggaaggacccaggagaugaaagaaacccugaagccaucucugcuugcuaugugggucugggagggccccgucgccacguaugccaugcuagcaucugucaaaacuuuccagcccuuguccccacaccuuucuccaucuuugagugucccauaugcucaugggauacuuccuacccaugauaucuuaucagagauuuaaugcagcuaaacgcucucuuuccuuuaacuacagaugcuuaugccaucuuccacaccaacccuccuuugcccguuauucacuucgucauggcuggcuuuucagaaggcaucuguugccuucaccacaguggguauggugugcccuucccaacagagugaauuuccaguugucauccgauuuccuguauagcccuuugcuaucgaagaaaugcaagccaaaaucaaaaccuaugaccugucugaguggcaaagcaugaugagaaacuagugggcuucuaaaugagaagcuccuggugcacaaaagucuauaaguucuagaagauggcgagaaacacuggagacagcgagagagagacugggaggcucagcugggagcuuggaccuuagagaucaugaguuggauacagacagacucuuccuuccucccucccucccucccucccucccucccucccucccucccucccucauucuccaucaucauugcccuccucauccuccucccuccccccuccucuuacuauuuugagucuacuguaucccagccuuagacuuacuacgcuauguagcugaacaugaccuugaaaucccgacccgccugccucugcuucccaagugguaagauuaacaccauaccuuguuuaugcagaaccagggauugagcccugaguccuggcuggccugagcuccgaagguuucccagagcuccgacagauaaagaggagagagaagauugcacuggauggcagacaugauacuuuauucacauuuguggaaaguaagccacauggagcucaaaucccaucaauacguuccacuuuaucuuaaauaaagcauucuuuaagggacuguucugggccgggcagcaugcagcuggcugccgcguggcccuucugagacuguagugauggauacggugggguguuccaaguucagggaagaaagcaagcaacgaggaagcagcaagucaggagacaguguccguguccagauacuaccgagcccagccugagagccguucccugugcgggucccagcagaugugcaggcaguacccacugcuccucccauuuacaaggcagggagacugaggccagagcagguggacggaaaaggcuucucuggccaaagggacaacugaagugaugucugagggucaggacauguugucugagaaccucaaauaguccacauaaggggcaggcguggaaagcaaaacuagagacgagccuaugaguuuucuguuggagcaggagggccggggagucucagaggucgucauaaacauugaacacuuuagggaccauguuaucaggggccaagcuucugguacagcaacacuuacggagagagccuugggggcuugacaugggagaaaugauuugagcuauagauguaguuccuuugcagaggggaggggaggaguuggagcuggaaacccucccuaagugcuccgcccaccacaccguacuaugguaucaggcuuuuuaaugaagccaugugcauuuugaauucaugcuuugccggguggcuaagguguuuagacaccugacagcaaacaccccaccgauguauauaaucauggugcccugcauuucuaaauaaucucaggccucagcuuccuccacauccgccauagaccucuucaggcauaauuacagcucgucaggugacagcugccaugagugagaggauuuuaauguacccguggauuugagugcugcaguuugcuuggaccuugauaucagagauuugcauguggagacaguuaggaguccagugucaugagcaacaguaaggucauguuccaagcacagggcugugggugcacauugaacucucuggccccacaccuagaacucccaggauaugguggguggagccauccaagggaguuuccagcuucagcuccucccccuucgccaucuccucucugguuccuuccccuccucuccauggccuccugcaaagaccugcugcuggcccccaggacaccgaaaaagccgccaaggcugcauuggguccugauguaauuucucaacaagaucuugaccccucugacuuuacuccuuuucuuccacaacuccucagcacagcccacuaucuucaacaagucuccccagggucagccacagacccggaacuacuuuccccugcgacuccuucacccccagggcaguggcuuuguucagcuaugggagcacaugggucuuuuugcuucucagacugcacccucuccaucccuugcuugccccaguucaucaccaaagacgaucagguugcagcuagcccuggucaggugcucucuccuccucacucugaauuguaucuguuuccugaggugaugauggaggaagggaggauaggaaggagccauccuugugcugccauccuuauauguggccagaagagacacacugcauguaguucucgucucucgugcucucuguuccccuugugugugcauguauggccaugcaugccuguagaagcuagaagcugacaucaggaaucuuccucaggcauucccucuuauuuuuccccccugaggcaaggccucucacugaaccuuaaauugggcuaugcugauuggccaguaggccccagggauccucccgccucugcagccccaguguuaggaucacagacaugcaccaccacgcucaacuuguuaaguggguaugggugaucugaacuggaguccucauggucgcuaggcaagcacuuuaccaauuugcuaucuccuaguccccuuccccucucuucuaagagguagaagcuuccucgggccuccaguugcaccccaacauuaguuuauuuaccagucaaauauuuaugcccuucucuuuucugggcucugcuguuucugaaaauguggguuaccuaugguagcucuugccuuuaggacgucaucugggggcaagcaggcagucagacacucaaaagagcuaugucaagauauagacaguguacaugaagauuuuguccagcaggguagccuccagacauaucugucugcaguuaaguugcaaucaauuagaauuaaagaauuuaauuuuauuuucaaugaacuauugaccagcagcugccauguugaaucagcagguuggguagauccgucauugcaggguggaugaacagaauccaacuggaggcuccagagggcagguucuugucugccccauguccaucagugacccucgggugccaagaauaguacaggagcuuauuaagcaugugcugaauauagaaggaggacaauguagcacaggcuaugaaagcaagauggauaaacugguuaaagagggacaugcaacaugaaugucacuguggagccccagagagaugggaucucuaacagcugcagguagacagcgugcuccacagacuuucuauccucucuucguggcuucuuucaaugucacaauggcuggaaccccacaaugugcugcugucauuuacacaaaggaaggaagguggguagcauccacaccacaccuugcugucucuucagauaccuggaagagguaagaucucaauuggcucgugggaggcggagagccagguguggcuuaauugugagugaccagguugaggaaccgaccugguuguaaacaacacacgucuguuuugacauuuggaaaugagacuuguguuucaugaggcuggacuuugugaucagugagagaggccaaugugguguguggccgucaggaacgguguugcuuuaugaguuuggcccugguggugguuugggaauugcucaaguugguuuucugggcuugcuagugaaacagccucuaugugugucuuuugugccauuggagguuuaguuccaugucaauuucuagaaguggauuugagaguggguacagaaccaguuuugucagagaauccaucuccuuucauaaugacgauuccucucauauccccucccuaaaguaaagggaaaucccaacucccaugauucucugcagcauggaauauuauccacguggugaguuuccaccaagcuaaggggaaagaagugaaugauauuucaaugcuguuuuaauuuuuaccucccacuuuacgaauuauaauuuguguuguucuucagagcaaaagucuuuuccuacauaaaugcuaacucugucuuuuguucguuuuguucccagacagugucuucuuuccucuauucucagcauuucaaagcucuuuacaacuuggagguauuacuaguccuuuaccuaugacacgcacauauuugacacaugccuuuuaauuggcucauuguucugcuuacugggccaucugugucucuucugccuuugcugaaguuuucuaguucauuuuaagugugcguuuuucuuguauuucucacuuggagccuuugauauauuacugucuuaaaggccuugucagauuguuucaggauaaugaguuuacacuuggucuaauucuuguuuccugccugaacucuggaauuuugggugcuggcucauuugggcagggaggguugcauuugcuuguuuuuguuuuuguuuuguuuuuuccuuuccuuuuuccuugacaccccacccccaccccucgccccagaucucuacucauucugucuuugcccccagcuggugcagaguucucacaaaacagccuaucuguuugcuaccguccuuuagccuuccuuccugagguuggggagggugccuuacucccugccuagcugguggcccugagacugaggucccuucucccaucuugcagagaagaguuuguguccuccugcugggaagaggccccuucccaagguucccuucucugagcccugcuugaguccugcuccacucucccucuggcuuuccugcuucucuuacucaagagauaaucauguuugugaacccagcuucaucuuucuggauuuucuuuuuguguuuucucugccaugucucugcauucagugcagggguauuugucccaguuuacccagcugucuuaaugggaaacauuccuucauauuucaaaaaagcuuggugggaccagacaggaggaagcuaguguggugggaguucccucuauucaauacauacccagagugggcaucacuuccugaccucacaguccuaugaggcaggggcggugccacccauuuccuuugagugguaguaaaggcacacagcaggugaguaugcaaugcagaugaagaagcaggugagcaggcaggugaagaagcaggugaguaugcaggugagcaugcaggugagcaagcaggugaguaugcaggugagcaagcaggugaguaugcaagugaggaagcagguaagcaggcaggugaagaagcaggugaggaagcaggcgaggaagcaggcgaggaagcaggugagcaugcaggugaagaagcaggugaggaagcaggugaagaagcaggugagcaggcaggugaggaagcaggugagcaggcaggugaggaagcaggugggcaggcaggugaggaagcaggugaggaagcaggugagcaagcaggugagcaagcaggugagcaugugggugaagaagcaguugagcaggcaggugaggaagcaggcgaggaagcaggugagcaggcaggugagcaugcaggugaagaagcaggugagaaagcaggcaaggaagcaggugaggaagcagaugagcaugcaggucaagaagcaggugagcaggcaggugaggaagcaggcgaggaagcaggugagcaggcaggugagccugcaggugaagaagcaggugagcaugaaggugaagaagcaggugagcaggcaggugaagcaggugagcaggcaggugagcaggcaggugagcaugcaggugagcaugcaggugaagcagcaggcgaggaagcaggugagcaggcaggugagcgugcaggugaagaagcagguaagcaugcaggugagcaugcaggugagcaugcaggugagcaagcaggugagcaagcaggugcagaagcaggugagcucacuguccagucuuguauuccugagagguugggugggguuaagcaaguggugacuucccuuguuugccaggcucagcaggguggauccugccccguggcuucagccugguauggaguggacacgggagggggaaggugugauauugaggacuuagcugcuccuuccuuugcugugaacaucuuggugcaucugaagguuaauuuugauugucaguuaguuggacaagugucugcaucagcacugaggcucauguccagagaggucucacugggguggguggcauuuucauuugaccugguggccuagaaugacuaaaaagaggauaaaggacgaagcaguugagugcugcuguguuccuuaccccaguuccugaucuacuaccaugugagcagccuuccacuuccagacugcggcuggcuggcugauaugccuugucuucuacaauggaacgauacuuuguuucauuuaccuccuggaaaaauuucuuccuuuuaaguuccugauguaugcucgcauguauguaugcuuuauuuauguaugccuuauauaugugugggcgugcacauacaugcauguucauguccauauggaagacaggauguuauuucucaggaacuguuucccuuguuuuaugagucagggucucuuacugggaccuggaacuugcugguuaggcuaauguggguuugugugauugaacucagguuuuuguguuugugggugggaagaagugugcacuaugcauuuggucauaggaaggagaacaauaaugaauaugguagccuccagcuaagaggagggaagagcuuagacuguccuggccacguugguguuugcgccuucauuuacaguuaagaauaauccuggagacuguccgucucuuuacauucauccgagaaacaggagccagaugguccuguagcauuuccccaguuacccuccggcuugaccuaucccugccgucgaacuguggagcccugagcuuccgaguaucccaaggcucucucccugccugcuucuugccaucucucuggagggaguugagacgcucaaaagcaguuccuugaggugaagacugaagggcuagagugagaaagcaacuuccuacacaucuucagagugggggaggugcagaauguuacagccacagggacauguacuaggugcucgcaggggcuccugauccuuccugggucaaugguguugcgaauucccaaaucagcaucagccacgugcauccagcuucaugaaugauuggucagcgccaccucuaaacccaagcucuaguaggggcguggccuuggauugggggcggggcggggcggggcggggggggggggaacgccugcaucucccuguaucgcauuuccuguuaccuucugaucgacaauuacugcaggcauugccuccaaaugaagcccaagaguaggaacuuuauuccucuacuuugaagccccaucacucccuugaacagcucacccaccccugguuauauucaguaggaauaagugaaguaaaaugagcagccgcuggccccaauccggcuuccauuauauaaaauccgaguuguaacuggcagcgggcuuaccuuuaucuguaagauggacccacaguugccgcuccacagaacuauugaguuaagucagagccacuca

SEQ ID NO: 4809 - RNA, 1338 nt, Mus musculus
cacuaaagacagacaaaggcacauagaaacacaaggagaggucaggugaagguggagguagaggcuggaaugucacauacaaccaggagcuggaagaggcaagaaugauucucuucagaacccucccgagagugcgagccuugcugguaccuugguuucauguuucacaucucugggagaauacaucucugcuguuuaaaggcaaccccuuuauggcgaccugcuauggcugcuuaaggaaaagaacacauauaacuuuauccaauucaacgccacuuacggauacugucgccauaucaaggcguauaugcauacaauaauucugcuuucaauuuaaagaaggacauggaauuuuuccaagggucccaagguuaagaauucuuucgguagauaauuggauguguuuaagcaguccuaaucauuuagcugacccaauugugcccacauuucagaacagggauuacggaaggaacguagagaugaauaggaguugagaggguuucuacgcacugagaaaagaguuagcaugcaaucaccaaccuuucauaccuuuguaaaacgcugcauuauuuucuccuggaaacauuuacaugaaaagaaaauuaauaaggcugcuuaucaugagucccaggcaggagucuuaauaagauagagaggaauauugauuuuggucccuacaguacauucucaaaugaugguguugcuagaaagaaggaaggcacccaagaguuggcaccaucuugucaugacccacuguggucaggcagagacacgagaggagaaugggaaggguggguguguuguuuuuuuggucccgagaucaggaugcugcuggacauucaggauguagagcagcaggcacagugggcuccuccguucacaucucaugacagagcugcuggauguggaucggcagcccggcaaaggcggggagagccgcgcugguuccggaaccgugagaagagaguguacgccgccgcugaaugguuucccuuuggacguuauguguuggagacugugguggcugaucuucauugucaacuugaugucauugaggaucacccaggagacacaccuuugaaccuaccuaugaggacauuuccaaagagauugauugaacuacccagggaaaauacaccaugcgugugggagguagcauuuccuggacugugguaccagagaaagaaaaagaguaaaaagaaggaaagagcugaacagcagcguucaacccucucucugcuuucugacuguggaaaccucauaccccguuugucauguuuuauccaccaugauauauuguccccucaaauugugaguugaaauaaggccuucuuuuga

SEQ ID NO: 4810 - RNA, 1015 nt, Mus musculus
ugcagaccacauauucaaaugcccaagaacaugggggacaacucauucaaaccacauuugguaagauggaaccucagcugagaaaauaccuauaggcaaaucuguggcgcauuuucuugguucaggauugaugugggaacgauccaggaugggugcuguccccacuugggcagggaguacuuacugaguuguauaagaaagcagguugagaaagccaugaggaggacagacagugagcagcagcguuacuccauggcuucugcuucgguuccugccuccagguuacuguccugacuuuccugcgugauacacugugccugcaaggugaaaugaagucucucuucccuaaguuacauuggugcuuugucaaagcaauagaaagcaaacgagaacagaguggguucccccaucaguggguuccuguccaauauacccaagugguauaguguacaccaccgacauggagggggacuguuucccacacccuacuuuguaugcaguuacaagaacaacaacguugacacaacaauguugcucuucuacacgucagugaagccuuacuguaacucuuuucggcaggcacugucacuggcuugaguuccuucagcucucaccaugcuuucccagaaggcauaaagagaagagucuaaggaaggucaaggugaaacgcauuccacacaauaguguguaauaaguaacaucuauguugcaugcucugguucccaagacccgggcagcauggcuccacccccucccuuugucucaccuggccuuguucacacugcucaacccuaugguauuuucuccuccucaagcuccaagacugauggaacccaugcugccagggccuugaguccuuuacuucacagggauugagaauggcuggaagaccuuauccauggcuugaugggcuguuaaaggguuccccggggcagcaccgcagacagcccagauggaacccugacgagagcagagucguccugcauaggacucaaccccucugcagaaccucaau

SEQ ID NO: 4811 - RNA, 56555 nt, Mus musculus
guguauacacacaugcauaugccucgccccucaaaaaccaaagcccucaccaacauuagaguugagccugaggcugaaguggcauaauuuaugaacuuagagauagcccauggucacauguaggacuuacccggaccuggagcugcuaaucuaaaucaugaaaaguuagguuuaggacuaggggccucugagcccuugcuccugugccacacaaacccaggcaggucuaagaagacuucaacccacuuagcaugccucagccuucaacaagaugucuugcccaaggagccuuuuaggacugagagagagcagccgggauaccccugaggcugugagcagguguuacaguuagugcuaacugcaaguucugucagcuccaaucaccagcacuccucugacgugcauuuccuguaaccgagcagauccugggagcaggccaggccagcugcccccugauuagcaccacuggacucucucuugcuguucuggcugccgugagcaagaggauuuuuuauuuuuuauuuuugucccugaaacuauaauaauaauaaaaaaaucucuuuaagacacaaacugaaacagcucacucuugcaacucucuccgcaaguuccugcagacaaacauagaauucagagcuuucuaggaccuuccuucuucaccauuaggcccaucccccagugacacugaugcccugcuggugucaugguggugucccaguuuaccuugccaaaagucaccuucaccacauagccuuccuguaaugauuccaugagcccggggcacaaguucucuuguguguuuucuuuaaaaccacccugaucacggggcuuuugugaugauaguugacuaugguuaagccaguuuauugguuugcuacaagauucuacuaguaaaauuucuuguuuugauagacuguauaaaauguauucgcagugaccgacacagaagggacuucaagaauucugguucuggcuccgccccuuucaucagccguuauccuguuaagccacucugcaaacugaauugauuagcuucuccugcaauaggaaaaucauuuauuaaacaccaauggggucucauacauacauuauauacaccaaacacuacgagaagcuuauagcuucgucugucuuguggcuccugagaaggcccgagacacccugauguggcuccggcugaagcugcuggguuucuaacugucacaggucucagaaaccauggggaguaguauuugugagguggggaugggguguguguguguguacgugugugaacacaagaagaacacuggaccucuagguuagagcccaggaguuaacugguacccgugguauuuaaccaaacgaugggacccuagcuggaugcgaucuuacccacgucauuagucaucacuccagagggucaggcagugcugcuucuagaacccucuauccucaaaucuuaaaagcaaaauauuugcauaaaaccuacacacuuccacccauggccacacuagcucuagcuuagauaaugccuaacagauggacuguaaagugauagcugugcuguguuauuuaaagaaugguagggaacacguacguggucacuuacagguucuucuuuuuuuuuuuuuuuucaaauaauuuccauccauaauuugaaagcuaacuagcacuaucugaccuuucagaaaauggcucuuuaaaacaauaaaacagggaacuuugguaugguuggcucugcuggaagggcccuggaauucccacguugguuugugucuucacugcacaaccuucaaccgccauguucucagacagaggaacccacaggcgccacuuccgcuccagccccgaagagguuaaagaaagggaggcccacgcuguccagugacuuuauugcaggaggcgagucaggacuggguggaugcagauucagggcagcagcagaggaaacucucccuggcacagcgcguggcacucaaguucagcagguacugagaagccauucuccugauucccuaugguuccguucuucagagcacuuuucauacaaagaguccuagaggcaaauaagaaaggauauucuucggccaccagccaccuucaggucucccagccgaggcgccagugagccuaucucccagcuuccucuggagggucagaaagccuccgucgcauggcggcgccgugcucccugcuccugguccuccucucugaguacuggaagaacggagagaagagacaacaggucacacaacacuggaucagcuaagcuacaaugcacucacggacacucugcucuuucgcucacugagaucagaggcaggaucccgaggaacauguggcgcuugcuuauucaacacacuugucaacagccgcauugagcuccucccaaagaggacaggggguguuuggacagaugcauucugucccuguccccagcagcuccucugucuaaucuaccuugagagcagccuguucagcugcuggguggaucugcuuauccaaaguuguggcagugaaccgaauaccaguaaauaccccuccugccuucuauuauucuugcuuuaaccuucagguaccugaugaccaaugguggcccucuuucccucguuucuagcccaaauguuacugguuucuccaauuguuuagagggcuuggccccuuucuucugacccugcaaauuggcuugucuugcaggccacuuuaauagcaacaccuuuauuaaaaguucagaacaagaauugaacaaacuacucaagccaguggcugacagauggaugagggagcccacuccucauguguuucucuaacauuaucaagaguacacagcccuuugucauaacccucccccuaccacccccguugaaagagcacuuagauuuucucaaaugcuuauuaaccuauauucaaaacagaaugucuuaauacacauaucaucaauagauaaauauggacauauuuuaaaaauaaauuauucuucucuagggaggggacaagauggagaguaaauuaaaaggugaccauaugagaacaacggaacaucuuuuaggggccauagacacggaaagaacgaacacagaaacagaacauuuaguagcauccaacuggaccugacuggaaucccuccccaacuucuaagaaaaaaauauguagauuuucaacuucugaacuccucuguucaucugggacacaaacagaaagagccaggccacauaaucguuccggaguuucaaucaauacaauuucaaacuaaggguuugauugaggggcuguauaaaccuuugaauggcaguuuuuaaaauugacauuuauugucagacguaguggcacacaccagccuugaaaggcagaagcaugugggucacugugaguuagaggccagccuggucuacagagugaauucuaagucagccagagcugcgcagugagacccugugucaaguacauacauagacacauucguuuuaugucuauguguuuuaggacuucucuccuccaccaugugugucccagggacggagcucaggugguccacuuggccucaagcauccucaccagaugagccauguucucaggccuuaaauaacaguuuccuguuuuucuucaucaaaagacuacuccagccuggguaugguagaucacauuguuaauucuggcugaguagagagggcugugaguccuaggauaaccugggcuacacagcaaaaacaaaacaauaaacaaagcaaaaccaacaccagggacgaggugaggaaggacaggcacaggggcuuuucaaacaaaucuguggaggaugcaggaggccauggugggggccaugugagacccugucucaaagaccaaacagagcaaaaggacuaccugggagaaacaauaugaagcacugauccagaauacagagagagaugugcucuagggaggaagagcugacccuggaugguccaugacaaccacagaggaagggucaaaggugauguguggcaggcaugagaaugaaucauagagcacacugagcggagucugugcugacagaggaagucgagauggccuugaacacaagggaaagauugacggugaagucacugacaaagacaucaucuaacagcacacacuagaggacagcuaacuccacgaugaagggacuggacacaggacgugcaagggcaguuccugcaaagaagaaggcagcagagaggggcagacacaaguagaccccuuaaaguggcgagcaauauuccaacacacuggggcugaggauggcucacacaugguacggagccuguacggcucuugcagaggacccaauaucaguccccagcacccaugugaggcacaguuccagccccagggaauccaccaccugcagcacguccacgcgugugcacacaccacacacauacauacaugggaggcagcacguccacgugugugcacacaccacacacauacacacaugggaggcagcacguccacgugugugcacacaccacacacaugcauacaugggaggcagggucagggggaucugacuuagaggccagccuggucuacagagcaaguucuaggacagccagggcgacacagagaaacccugucuuggaaaaaaaauacccaaacuaccaaaauaaauaaauaaauaaaugccaaaaucaaaaccaaaaccaaaacuaaaaccaaaaccaaaagaacaggaaauguaaaaaagagcaggccagaccuggcaguggagaaaucagggggagccuucauaagcugcagaaacgaagcaacauuaaacauggggagguguccuggcuagcuuuaugucaacuugacacuagcuagaguuaucagagagaaaggagcuucaauugagaaaaucucuaugagaucagauacagacgagccugcaaaaaauuucucaauuagugauuagagguggugggcccagcccauuauggguagugcuaucccugggcugguggccuuugguuucuauaagaaagaaggccaagagagccagcaagcagcacuucuccacggccucugcaucagacccugccuccagguuccugccugaauucagcuccuguccugacuucuuucacugaugaacugugauguggaaguggaagccgaauaaacccucuccuccccaaaucgcucugucauggcguuucaucacagcgguggaaacccuaacugagacagaaggaaacaggaaaucuuaggaaaacaaauacggacaagaaguugcuaugaccaccgacugacgagucacuaacaacauucaggaccaucugggaagaagaguucacgggagguuuuagucaucaaaacaauggcaaaauuacucaacuacacagggacaauacaucuaaacauaagcaaaaaucuauaaaauugaauauauggaaacaaaaaauguagcccaagauuuguuuucugcaagcauaucacgaagcacuagguuuaguggccacacaagccagccccugaacgugauggaaaaacacuuuucaggaaucauccuaacauauacauacauuuguuaucacaaagacaaucacccuggauacagccccugggggugacagcacaugccuuucuuuauucagcaagcugagaugggagaaucgagaguuuaaaacucagacugggcuauuuaaaaaugggucauaccccuauauaguuauucaaauaauaacugaaauuaaugaaggguggagaggcacuucguauacacacacacacacacacacacacacaauuaaaauuggaaaauggaucuuuuaguccacauagaaaaaaauauauauauauauacacacacacauaugcacauagacauguaaucauuauuuacuuuaaaaggcucuggauauaaaguagccgaucuauaaaacagaaauauaaauaccuuauuuucaaacguuuaaagugaaucugcuugguuaguaccuggaaagagacaaugccugguacuuuagcucuuggcccauguccccguccauggugcagccuacaccagugacaugugaucacacaagaucccuguugcuguucacagcacaaagacucuaagcgucucacuaaagauggaacaagccuaaguuagcccccucacuuuacuuaaugaaacuguggcucaaagacucuuggucaccuaaaaagcaguucaucaaugucaccaaagcaccuccuugaugccaggggauagauuucuuggauauuuuucaaugaaagcaaagaugcuuucuccccuuguguccaaggaagaaaggggacaacauucuaaaacugcucccacagcaagcucaguccucaugguuuuaaagagaauacauguaaaguugauuugcuuuagaccaaaaguauaggaaaccucaccacaacaacacaacaacaccaccacaacaacagaauauccacaaaggcucugcuuaacucuggacaccgggcucaccucauucuucaaacacuuccucauuucccggucgaggucguugcaauggccgaaaaacuucagaauguugugcuaaagggaagagaaggggggaacaguucagcucucuaaccgccaaugucucugaaacacagaccuaagaggacgcugcuguagagaugucgccgaccguugcucugugaguaaguaauaaguuaaacaagauucucaggaagccucgcucauccuuuaaaaaugucugcaggacagaauccaaacaaaucugaaugaugagaugacgugacaggucaucuuguaauacgugugaggucaaagacccgagcuacaccuccaggacccacaucaaagccaggcaggcagcccgggaagaggggacuggaagaccccagggccgcugagcagcccacccagcugaauccacaagcuccacagucagugagagauuugucucagaacaagacugcaaugauugaaaaagacauccaacacugaccucuggccuccacacucacguacacacacacacacacacacacacacacacacacacacacacgaaugcacacaaacacgcaauacacauuuuucuuaguuugaaaacacaaaauaacccauuaaaaccuuaccuagugaaagagaagaaaaguuuaaccgcagagcagaagagaagacuuggcaguuaacaguacuugcuucucuuccgggacccagguuccgcucuuagcacacacacacacacacacacacacacacacacacacacacacucacacacacacacacacacacacacacacucacacacacacucacacacacacacacacacacacacacucacacacacacacacaccccucugcugagagcuuugggugccccuucucauuugucacugggcucggacaaggaagugggcucagauaagaaugucagaaacacugaccguggggcucuguuuacugcuuuacuuaauuauuauccugugugaucuccuguucccagcacccacauggcagcuaaggagcuguaacuccaguuucaaggaauaugacagccuugucuggccuccgcaggcacugcaugccuaugguacacacauacauacaggcaaaacacccauacacauaaauaagccucaaaauaaagauaaacaaaccucaaaaauguaaagaaaaaugugucuuaaauucaaagucuucuucauuggaaagcaaaacuaaaaauuucaucuguguuuccaacccugcugccaaaacuauggcugcugcuuggcagaugcccaggcuggcacuaaggagagcuugcgugucucaggguuuaaggugggccgggcagcacagugauccgcucuaaacgcugaaccugaaccuguggcuguaauaggcaggcuucuccuucucuugcuaauaaugguuuucucgggaaccagacaacacaugauuaguaagcggcaccuugcgguauuucucuguucuccuccagggccgcuguagagguaccugucagggucacacugaauaaacggucugaguuguuucaauaaacacuucaaacagucugggauuuccucucugucacccacuggccuuccucucugucacccacuggccuucccagaacaagcacuuccugcguuuucccuagaugauuucugugauggcaaacaacaggaacaaggcauguucacccuuucuaaaaaaauagaagacggcacuuuagaaaucacagcacaguagucagugccuacagcacuugcccccccacauacauacauacauacagacagacagacccacccacccuaauaugugcacagguguggcuaugauguuguauauacacguguguagagaccagagguugguguugguguuuucuuccaucucuugccgccucauuuuuugagucagggucucuccugaaccuggagauuuccaauugagccacacuggcuggcuagcaagcaccagggcuccuccugucugugccucccugggccaauuacagcccacacugcugugcccagcucuuacacaggugcuugcauuagaacccagcccucacacaugcaguuagcuccagcugccccguguauacucauguucuuuuuaaaaccuaagauaaaagcuaacguuuguccuuucaccuccacgucagcuaagcccaaaugagaguuguugggagccgcgcccacauucgccguuacaagauggcgcugacagcuguguucuaagugguaaacaaauaaccugcgcaugugccgagggugguucuccacuccaugugcucugccuuccccgugacgucaacucggccgaugggcugcagccaaucagggagugacacguccuaggcgaaggauaauucuccuuaauagggacgggguuucguuuucgcucgcucuugcuucuuacacucuugcuccugaagauguaagcaauaaaguuuugccgcagaagauucuggucugugguguucuuccuggccgggcgugagaacgcguuuaauaacaauuggugcugaaauccgggacgagaaauuccgggacgagaaaaaauccggaaagaaaaaacccgggaggaaacucgggacgggaguuucacuggcgcaaggaagaucccucauuccagaaccagaacugcgggucgcgguaauaaagguucccguaaagcagacuguuaagaaggauucaacuguaugaauucagaacuuuucagcuggggaacgagaguaccagugaguacagcuuuacgagguaagccuggccuugaacuuucuaaggaaauucaagacagucuaucagaaguaaaguggaaaauguuugcccuugaauuuuuucuaguguuagaagcccuuuuguuccuuuucacauguuaucaagugguuaaggcagggcggauucuggaugaaauucagggcaaucuaucagaaguaaagcggggagagagaguaggagcaaagagaaaauaugguacacaaaauaaguauacaggccuuuccaagggucuugaacccgaggaaaaguuuaggucagguaagaauaccuggggagagauuagaaggaaggaaaagaaaaaagaaaagaaaaaagaucgauuagcggaggucucuaggagauacucgucacuagaugagcucaggaagccagcucuuaguagcucugaagcagaugaagaauucuccucugaggaaacagacugggaggaagaagcagcucauuaugagaaaaaaggguaccagccagguaaagugcuagcuaaucaguuaaggaagccaaaagcggcuggcgaaggccaguuugcugauuggccucagggcagucggcuucaagguccgcccuaugcggagcccccgcccugcguagugcgucagcaaugcgcagagaggcaaugcgcagagaggcaaugcgcagagaggcagugcgcagagaggcagugcgcagagaggcagugcgcagacucauucauucccagagaggaacaaaggaaaauacaacaggcauuuccagucuuugaaggagccgagggugggcguguccacgcuccgguagaauacuuacaaauuaaagaacucgccgagucgguccguaaauauggaaccaaugcuaauuuuaccuuggugcaguuagacaggcuugccggcauggcacuaacuccugccgacuggcaaacgguuguaaaagccgcucucccuaguaugggcaaauauauggaauggagagcucuuuggcaugaaacugcacaagcgcaggcccgagcaaacgcagcugcuuugacuccagagcagagagauuggacuuuugacuuguuaacgggucagggagcuuauucugcugaucaaacaaacuaccauuggggagcuuaugcccagauuucuuccacggcuauuagggccuggaaggcgcucucccgagcaggugaaaccacuggucaauuaacaaaaguuguccagggaccucaggaauccuucucagauuuuguggccagaaugacagaggcagcagagcguauuuuuggagauucagagcaagccgcgccucugguagaacagcuaaucuaugagcaagccacaaaggagugccgagcggccauagccccaagaaagaacaaaggcuuacaagacuggcucagggucugucgagagcuugggggaccucucaccaaugcaggcuuagcggccgccauccuucaaucucagaaccgcuccaugggcagaaaugaucagaggacauguuuuaauugcggaaagccugggcauuuuaagaaagauugcagagcuccagauaaacagggagggacucucacucuuugcucuaaguguggcaaggguuaucauagagcugaccagugucgcucugugagggauauaaagggcagaauucuucccccaccugauagucaaucaacugaugugccaaaaaacgggucaucgggcccucggucccagggcccucaaagauaugggaaccgguuugucaggacccaggaagcagucagagaggcgacccaggaagacccacaaggguggaccugcgugccgccuccgacuuccuauuaaugccucaaaugaguauucagccggugccaguggagccuauaccauccuugcccccgggaaccaugggccuuauucucggccgggguucacucaccuugcagggcuuaguaguccacccuggaguuauggauugucaacauuccccugaaauacagguccugugcucaagcccuaagggcguuuuuucuauuaguaaaggagauaggauagcucagcugcugcuccucccugauaauaccagggaaaaaucugcaggaccugagauaaagaagaugggcuccucaggaaaugauucugccuauuugguuguaucuuuaaaugauagaccuaagcuccgccuuaagauuaauggaaaagaguuugaaggcauccuugauaccggagcagauaaaaguauaaucucuacacauugguggcccaaagcauggcccaccacagagucaucucauucauuacagggccuaggauaucaaucaugucccacuauaagcuccauugucuugacgugggaauccucugaagggcagcaagggaaauucauaccuuaugugcucccacucccgguuaaccucuggggaagggauauuaugcagcauuugggccuuauuuuguccaaugaaaacgccccaucgggaggguauucaacuaaagcaaaaaauauuauggcaaagauggguuauaaagaaggaaaaggguuaggacaucaagaacagggaaggauagagcccaucucaccuaauggaaaccaagacagacagggucuggguuuuccuuagcggccauuggggcagcacgacccauaccauggaaaacaggggacccaguguggguuccucaauggcaccuauccucugaaaaacuagaagcugugauucaacugguagaggaacaauuaaaacuaggccauauugaacccucuaccucaccuuggaauacuccaauuuuuguaauuaagaaaaagucaggaaaguggagacugcuccaugaccucagagccauuaaugagcaaaugaacuuauuuggcccaguacagaggggucucccuguacuuuccgccuuaccacguggcuggaauuuaauuauuauagauauuaaagauuguuucuuuucuauaccuuuguguccaagggauaggcccagauuugccuuuaccauccccucuauuaaucacauggaaccugauaagagguaucaauggaaggucuuaccacagggaauguccaauaguccuacaaugugccaacuuuaugugcaagaagcucuuuugccagugagggaacaauuccccucuuuaauuuugcuccuuuacauggaugacauccuccugugccauaaagaccuuaccaugcuacaaaaggcauauccuuuucuacuuaaaacuuuaagucagugggguuuacagauagccacagaaaagguccaaauuucugauacaggacaauucuugggcucugugguguccccagauaagauugugccccaaaagguagagauaagaagagaucaccuccauaccuuaaaugauuuucaaaagcuguugggagauauuaauuggcucagaccuuuuuuaaagauuccuuccgcugaguuaaggccuuuguuugguauuuuagaaggagauccucauaucuccuccccuaggacucuuacucuagcugcuaaccaggccuuacaaaaaguggaaaaagccuuacagaaugcacaauuacaacguauugaggauucgcagccuuucaguuugugugucuuuaagacagcacaauugccaacugcaguuuuguggcagaaugggccauuguuguggauccauccaaacguauccccagcuaaaauaauagauugguauccugaugcaauugcacagcuugcccuuaaaggucuaaaagcagcaaucacccacuuugggcgaaguccauaucuuuuaauuguaccuuauaccgcugcacagguucaaaccuuggcagccacaucuaaugauugggcaguuuuaguuaccuccuuuucaggaaaaauagauaaccauuauccaaagcauccaaucuuacaguuugcccaaaaucaaucuguuguguuuccacaaauaacaguaagaaacccacuuaaaaaugggauugugguauauacugauggaucaaaaacuggcauaggugccuauguggcuaaugguaaagugguauccaaacaauauaaugaaaauucaccucaagugguagaauguuuagugguuuuagaaguuuuaaaaaccuuuuuagaaccccuuaauauugugucagauuccuguuaugugguuaaugcaguaaaucuuuuagaaguggcuggagugauuaagccuuccaguagaguugccaauauuuuucagcagauacaauuaguuuuguuaucuagaagaucuccuguuuauauuacucauguuagagcccauucaggccuaccuggccccauggcucugggaaaugauuuggcagauaaggccacuaaagugguggcugcugcccuaucauccccgguagaggcugcaagaaauuuucauaacaauuuucaugugacggcugaaacauuacgcagucguuucuccuugacaagaaaagaagcccgugacauuguuacucaaugucaaagcugcugugaguucuugccaguuccucaugugggaauuaacccacgugguauucgaccucuacaggucuggcaaauggauguuacacauguuucuuccuuuggaaaacuucaauaucuccauguguccauugacacauguucuggcaucauguuugcuucuccguuaaccggagaaaaagccucacaugugauucaacauugucuugaggcauggagugcuugggggaaacccagacuccuuaagacugauaauggaccagcuuauacgucucaaaaauuccagcaguucugccgucagauggacgugacccaccugacuggacuuccauacaacccucaaggacaggguauuguugagcgugcgcaucgcacccucaaaaccuaucuuauaaaacagaagaggggaauugaagagauuuuaccccaagcaccaagagugucugugucuuuggcacucuuuacacucaauuuuuuaaauauugaugcucauggccauacugcggcugaacgucauuguucagagccagauaggcccaaugagaugguuaaauggaaaaauguccuugauaauaaaugguauggcccggauccuaucuugauaagauccaggggagcugucuguguuuucccacagaaugaagacaacccauuuuggauaccagaaagacucacccgaaaaauccagacugaccaagggaauacuaaugucccucgucuuggugauguccagggcgucaauaauaaagagagagcagcguugggggauaaugucgacauuuccacucccaaugacggugauguauaaugcucaaguauucuccugcuuuuuuaccacuaacuaggaacuggguuuagccuuaauucagacagucuuggcucugucuggacagguccagaugacugacaccauuaacacuuugucagccucagugacuacagucauagaugaacaggccucugcuaaugucaagauacagggaggucucaugcugguuaaucaacucauagaucuuguccagaaacaacuagauguauuauggcaaauagcucagcugggguguaaacaaaaguuuccgggauuguguguuacuuccauucaguauguuaaauuuacuagggcagcuaauuugucaaaaagucuuuuucaguauauguuacagaauuggauggcugaauuugaacagaucccuucgggaauugagacuucaggucaacuccacgcgcuuggaccugucgcugaccaaaggauuacccaauuggaucuccucagcauuuuccuucuuuaaaaaaugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcuuccccugauauaucuaugcuuaggcaauaggucgcuggccacucagcucuuauaucccaugaggcuagucucauugcacgggauagagugagugugcuucagcagcccgagagaguugcacggcuaagcacugcaguagaaaggcucugcggcauauaugagccuauucuagggagacaugucaucuuucaagaagguugaguguccaaguguccuucucuccaggcaaaacgacacgggagcaggucaggguugcucuggguaaaagccugugagccuaagagcuaauccuguacauggcuccuuuaccuacacacuggggauuugaccucuaucuccacucucauuaauauggguggccuauuugcucuuauuaaaaggaaagggggagauguugggagccgcgcccacauucgccguuacaagauggcgcugacagcuguguucuaagugguaaacaaauaaccugcgcaugugccgagggugguucuccacuccaugugcucugccuuccccgugacgucaacucggccgaugggcugcagccaaucagggagugacacguccuaggcgaaggauaauucuccuuaauagggacgggguuucguuuucgcucgcucuugcuucuuacacucuugcuccugaagauguaagcaauaaaguuuugccgcagaagauucuggucugugguguucuuccuggccgggcgugagaacgcguuuaauaacagagagugacacuuuaugaagcccaacuacccaaggggaacuggacaaagcacauagaauggguucccuugcaccugcgagcacuaacugugcauugcaguugguaucugagcaccuuuuacacggagaacagcgcaccaggcacuggagcgucagcagugaacgaagugaccuuggcucugcuuucagugcagaacaaggacaaaauucaccauuuccauguaacaguacuguaguccacagacacucgggggggggggggcggcaagaauuugucauugggagaugcucaugggcaguccugguuaaaaucaguagugguaaacaaaacuaaaaggcauaaauguggggaagggaucagccaggagggaugacgaaggauguaggagaugagaggagggacgauggaggagaugagaggagggacgauggaggagaugagaggagggacgauggagggauggaggagaugagaggagggacgauggagggauggagggauauauaaggaaggaugacagaggagggaugacagaaggaugaaggagauagagagaaugaugagaauaaacagaaagcucuguacacgugcaugaaacugucaaagaacuuaauaauagacacagaacugugauauaaauuuaaauacaugaaaacucuuuuccaauaacuccaaguacuuaucaguucugcccacucucaccuucccacgagagugacagcagacgucuccagaggcuggugagaaguggagcagaagaaauuaaggacuagugucuggcucugacaaguagaugucacuaagacagaaaggggagauggcuucagaagagcuaagucugucuggacaacuugaguuugcuucuggaacagcuaaguccauggaguugauagaaagcagagauaaauagaauuuagggaaaaagucugagcuagagauuucaguugcugaugacaagagaauuucucaggagguagagcggacaaacaggcuuaggguagagguaagacagccacacugaccaagggagaguaguuaagaguaaauaaccagguuaaagaaucaagguuagggaauggcucaguggacaagagcacugacugcucuuccgaauguccugaguucuaaucccagcaaccacauggugacuuacaaucaccuguaaugagaucugacacucucuucugaugcgucugaagacagcuacaguguacuuauuuauaauaauaaauaaaucuuuggaccagagaauaauaaauauaauaaauaaauaaaucuuuggggccaaccaaagcaagcagggucuaccagagcgagcagaggucccaaauucaauucccaacaaccagaugaaggcucacaacuaucuguacagcuacaguguguacuuauauacauaaaguaaauaaauaaaucuuaaaaaaaaaaaaaaaaaggaucaagguuaaagaauggagcaaaugcuggcuggcgaugccccgagcuuaaaaaugcacuuggccgugaccuuggcuggcagugaccuugcuggcuacagaaaacugagagaggagaaagcacacacucuuucaagucuguuccaaggccugggauuacugcaguucuguguuuguguucucaggaugggaagauguaagucuuuuaaaacacuaauaggaagacacuccacacacccccuccccaaagggaaaccacaaggacaagagaaagcccaggaaaaccuccucucggugacguccuuucugacggcaaaggaacgggagcuccuguuuccuugaugccucccugggcuucucgugucugcagugacaggcguuacuucaauacugccuuucuaagccagaaaaauguaacaguaaggccucccaguggcuuugaggaagaggcuauuuuccuuucuguauuucaaguauagaugguuugagucuugcugacaaacguaggcaagacaaccaguagaucagaagcagccuguggaugcugugggcuacagagacgaccuguggcugccaaaccacaggaggaacacacagagcaugggaggaaggaggagagcacagcagggcugacuggcgaggaggaggaccacagagcacugcagagucccucauggaaagggacauccagagugagugacacagccuccuaucagagacuaaaacagcuauacaaacugggggcagaagcuagaugacuuggucuaccauccggucaauuaaauuaccaaggcagugugugguacacacccaguguccuccaagggugcuggaaauggcaggaaguugcagcuuuagcaaaauucuacagacgugcacauauggccuguuccugcuuacacacuugaagcuccguucuacugugagcucgaggggugucaggcccagugaugcugcuucaaugagaugagauucugagagcagucucucacugaucacucaccucuggggcacacaaagcacacgaaaggcauuucucaaauggcugaccccaccacugccggagucgcauucuaccauagcaaugccacccuuagccuguguucaacuucauuuuggucaccccucccucuaguguggcuagaugacucaucuggaauaaaguuagaauugugguuuuuacucaugacacacuucugaguccagggauuaaagguaugggccaccacacccagcuaaagguguaaccugggcuauccuugaguuccuggucuuccugucucugacucuuaagcaaguccuaacugagugaggccggagcuaccacuagcuucucuacagagcacacugaaagacacccagggccccaagacgaaacggcccgggcaacagagccuguuuuagauccuaacccugacaugcaggaguccacacugauagcagaaaagacuaagacagcuccauagcccaggccuuaaaauuaaguaacuccauagcuacugcaccaccaaggagaacuuaauucacuaguguuuaaaugugcacagugacuuccugucacagaacugugggagggaggacaggagcacuuacggcggacucuagacccgugacccgugccagucugucccacacacaggcuacaaacucgguuucuuaccauguguguguggcuuuuuuuuuuuuuuugacauuuaaccccuggcccaccagauaucacucauaggccuaguauaaagaaaaauauaaccucaaguuuuccaaggacuaugaauuaugaauuguucuagugucagccauuaaaacuccauuugaaauccuugggaaagaacuggucucccaacacccagaagcaugggcagaacacaggagaaaaccacagaugguaagggucuguggcauuuggggagaggcagaacgaggcaggcccuguguuuaccugcuucuaucucacgggacagggagcuaaggaguacagcucugggggguuggcuuugucagcuaaggguaccacacgggacugcaacaccuauuggcugacaugucucagggcugcagaaccuacagagaacuacagaaccaaaggcucaaaagcagccaagacuccauggaguucuuucaagccaaaacagacaccuuacucaacacucgagcagcagaggaccuagaaucaaaacuaauuaagcuacuccagacagcccuuaaaacucucaacgacaugccuaccuagcagaggauuucaaccagcaaauugcggguggggugggguggggugggguguggugugugugugugugugugugugugugucuaaaacccaaguguucagcagcaaaugagaaacacuuaguaagauuuuguuuuucaagcgacaggcuaauuuuaaaacaucugaggaauuaaaaagguucuaggacagccaaaaccaugguugagcugggcauaguggcacaugccucuaaucccagcauuaagaggcagaagugggcagaucugugaguucaaggccagccagugcuacagugugagaccccaucucaaaaaaaaaaaaaaaaaaaaaaaaaaggcacaguuggaggagugcgggucugagacaacauaaggcaacaguauccaugccguguggcacgaggacagacagacucauggcuaaggauccggcgcagaguagcagcauaaaguucuuaccucacaagccugacagauugagcuuggugcccuaaggcuuccaaggagcggggucuguaaucccagcauuacuagcucagucugguccugaacuuaucauguugcuaaggaucauugagaaucucauccuccugccuccacggccuccaacucagugguucucaaccugugggucucacccccuuucgggguagaacaucagauucccugcauaucagauacuuaaauuacaacucacaacaguagcaacacuacacuuaugaacaggaacaaacauaauccuacagcugggggucacccagcaugaggaaguguaggaagguugagaaccacugcucucagugcugugauuacagacgugcagugcuggguacugaacucagagcacucugccaucuacauccucaacccuuaagaagcuggaaaagagaagcaauuuuuaaaaagaaagccauuaaauuuaaggaugagugggcaggcugcagagccaggaacacaccucccuacucucauagagucgggugauuucugaagauaaauuggaggauggagaggcaagacagucuccucaacaaaugaggucaggacaauuaaguaucuauaagcaaaacaaugaacuucaaaaaccacaccucauaccacacaugaaccuuaacuucauccaccagagaccuacauacaaaagcaaaaccagaugauucuaguuuaaaaaaaaaauccacagaaaaauauucucuuugugacuacaggaaacaagcaaagauccuuaggacaguaaacaaacaaaagacaaacccuaaaagaaaaaagauaaacaugaccuuaacaaacuguaaguuucucuccaaaauauaucuuuaagaaauagagggcuggagagauggcucaguggcuaagagcacugacugcucuucaagaggaucuggguuccauucccagcacccacagagcagcucacaacuggcugugacuccaguuccagggcuucugacacugucacaaagacauacauguacgcaaaacagcaacgcacaaaaaauaaaaauaaauuuuaaaauguuuaaaaaggaaaggugggaggggagagaacgagagaacaaaagagagggagagagggagagggggaagggggagagggaggagaaaggggaaggaggagagggagugggagggguaaggacaucuguuguagguaguacaagucuuuaaucacagcacuagggagguagaggcaaaugaauaugugaguucauggccagccagggcuacaugguaagacccuauccaaaaagaaaagacuaagaauacuauagaaaugaaagaaaauagcgaacuuaucaaacuuaugugccaacuuauaucaaauuuauauacuuuaaguauaagugauauacuuaaauaacuuucaggcacucaaauuuuucaacauaagggaaagacuauauaaauggccaaaguacacaugaaaaaaaauuaaaauuauugcccaucagagaaagagauucuuaaaaccaaaaggagacauuacuacauccucacgaccauuaaagcuaagauuaaaaccuuuauagcaagugcuggugagaccauuacaaagcacacauggaaaagugucugacaguuucuuaaagacaucacacaaucuggccauuccauuccaacgcauucauccaagacaaauaaaaagauguccacacaacuucuugugaacaaauauucauagcagcuuuauucaaaacagcacaacuccuaaagggccaaaugucugccuguaugaaaauagacuguagauguucagacaaugcacuacacucagaaagagccacucugagccacugacacagaaaaagcagguacccacaucacaacagggaugcagaagaggauauuuacagcgcacuccagagcagcaacgcacgucaacagcaucaaaauguaguggugagcuccagggccgagcagaacgugaggaacacugcacacucagcagggacacucaugagagggacauugugauguguaagcaaggguacuggucgaacucauucaacuguacacugagaacuauacaucuaguguuuauguauguauugauauuaauuuucaagguuuaccuuuugguucuagaauuugagguguaagccuuacuguaugaaaucuuuuagaaaugaaaaucagaaccaaaugcuuaaaaugauuuaaauuuguaauagccugggaccaaauguuacuaugcaaauaacauauaacacagaacaacuuaaaaauuccauuuguguauguugugugcacacucaugcauggaucucaaaaggccagcuuuccagaguugguucuccccuucuaccaugcaggcucuggggacaaaugcgcauucucaggcuuggcagcagguacaacuaccuacugagccacccugccagcucaacaaagaauuuuugaaaacaaggacugaaacuccugaccauuacuucauuaagguagagaguacaagaaaacacaguacccuggguuugaagcuagaccuaaaggcccucagcaacaagguggagcuguuacucucugaggucucucgcucccuucugcccuugucugcggcuuacuauacacagcauggaaauguacuaagcagacacaauugacuccguuuaaaacaagacuuuacaguuuuacuuuaaaaacccugaagcuguauuucacuuauaucgcuugacucauuguccaauuagguacagugugugcaagagugccuaauucuuuguuucuuuuucaagacaggguuucuccguguagcccuggcugucuuggaacucacuguagaucaagcuggccucuaacucagaaauccaccugccucugccucccgagugcugggauuaaagguaugagucaccaggauccugcauaagagcauguauucuuaauccauauacauacacacacacacacacacacacacacacacacagagugugugagcugccugcccaaaguguguuguaucaauagcauucugugacccacucaaugugucugccaagguugcagguguuccuuaucaccauucuuuggucccaccucuuauucacccaagugacagucacuauuacuaagugugauauaucuacaguuuacagcaucaggagguaaacagaagcacaaaguuaaagaaauaucacuaaugcuucauagaacuguaaaaaacgaaccaaguauucaacaucuacaaaaaaguuaacuugauuugcagcagucccuaccuggcucauuuucuacuuuccauuucaccaagacuuaagugaacccaucaaaucuggcccuccaaaagcugcaggugguuaacacacacuuccauaaaggugacuaccaagcgacaacccugaauuaugccaguguccuucacuaggacaugugaggacaugcacugcagcuucugcgcaggaccacacagacucucuaccuugacacuugucacacgugcccugccacugucccuuugcacuaacagagaucacgucucaucaguccuguaccuaaguuucacuugugcccugcagucacucuucuggacucuuacauuuuugugacauuccuuuagcagguuaaucaggacguugcauucuucggugugcaaguguggagacaaguccggaugcaucguuaggagggcgaguaggagcagaccuguggacacaagagugcguugaguacgcaagaacacacuuguaauuucaagagucggcaauggccucuaucagaagacagugcuaggugugagcagccauaauggaagagcgucaggcugguaggagcuccugcuuuaaggacuuugcagacccccggaguuggguuacuagucacucuauucagguaaaaguuuaccaauuagaagaacuggcuuauugcuucuuuuaaauuguauaucccucugagagagguauaaagggccauaagucagucucacauuagugugaauuaaugcagacggcuuucuugucuggcugagacacuuagcuaaugaaaguagcuuucaaauuuaacagaucuaugcacaaaaguaauuacuguacugaaaacagaaauccaagcucccaggauuaguuuaaugggucaacuacaaauuagaaaauuagugaccaagguuaagaaaauaauuauuuugaagugucuacaauaguauuacucugcuauuuuuuaaaucuacauuuucuaauucagaaacaugaccaaaaggaccacuucauuguuuuaagcuuaaaagcgcccaaaaaagaaaauguuacgaacuaccucagaccuaauaagaaagcuacuguugccaggcauaguggcccacgccuuuaaucccaacacuugggaggcaaagacagaggcaggcagaucucugaauuugcaacuagccugguuuacaaagcaaauuccaggaaagccagggcuauagagaaacucugacuuucucaaacaaacaaacaaacaaacaaaaagaaagcugagggguggggagggaagagggugcugagagauggcucaguagucagagguaagagguaagagcuugcugucccccuccagaacuggaguuucuucccagcacccauaccaggcagcucccaaccccauaacuacagcaccucuucuguccuccaaggcaccugcauagacacacacuggcacacacacacagauauacagauacacacacacacacacacacacacacacacacacgucucgucuuuccuuuccuguuuugaaacaggguuucucuggguuaccagccccugcugcucuggacuugauuuguagaccaggcuggcuucuaacuugcagagaccgccugccucugccuccccugugcugggauuaaaggcgugcgccaccacugccaggcuaaaucaucuuuucaaaguaaaagacaauacaaguauuggaggggcugcaaagaaacugggagacuggaggccuugugcaccgcugauguccuguaaaauggugcggccacaugagaacacagugagucauguagccauuccgacuacaccacaggggcccgguccugccaccucagcacucaggaggcagaggcaggagaaacaagcuuaaggccagucugacacaguucacgacaaaucugaggaaaaccuaggccacauagcaggacugucucaaaacgggagagagaagagccagcgguucacuuaccugcucuugcagaggacccagaacccacagggcagcucacaagcaccuaacacuaguucugggggucccaaugccagcuucuguccucugcaagcacugcacaagccuuacgcagggcaaucccuuauucauagaaaagaaauguuuuaagggaaaauuuaaaauaauuacuauaugaccuaguaauuccacacuuagaaauacccuucaaagaagugcaggcaggcucuugaggagagaccaagauacccacaugcacagaucacucccaagagcaaaaacaaaaaccaaauguccagccagacaaacagacaagcucucccucggccacaacacuggacuaccauugagccuuacgaggaaagucacuauuugccgcgacagggaugggguuggggauauaaagcugaagaaaacauucucaaagcaaaaccaaaccacaccccgcagugacgauggcguccccugaaauccuucguccacaugcagacauaaagcaggagcugcuaggcugaggacaugggagcuguggaagaggcagucccuuugcagacacacacagaaaggugccguggaagacggugguggccgccauacuacaugcaccuggguuuugguuuuuuauguauauguguacacuguagcugucuucagacacaccagaagagggugucagaucccacuacagauggcugugagccaccaugugguugcugggauuugcacucaggaccucuggaagagcagucaguguucuaagcccccguucaccuggucaauaccacuccuggaaaugggucagauggcacauucugcguuaagcauauuucacuacacugaagggaaggaaagaaaaaaccaaaaagcaagacauuucauuaggcaaagaguucuuagaugaaucaaaggaucauccaugaaaaaauauuuugauuaucucacgaaaauuaaaaucuuuugcacuguagagaacccaguuaagaaaauaaaaagucccaggcuggcaagguggcucugcacuugaaacucugcacugaguuucagucccccggacucauauguggcuaacucucagaagccacacaagcaccacagcacgcaugugcccacccacacacauacacacacuauagcaagcagaagcagccuugagugagcugagucccagguaaauguguuuuacugacauagucacggccgcaucaaggacuccagacccucagacccauggagaaaauggcaaagccuuccccucuggucuguguguggauauugcuaguguguaaagaaauguucaucacagcuuucuccuccaccccaccuccccuacagacagugcuccuacagagaucagcuaaaccugucuccuggauccagcugucuucuauuaacuccgucugcuuaucugcaugcaguaacccacugucuuccuugauucagcuguaggcaauaaccccacugcccuguucaacucugcacaauaagcaagcugaguuggggagggugcuugcuaucucuccagcuaaaagcccagaccaccugacccagcuuuccuguuugugugucgucugucuuuuccuuagccccuaaucuccccagucaggucugucccugcagcuguccuagauguggcaacauaaaaaaaauaaauaaauauaauuuuaaaacauuaaaucuugguccccccccaucccccaccacugggguggugugaugguuuauauaugcuuggcccaaggaguggcacuacuuggagguguggccuuguuggaguaggugugucacugugggcgugggcuuuaauacccucauccuaguugccuggaagccagucuucuccuaggcuccuucagaugaagauguagaacucucagcagcuccaacaccaugccugccuggaugcuaccaaguuccccaucuagaugauaauggacagaaucuuugaaccugugagccagccccaauuaaauguuguccuuauaagaguugcccuggccauagugucuguucacagaaauaaaacccuaagacaggugguaauggugugacccgugucaucagcuagaccacacuuacagcucuagguuccagacucugacagcucugcacagguugaagaaacacaggguacagguagaaucucuguaauuucugaucaguuucacuacaaaccuaaaacuacacuagaaacuacaaucuauucaaacaaagaaaccacaaagagauuuguagacuguuaucuaagaaugcaaaaaggucuacaauucaguaaaacaauccaaucuguaagauucauuagaggggcaagaccugaagaaauacuucuacgauauaagaauaguuaaguuuaugaaguccguaaaaaauauacucagcacaagagcccacgcucuuccagagguccuggguucaguucccagcauccacaugaggugguucccaaccauguaggaaguucagcuccagaagaucugaugucgccccuggacuccacagacccuacauucaaacauacacacaacaacacaggcaugugcacauuuacauaaaaguaaaaacuuaagacuaauuucuaaugcaguaccgauuaccucaaauaccacugaagguuguacugacagugaaaacccaaaggcuuuguagaugcucaccacuaacauagacaagcaagcccacugcgcuugcuuacagcagagucugcagcacugaacugugggauugagaggcucaagaaaagccuguggaaggcagaggcaaugaugcaugcuggcuuaguaaacauauuuuccagggaaaugccaaguuugacuucccacuuucuggguuuugugauguauuucucuccagcacacaagagcauccuguaucagccuauccugucagcauucacaaaucucucacgaugguuguccgcgucuucuagcaucugcaugacccggcugguagcagaugcuccugccaguucccuggcugugaacuuuuuuggugccuuagacuugauaacuucuuccuccacuucaaccgcuuuccuuccuucuuccugcagguccaucagcucuucguccugacgaucucaugaaucucuuccucauugaugucaaucccagcagcuucccuagagcuaaugucuuguuacuggcgauaucaacagcaucuucgucaaagccuuucaguggacucacauacaucuucagaacgcucuuccagaggccguucauguacugcugggugacuucuccccacgcagcagcaauauuccagauagcacacuggauagugacaccuuuccaaaacacgaggaguacuuggaaaaacuccacugcuuccucagucuuagcaaaugccugguaugaacugugugcuucaaaaguagcuaucgcgccaucguccacugguggaaacagcaugaugguguucaguggcaggcacaacacucucccaucaggacacaugucaaccaugugccaucgaugucgggagcaucgucugggaucagaaggacagugaacgggaugcugcuuugccuacgauaccucuggcuuguagaaugaaacaguucaggaagcaauccuucaacacagcucaugucaucugcuuucuuguuauggcaauagaguuaccuggccuuugaaucccaggauuauccugcacuccgggugaguauaugcacucccugggauauguuuccagaacgagcugguuucaucaacauuaaauaucuguucugguaaguauuucuaauccacaauuacccuaugcaauguuuccuugaaagcuucagcagucaacaucagcagcuacugccccaccacggaccuuaagaguaugaaaacuguguugcuuuuggaagcacaggaaucgcccauguccugcuguaaacaucuggguauauguaggagcaguguggaaggcucagcccggcuccucagcaggcugaguggcaagcgcugcacaugcccuucuguccagcccacaaaucguuucucuguauccuugaucgguccagcucuccuagugacaauggcagacuuaacaacgugaacagugaugauuuuacagccccaccaauccccucauccuucaagauggcugagacuguggacugggaaacuccugacucaugggggaugaccgucacuggcuggccaccuucaugcugggcaauuauuuggaguuucaucuuuaaucaccuuccuuguuuucuucccaccaggagcaggacaccacagaaggacauuuuguagacaugaugggaugccaaaccgcaauauccaaaagcacaggcaacacggauaauguagaguuuucccugugucccugagcuauggccaggcgcugcgaccugccaucaagacaccacaccuucagccagggagaggacgaaggcaacauccagcagcggguuucugcggcaguuucugcagcacucuaaggugaacuaccucuguaucagaagccagacaauaccaagcaggguuagggggaggagagaugaucuagauaaaguaggacacacccuucugcagcucauaccuggguaucugcccgagaaagaaaagccuaaccucacacuaagcccuaugugaacauaugcaaaagcaguauucuuuuauuauuacaauguuucuuuuuuuacauagggucuuaccaggcagcccugguugguuuggaacucacaauguaaaccagacuggccuugaucugagagaucugcaggccucagccuccaaaggcuggaauuaaagaccucuggcugggagcauuaucuucagaguuagggcugggaauguaaagccacccaguuucuaauuaaccagcuaaacauauaaaccacuguggccuaacuguauucuagagacucacuagcugcgugcucuagucaugaugaaaagcccuauccuggaggaaaguggacaccagggacuacacgaugagacaauguuuacaaaaggucacauucguguucacagaaacagacaccaaaccacugguugauuaggaauaaaggugaaaaugaggguuaguuuguaaguggacauaaacaaacuucuuaaagugauuaaaauguucuaaaacuagguccugguaauggcugcacaauucuacaaauggacaaaaaucgcuaaacucacuucagugggcaaauuugguaugcacauuauacuucaauuuuuucuauuuaaaaaaaaagcugagaaauauguauuuauuuauucacaaacugcccacuucaauuccaacaaauaccaaagaaagccuauauaaauaauucccaaaaaacuaaugcaaagccacuaccuuaaggugcaauuuuaaccacuaccuucagaaacuaccaaacauacaccuauaccacagcuagagaccauaaaucaaccuguuccacccagcuaaguauuugaaauggaaaaugcaaacacauccaaguucagauuuuguuugcucugcacugacuacagguuauauuauuauuauuauuuacuuuauguauauaugagugcucuguuuucaugaacuccagaagaagaaacuagauuccauuacagaugguugugagccgccaugugguugaugaaaauugaacucaagaccucuggaagagcagucggugcucuuaaccacugagccaucucaagcccuacagguucuuucaaugacacaaaugugugccucagaagcaugcggcuugauaucauucauccacgcacgccaucggccacuguuauggcagugagugccaacaucuccuguguacuauaaguuaacagaacguagaauggaguuaaauuuguuuccaucucacuuguauuuucugaaaacacagauuugccaccuagaaaaugacuugaauauuucacuucagaaacauacuugucaaaauauuuuuguacauuuugaucaagcagcccucaaauuuguuccuuuauaggucaaacacaaacuuaagaugcucugagcuauuuaauuagcaaagcagacauauggucuccaacuucugauggcccaccuuaucaucucucgguuucauuaucauagaacgaugaaaugcauuuaggaccugcuguucaaaucuuaagcuuuucauaaacuagcagugcaggccagugcuuucucacggugcuggguacuggugaccaccuggcucgugagucccacagcguagagaaauguaugcgcugcagcacacuggauggcuauuauuccuugaagcacuguguuuucuauuuccacauucuuuucacaucuggaaaaaagcauaucuauguaucauaauauaugcgauauuuuauuuaaaaagaggguuuguguuagaagauucugcuccaccuuacacauucugggcacggugacauaagccagggagagcuaugguguucaguccauaagguauaccaaauacauuguuucuucagagcugagggucaaaccagggccaugucuagugcuaaccaagcaucggccauugcaauuuggccuuaccgugcccuuuaaaugaaguuuugaacuuacagugcauuuaucuggacauaauccuaccacaauuuaauaaguaucuguacuugagaaagcauuuggccaauaaucuauauauguguaucauagacaaacaaacacacauaacuacauguauuuucuucccaucaugacaaaaguuuuuaaacuuuguauauuacuacagugcuagccagaaaaaagaaaaaaagaaaaauuguuuucauuuuauuuuuaacugagaaacgaaaaugggcuuuucucacugcuuauccuggauggcuguuucaaagaauaaaauguuaauuuuguuuucuuccacucuuggcaagaagaacucuauuuaaccuaaguccuaaacacgcaaccuuauggaacaaaucccuugcuuuagcgccaggaagcacauuuuuaaauagagugacucuaguaugaggaaaugcgugcugauaagagaagguauuauaagaggugacaucccuauauuuuaacgccaucuguauuucuuuuagagagauuuugcuauucuggcugcccaagaaagaaacuuacacuacaguugccauuccuaauaguuuaaaauaagcaaggagcuggagagauguuugguggguaaagcucuugcugugccuuaggugucugcaccccuuauugcggagaucgggucaggcagaccccaagaagguucucauggcuagccaaccuagccaaaacagcaagcuaacacaguuaaggagaaagcaggucucaaauccguaaggcagauauagacauagagcaugaggguuggcuggacugaggucaggcccaaucccaaaacagacacauacaaaaauacacacuaauuaaggccagcaagugcaugaggacuugaauucaaucuucaaaacacacaugguggaaggagaaaacuaacuccagugagcaucuucugacaggcaggcgugcacgcacacacacgcacacacacacacacacacacacacacacaugaucauuucucaacuaucaccuuaaaacugcuucucaaaagaauaggccucugccgggcgugguggcgcacgccuuugaucccagcacuugggaggcagaggcaggcggauuucugaguucaaggccagccuggucuacaaagcgaguuccaggacagccagggcuacacagaaaaacccugucucgaaaaaccaaaaaaaaaaaaaaaaaaaaaaagaauaggccuccucugcaucauucuggaacaaucuccuacuagugccagguaggcagguaaguagucugcuaagaccagggaaauuuuagaggaaaaaagaaauaaaugucugcugaauguugacauuuaacacugaaaauggagaggcguauuuucacuucgaucaaccaaauaccaaggccuggauguacaagacagaaaagaugucaagagaaucccuuugccaaggcaaaguugcauacauuuaaaguggguuuuguuacuaacacagggucuaguguagccucaaauuccuuauguugcugagggugaccuugaauuccugauucuugccuccaccaccuccccagagcugagauugaagcaaaccauccuacccuccuugccugggguuuuguuugauuucgagaaguuuuaacagaggcuucuaauacaucuauugugaaaacacucacagucguccucgaagccuaucuaacggacccuaaacauuacuuuccuugucaaguguaccgugggggaucuuuacagauacccacaucaccagccaguccagugacuuuucaguaaagaaacuuuugacggcagcucccuagauuaguuaucagccagaacaguuagcucaaugcgcccucagugucacgcaucuccaaaguuuugcagcaggguacgcgcacucgaccaggcgcgcgcccaaggucgcaaugccagcgagcggcgggcagaucucagcagugugacagcucaugcccgcggcucaccaagaagaguguuccuaguaaagguccaagggcagggacaugggugaaccuagcgcggcgugggaagcuaaagagccgcguccuuccgccacaggcagccagaugcccggaggcugaaggacacccgacacucaccgucacucagccccuacaagaagcacagaaagagaagucaccgacacggagcccgcagcucccuuaggacuugcaagcaccgacgcuccgcgcaugcgucauccugcaugcaucgcuccgccuggaccgguccacugucccaugcugagggggaucuagggccaucccaccggggcucggcggggacagcacacagagaugacugccagguggaauucgagacggagaacaauuauauuuacaugauccugucucugaguacagcgacucuggggaucuaaagcguuuuccaucaggcgcccacagccgcguccccccgugcagccgaagcagugcggagggcuugccaggugggcggggcccgagcggccauuggcggcuucaaaagcaccucggcgggaaccgcugcagagacggcgggcgauguggacugguaaggcagccucagcgacaccgaauuggacucggaggcggcgggaggacuacaggagccaggccucagacaucuacgggggccuugccacggcgcaguuccgccacgggaucuuagccuaggagugacacuaguggaggccggguccgggccaagagggccgggaugagcguccauggcgucauauccgcccggaguggggcgggguuuuaugucccuuggcguuuaugccauggaggcuccgggcugcccgcucaagagcugcuuuacuuugauccuuagguuccgucgagccuaggugucagcucucuaauuccuagccucgccucaguuuuuguccaugccuccuguugcuauacuccuugugcuccaugcgggucuaccggaucguuauugucacguguacauucaacagccuugucuuagcugcuaccaugaauaaagcgcuagaaaauagaaauugaaauaguaacagggcagaaaguucacucaaagacuugcuaacuuuguugauguguuacgcccuuucugucauuucuuuuaggaagggcauggugcagauagaucacucagaauuaagaaucuucggaagugcuaaggauugggcaccccaccccgaaggcccugaucuccgaaguuuauagccgcaucuggccuggucaguacugggauaggagaaaugccugcuuugcauacacucuccucuaauuuaccucacugaggaucaggaaaacgcucucagauguugucacgaacaagguguugguuuaauaguugacagacaguggaacuauauccuucccuugugcauaccgcuuaggguggguauccagucacucuuccaucagucauuagucaagugcauaugagauuguucuugggugaccagacucgcugugugauuuggcucauggugacugaaauugcuaggaucagaaccccccagcccuggcagcccuaacaagcuaggcuccauaggccacuuaaaaggacaagucuuuuguuuguuuguuuguuuguuuguuuuguuuuuucgagacaggguuucucuuuauagcccugucuguccugguacucacuuuguagaccaggcuggccuugaacucagaaauccgccugcuucugccucccaaguacugggauuagagaugugcgccaccaccgccuggcuaaaaaagacaagucuuaaaugagaggcagaaaagagacauguauucaguguggccacacugggaagagcaaagaggucuagugacccacacaccaaguguugaguccugaaacagaagauucaacagaaagcagaggguauacacaacuaagcagcccuagucacggugugguccucccaucucugagacaucguugcccugguguugcagucccuucugcaagagggucugacaaggagacagaaaagcucccucugacuggcaccaggugucagccuuuccuuccccaucagaucccuggguugaacuccaugucucuguggggacacucacaagugccucuuuuuagaaugacuuugcuccugccagaacaguuauaaaacggcuauagaguuuaaaaacauaguugugaauaagaucaacauagucccugucuugagcagaaaaaaaaauuaacguagcuaugauaaaauuauaaagccaauugcaggugguucuguaaaaauaauaaacgauggaagauuggaaaaaaaaaaaaaacaaacaaaccacuguuggaugauugcaguaaguuuccuggggagccaggcagugguggugcacaccuuuuuaaaugaacucagcugggacuagagagguagcucaguugguggaaugcuugccuccgcaugcaguaagccuuggggucaucucccaaaccacaugaaaccggaugugguagcgcacacguguaacagcagugccugggagauggggacaggaagaucagaaguucacgccagccuggguugugugagacccugucucaggagauaaagauaaggagcuagagagcaacucguuguugcucuugcagaggaccucaguggaggucccagcagccacaucaagggcucaccacugccucuaucuccaguuccgggaccagacacuugucugaagggggaugccagcacaccuacguuauaauguucacacagucacauacucauaacuaagaaagaaagggauaaaguacagucagcauaaaauacacauaucuuuagccaacaggaaaucacaugcagcauucaagaagcuuuuguaauauuagaugccaggcccagccaggccucucaugaggaauagccaucuauuuacuucuuuggaguccuugggugugagggaagcgacaugagugacagggacaccaaagaccuuguuccuuucuagaagacaagcuggccaaggaaacuuaaaaaagucuacagagacuuuguuuagucuucaaguggaaaugaugccuguuugucgggcacuguggcguaugccuuuagccccagcaugugggaggcagacacagguggaucucuaaauuagaugccagcuugguccacauggugaguaccaguauaaccagagcuauguagaaagacccugucucaaaaaaaaagaaaaagaaaaagaaaagaaaagcaauugugcuuauuugcauuuuacccccugaacugguauccaauugaggcaacaguaggaugagccaugccuuuuaaaggcucuaaagaaagauaaaaggcucaggcucucccuucccuguaccacaacuuuaguacgccuaaguaucaccugcugccgagggaacuaucccauggucggggcucaggacaaugugggcacucgaugacguugcuugcagacacagagcaggacgguauggucaauuggcagugcacagguguccacacuuacugguucacauaucauagggagucagccacugccuaaaguauuaccuggaaaaguccaggauuaagugucuaaguaacucucacucuacuaggugugccacaguauggcagagggcuuuauugcaggaucaugugugaguggcaggcugagaaggcagccauggucagauggcuggaagaggccagagagaguggggaaagcccuccaguguagcacugcccuaggcagccuccuuguagcuaaguuacaguccuguauccccaugacgagauuaacacauccugucacuuuccaccuuauauuuugagacagacucacugaaucugcaguccgccaguucugcuagacugccuggccagcaggccuucacaccucaaggcuucugcccccccaaauacacacacugugcuccgccaccaggauuuguacaagaauuguaagggucagacucagucugaauguguaacaagaucuuuacugacacuccaucaucuccugugcucuuaaaggaagaaaauccuuguaggaaacuaauccaagucccacuaggccugacuucccaugagagugcauuaauccccucugagggcuguaucccugugaccuaccuaaucacgguccacuaggcuucuuaaagagcuagcacaucucaguaccauuaaguugguauucaguacagacuuguggaguccaaacccuauccauauuauaacagcacuaauugauauacuucuaauuccagcucuuagguugaggcaggagaccagauuuggcuucauagaagauuccaggcuaacccugucucuggggaaaugaaggaaauaaaaucuggaggcuggugaugaagguguagcuuaguugguagaggauuggccugacacaggaaggccgggcuuagcccaccacugacgacugggaacgcagcacacugacucccuccacaaucccacgcuuggaaagcagaggcugaaggaccagaagucgaagggucaggcgggagagagagggggcuuagcagugaagagcacuugauguuccuuuuggaagacccaaguucaauugccagcauccaugucagguggcuccuaaccagcuccaacuucagguccagggagucuggcaccuuuagccuccuuggacaccugcauucaugugcaaggcaugcuggcacaccaagaaaugagggguaaauauguauauuucuuuauugguuuaaagugauccuuggccacauagugaguuugaguccagucuaaggcuacuugagaccauauguauaugcauguauauaauuauguauauauguguauauauauacacacacauauauacauaauuauguucacacaugcagcuuaaagaggaauacacuacuguguucuuuuuguuuuguccaagggcugaagagaugaaggagaauguugccgaguuucuccggaggaccauccugaaaaucccucugagugagaugaagagcauccuagaagccugggacuuuuugucugaagaccaacuacaaaccauaaaccugaagcagagaaaggacuaucuagcccaggaagugauucugcuaugugagguaacaguguucaaaauuaucaaccaaauacauugauacaauggacuauaguuagagcaguauguacauacaguuauaggguuugguuuuguuuuuuuaaagcaaagcuacaaagaacaauucggggugggaagaacaggcuuuccagcagaugggcuacagccguuagaugcucgcaugcaaaacaccuuugcugcucgaggcagccguguucagucccagaagugucgaugcugaggcggggauaucuagaguucagauaaagccugggauaaauagugaauucaaggucaacagcacaggaggacugucucacaaacaaacaagacaaggccauuccauuucaucaccucugcuguuuaaaaaagaaaguuggacucaaauuagauccaugauccaaaugcaguaccuaagacuaucagauauguggggaaagcaagaggaaaauccuugugauacuggacuagggaccugcagcuagcauguuagaaugucgcaagagucauuaauacaaaaaaaaaaaagaaucaaaauaauuaauaauaauaauaaugguaggaaggauggcuugguggucaagagcaccagcugcuuuuccagaauaccugauucuacucccagcuccaaaguggcagcucacaacuaucuguaaucccaguuccagggcaccagggacacacaugguacauagacauauaugcaggcaaaacacucagaguaauuuucugaacauuuggcuagacgcuucccaacagaagaccauaaauaagcauaggaagaaguguucagaaucacuagucaucagauaaaugcaaauaaaaaccgcaaaauacgguggcugggaugaccaggauagaaaagacugagcacaccuguuuggaauaggugggauuccguuccuucuggugcugggcacuggacccagggccuggagcaugcuaaguaggggcugccugcugagcuguuuguaccucaagcccagcauucauuuugaguuuuagugcuugggguggaggccagggucucagaucugcugaguuagugucuuacccgagcuguauuucuagcccuuaacaauucucuaaaagucuaaacauuugccacuguagauugagccaucccacugccagacauuuccucaggagaaacaaaaacacaggcauauccacagaaaggcacauauguuagcacagugcucaagucuaaaaccuagaggcagcccaaguccauccacagguaacugugucuauucacauaacagacaacugcuagcaauaaaaggaaucgagcuauagaugcagaaauguggcuaagugucaaaauaauuaugcugaguuaaggaagccagaucaaaaaagaauccaaccuuauguuaacguuccuauaaaacuggaaaauacaaauauuaugacagcacaaggauccguaguugucugagcaccaaggacugggacgaagagaauuggagacaggaaaggauaggagagagagagccacagggacacuggucauagagguugcugggcaugugugccacauugauaugacaguggccacaucugaaaaugugguucugaggaaaugcccugacagaagcagcuccagcaagcccagguuugcucuggcucccauuccuggggacucaguccaucgcgacucagaaagcauggcagccuuggaggagcacaggcagcaggagcacccuggccagucaggcugcgugcacccccagggagcaggaaguauggcgggcuccagagccucauggucacucucugugaccagccuccagugaggcuccaccaccaccaccacccaaacagcaccaccugcuggugaccaggugcucacaugugcgccuccggggacauuucacaugcaaaccacagcagguaugcagcuucauguauguucaagcgugguuuuuuguuuuguuuugaggcagucucuguaguccugacugaccucggacucaucacagcccuucugccuuagcgucccaagcaguaggauuucagccugagcccccauggguggcuuuuuccuguuuaaaauguacauguuaagugauacgugggaagugaguuucaggagagggugggcuaagguaagaacuggaggggugucuguuggcuccgaagacgcuagagccuggcgcuagauggccagaacaguaagcacuugaggcgugccgaugggaugcucuggcuggcccugaaauaggcuugaggggcuggugccccauuuccuaauugguccacccucucuuucaggacaagcgugcaagucuugaugacgugguccuuuuagacaucguguguaaguucuggggauuugucauuacuuuggaauguuguuucaucagagggaauuucuuauguuaauacagaucccagggucaagagagcuggcucagcaguuaagagcacuagcugcucuugcagagguccugaguucaagucccagcauccacacggugcucagaaccaccuguaacucugguuccaggaaucugauguccucuuguggccucugugggcacugcauguacaugguacacagacacauugaggcaaaacauacauauaaaaacaaacaaaucuuuuaaggaugcggauucuagaguccagaggccugguacaagaucccugcucucucacugacgggucuagaguccuuuauugaguuuuaucuccgcucugacccucagacuucgccuaagucaguggacauggaagagucagacccugucuuuaggacuguggaagcucaggaccuuuggagacaggaccuggcccaucaugagcgagcauaaaguaucaguuguucggcuuuguuacucauuggaaaagcaccacugagaguuugucaugggcgcagccucucgugguuugcuacuucuuagguuucauuuucuucaaaauucacuuacuagacuuucagaacauagacccuaagaccagauugcuuggguugguuucacgacucuaucguugcuugccuguaagggugugugugugugugugugugugugugugugugugugacucacacacuugccuugcuacuuccuuuuggcaaauguguauaauaacgauaauaaucaagucagacugcggugagaucagaugaaacuacaggucaagcccuuggaacagaaggagucucucuggauauggggcuuuguuucuuacauuuuauuuauugaaaggggcacacgagcggcacaccuguggacauuaggacagguagcugaguaagcucugucucuccuugagggccccagggaucaaacggcugaacugucucugacccagagcccauuuuucuuaaaacuaauuuguugucuuuauauguggggcuaugggguguccugcaucugcucggggcucgggaaguaggaugcaggaguuuugacugcgcuuaacccacaccagcguagggcacagggcaggugucgggcugugggacccuauguucuauccaccaccuagacagcggcucacaucagucucaaacccuagucacaaaggcucuaauaaccacuucuugccaccuuaggcaccaagcccacacaucauggacuuacaugcacguagacauaaacacauaaaaugaaaaugauuaguuccucaaaaagaaaaggugggcccacagaagacuggugagcagagcaggcgacacacaagcuuguagauacugacugggguuuaucugaggagaaagguuaccuaucucagagauaccuagugugugaagggggauuaacuuauaggaccacacugggacuuccuuuucaguggucacgugaggaggcuuccuugagagacaguauucgaguuagagccaaaagaugaguucgcaguagccaggcagagcagagaagcugaggagggggaagcugccagggauggggugggagaagaguaccugagaugcaagagcagaggcgagcuggcuccaguggaggggaacauuaagauaacagagacuuggaagccacuagaagggucucaguaucucuccuaaugaugucagcccuggacagguucugagccaaaacaauuaggugccugguuuguuuguuuuuuguuuguguuuuuuuguuuuugucuuuugggggguuauuuuguuugguuugguuuugauuuugguuuugguuuuuugagacaggguuucucuguguagcccuggcuguccuggaacucacucuguauaucaggcuggccuugaacucagaaauccacgccugccucugccucccaagugcugggauuaaaggcgugcaguaccacugcccagcuaggugcuugguuuuugagagagcauguugguuacagcagaagagaggccgggggugggggugugaggauucagacaccugugggaucuucuggagaaguauaaacgagagaggaaggcagcccacgugaggugaucgucaggagagaggagggugagggccaaggcagagaagggacuuacacccagcccagggacaaaggcaaguggggcgagcuuucaggauucuuugcaucuacacaugagcuaggggccuccccuuuauucuguggaggcugcagaggcgggucuaugagauaccucaggcgugggguaggcuagcaugugccuaucgcagguacauuugaucuaaguccuccauggucaccuuuuaggugaugcgcagcagagcuuuugacaagaguucugacuuucugcuacaccagucuuacucaggccaguuagcaagucuugccaacucuaaacacagagucaacacuaagacaacacuaacuguaagcccuucucucucagauacucaauuucaucggcaccagaagcuuuggaauguuuuucagaugaguaaggaaccagguaauguuuccugcuuuaaauuaaaugucuagauugcugcuuugguaguuugaaagugaguaccaaauguugucuuuuuugucaggauuuuauuuuguuuuuuuguuuuuuucugagacauuguaucccuguaugucauaggcuagucuagacuucacucuguaggcaaggcuggccuugaacucacuguguagacuaggcuagucuggacuuguggugguuuuccugccuuuaccuccagagggaugagacugcaggugugugcuaccacacccagccgagcccucugcucuccuaggcuuuuggaaagccgugacuguuccucauguguguucccuggcacuuaucaggagcaugugugugguauggucguuacugcucuggggugcaggggacaaagacauuguaccgcucuugacuuuucuuauuuauuuauauauuccuguguuuugacaggugaagaugucgaccuuuuugauauggaacaguuccaaaguuccuuuaagagaauucuucagagagcauuaaaaaacguaaggauccaagccuucuuggauuucuaugaaauucaguuuaaugauaucgggggcggaggguggggugggggguggagauaggucauuuuaccuaaaccaacugaaguauuacuuccaucucucgccugcccaucccacccaguacaucucaggagcaacacuuaguggaacucugcuguggcagcagcacccucaguuaacaauguccaguucauagcugccugccacgugaggacuugauaggucgcugaaaugaccaagcaauugaaucuuuaagcuuacuuaaugaauucccauuagaugguccacaugcagcugauggcucuucuauuggucacucuugccuagagugagacgcuuugcuguuccaaccaguaggggccacagagcuccaaagaggagcacacucuugcugcucaccaagggacaacacaugauccugcgaacccgcagcccagacagggagaguuccucaccauugcaccagaggaucaggaaaggcagccuagcaggcagcauagccaccugcucuuccugcaguaagaucccagagggaaggaggagcgagcuggcuggcugcucuucagguucuccuuuccugggucagaauucugagguggacuggagcuagcugacaaccuagcaguggccauugaaucccagagcugacaaccuagcaguggccguugaauuccagagcaaguccagucauggcugcaaguuuagaaagacuaauggcuggcugugaaauggauaccauacagccuccugugccgccacauuccuaaauggcucuggcugcugagacccaugggucaggaucaguguauuaagggcucauugccacacaggaauccugcuguaaacaaagagacaaacuaagugugugagccugcagugccaaaagggcuucuagaaaagccacccccucccccuuugauuuguuuugguuuugagauaggaucucacugccuggccagaacuuacaaagaucugccugccucugccucccaaggcugagauuaaaggugugcccagucagauaccucauuuuucaaaaugucuuuuauuacuuuauguguauuaauguuucucugcauauauuucuguguacuaaguacaggucuggugccugcagaagccagaagagagccucccaugcccuggaacuguaguacagaugguugggagccgccccaucggugcuaggaaccaaacuguaguccucugcaaaagcagcaagcgcucuuaaccuauaugccaucucuccugccagaguauaagguuuuuuuaagggauuuuucuuucucagauauacuuuacaagguguaaauagaucuucauaagauaaucacaaaauguuuucccaaacagucccaaaaugguaucauaagaaguagaaaaagagccaagugugaccugagcugaccuccaugugucuuguggcaaugugcacacuaacauacuuauaaagaagcuuaauuuuuaaguagaagaaaagacugacaggugcccacaaugcaugaaaaauuauucuaacauugauugugucucagaugcccgugguuggugccauggugagauuuaaccaggacgguauguuuucuucuaagguuacagucagcuucagagucuaugagaaggauucgguguggauccgaguugccuggggaacacaguauucacagccaaaccaguacaagcccacguucgugguguauuauccccagacuccguaugccuucauuucuuccugccaucugaagaacacugugccccuucuccaucagguaggaacaggggguacagcagcuggagugcccaguagcuagaaaccacauaccuagauaaaugccuaccucccguucuaaggagagcguuucuccgucggcuaugugacagaagauauuaccuugaucuagucuuuauugucagugugaagguaaagcguugcuuaguauuaaauccagcaaguuccuaaagguagagaugaguugucgagguucucugccccuucuuuauacucuauccaccccaaacucuuugucacuuugcugucucaugucaggauuagugcuuucuauaucucuacagucugccuauugauggcaacugacauuuaugaccacuuucuacauguaauguacacaaaaauacugccaugucagagguagccucucucuuagggguuugccuuugugucuuauucacuauuguauuguugugaggagacgccaugaccaaggcaauucuuauuaaaaaaaaaaaaaaaaugcauauaacugggagcuugcucaccauguuagagguuugguccaguacagucgugguggggagcuugucagcccauaugacacuggacuaaagcugagagcuacauccucauccacaggcuggggggacauggguucuaggucaugggcuuuuaaaacuuuaagcccucucccagugacacacuuccuauagcuacuccacggaagccacacucucuaagcaucgucagucuuucagacauuucacucccuggucuaagcaucagagcauaggagccucugggggccauucuuacucgauccacaguucugugcucuggggggguccuggcuucuuucccaaaaagaauaacucaucccaaauuugugcuagucauuaugccuccccuguuagcaucuccugcgcucccagaguccagcgugaguugggugcaggugagcugcacggcuccccacacaccuucugucugguaaugcagcucacacuucacugucagcagcaggccuuaggggcccacaagugaguaaggagauaggguuacauuucuucucacuugcaagaguggggggggcgugucuugcgacagggcucacccccugcccucagccucccuagggccagggucucagguguguacugcaccccacacagggcucuucccguucucaguugcagcgccugcauuucacugagcagucuguauagacccacgcacaacccuaacagucucgcuccucucccuccaaggcacugaaagucgccagcaaacaccaucagauugugcauuuggaucugaggagcaggcaccuggacucacucaaggcaauuguuuuuagagaguauaaucaggugagccaagucuuuaaaguugaguuuuccuuuccucuugcacacaggaaguagguggaggccgcccccagcccaucccugcaggcuagcgaguggaugaagcuuuuagucaccucauuuuguucacagugucauacguacacaauguacugugaucauauuggcccgcguuacccucucuuaucccuguccucauucugccaaccccuucuucccaucaggaccccuuccuaucuucauggggcggagggaaggcugaaggcaggcggggccuuuggagguugcugcauuuaauuggggcuccuugcaugagccuggguguggaguaugacuaucagcugccuggagcgccuucuccuccuacagaagcugaauuguuuggaugcuggaaucuccauuuaaugacaagggcgggucuuccccuguggucugaagguucagacucuagguggauggacuuccuuaggaggcugugcuguaucuucuguuguagcuagagagaggugguggcuuucuacaagccacuccuuaaggggggaggggggaacaggguguuuuugccucugugacuucagccacuauaaacgggagccccuaacugugaacuacaauaaaugcuucuucccuuuaaaaaggaaaauaauuuuuacuuuuauuguuguugggagcuuuaagaugggaucuuguauaccccaaggcuggccuaaaacauuacuuagcugaggucucugccucccaagugcugggauuacaggcaugggcugccaugcuggccugguaagaaguuagaugauggcuuucuccgacugcuccuucuuugucugcccucugcccuccugccaggcagaugucaacugcugcccugcagugcagccagaccauuauuaggagaagucacaugucagcugccacgcugggaaacugucacucacuccagcgcaauucaauagaaaggaugcaagaaaugugggcucugguagcaguuauuuuuccuaaaaggccccugagcgauuuuccaggauaagaagacauggugcugacgccagggugucagcugcuguccucacuccucuggaguuccuguggccccugcgugguuugguuugguuuagugcuauggugaacccacggccucucauuggccaggcagacacucuaacauccuuugcccaagaaacauuguuacacugguuccucaaacagccaugcugcaaggcuugcuguccuaggagucuugcucagucuagccagccuguggcagagcuaccacuucuauuuaguaugaauagaaaauauaagacugcuucuuaaaaacauaagauuuaacaccuuagaaccaauucaugucuuaacccaacauguucaaaucaguaacguguucuuuuucucccucccagaccugugaaaauuacagcuccacaacgucucugcaggaagcgagccuuucuauguguuguauguaugcucugagucagaguugggcuuggggcagcugugcggcaaagcaucugugcuaggaucucguugcagagcugguucauacuucccaaaaaaccaagcauuaaguauucagaggcagaaaaccaagcuaccacagguguccuucagaauuugcuaaaauggcugacagucacugagagugcauucauacugagcaacauaccucaguguuugcacgugguugauagcuguccugcaaagaagcacaguccacugggaaaucagguuucgggaaggccugguaacucaaagcaggaucacggagcuagguuguccaagguggaucccaugcuccugaugagcugggcgugcugguucuagaauaauaaccugagucucgcccuagaaaagcuaaacucaaaagccggguagugguggcacacgccuuuaaucccagcacuugggaggcagaggcgggcggauuucugaguucaaggcaagccagggcuacacagaaaaaaaaccugucucaaaaaaaacaaagcaaagaaagaaaaaccuaaacucaagguuagcaguggaaggaaauaaaacugauguuaggaacagagacuccaagggcagaagaccuaccagugguccugugcuaaguaaagaaacaugguacagauuuacucacgguaacuguaaggaaguuacacaggaguguauuagaaccucgucagggauggcucuauugggauuucuuacucccuaugucagccugugcuuuccagcuguccugucacaucauuauuucagugaaaaaagaaggcccuggacacaucugagcuccacaaaccaucugcagguuuaggaaugggaagaccgcuauguaaggcgaaguguauuccuaacggcacucuuaaucugaacuccuccacaguggauucaaagaucacucacgaaaacacagaagaaaaagugaggguccaccgagucacucaagagaccuuugggaccuacccucagccacagcuagaguucgcacaguauaagguaggauggcacagcggacguccucagcaagcuagguacaggaccugucauuggaaacaugucuaaaacuauucucuuauaaguaaccuagauauuuucauuauauuucuuaauucucuuguuagcaaaggagacaucaugaaauucugcauuuucuuuugcauuuugucuucgugauaauucuguuguauauuuccagcuguggggaggucuacaccccacuagcuuauccacacauagaacaguauuuagcacguaguaaaugcucauaaauacucaaaugagcuggcuaugguggcgaacaccaguaacccagcauuuaggagacugaggcaggaagaucucaaguuuaaggcuagccugggcuacuuuguaacuuggaggcaaaccugacugacugacugacucagaaacccaaaacaaggaaacccagagaaaacacagaugaagaaacaucaggagugcaaauauacuguaaauuaaacuuguuccagagaguugcugccugucccauggcuguguagccagccauacaggcgcauaaguccauagccaccauuagaggaacugucacaggcgcccuagcacgagcccgugcgccuacucauaaugccuuccuucccaagccccaacaagaauguucccuggguugucauggcuacaggacacgcucaaaaucugccauuuaggcccaaagucugcuugguuggauuuguuuucaaagaaguuggagauuuucaaguggguuuugagaggugguauguuuauuaagucguaugcacacacagcuuuguucacguaagcuaacaguuaugaaugcuaaaggucaaugcuggauauuuuuuuaccuuguucauugauacagagucugucacugagccuggagcauuauuucaguuggacuggcugcagggagccccaacuuccucccaagugcuacguuaugcauacaugccaccacaccuagcuuuuacaugggcucuggggacccuaacucaggcucugcuguccagccacaaccacuucacccgcugagccaucuguccagucacauggcucguuuuuucagauaaggucuuguagucuagaaaagccucacauucacuguguagccaagguggccucgacuuucugacgcuccugcuuccuuucugucgcagguguggccaccacucuuagguagacaguagcucucggugugugcucucuggagcgguggaaccagucacuugggaacggggaggaagcauagcuccuagcuccauccuguuccuccugguuuaggagaggucuacccagccagccauguuuugcaugcuccuggcugcucucggagagccacuggugugcaagaucgacugcuuguucacaucuuagagugguuaaguucuguuagucuaggcgcgcagucauuuccucucaccugauguucuccaaccucagaaaacgacuuagaggaccacugagcgauuuguccacuuuaacucaccgguggcuacagguugaauuuauugcaaacauuaagcauccugcagauguuucagcacagggccucagguuuuaagaaucacuuaaguuggggagguaacagguucaccuggacgauacgcacgugggacucacagccuucugggugaugugugugguuggguugggaggcucuggggugcauuuggcuguugagauagugucugccucccucaaacguggagcccuccuugacucauccuccugggagcuaggacuauaaggaugugcaacuacaucuaggaaugucugagucuuccuuaauaaaaaccuaaguuuuuuuuuuuucuguguauaaguguuuugccuggauguguauguguguccagugcagaguccagaagucaguguagaauccccuguaacuggaguuagggacagaugguugaaagccaccuuacggguccuaggaaccuaacuuagguccucgacaagaacagcaagugcucuuaaccacugagcccuuucuccagcccugagauuuagugccuuuauuugaaugcagaauguaacggucaggcgccugugggcagcacagacuuuggcuucucccacagcuggggugcuaugcugagggaaguguggacagagcuuccccuguagauuguggggcauuggacuauacacagacaggcugguuuccagucgagcugaggucugaacccugggaccuggugguguuaauuuaccuacuugggaccgaaggaguucucuuaugucugggacucuggcuccugucgaaguuaccccccccccaccccccacaggagaaguguguggcuagcagucacauaggccauguuccaagcuucuaaucuuuaggcuagacuccuccccaguuuccuagcagcagaaaagguagcaacauacuuuaaagggggcuguuuggccccuccuugcgcucucacuccucucucuuugucuucucuccucucucucccucucccucccucuuauucucuagccuuucuucucucuccuuuuccucccuucucuccucuuagccauagccugucucucucugucucucugucucucucucuuuucuaccuucucucuuucccccuuccuuucuauaauaaagcucuaaaaccauagaccgucucugcucaucaaggcccucugugcagacucucgccugugugggaaccucucucccucagcccucucucccauauucccggggcuacaggguguagccccgggcccccagucgggggcugccccuuguccaccacacccacaccccacucacacccccaucaaauggagucaguggcuuagaugcccagccaggguugaguggaaagagcauagguggaacucuggccugacaugggcuauccucccucccccccucuuucccucaaccccuuuuuaguucccacaguaggugaguacugugcugagggcugcucugacagccagccucugcuaugagccagauacagcgcuggcacuuucugcuggacauccuuccuauaacagaugcuuucugccugugcaguuaaguuaaaugggcuuuguguguauuaauccguguguaggaauuaaugaaauacauaauugguucauuaucucucaccaucccagcugaucccagaacuuaaccaucauuuacaaauacauauauuuuugacagcuggaaaccaaguucaagaguaacauaggugggggccucuuggccgacaggaaagagcccuuccggugccuuguaaaguucuccaguccacaucuuuuggaagccuugaaauccuuagcuccagccgguaaguggucaguuuaugucacgggccagccagauaucaccaguggcuguugcuucucgggagauggccaucugguucccuguaagccgguucccucugagcccucccuccucuccagucugcuuccccuccagcccuuuuccccuuuucgugucugugccuauuaggggguaggagaaggugcccauaacucuuucugaccguagccguguuuagacugaguguccccguggucauucuuauguuucguuuucuuguuuucaggaauugcagaugcaccacuuucuccccugcucaccugcauaccgagcaagaaaaugaauuauuuuaaaauuagagauaaaugaauacauauggcuuggcuuccgcugcacaugcagguccaguuauaaccgaccagcuucuguguacagucuugugucuuagaagccaauccuuggcgucggacauucgguguuuuuaaugaacgauugggacugcaucuguccuucauccgugcaugcccucucucuucccgucuauuaagugcagcagcugugggcauuugacaagugauaaauaugugcacgcacacgcaggaggcugcagguuggccucaacccuggcacgcacagaaguggagcauggguugacucuguaggcaccuccuguccuuccucccgcugcugcuucuccucagaaguccgucccugugggaucucuguuacacacccuugaucacagaagaaccaagaagcuacccaaccccaaacuaggagagucagagggaagcuggaggcuacuacgcaaggcugcauaucuaacggccucuuuguguaaaacaacuucucuauuauacauauuccuaauauacauaugcuucucgugaucuuuuauccauggcacacugaaacugagcaucacugaucugugaauaaagauacugacaaacgcauuaucaguuccuuuggaugaauauacaaauagucgugaaaggacuaaguaauacuuauacaguaauguguacaggcugugggucauccgauauggaaccauuuuaaguuuuagcuuggucagacaugucaggcgcuucccucgucccucagugaucugaguauuugggcuuugugcugacaaguucucacgucaacuugauacaagcuagaguugucugagaggagggaaucucaguuucaggaaaugccuuccuaauaucaggcugcaggcaaggguauuuucaggcugaaggguauuuucuuaauuagugauugaugagagagauggucccaucccugggcuggugauccuggguucuauaagaaagcaggcugagcaagccaguaagcagcgccccuccauggccucugcaucaguuccugucuccggaucccuacccuguuugaguuccuguccugacuuccuccagugaugggcuacaaucuggaagucuaagccaaauaaacccuuuccucccccaacuugcuuuuuggucacgguguuuuaucacaauagaaacccuaacuaaggcuuaaagacauuuccuccauacauaccuuuuuaagggggaggggggaugguuugauuuuauuuguaugagugcuuuguuugcaucuguguauguauaccacauucgugccugggaacuggaguuauggaugguuguaaaccaccauuugggugcuuggaaucaaaccugucuuguguaagaacauuaagugcucuuaaccacagagccaucccccuagccccacuagcucccuuugaccacucucccgaccagucagucacauacaaagaagucauucugcccacaagguucaugaguggcugaaugggaacugccgaagcccuugcacuugcugggguauuuauucuacuucguaacucucccugguacaguuggcaggaaucuggaccuggaaucugaacaagaaagccuagcgucaugcugaacaauucucaaaaaugccugcuucagaauuccuggagucugaguauguccccaaggcaaagggacucugcaguugagcccauuggcccugugauacccagguccaauguaguagguggcaugaugacgauagaugucgguuaugaaaugugacagacucaacuucccauuccugauuuugguguaaaggaaggcccauuggcaaagaaaugcaggugaccucuagacgcugaaaaaggcaagauccuuggaagaacaagcccagcugacaccuugcuuucagccgacuagauccaccucagacucuucccucuucagagauaagagagaauuagucugugggggcugggcuguagcucagcuggcagaguacacgucuaaggcacuggguucaaucuuuaacgcuaccacuaggcuuaguaaaaccccaggaguauggagguagugguaagagaauaaggaguucaaggacuccuugauuauauggggauucugaggccaggcggggccucaaagaauaagauaaguuuguuuuguuuuguuuuuagugugcuaccgaucaaauccagggccuuaagcaugcuaaucaaauagucuacaauauaaaauuuauuccuaauaacaauaaaucaacggucaaaaaaaaaagguuaaaccugaaagcaucucuuucucuucuauccagcuguugccugagcucaggucccuaggaaguagaaaguguggguucauggaaccuauccaauucaccuguucucccagcacaugggacuucaaccuccaacacgcgcucgccgcggccggcgggcggcgcugcggccaccgaccggccggaugcuaaugagcccggaggccccgcccccugccggaaguggcugcggcgggggcgggcacugcgagaggggccuggcggccgugcgggagccauggcggccacggaggcggcggcggccgauucugcggguccggccccgggugucccggccacgccggcgagcacgcggggagccgccgccgccucuagcccguggaggccgcccgagucgcgacugcaaggcagccggccgagaccggccagggcucgggccgcggccccggugccaccggcccgggagcugauccagccgacugugagcgagcugucccgggcugugcgcaccaauauucugugcaccgugcgcggcugcggcaagauccugcccaacagcccugcgcucaacaugcaccucgucaagagccaccgacugcaggugagcgggccgcggcggggacgcgggcgcggggugugcgggguuugcgccgugcccugccaccugcgcccgaccgaccgagcacggcgagagcgcgggggagcgcgcacaacgcaccgggcaagcagcuucucgguggcgugcccacaacaccucggggagccugccuguuuacucagguuccaaggaugagcgacaggugaugucgccaaggcacccagaugcaaccccgcaggcuuuccgccccucccacgaaacugccgguggguccuaccuggucacucaaaagcggcugcggguuggguuggacucugggcacuugagcugcaaguuucacgaggcugcugagaucaacucugcgcaggaaggagaggggagggagguuucucccguggaucuguaaggaggagguucaccgguagcugguaugacggaugucugaccaagaccucuccguguuacaua

SEQ ID NO: 4812 - RNA, 19788 nt, Mus musculus
cauuggcggcuucaaaagcaccucggcgggaaccgcugcagagacggcgggcgauguggacugguaaggcagccucagcgacaccgaauuggacucggaggcggcgggaggacuacaggagccaggccucagacaucuacgggggccuugccacggcgcaguuccgccacgggaucuuagccuaggagugacacuaguggaggccggguccgggccaagagggccgggaugagcguccauggcgucauauccgcccggaguggggcgggguuuuaugucccuuggcguuuaugccauggaggcuccgggcugcccgcucaagagcugcuuuacuuugauccuuagguuccgucgagccuaggugucagcucucuaauuccuagccucgccucaguuuuuguccaugccuccuguugcuauacuccuugugcuccaugcgggucuaccggaucguuauugucacguguacauucaacagccuugucuuagcugcuaccaugaauaaagcgcuagaaaauagaaauugaaauaguaacagggcagaaaguucacucaaagacuugcuaacuuuguugauguguuacgcccuuucugucauuucuuuuaggaagggcauggugcagauagaucacucagaauuaagaaucuucggaagugcuaaggauugggcaccccaccccgaaggcccugaucuccgaaguuuauagccgcaucuggccuggucaguacugggauaggagaaaugccugcuuugcauacacucuccucuaauuuaccucacugaggaucaggaaaacgcucucagauguugucacgaacaagguguugguuuaauaguugacagacaguggaacuauauccuucccuugugcauaccgcuuaggguggguauccagucacucuuccaucagucauuagucaagugcauaugagauuguucuugggugaccagacucgcugugugauuuggcucauggugacugaaauugcuaggaucagaaccccccagcccuggcagcccuaacaagcuaggcuccauaggccacuuaaaaggacaagucuuuuguuuguuuguuuguuuguuuguuuuguuuuuucgagacaggguuucucuuuauagcccugucuguccugguacucacuuuguagaccaggcuggccuugaacucagaaauccgccugcuucugccucccaaguacugggauuagagaugugcgccaccaccgccuggcuaaaaaagacaagucuuaaaugagaggcagaaaagagacauguauucaguguggccacacugggaagagcaaagaggucuagugacccacacaccaaguguugaguccugaaacagaagauucaacagaaagcagaggguauacacaacuaagcagcccuagucacggugugguccucccaucucugagacaucguugcccugguguugcagucccuucugcaagagggucugacaaggagacagaaaagcucccucugacuggcaccaggugucagccuuuccuuccccaucagaucccuggguugaacuccaugucucuguggggacacucacaagugccucuuuuuagaaugacuuugcuccugccagaacaguuauaaaacggcuauagaguuuaaaaacauaguugugaauaagaucaacauagucccugucuugagcagaaaaaaaaauuaacguagcuaugauaaaauuauaaagccaauugcaggugguucuguaaaaauaauaaacgauggaagauuggaaaaaaaaaaaaaacaaacaaaccacuguuggaugauugcaguaaguuuccuggggagccaggcagugguggugcacaccuuuuuaaaugaacucagcugggacuagagagguagcucaguugguggaaugcuugccuccgcaugcaguaagccuuggggucaucucccaaaccacaugaaaccggaugugguagcgcacacguguaacagcagugccugggagauggggacaggaagaucagaaguucacgccagccuggguugugugagacccugucucaggagauaaagauaaggagcuagagagcaacucguuguugcucuugcagaggaccucaguggaggucccagcagccacaucaagggcucaccacugccucuaucuccaguuccgggaccagacacuugucugaagggggaugccagcacaccuacguuauaauguucacacagucacauacucauaacuaagaaagaaagggauaaaguacagucagcauaaaauacacauaucuuuagccaacaggaaaucacaugcagcauucaagaagcuuuuguaauauuagaugccaggcccagccaggccucucaugaggaauagccaucuauuuacuucuuuggaguccuugggugugagggaagcgacaugagugacagggacaccaaagaccuuguuccuuucuagaagacaagcuggccaaggaaacuuaaaaaagucuacagagacuuuguuuagucuucaaguggaaaugaugccuguuugucgggcacuguggcguaugccuuuagccccagcaugugggaggcagacacagguggaucucuaaauuagaugccagcuugguccacauggugaguaccaguauaaccagagcuauguagaaagacccugucucaaaaaaaaagaaaaagaaaaagaaaagaaaagcaauugugcuuauuugcauuuuacccccugaacugguauccaauugaggcaacaguaggaugagccaugccuuuuaaaggcucuaaagaaagauaaaaggcucaggcucucccuucccuguaccacaacuuuaguacgccuaaguaucaccugcugccgagggaacuaucccauggucggggcucaggacaaugugggcacucgaugacguugcuugcagacacagagcaggacgguauggucaauuggcagugcacagguguccacacuuacugguucacauaucauagggagucagccacugccuaaaguauuaccuggaaaaguccaggauuaagugucuaaguaacucucacucuacuaggugugccacaguauggcagagggcuuuauugcaggaucaugugugaguggcaggcugagaaggcagccauggucagauggcuggaagaggccagagagaguggggaaagcccuccaguguagcacugcccuaggcagccuccuuguagcuaaguuacaguccuguauccccaugacgagauuaacacauccugucacuuuccaccuuauauuuugagacagacucacugaaucugcaguccgccaguucugcuagacugccuggccagcaggccuucacaccucaaggcuucugcccccccaaauacacacacugugcuccgccaccaggauuuguacaagaauuguaagggucagacucagucugaauguguaacaagaucuuuacugacacuccaucaucuccugugcucuuaaaggaagaaaauccuuguaggaaacuaauccaagucccacuaggccugacuucccaugagagugcauuaauccccucugagggcuguaucccugugaccuaccuaaucacgguccacuaggcuucuuaaagagcuagcacaucucaguaccauuaaguugguauucaguacagacuuguggaguccaaacccuauccauauuauaacagcacuaauugauauacuucuaauuccagcucuuagguugaggcaggagaccagauuuggcuucauagaagauuccaggcuaacccugucucuggggaaaugaaggaaauaaaaucuggaggcuggugaugaagguguagcuuaguugguagaggauuggccugacacaggaaggccgggcuuagcccaccacugacgacugggaacgcagcacacugacucccuccacaaucccacgcuuggaaagcagaggcugaaggaccagaagucgaagggucaggcgggagagagagggggcuuagcagugaagagcacuugauguuccuuuuggaagacccaaguucaauugccagcauccaugucagguggcuccuaaccagcuccaacuucagguccagggagucuggcaccuuuagccuccuuggacaccugcauucaugugcaaggcaugcuggcacaccaagaaaugagggguaaauauguauauuucuuuauugguuuaaagugauccuuggccacauagugaguuugaguccagucuaaggcuacuugagaccauauguauaugcauguauauaauuauguauauauguguauauauauacacacacauauauacauaauuauguucacacaugcagcuuaaagaggaauacacuacuguguucuuuuuguuuuguccaagggcugaagagaugaaggagaauguugccgaguuucuccggaggaccauccugaaaaucccucugagugagaugaagagcauccuagaagccugggacuuuuugucugaagaccaacuacaaaccauaaaccugaagcagagaaaggacuaucuagcccaggaagugauucugcuaugugagguaacaguguucaaaauuaucaaccaaauacauugauacaauggacuauaguuagagcaguauguacauacaguuauaggguuugguuuuguuuuuuuaaagcaaagcuacaaagaacaauucggggugggaagaacaggcuuuccagcagaugggcuacagccguuagaugcucgcaugcaaaacaccuuugcugcucgaggcagccguguucagucccagaagugucgaugcugaggcggggauaucuagaguucagauaaagccugggauaaauagugaauucaaggucaacagcacaggaggacugucucacaaacaaacaagacaaggccauuccauuucaucaccucugcuguuuaaaaaagaaaguuggacucaaauuagauccaugauccaaaugcaguaccuaagacuaucagauauguggggaaagcaagaggaaaauccuugugauacuggacuagggaccugcagcuagcauguuagaaugucgcaagagucauuaauacaaaaaaaaaaaagaaucaaaauaauuaauaauaauaauaaugguaggaaggauggcuugguggucaagagcaccagcugcuuuuccagaauaccugauucuacucccagcuccaaaguggcagcucacaacuaucuguaaucccaguuccagggcaccagggacacacaugguacauagacauauaugcaggcaaaacacucagaguaauuuucugaacauuuggcuagacgcuucccaacagaagaccauaaauaagcauaggaagaaguguucagaaucacuagucaucagauaaaugcaaauaaaaaccgcaaaauacgguggcugggaugaccaggauagaaaagacugagcacaccuguuuggaauaggugggauuccguuccuucuggugcugggcacuggacccagggccuggagcaugcuaaguaggggcugccugcugagcuguuuguaccucaagcccagcauucauuuugaguuuuagugcuugggguggaggccagggucucagaucugcugaguuagugucuuacccgagcuguauuucuagcccuuaacaauucucuaaaagucuaaacauuugccacuguagauugagccaucccacugccagacauuuccucaggagaaacaaaaacacaggcauauccacagaaaggcacauauguuagcacagugcucaagucuaaaaccuagaggcagcccaaguccauccacagguaacugugucuauucacauaacagacaacugcuagcaauaaaaggaaucgagcuauagaugcagaaauguggcuaagugucaaaauaauuaugcugaguuaaggaagccagaucaaaaaagaauccaaccuuauguuaacguuccuauaaaacuggaaaauacaaauauuaugacagcacaaggauccguaguugucugagcaccaaggacugggacgaagagaauuggagacaggaaaggauaggagagagagagccacagggacacuggucauagagguugcugggcaugugugccacauugauaugacaguggccacaucugaaaaugugguucugaggaaaugcccugacagaagcagcuccagcaagcccagguuugcucuggcucccauuccuggggacucaguccaucgcgacucagaaagcauggcagccuuggaggagcacaggcagcaggagcacccuggccagucaggcugcgugcacccccagggagcaggaaguauggcgggcuccagagccucauggucacucucugugaccagccuccagugaggcuccaccaccaccaccacccaaacagcaccaccugcuggugaccaggugcucacaugugcgccuccggggacauuucacaugcaaaccacagcagguaugcagcuucauguauguucaagcgugguuuuuuguuuuguuuugaggcagucucuguaguccugacugaccucggacucaucacagcccuucugccuuagcgucccaagcaguaggauuucagccugagcccccauggguggcuuuuuccuguuuaaaauguacauguuaagugauacgugggaagugaguuucaggagagggugggcuaagguaagaacuggaggggugucuguuggcuccgaagacgcuagagccuggcgcuagauggccagaacaguaagcacuugaggcgugccgaugggaugcucuggcuggcccugaaauaggcuugaggggcuggugccccauuuccuaauugguccacccucucuuucaggacaagcgugcaagucuugaugacgugguccuuuuagacaucguguguaaguucuggggauuugucauuacuuuggaauguuguuucaucagagggaauuucuuauguuaauacagaucccagggucaagagagcuggcucagcaguuaagagcacuagcugcucuugcagagguccugaguucaagucccagcauccacacggugcucagaaccaccuguaacucugguuccaggaaucugauguccucuuguggccucugugggcacugcauguacaugguacacagacacauugaggcaaaacauacauauaaaaacaaacaaaucuuuuaaggaugcggauucuagaguccagaggccugguacaagaucccugcucucucacugacgggucuagaguccuuuauugaguuuuaucuccgcucugacccucagacuucgccuaagucaguggacauggaagagucagacccugucuuuaggacuguggaagcucaggaccuuuggagacaggaccuggcccaucaugagcgagcauaaaguaucaguuguucggcuuuguuacucauuggaaaagcaccacugagaguuugucaugggcgcagccucucgugguuugcuacuucuuagguuucauuuucuucaaaauucacuuacuagacuuucagaacauagacccuaagaccagauugcuuggguugguuucacgacucuaucguugcuugccuguaagggugugugugugugugugugugugugugugugugugugacucacacacuugccuugcuacuuccuuuuggcaaauguguauaauaacgauaauaaucaagucagacugcggugagaucagaugaaacuacaggucaagcccuuggaacagaaggagucucucuggauauggggcuuuguuucuuacauuuuauuuauugaaaggggcacacgagcggcacaccuguggacauuaggacagguagcugaguaagcucugucucuccuugagggccccagggaucaaacggcugaacugucucugacccagagcccauuuuucuuaaaacuaauuuguugucuuuauauguggggcuaugggguguccugcaucugcucggggcucgggaaguaggaugcaggaguuuugacugcgcuuaacccacaccagcguagggcacagggcaggugucgggcugugggacccuauguucuauccaccaccuagacagcggcucacaucagucucaaacccuagucacaaaggcucuaauaaccacuucuugccaccuuaggcaccaagcccacacaucauggacuuacaugcacguagacauaaacacauaaaaugaaaaugauuaguuccucaaaaagaaaaggugggcccacagaagacuggugagcagagcaggcgacacacaagcuuguagauacugacugggguuuaucugaggagaaagguuaccuaucucagagauaccuagugugugaagggggauuaacuuauaggaccacacugggacuuccuuuucaguggucacgugaggaggcuuccuugagagacaguauucgaguuagagccaaaagaugaguucgcaguagccaggcagagcagagaagcugaggagggggaagcugccagggauggggugggagaagaguaccugagaugcaagagcagaggcgagcuggcuccaguggaggggaacauuaagauaacagagacuuggaagccacuagaagggucucaguaucucuccuaaugaugucagcccuggacagguucugagccaaaacaauuaggugccugguuuguuuguuuuuuguuuguguuuuuuuguuuuugucuuuugggggguuauuuuguuugguuugguuuugauuuugguuuugguuuuuugagacaggguuucucuguguagcccuggcuguccuggaacucacucuguauaucaggcuggccuugaacucagaaauccacgccugccucugccucccaagugcugggauuaaaggcgugcaguaccacugcccagcuaggugcuugguuuuugagagagcauguugguuacagcagaagagaggccgggggugggggugugaggauucagacaccugugggaucuucuggagaaguauaaacgagagaggaaggcagcccacgugaggugaucgucaggagagaggagggugagggccaaggcagagaagggacuuacacccagcccagggacaaaggcaaguggggcgagcuuucaggauucuuugcaucuacacaugagcuaggggccuccccuuuauucuguggaggcugcagaggcgggucuaugagauaccucaggcgugggguaggcuagcaugugccuaucgcagguacauuugaucuaaguccuccauggucaccuuuuaggugaugcgcagcagagcuuuugacaagaguucugacuuucugcuacaccagucuuacucaggccaguuagcaagucuugccaacucuaaacacagagucaacacuaagacaacacuaacuguaagcccuucucucucagauacucaauuucaucggcaccagaagcuuuggaauguuuuucagaugaguaaggaaccagguaauguuuccugcuuuaaauuaaaugucuagauugcugcuuugguaguuugaaagugaguaccaaauguugucuuuuuugucaggauuuuauuuuguuuuuuuguuuuuuucugagacauuguaucccuguaugucauaggcuagucuagacuucacucuguaggcaaggcuggccuugaacucacuguguagacuaggcuagucuggacuuguggugguuuuccugccuuuaccuccagagggaugagacugcaggugugugcuaccacacccagccgagcccucugcucuccuaggcuuuuggaaagccgugacuguuccucauguguguucccuggcacuuaucaggagcaugugugugguauggucguuacugcucuggggugcaggggacaaagacauuguaccgcucuugacuuuucuuauuuauuuauauauuccuguguuuugacaggugaagaugucgaccuuuuugauauggaacaguuccaaaguuccuuuaagagaauucuucagagagcauuaaaaaacguaaggauccaagccuucuuggauuucuaugaaauucaguuuaaugauaucgggggcggaggguggggugggggguggagauaggucauuuuaccuaaaccaacugaaguauuacuuccaucucucgccugcccaucccacccaguacaucucaggagcaacacuuaguggaacucugcuguggcagcagcacccucaguuaacaauguccaguucauagcugccugccacgugaggacuugauaggucgcugaaaugaccaagcaauugaaucuuuaagcuuacuuaaugaauucccauuagaugguccacaugcagcugauggcucuucuauuggucacucuugccuagagugagacgcuuugcuguuccaaccaguaggggccacagagcuccaaagaggagcacacucuugcugcucaccaagggacaacacaugauccugcgaacccgcagcccagacagggagaguuccucaccauugcaccagaggaucaggaaaggcagccuagcaggcagcauagccaccugcucuuccugcaguaagaucccagagggaaggaggagcgagcuggcuggcugcucuucagguucuccuuuccugggucagaauucugagguggacuggagcuagcugacaaccuagcaguggccauugaaucccagagcugacaaccuagcaguggccguugaauuccagagcaaguccagucauggcugcaaguuuagaaagacuaauggcuggcugugaaauggauaccauacagccuccugugccgccacauuccuaaauggcucuggcugcugagacccaugggucaggaucaguguauuaagggcucauugccacacaggaauccugcuguaaacaaagagacaaacuaagugugugagccugcagugccaaaagggcuucuagaaaagccacccccucccccuuugauuuguuuugguuuugagauaggaucucacugccuggccagaacuuacaaagaucugccugccucugccucccaaggcugagauuaaaggugugcccagucagauaccucauuuuucaaaaugucuuuuauuacuuuauguguauuaauguuucucugcauauauuucuguguacuaaguacaggucuggugccugcagaagccagaagagagccucccaugcccuggaacuguaguacagaugguugggagccgccccaucggugcuaggaaccaaacuguaguccucugcaaaagcagcaagcgcucuuaaccuauaugccaucucuccugccagaguauaagguuuuuuuaagggauuuuucuuucucagauauacuuuacaagguguaaauagaucuucauaagauaaucacaaaauguuuucccaaacagucccaaaaugguaucauaagaaguagaaaaagagccaagugugaccugagcugaccuccaugugucuuguggcaaugugcacacuaacauacuuauaaagaagcuuaauuuuuaaguagaagaaaagacugacaggugcccacaaugcaugaaaaauuauucuaacauugauugugucucagaugcccgugguuggugccauggugagauuuaaccaggacgguauguuuucuucuaagguuacagucagcuucagagucuaugagaaggauucgguguggauccgaguugccuggggaacacaguauucacagccaaaccaguacaagcccacguucgugguguauuauccccagacuccguaugccuucauuucuuccugccaucugaagaacacugugccccuucuccaucagguaggaacaggggguacagcagcuggagugcccaguagcuagaaaccacauaccuagauaaaugccuaccucccguucuaaggagagcguuucuccgucggcuaugugacagaagauauuaccuugaucuagucuuuauugucagugugaagguaaagcguugcuuaguauuaaauccagcaaguuccuaaagguagagaugaguugucgagguucucugccccuucuuuauacucuauccaccccaaacucuuugucacuuugcugucucaugucaggauuagugcuuucuauaucucuacagucugccuauugauggcaacugacauuuaugaccacuuucuacauguaauguacacaaaaauacugccaugucagagguagccucucucuuagggguuugccuuugugucuuauucacuauuguauuguugugaggagacgccaugaccaaggcaauucuuauuaaaaaaaaaaaaaaaaugcauauaacugggagcuugcucaccauguuagagguuugguccaguacagucgugguggggagcuugucagcccauaugacacuggacuaaagcugagagcuacauccucauccacaggcuggggggacauggguucuaggucaugggcuuuuaaaacuuuaagcccucucccagugacacacuuccuauagcuacuccacggaagccacacucucuaagcaucgucagucuuucagacauuucacucccuggucuaagcaucagagcauaggagccucugggggccauucuuacucgauccacaguucugugcucuggggggguccuggcuucuuucccaaaaagaauaacucaucccaaauuugugcuagucauuaugccuccccuguuagcaucuccugcgcucccagaguccagcgugaguugggugcaggugagcugcacggcuccccacacaccuucugucugguaaugcagcucacacuucacugucagcagcaggccuuaggggcccacaagugaguaaggagauaggguuacauuucuucucacuugcaagaguggggggggcgugucuugcgacagggcucacccccugcccucagccucccuagggccagggucucagguguguacugcaccccacacagggcucuucccguucucaguugcagcgccugcauuucacugagcagucuguauagacccacgcacaacccuaacagucucgcuccucucccuccaaggcacugaaagucgccagcaaacaccaucagauugugcauuuggaucugaggagcaggcaccuggacucacucaaggcaauuguuuuuagagaguauaaucaggugagccaagucuuuaaaguugaguuuuccuuuccucuugcacacaggaaguagguggaggccgcccccagcccaucccugcaggcuagcgaguggaugaagcuuuuagucaccucauuuuguucacagugucauacguacacaauguacugugaucauauuggcccgcguuacccucucuuaucccuguccucauucugccaaccccuucuucccaucaggaccccuuccuaucuucauggggcggagggaaggcugaaggcaggcggggccuuuggagguugcugcauuuaauuggggcuccuugcaugagccuggguguggaguaugacuaucagcugccuggagcgccuucuccuccuacagaagcugaauuguuuggaugcuggaaucuccauuuaaugacaagggcgggucuuccccuguggucugaagguucagacucuagguggauggacuuccuuaggaggcugugcuguaucuucuguuguagcuagagagaggugguggcuuucuacaagccacuccuuaaggggggaggggggaacaggguguuuuugccucugugacuucagccacuauaaacgggagccccuaacugugaacuacaauaaaugcuucuucccuuuaaaaaggaaaauaauuuuuacuuuuauuguuguugggagcuuuaagaugggaucuuguauaccccaaggcuggccuaaaacauuacuuagcugaggucucugccucccaagugcugggauuacaggcaugggcugccaugcuggccugguaagaaguuagaugauggcuuucuccgacugcuccuucuuugucugcccucugcccuccugccaggcagaugucaacugcugcccugcagugcagccagaccauuauuaggagaagucacaugucagcugccacgcugggaaacugucacucacuccagcgcaauucaauagaaaggaugcaagaaaugugggcucugguagcaguuauuuuuccuaaaaggccccugagcgauuuuccaggauaagaagacauggugcugacgccagggugucagcugcuguccucacuccucuggaguuccuguggccccugcgugguuugguuugguuuagugcuauggugaacccacggccucucauuggccaggcagacacucuaacauccuuugcccaagaaacauuguuacacugguuccucaaacagccaugcugcaaggcuugcuguccuaggagucuugcucagucuagccagccuguggcagagcuaccacuucuauuuaguaugaauagaaaauauaagacugcuucuuaaaaacauaagauuuaacaccuuagaaccaauucaugucuuaacccaacauguucaaaucaguaacguguucuuuuucucccucccagaccugugaaaauuacagcuccacaacgucucugcaggaagcgagccuuucuauguguuguauguaugcucugagucagaguugggcuuggggcagcugugcggcaaagcaucugugcuaggaucucguugcagagcugguucauacuucccaaaaaaccaagcauuaaguauucagaggcagaaaaccaagcuaccacagguguccuucagaauuugcuaaaauggcugacagucacugagagugcauucauacugagcaacauaccucaguguuugcacgugguugauagcuguccugcaaagaagcacaguccacugggaaaucagguuucgggaaggccugguaacucaaagcaggaucacggagcuagguuguccaagguggaucccaugcuccugaugagcugggcgugcugguucuagaauaauaaccugagucucgcccuagaaaagcuaaacucaaaagccggguagugguggcacacgccuuuaaucccagcacuugggaggcagaggcgggcggauuucugaguucaaggcaagccagggcuacacagaaaaaaaaccugucucaaaaaaaacaaagcaaagaaagaaaaaccuaaacucaagguuagcaguggaaggaaauaaaacugauguuaggaacagagacuccaagggcagaagaccuaccagugguccugugcuaaguaaagaaacaugguacagauuuacucacgguaacuguaaggaaguuacacaggaguguauuagaaccucgucagggauggcucuauugggauuucuuacucccuaugucagccugugcuuuccagcuguccugucacaucauuauuucagugaaaaaagaaggcccuggacacaucugagcuccacaaaccaucugcagguuuaggaaugggaagaccgcuauguaaggcgaaguguauuccuaacggcacucuuaaucugaacuccuccacaguggauucaaagaucacucacgaaaacacagaagaaaaagugaggguccaccgagucacucaagagaccuuugggaccuacccucagccacagcuagaguucgcacaguauaagguaggauggcacagcggacguccucagcaagcuagguacaggaccugucauuggaaacaugucuaaaacuauucucuuauaaguaaccuagauauuuucauuauauuucuuaauucucuuguuagcaaaggagacaucaugaaauucugcauuuucuuuugcauuuugucuucgugauaauucuguuguauauuuccagcuguggggaggucuacaccccacuagcuuauccacacauagaacaguauuuagcacguaguaaaugcucauaaauacucaaaugagcuggcuaugguggcgaacaccaguaacccagcauuuaggagacugaggcaggaagaucucaaguuuaaggcuagccugggcuacuuuguaacuuggaggcaaaccugacugacugacugacucagaaacccaaaacaaggaaacccagagaaaacacagaugaagaaacaucaggagugcaaauauacuguaaauuaaacuuguuccagagaguugcugccugucccauggcuguguagccagccauacaggcgcauaaguccauagccaccauuagaggaacugucacaggcgcccuagcacgagcccgugcgccuacucauaaugccuuccuucccaagccccaacaagaauguucccuggguugucauggcuacaggacacgcucaaaaucugccauuuaggcccaaagucugcuugguuggauuuguuuucaaagaaguuggagauuuucaaguggguuuugagaggugguauguuuauuaagucguaugcacacacagcuuuguucacguaagcuaacaguuaugaaugcuaaaggucaaugcuggauauuuuuuuaccuuguucauugauacagagucugucacugagccuggagcauuauuucaguuggacuggcugcagggagccccaacuuccucccaagugcuacguuaugcauacaugccaccacaccuagcuuuuacaugggcucuggggacccuaacucaggcucugcuguccagccacaaccacuucacccgcugagccaucuguccagucacauggcucguuuuuucagauaaggucuuguagucuagaaaagccucacauucacuguguagccaagguggccucgacuuucugacgcuccugcuuccuuucugucgcagguguggccaccacucuuagguagacaguagcucucggugugugcucucuggagcgguggaaccagucacuugggaacggggaggaagcauagcuccuagcuccauccuguuccuccugguuuaggagaggucuacccagccagccauguuuugcaugcuccuggcugcucucggagagccacuggugugcaagaucgacugcuuguucacaucuuagagugguuaaguucuguuagucuaggcgcgcagucauuuccucucaccugauguucuccaaccucagaaaacgacuuagaggaccacugagcgauuuguccacuuuaacucaccgguggcuacagguugaauuuauugcaaacauuaagcauccugcagauguuucagcacagggccucagguuuuaagaaucacuuaaguuggggagguaacagguucaccuggacgauacgcacgugggacucacagccuucugggugaugugugugguuggguugggaggcucuggggugcauuuggcuguugagauagugucugccucccucaaacguggagcccuccuugacucauccuccugggagcuaggacuauaaggaugugcaacuacaucuaggaaugucugagucuuccuuaauaaaaaccuaaguuuuuuuuuuuucuguguauaaguguuuugccuggauguguauguguguccagugcagaguccagaagucaguguagaauccccuguaacuggaguuagggacagaugguugaaagccaccuuacggguccuaggaaccuaacuuagguccucgacaagaacagcaagugcucuuaaccacugagcccuuucuccagcccugagauuuagugccuuuauuugaaugcagaauguaacggucaggcgccugugggcagcacagacuuuggcuucucccacagcuggggugcuaugcugagggaaguguggacagagcuuccccuguagauuguggggcauuggacuauacacagacaggcugguuuccagucgagcugaggucugaacccugggaccuggugguguuaauuuaccuacuugggaccgaaggaguucucuuaugucugggacucuggcuccugucgaaguuaccccccccccaccccccacaggagaaguguguggcuagcagucacauaggccauguuccaagcuucuaaucuuuaggcuagacuccuccccaguuuccuagcagcagaaaagguagcaacauacuuuaaagggggcuguuuggccccuccuugcgcucucacuccucucucuuugucuucucuccucucucucccucucccucccucuuauucucuagccuuucuucucucuccuuuuccucccuucucuccucuuagccauagccugucucucucugucucucugucucucucucuuuucuaccuucucucuuucccccuuccuuucuauaauaaagcucuaaaaccauagaccgucucugcucaucaaggcccucugugcagacucucgccugugugggaaccucucucccucagcccucucucccauauucccggggcuacaggguguagccccgggcccccagucgggggcugccccuuguccaccacacccacaccccacucacacccccaucaaauggagucaguggcuuagaugcccagccaggguugaguggaaagagcauagguggaacucuggccugacaugggcuauccucccucccccccucuuucccucaaccccuuuuuaguucccacaguaggugaguacugugcugagggcugcucugacagccagccucugcuaugagccagauacagcgcuggcacuuucugcuggacauccuuccuauaacagaugcuuucugccugugcaguuaaguuaaaugggcuuuguguguauuaauccguguguaggaauuaaugaaauacauaauugguucauuaucucucaccaucccagcugaucccagaacuuaaccaucauuuacaaauacauauauuuuugacagcuggaaaccaaguucaagaguaacauaggugggggccucuuggccgacaggaaagagcccuuccggugccuuguaaaguucuccaguccacaucuuuuggaagccuugaaauccuuagcuccagccgguaaguggucaguuuaugucacgggccagccagauaucaccaguggcuguugcuucucgggagauggccaucugguucccuguaagccgguucccucugagcccucccuccucuccagucugcuuccccuccagcccuuuuccccuuuucgugucugugccuauuaggggguaggagaaggugcccauaacucuuucugaccguagccguguuuagacugaguguccccguggucauucuuauguuucguuuucuuguuuucaggaauugcagaugcaccacuuucuccccugcucaccugcauaccgagcaagaaaaugaauuauuuuaaaauuagagauaaaugaauacauauggcuuggcuuccgcugcacaugcagguccaguuauaaccgaccagcuucuguguacagucuugugucuuagaagccaauccuuggcgucggacauucgguguuuuuaaugaacgauugggacugcaucuguccuucauccgugcaugcccucucucuucccgucuauuaagugcagcagcugugggcauuugacaagugauaaauaugugcacgcacacgcaggaggcugcagguuggccucaacccuggcacgcacagaaguggagcauggguugacucuguaggcaccuccuguccuuccucccgcugcugcuucuccucagaaguccgucccugugggaucucuguuacacacccuugaucacagaagaaccaagaagcuacccaaccccaaacuaggagagucagagggaagcuggaggcuacuacgcaaggcugcauaucuaacggccucuuuguguaaaacaacuucucuauuauacauauuccuaauauacauaugcuucucgugaucuuuuauccauggcacacugaaacugagcaucacugaucugugaauaaagauacugacaaacgcauuau

SEQ ID NO: 4813 - RNA, 17053 nt, Mus musculus
guagaauucuagcuucucuuuaaucaccaaauuuauguucacaaacaaccaaccuuaggggaguucaggugacuuaagauuuuuguggggacaguucuugcacaugaaggacaauuacaugcuccauucuuuaucuuguaacuauuaagacacaucgccacagacacaaaaacuuaaaaagccauagauugcugcacuuauauuuacaaagagccacgagcagacaugcacuucuccuucagccggagggcuuaaauagaugcuugagcguuaaggcaguggacgaguccaaaacaacagaaaaucuaaguuaaggcuuugugucuguucugaaacucacauucacaggcgacuguggccacaaccacuguuuagcuccuggguugcauucaccugccggguguguuauuagcccauucccgaguccucugcaucgggugaaugggacaggacagcagcaauaccaacuuauuuaaugagucaucaccagcccccuuagguuucauuuugaagguucagcuuuuggcagcacaaacguaugccaaaagaacagggcuuuuccauccaggcuagacuggaaagguccccaggcugggcugauucugaauuugccucagaguugggcaccagcuaugaauccaugaucuacuuagcacagagccccccaggcaggcuugaccucgcucuccccucagagugagaguauucuuaaccguugaagcaauugcucuccagauuuuuccucuuuaaagaaugcaucacaacauaaucuagaucagcguacuuuagaugggucuauucuacaguugcuagucucaggguacacauacuaugcuugccagaccuaagagcuucuuucagggaggagauggggguggguggaaggaaagacauugugggcccugcuucuccuaucaagauaacaagugcagcauacuggcgggggcugggcaggaaagccuuucccccacccaugccuuccuuuuuaauucuuagagggucucuaaguccauuaugggaagcagucgggcaggccccauggucuacuguggagcaggaaggauguuugugggggaggugauguaauguauaucacaacuugcccccaccccaaagucuucagaaaaaauguuuugcuuuugcuugcuaugaggucauugguagcugguagcaucuggguagcauuaggauggggacaagucacaggagagaccaaggaauaauuaaugaucgaaagguugggguauuuucagcuucaucccuaccucccaacccaccagauagggugacacucaagguuaaguugauugcuaaugguuuaagcaacucucuacccacacaacaaagcagccauuaaccccacaagacugaguuuggagguuccuacgaggcuaacaggcagauucuugguaggaggugugccuagagaagguguggaaguccucugccccuuugcacccagccuacccuucacagaaacaguaucccugaguucuaguaaauucacugagcacaaagaguguggagucauaggaaccccaauuuacagacagcuagaagcucuggggucaaccaggaacuacccucuagcuacugugugcucacagcuggcugccgucuggcacauggcaaucccacagauuugaucaacacucuggagggagcagaggagagcucguccacgaagcgggaugagccugagaugaacagaacugaggguguccacagugcgcaggcaucuccacagcuggauaccuuccucguacuaagccugccauugacaccgagugcuugcuguucucacacuggccaguaaccucacauugggagaaggauggcacacgaagcuggcggcagucacagcucagcagggaagggacagaagagacucaaaacugucauaaaagcuaaagacagguguggcuucccuuggugcuuccgagucagagggacaugacaaggcaaggugguggcaucucaggaguuagcggccacacaaacauugucugagcauuugaggugcccuuuacguggagaugccauuuaagugugcuauacucaguuaaagcagccacaaagcuugcccccuaccaccugcuaagcuuggcauuagcuaaacaguucuaaguuuuacagugucaaaugcauuuuuuuuuaaaaaaagauagaauagcuacacaggagcaaacauaggcgacauuucagaucaacacuuacacuuuauaauacacucacauuugcacaccaaucuuguggucacgaguacaaaacaccaagaacugaagagaaucuaaacagcugccccacugacuacauccccagucggugccgcuguccuugagcccauguucuaaacgcacaaggagcggggaugccuggcugcaccuucagaagcuggagacagcgugcagcucugcgcaugucuggguuuccacggagcugaacugggacuccaucguauuccaggccagaucggcuagaaggaagucauccauugcugucugaguuucguugcuggugaggaacaaguuccccaggggcucgaagccagaacucaugguuuguguuucugugcugcucaacuggaccuugcucuccagagcaggcaggugccgagcagggcaggcuccuucaguuugggucucugugucagaggagucgguacucauggagaagcuggaguguuucaggaugcugcccaggggcaggugaggacuacugucuaagaagaaguuuaagucuguuugugucugugugucgaacaucucaaggcccaggaagccugaccccgcucugaagccauagggcuguguggagggaucugagaggaggacgucggucugcgucucgauguccagggacuccaggaccggcucagugcucauggagcugagcucacucuccucagucugagucuggauauuggaggcugagaggaacucuucaauaucaaaaucaaucccagaauucugcgcugagccagcugggagcugggcgucagguccgggguuggugucggacaagagacuccgguuauccaguguuugaccuggcagguuacuugacaagauguuuuccaagucgcucagcagaucuaugguuugggucugauuaucugucauggugugugcaggaagcaagccguucugggugcugaaguuuaacacgggugcagacuuuuccaugacuuggccuaagaucuuagggucacucugagguggcagaccaugagucccugucucugcaacuaagcugcuacucaugauggugucaguaggcacacuguaugacgcaugcacgcuuucaaaaauguccccacacaagccaguguggcccacuggcacugagucguuugugcgguucugcauccugcuggucuggguuucccuggagaccccaccaggcuggaaacaggcgucuauaaaugcaucugucugagcagcuauggaugaagugaccuuagagcugggcaccaacgucuggguguggacacuaacaggaagggacacuugagaaucaaacgacaggucagucugagaacacgaugacacagaggaaucagggccgagccacugagcagaggguaucaaguuggcugaggcauaggucagaucugucugcacguugcuugaggaaaugcugguccucugacacacacucccuaccucuuguaaaggacuacacaggcuuuuacccaaguucacuugaacaccuguauucauuggcucaacaacaggacugauaauuuuugagagagguaggcucuccuucagagagcaggccucugaguccaggcugaggaucagggcuccuaccgacagagguacuaagugcacaguaccggcugcagaacugugauccacaccuaacaccacaggcugggccgaggacuccgcuguaggcacaaagacaggcacgggggaaaacugcaugacugggaguuuaaccagagccaccuugggcuuugguaacagcaacuucuggggacaccggggaggcgucgcgacgcucugcuuuuuggugugggcgcuacaggagucuucgagggaugcugcaggcuugaccuccggagcauccgguucagcagcaucuuggcgcggggcugcuuggucgcucagugguucagugguuuuacuggacaacuuuugguuuugcagguagcuuuccauuuuccuuuuuuuacuaggugggucucuggaaacaguaagaaaguaaaaauaaauucaauuuuaagaugugcgugcacgugucucuguguuauguguacauggugacgggcugaaauggguacccuuggagcuagagugaaggguggauuggagcugcuuaacucuggcuuaacuuuuggaaccucuuugcucugucuccuaagggauuucaugcauauguuaaauacacuccauuuucaacgaggagcuuuuaacaauuccauguuuauauuuauuaugugugugcacauguguacagcacauucauuguguagaggucagaacaacucucaggagucgguucccuccuccuaccacguggguccugaggcucaaacucagguugucaggccugaaggcaagaaccuuuacucacugagccaucucuccggucccuuaggucagagcuuuaaaaucaggaaccuuaaaaccaagaagcuuauaaguaucauaccuacagcagaaagcuacuacaccagauauaaauuuguuauuuuaaaaugaaauuuaaggcugagccuguaauuauaauccuagcuacacaggaggccgaggcaggauauuuaagagcagccuaagguacagagugcguccagggcuggaguuaaagaagaaaggcuggaugugacucaggcugagcccuugcccagcauucgugaggccaaaugaaacgcggagucacagucucacuuugagcucucagcaaucugucucucuggagaagaugcugaagcugagcuuuucagaugggaacaggaagggagcaucgggaacuguguggcuggagagguggcucagugguuaagggcacuugcugcuuuccagaggaucugauugguuuccagcacccacaucagcaccaccaguaacuccggcuccgggggcuccaaaugcccucuucuagccucugcauacauaugucguucacauacauguacugacacacacauacaucuaaguaaaaaauagaaaucuuuaaaacacaaagcaccugcaucagcuucucaagcugugcugggcacucgcgcgugcgcacacacacacacacacacacacacacacacacacacacacacacacaccuguacccccagcaccuggggggugcaccagggggacacacuuguuaucauuagauccagccucaaauaaaaaaaaaauaaagaggagccugguccuaggggcuccuccgucauuacugcugccauuccagaagcacccuuguuaaagccacagguuccucccccuguuccuucuguucccuuuguggcuggcuugucaggaggucccauuuacagcuacucaaccgcaucucccuguuuuaccugugcucugcagggaucucguggccaguucgguagaugugagacugcagugcgguucugcuggcguagggacagccgcacguacacuggaaggucuugccacaauccuccucgugucuuuucaggucccacucggugccguaggaauuacugcacuuacugcauuugugcuucuucucugcaugcauuuucauaaagugcugcggagaauaugggugggaugaagacaagagagagcaucacauugagauccgcccacacacccaacguccccaggaucaccagguacugcauuugccaguagacaaaccccagucuaacauaugccucuccuuaugcacagugggcaggcugccuuggaaccaacccguguauucagauucucaacuacacuuaacugcugugggcaagaauauacagugaguuggcuagauuuaugucaacuucacauaaacuagcguuaucugaaaggaggaagccucuguaagaccaucgugggcggugccaucccugggcugauaguccuggguucuacaagaaagcaggcugagcagaccucgaugagcagcacccucuguggccucugcaucggcuccggguuccagccaugcuugaguucuuauccugacuuccuccagugauggucuaugaccuggaaguguaagcugaauaaaccguugccuccccaacuugcuuuuaugacugugguguuucaucacagcaguaguaacuaagacauagucucugcagugaccucaagacugcagaauggcaggaaccacuucauuuuuguuuaaauucuuauuuuuauuuucaugcaucucugugcaugcacgcaaacaugaguccacuguuggugaggccagaagacaggugagauuuccauggaguuccggguggcuuugaaccaccuagaaugggugcugggaauggaaucggucuucucccagaguagugugugcuuuuagccacugagcugucucuccaucucagacuccauugcuuccgucucagucuuucuucucucagcagcuugaucccuuucuccucacaggacagcagccucucucugggaggccuucggacugcuccuccuuacuggcuucuugucugcucuugcccuuaggcacguauacucaagggugugcagcauccauuuucuaccucuuggcuggauuguccguuucuuccucuacaaacccggguaugggcauuucacacugaggaaccacugugugggaccuggccagcgacucccacacaacucacacuuggaucucugguuacgccugcucagcagguacagcacacacugaguuuaugccaucuguaugccacugugcugguuugauggcuuccaggcucagguauuugaauccuuguuccgcaguggacuggugccacuguuugguugcguuuagacgcucgguguaguuggugaaaguaaggcacuggagcuggccuuugagguuucagagccacaagcuguuccuaguuuacucuuucggccuccugcaugcaguuuaagccaugacugucagcuuugcuccaccauuaugccugaugcugugcucguagccacguccuucuguaggcuguccaaggcaugcuguuuccauucuuucauuuacuuauuuuaaaagaucauuuauuuuuauuuuauguguauuuuacaugcauguacaacaugugugcaguuccuacagaggccaggagagaaggugcgauuucugggaauugcagcuagaaacauuuguaaguuuugccacaugggugcugggaauugaauguagguccucugaagagcaaccaaugcccuuaaccaugucucuccagcggggucgcagcguuugaucaugguacuagcaaaguaauuaacaccuacaccuuggggaaguauagcuagugacuuaccuguuuaaccagagaaaacugagaaaacggucggucggggccucgaggacauccuuugauuggacaacaguagaauuucggugcaguugucaagucuuuccuuauugucggguuuacuaugccauccugcaaagguaaagcccagcaucaucagcuuuuguuuuuuuuuuuccuuuuuuuaagguagggucucucuauguagcccaaacuggccucaaaaucaaagauuugccuggaacuaaagguuucugcugcaccacaccuggcucaggaacugucuuaccaacccgucacaccaggcugcuggcagacauagcccgcccucccaggccccacagcccagguggugcuuguuccugggugucacccucacccacacucucagucuccgccccugagaagacuccugugaggaggauaugggccucgcugggagcaccgugguuuccguuuuuuuacuguguuaagagucugcacaagcaugcacggugcgcagauguauaaugaugagaggucagcaucaggcuuaaaccagucuccaguuuacuuguacuuucaagaacuauguuuguugaguuaguauguguaugcacaugccacagaacacauguacaaguuagaggacaacuugucaaagucccuuguucugucauauguguccagggacugcccuuagguuaucaggcugggcagccuggcaccuugaccuggugggcuauuucacugguccucuguccuauuuuuuggagacauggucccuuaccaugauggcuacucuugguugucaacuugacuuugucuagaaugagcuauaaucccuaacuggaggucacccugugagagauccuuuugcuugguuugaaauggauacaucacucccagucuggacauaugagguaggaagacacaccuucagugcgccucaccuucugcuggagucuauauaagaacacggaagcaggaagcuucugcucuuugccugcuugcccucucuggcuaggacagcaucccuucccuggcauugagccuacuuccuugggauuccagcacacacuggagaccaggugagacuuucagccuuguggaccaagcacuacuugauucuugaacuuucuguucacaaccagucauuguuaguuuagcuagacugcagccuguaagucauuccaauagaucauauauacauauauauacacacacacacacacauacacauacacacaccacacacacacauauacacauacacacacacauauacacacacaaacauacacacacacacacacacacacacacacacacacacacacacacacauucuguaagcucaguuacuggagaacccugacugauacucacugaacgugagguugguggcuaaggaguuccagcauuccucuuggcuaccuucccagccagcacuaauguaggcguggccccacacuuggguccuccugucugcauuccaugcacuuuauaaucugaccccccucccgcccccauuguauugaggacugaaccuagguccacauacaugcuaguaggcaaguguucgagcacugagcuguauccccagcugggucucggaucugauuauuauccuauuaccuaaaguauuuaaaauagucugaauguagguucuggcuguuggcgguguaaugagcaacacaaggucuuauguacuuccuauuaacccuucuguuguuuuauguauaugggcauuuugcgugguuuggugcccagugaggccaggagagggcaucugauccuuuggacuggaguuauagauuacagauggcugccaauacuaaccacugagccaccuccccaauucugcuaaguuuuugcuaaguacaacucaguuuuuuuuaacccaguauuuuagcauauccaguuccuccucccaaacuucccuuuauaaugccucacaaguagucuaggcuggccuggaacuucuccaucuaccucagacucagaaguagccuggaauauuuguguuaccaugucuagcuuuuaaaaugcuguaucuaauuucuucauuuguuuaauucugggccagggagaugccccauguuacccauggacagaguccaauccccagaacuaaugguagaaggcacggaccauuucuuaaaaguuguccucugacaaccacaaguaagccagccccuaauaauaauaauaauaauaauaauaauaauaauaauaauaauguaaaguauuucaagagacaugacuuuuaauauguugcucgggauggcucugaggcucaaguuagccuucucccucagccucuggauguacacacaccaccacaccaggcuauaagugacgucaacuggaaguuuuaagaaauguaaaugcauguguauguccuauguguggaggucagagagcacgcugggugacgcccucaggaaucagucucucucucucucaguggcuggaguuugcuaguccuggauuccaggcacacgcuaccuuacuacaccaggcauucucacuugggcuccaugggggaucaaauucagguccucuguguggcuacccacaccucagacuacugguggcuucagaccuaauucuuguccgcucccucccagcuggcugccaaaggaggggggggcuguggccugcuugucuccaggccaucagagaaagaacugaguggcagguucagguggcagcugcugcagaacaccuaggaaucccauuccucuggcauccugcuaagaggcgccgcaggcccugggacacagcuuccucugucugcuguguacucagugugaggugcuacuaacuggcuggcccaagucuucccagguucuuagagguacauguggccucgcugagagggaaggaagccuuguuuuguucagauuccaucaaauguagacaucccucugaguuuucagugcuggcccacucgucaggaccacgucacagcacuguccugggcagugguucucacccuuccugaugcugugacccuuuuauacaguuccucacguuguggugacccccaaccauaaaaucauuuuguugcuacuucauaacuauaauuuugcuucugucagaggucacaauauaaauaucugauaugcaggauaucugguaugugaccccugugaaaggcucuggacccucacagguugaaaacugguggucuacaaacucauacucacuucaauauugaaguggucucucaaagaagucucccuucccuuguuucccguauuuaaucacuguuuaaccaaagcgugugauuccaauucccccgaucccuuuaaguugccaccauaaucggcuucuugugauuuuucuucaugcacuacccugcucugcaaagaccuuacagcuuuuacuuuauuccuuuugcccuuauaaucuuuuuuccccugagaagagggcgucagaucucauuacagaugguugugagccaccaugugguugcugggauuugaacguaggaccuucggaagaguagucagugcuauuaacuguugagccaucucgccagccccagaaagcauucuuaaucauggagccaucucuccagcuucagucuuuauuguuuuugcuguuuacucuuuauuguuacugcuuuguggggccgucugagccauagccacagcccuguauacuuuuguuuuuugccagaagucuuaauaucaauaccugaguccccugugaaggucuaacucagcgguucucagccuucccgaugcugcgaccuuuaauacauuucuucaugugcuggugaaccugaccauaaaaugacuuuguugguaacucuaacuucgcuacuguuaugaauguauauaucuguacuguaacguaaauaucuguuaucccugcccccaaaggggccacaacccacagguugaggaccacuggucuaacugaccacaguuuuuguugaacauuggcacucacuauguuaugacaaccaaaacugucucucaucaccgaccucauuucauuuaccaauuuaccaucuguuuuaauggaaaacaacugaaccaacacaugcguuccccauccaguaucaucaaugaggggaaagacauagguauguguucaacugaaagaugcuucccaacuccugaauucacauguccacgauggagcgccuucugucuccuucaucaggucccaagcuguuuaaugugccccaaaauugaacuggcauccugcauauuuugccagauauauaauuuuauucuggggcuggagagauggcucagagguuaagaacaagggcuguucugccaaaggugcccucuucuucuguguaaguauacaagaagucagaacacuguauauuuaauaaauaaaucuuuuuuaaaaauaaagauaaagcuuuauucugaaguacugugugugcaggcaugaguuuuugcaugccacaaacaaguaggagccuguggaggccagaagcgggugucagaucaucuggaacuaguguugcgugugguagugaguaucucugugggugcugggaacugaacccaguccacuguaaaagcuguacucgcuccuaaccauugagcuauuuuuuaaauuaauauuuuaaaauuaaauuuaaaauguuaaauuuuugcccccagauggauauugaauguaccuucaaccacgccacuaccuuguccaguccauuuccagcagcuccccgaugccacccauggccacacuucagggcccgagacacucagguccccagccuuccuugcauuccucucauaccuaauggaacucagacugaaaugcccuuuacaaagugcuggggaccagaacugacucugagauucaaauauuugcauagacuuuacuggcucagugucucuaguuggaaaaccccaaacccuccuaaaccagagcuuuucuucaagcuucagauugguggccaaagaguucuggauuuggaguauuucaggugcucagccuauaguuuuaauuccccagccuuuucauuuguguaacugacuggcucugaguacugugaacccaggaaacguuccgguaagccuguguucugugcgcagugcucaggaggcccaccagaccuggaagugcaguuuaaguggggcugagauaacagcagucauucaaauggauacuaaaccccuccacccuggcagccacccaccacuaccccacacuucccuuuuuuaucauaggugcccacagggcuuugggguuucuuuuuauuguucugagacagugaguucaaaggucggcuggggaggggagagaacugcacaccacaugaggcaggagaguagcauucccucugcuguccucugcaggagucaaggacacgcgccaguuggggacucagugcugcacugugucugugguuggaacgaggguccacucucucacucauuccuuggcucuccuacugcuguuggcuccuuuugcucauaggaugcucuacccagccaacauuccucucucagauggaaaugugggaacauuuuauuaaaauaauauuaucauuacuaauauuaaaaguaauaaauuuagacgggcagugguggcgcacaccuuuaaucccagcacuugggaggcagaggcaggcggauuucugaguucgaggccagccuggucuacaaagugaguuccaggacaaccagggcuauacagacaaacccugucuccaaaaaccaaaaaaaaaaaaaaaaaaaaaaguaaugaauuuaaauaacaauauuuaaauguuucaagaaucugcagaagagaagacgguccccaaaacuaagaugguggggaccaaggguguagcucaggguuaagcacuugccagcaggagugaguccccggguuccaucuuuagcaccacagaacuaagccuccaaaaaacaagccuggaaaagagccccggacagaaggaggaggggccggggagguggcuugguggucaagagcauuugcugaucgugcagaguucggugucuagcacccauguggcagcuggaagcucacauccaccaguaacuccagcuccaggggacccagugcuggcuucuggccuugguaagcauccaugcuuuugacaugcacacacacacacacacacacacacacacacacaaaugagaaaauaaaaauacuuuaaagagcagaaaagggagggcaaaggguguguggcugaagagcagagucaagaagaccauaaagaugguggcagaagcugccuagcaccucacggcccuagccgaaagcacccgaggagcccacucuaaaccggaagucaguauucgucauaagagaugguuuacggagcagcuugccgcaaccuuucuaagucgcuggccacauaccccugucugaagcagaacacaggaucacuaugcuggcggggcuuugcuaacagguucuggaagugccccccugcgcccugccugcccugcuuucaaaugccucuccagcagccaggcagcuccuacuuccucccacucuuccucuggaucauuuuagcucucucuccacugcaucaucgcucucugcugagcccacugcaggcgcggcuggcugaugacauguccacacuuccuuucagggcgugggacauggccauuuauuuugagaagccgcaucaaaccaaaggcggccugcaaucccucggccugauuggccgugcuuccgaagggcuugaguauuaucaggcugcgggguagauuagaacauaacgaccauacaacaacugguaggggagagagacuaucacagccagggaaauagaaacaaggaacgcaaucagaaucacucaaguagcuguagccaagacaaugagaauucucauugaguugaagaaacucagcuaauacggggcugcagagaucaaucauguuuccccaaacacuagggccuucuuucuggggaccauguguccucaugacacucucuucuuuccucauaauauucugaggauaacacaugucaagaauugaacugaaaagccucuggguagcggcuagcggcuagcuugaggaugcacauagcugugacucugaggccuuaccacaaaaguauggcuaugucacacaggccccugcauuagaaaaaaauaacagacucccuuuccaucagacaacagaugcuuaggagcuguggggcccugagguuaccaaggcagaggcuacaaggaagugagcugccggacagggaaacaacagccauaggaaacccugaggcaguuuaaauacugcuaaacaaagcuuccagagaccaagcaggaaucuucucccaacagcccgucuuucuguuguccaauaucuggguucaggagugggccaggccguucacugcugucucuagauaagagaaucugaaaagcggaugaagagucugggaagaaugacacacaggcccuaggccagagaggacucugguacuccgacauacucaaaucugaauaaacaucugacugcugauguccacacuugcuggagcaggucaugguggcacacacuguagucccagcgcuuggggguaggcaggaacacucccaguaaguuuaggcuacucuggucuacagagugaacucaggcuagacaggguuccauagcaagaccccgccuaagaacugaacugaaccaaaccaaaccuguacuggcucagacauguucuuccugucacgugucauaccugcccuccuguguauuucugagcugugagcaccaaucuaauguacauuaucacaccacuucaccacagccaguggcaucucugugcuuccaaggcagaaccaaguuguagggguacagugcucccccaauagcagguccagauuaaagaacaaacacuucgcuaagaaaugcuggcuagaaucacuguggccaacaccaaggaugcccuuggucagagcagcagcuuuguuuugugaucagaaaucacccggggcuggagcugaagcuggagcccagaagagugcuugccuagaaaaccuggguuuggucccaagcacugaauaaaaaugggcaugaugaugcaugccggcagccucagcauuuaggagacuucaggagcauuuagggcaggaggaucaagaguucaagguuauccucagcuacauggugaguuugaggauaguuugggcuauacaaggacaugaacuauccuaucagcaagggggacaacacugaaggcuggugaccguuguugaaugcaaguuguaaggagcugagggauuaggccauggaauuauuacaggcacacucacucuccaccccccuaaaucauggugagagaaagagagaauuuaacauuuaggaugaaagaggaagcuucagguuggagccuguagugaguuguguucuggaacgaggcucaaaccuuuacacagaacuuccucagcuugccccugcugacauuuccugacugaccuuucccugacaucacuguugccuuuuguuggccuuacuacacuuauuggccuuacuacagaguaaaaccuaaaaguuacaguuggggaguucucaggggugggggugggggaugcccacggugaauucaccugcaggucagagagauccugcaacccuccaaguaaugacucaaaucugaccaggggaaaggcgcacaaaacugcuuucagugacuugcguuuuccaguuggagcacugggggcacugagaucugacggugaaaggaagcuuucuacuguaaaagcugagcagcugugacuuaacaggucuggcaugggggcccuaacaucugauuuccucccccaagcuuccagaguauaccauggguuugaaagccaccguccccauuuauguaacacggagaggucuuggucagacauccgucauaccagcuaccggugaaccuccuccuuacagauccacgggagaaaccucccuccccucuccuuccugcgcagaguugaucucagcagccucgugaaacuugcagcucaagugcccagaguccaacccaacccgcagccgcuuuugagugaccagguaggacccaccggcaguuucgugggaggggcggaaagccugcgggguugcaucugggugccuuggcgacaucaccugucgcucauccuuggaaccugaguaaacaggcaggcuccccgagguguugugggcacgccaccgagaagcugcuugcccggugcguugugcgcgcucccccgcgcucucgccgugcucggucggucgggcgcagguggcagggcacggcgcaaaccccgcacaccccgcgcccgcguccccgccgcggcccgcucaccugcagucgguggcucuugacgaggugcauguugagcgcagggcuguugggcaggaucuugccgcagccgcgcacggugcacagaauauuggugcgcacagcccgggacagcucgcucacagucggcuggaucagcucccgggccgguggcaccggggccgcggcccgagcccuggccggucucggccggcugccuugcagucgcgacucgggcggccuccacgggcuagaggcggcggcggcuccccgcgugcucgccggcguggccgggacacccggggccggacccgcagaaucggccgccgccgccuccguggccgccauggcucccgcacggccgccaggccccucucgcag

SEQ ID NO: 4814 - RNA, 7145 nt, Mus musculus
cuuuuucaaauauuucaguccacauuuaguugagucuacagacauagaacugaagauguugagaucugauuauaucaacucugggggaagaaaggcuugcugaguccuggacacggccucugcaaacgauaucucuggaaagcaccaucaguuaaaggcaggagccugcauccaccucauagagcgagggccagucaccagccugcgggucucacuguucacacaggggccuguucaccccgacucucaucagugcuucuugcucuuggcuuucagaugaugaguuucucacagaaccccuucccuucccgaagccaauuugaugucagugggacuguugguggacuucgccugaccagcuccagcggccaucccaucccagugaagaaccugucacagaauauugagguaggugcugcgcuguuagcagcagcuggguggcacuuggccuuccuucucuccagcuugguuugggagcagaugugagaacaacaguuaaagagagagagaccgcucagugcaucccugacacuaggaaacacuguauucagcuuuaaaccaugcauauauggccauucacacaucuuugguaugugacaguucuccuaacucuauuggguggaauucuaaucaugguacaaaccaaauguucauuucaaagguucgugaugcagccuccaaacgcuguuagauuuuccuuaaagucaagcaagaaugcuuacauucuauguacgaugggcacuuagauuuuuuuaggagcuuacugacuuuuucuagucgucugugguuuccccucaaugacugauuaacaguuugcagggacgucaccauugucgcccauggcacuugugaaugugucaccaggcacuugggaggaaggugaucuggagauuggcuguugagacuagauuacccaggggcccaguggagguacaagggggccucagaagagagaagcaggugggggaagguguuaaggagagacacugacugcuguugaugacacagagagagguuggggugaggugaggaauggaccagaaaccucggaccacagguggccuguagaaacaggaggauggaaagauaccucccugcccccaaggcagaggucuuccuguccauccacaccaccucagggcuuugaacauacaucacuuucccugcccaccugccugcugccuggcccgaacucuuuguuucugaaaacagauccugcugccccggauuucagcacacauugagccgaagaugcugagccuggccucccgugaagcucugucagugaaugugacagcaggggacacagcuuuggggauucagcuucauuggggaccuggagucccacucauacucagccugggcuauggcuaccaucccaaugagaccagcuaugaugcccaaacacaccugccuccuguggccgccacagguagucagcuuccugggcuguuugcuugagcaacuucccagcuguguccagcuucaaacuaaaguuuuaaaggaaagucagaggacaaggcugggacgauggcucagucauugaaguguaaggaccagaguuccacccucaggaaccacauaaaaagccuaugccugugaucccaauccaggguggggaagggucagagacaggaggauucugggguucacuggcagcuagccuagcucaaucugugagguugcagguuuuggugaaagaacuugucucaaaaaugaaaaacagaaaaccaaccaaccaaccaacaacucccgcccccccuccccccgcaaaaaaaaaaaaggagcuggaaagauggcucaacaguuaagaggacacacugcacauguggaggauucugguucgguucccaucauucaugauggguggcucacaauuccccuuguaacuccagcuaacggaggauccaugccgcuggccucuauaggcacccacacauacccacauucacauaccccucacugacugcacauaauuaaaaauaauaagaauaaaucuuuuuaaagcaugaaauaagguggagaagcauugaagaagacccagugucagccuuuggucuccucauaugcacacguguguguacacacacacaugcacaaacacacacacacacacacacucauauacaggcacacacacaccacauacacucauacacaggcaaacacauacacaccauacacacacacacacacacacacacacacacacacacacaccaugcacacauacaccacacacaugugcaugcacacacauacaauuauuuaaugaaaaagcaaagaacaaacuguccaccuucuucagugacugucaugggcugaugcuauugguguuauuuacccccauuagaugaacauuuauuacaugcaauggagaugcagaugagcccauaaauaacuuuccaaggccagcuauagagaucucuauguuacagauaugggcagagagggucaagccaggugcagagcaaucccagcacuugggaggcgaaggcaggaggaccuguaggaccaguagacccaaccuuggcuacguagcaaguuugaggccagccuggucugccuaagauucugcucaaaacuacaaaucaaacaaaaaagaacauagauauucaauaaccagucugauaccacauagccaauaaggacaugagcccuucauguccugacugccccugcacagugagcaaggguacucgugggacgauagagccgccucgaggucuccaucccugccaugucaccuuggucuccccuaguuucaaugagaccagagccuuguucccugcaggugaucuucccaccuggauccugcacccagaggaccugcccuucggagaaggagucuacuauuugagggugguccccgaggcugaucuggagucuagcucuggcaggaaccucacaguuggcauuaccaccuuccuggcacauugugucuucugggaugaaacccaggagaccugggaugacucugggugccagguaagggcaugaagaauaagcuggggaggcuuggugggagugucuacccuuguagcaucccuucuggagccucuggcacgaugucucuggcuucuccaaggugcucugcauaugccauuccugugcucagaauguccucuuuccccucaguuaagcccauuuuccuugagaaaacuucauggccccgacuaggucagauuuccugcuauaaacucuggugcacacucccugcgucacccugcuugguggugugguccccaacaucuuaccugagcccaucucaggagccaaaaguacaggaucaugauuauaaauaggcaugauucagagggcaucguguguguguguguguguguguguguguguguguguguguguguaaggcauagcaagccagggugucacuuuccagaaacugaccucagcugugucccaaguucaacuuuaccagcauuagcucaucagugcuucagauaaccccaggagagcuguuguccccauuucacagucaaugagacaauggaucaggaaaguggauggaucugccuccaaaucccacacaccucguacagaggaccugugccucagagccgggucugcccguggccaaaucaucaccaugacaacacagcuuucccaaaucaucaccaugacaacacagcuuucccaaccauugagguucagaauggucuuauugugaucgaauuuuuaucaagguccaaggagcaaaauggcgaugguccuaagagauagaaggugccaugcucuaagcaccagccuuugcaucucaggaacaggccugggcggacgguggccucccagaccacccaauccccaaaacuaccuuauguggcuaacaugggaugcuccuguacccuaggacucagucugccaucaaauggauuugaguuuaguccauauuugcuggaugaauuugggcaaguagccccaccucucugacccuuaccauccuaaaacggggucaagcugaguggggugcaggggugcaagcaacuuuacacaauaccuagcuuacagagcaggcuccaccugucaaagacaaucacuguguuaaacccucugguuguaaaaggcaacgcugucuacaagcuggcagccaggggacaggaucaggguggugguggggagaaggcacaggauucacucagccaaaccuacagaagugagcuuccagauguuugugaugccguuuaaaaugcgcuccccugggguuggagugaugcaccaguuggaaagugccugcuuuguaagcacagguccuggguuacaugugacagugccaggcaucacucauggagaggcagaguuaugcggcggcuuccuagggcucccugaccaaacuguuuggccuugauggugaacuccaggccaaugaaagacccugugucagaagcccagugugguuaugcgcaccuuucaucccagcgccuggcaagcagaucaaacaagaaagccaaaauaagagagagcaggagagcgggagagcgggagagcgagagcaggagcggagcgagagugagagagcaggagcaggagagugagagcgagagaacauugcuggaaagguuaggguuugaucccuagcacgaugaaaguaaaucauguucucgaaaaugaauuuuuuucguuguguguguauaugcauguucaaaugugggugcacaugcaugugcguccauguguauaucagccagaaacugaugcuaggauuaauccuccauuuuccaccccauuggaugaggcaggugucccagucacacccacagcuggcugacaaggcuaggcuagguaucaagcuuucucuagggcuccugccucccccuucugaggcuggaauuaccagcauguuagcagguucaccuuaggcauccauuuggguucugggaacucuggacucuguccgauccucgcuguuuucacggagaagccgaguucaguuuccaccaugcacaucagcagcucacaaacaugugugacuccagcucuaggggaauuugaugccucuggucuagauagccagucagccagagucuuguguagcucagguuagccuugaauauguaaauggguugaggaccuugaauaccugguccucccaccuucugauucugggauuccaggugaacgccaccacacgcaguuuaugugauguugauucaacccugggcuucaugcauucuaggcaacuucucuaccaacccaguuacauccccagcccuaaaaaagauauaauuuuacccagaggguuggcuaaauccaugggcccgaaaggcugacuguguggugcccacacugaggugguguuuaucauuuugcuucacugggcugaagcagacucguuucucgaauauggucucucugggguuugcaggugggcccacgaaccacccccucccagacacacugccuuugcaaccaccucaccuucuucggaagcuccuuccuggugaugcccaacgccauugacguccgccagacugccgagcucuuugcuaccuuugaggacaaccccguggugguuaccacagugggcugccucugcaugcuguaugugcuggugcugaucugggccaggaggaaggacauacaggaucaggcuaaggugaggucuuggcuuccugggaaggggaggaucgggggcuguggaggccagaggccaggggucuguggagaggccaauugugguagccuaggccuuaaccccuggggucauuuccggggagcuggccccucagccuaugcgcuuacagaucauccccuuucagcagauuaucagggagauugugcugucaaucaucaacuaaauacucacugcaugcaggcacuaccgccccacucauguucacaaucucugagggaaugcauaggggacugugagggcccaguguggcagagcuugaggcugcccaucacugccucccuccucccuacccaucacuugggaugacaucacagaauuaaaugucauaaggugucacucaguagucacacgggucuuugcuuccuccaugggaccgaacuuugaucucuaaaugucucggguuggggcuggagggauagcucagcaguuaagagcacacacugguagaguggagcaaggcuucugucccagcacuuggagguagaggcaggaggaucucugaguugaaggcaagucuggccuacacaguauuucuuuuuuauuuuuuuaaauuacuuauucauuaaguauaugagugcacuguagcuaucuucagaugcaccagaagagggcaucggaucccccuacagaugguugugagccaccaugugguugugggauuugaacucuggaccucuggaagagcagucagugcucuuaacugcugagccaucucuccagcccuacacaguauguuuuaggccagccagagaaacacaaugagaccuuguguaaaaaaaauuaacaacaaagacaaaacuacacaaauggggcuggagaggugguucccugaucagagcacuuguugcucuugcagagcacauggguucgguucugagcaccgacacggugccucacaaccaucccuaaguccaguaacuccaguuccaggggauucacaugcaugcucauaucuacacacaugcagacaaaacacauaacuaaaauaucacaugcugauguugcacagggaccaagcucaagguccauuccuagaacccacaucaggcagcucacaaucacguggaaccccaauuccagggaaucggugcacuauucuggccucuuuggacauuguggccaaacacacacaauauguauauguguacauauacguacacacauguacacacacacacacacacacacacacacauacacauuucaggaggcugagguguauagauuucuaugaguucaaggcuuggcuggucuacauagagaacuccaggcuagucggucaagccuacauagugagaccuugucucaaaaaagaaacacaccuauauauauaauacauaauccaccuuaaaugccacagguugacucccagaagucaggcucuaaaauggaguuaaggcugaggguguucucuaaaaggaacuuuuagggugagccccuggggagcuggcaguacggucaugcugcagugacagcucaccaguccucgaggaga

SEQ ID NO: 4815 - RNA, 5230 nt, Mus musculus
ggucccguggccaggagcaugggcucuggaguugaagaacccagggcugcagacuucugaucugucuucuggucucagggcucaguucaguuugucucuggaggaagggcaguguggguuuuggccucugugggcucuaaagaaagggugacuggguccugggccgcuguguuacccaucaguagcaauggcacaguuauuucuuuggucaugucuacuguccaugcagacagugcugugagacgcugagccaguaggguacugguugggaacugcgcauuccuggcuccugucauugccuggcccagugucugccaccuccuuaaaaagcauccaacaucuguuugugcugagaaaguccuuucccuucuggacacacaccacacaccccaccucucaucuccgacauugggauaucagaaacacaccccaccccaccccagaccugugcugaaauguucaagaguggcagacaagccaggcaugguggugcacuccuuuaaacccagcaagugggugauagaggcggguggagcucugugaguuuagagccagucuggucuacauagcaagcaccaggacaacuagaacucuauagagaaacccugucucccuccuuucagagcgugccugacggaguccucuaaggaucuuuaaaguccuuaaccaaggaggaacuuuucgcuuucgccagaauaucaaguuugucaucuagguugaccaaguaaaccugguguuuucugggcugcuggccgaggcuuagcuuuaagccuuuaacuuggaugguggaugugggaaccgcuacucuuucuguguguccgaggcuuccagccuggagguucucggcagugugcagcaugaggccugagcauccuggagccguccuagcaggugcccagacccuguaggggccuugaggcucugguuccgugguagggcauagaaaggagcauuucaggccagugggcagaacuacagaguuucauuagcuuauaaaucuugugcauuuucuucuugauuuuuuuuuuuuuuugagacaaggucuuaagagccuucugccucugcucccaccaggucgaaugacguuagggugacagggugcgucccgcaguucuggcugauggugucugccagcacuaccaggggcccacugugcucaggacagacuguguggugcucugggaacuguuuauuuagucaaaaggagucauuccauggguccugugagguaguucuggguccuaucuaggcuuugccuuaugcccuccacugcucgucaucacguuagucccuugacacuggccacuggccaccagccaccauggcagacccuucccagggugccucaugguccggcuuucccuaacaguccuuaauucccagagaucucuugaggccgugaugcccaccagaagcauugugcucgcuuggcgcaggcuuuguuagaagcucauggcugacuacccugcuuacagcuagggaacggcacucagcucucccaagcugggcuggcugcccgggaaggugcuuggcgagcucagccaacguccccugggagccggugugguucucuguuaccucuuguggaacauuucuagggagcccauucuuuuguuccuauccugucuccucugguuaaagccugccagagagccccucagcccucggguaaacagugagauguucccuucaccccgguggucaugggagaacacuucccagauccccuccccauccucagggcucugggcuguccuccugcugcuggaacaggguccuucccacagcccucuggagggagggauuuggaucuggucaucagagcauccucaguaaacucugcuggcuuucaagcccucauacccuucuccccaccuggcuuccuaguugcuugaacugugucaaaaagaaacaaggaaaggaaagccagcaaagaagcuuaacagauaaagcuugauaacgugaguuuaacucccagaacccaugugggagaaagaggaaacugauucccacaaguuguccucuggccuacacacacauucacacgcacguuaauaaguaaaaggaaaauuaacucaagugcugguggcgcaugccuuuaaucccagcacccuggugacagaagcaggcaggucucugaguucgaggccagccuggucuacagagccaggacagacagggccacacagagacacuuugucucaaaaagacaaaagaaagaaagaaaacuagaaaaagaaggagagagcuguaacuccugcucccuggacccagagccccggagcagcagccuauccagaaugugccuucucagcccuaccaugccucuguguuggcaccucccaccagccagcccuggcagugagagggacaccugccagccagucccagcagcuuccgggucagcacccagcauagccaaacacaucucuagccuggagcaacuggagacuagaacaggagccuuccaccuucccugaggccaccacaggcucucucagagucaggggccagcaccaggccacacauacuaccucagcaucuagcaucugucacagcauuguguggucacagauuguccaucaagauugugcucagagccuggucgccucacagaggcuggcugacacccucccucugcacuggccccgcaaaccgcuaugggauuccuuccugcaucccauggcgugcuccagcgagcaagccaggcuucugucuccuccugccuuguuuagcucugacuuaaauacaccucgaacccccaaacugugaguagagucagaaaugggaguagcuuguuugcagugagaaagggaccgcuuuuucauauuuucaucacaaggggucuugcuucaagagaaccccuaaaaacuguguauaugaugcugaugaccagggugaugaggacuguugugauaccuagaauaauucacagaacuugacugcaggcuuuguguaaacaacaguaaucaagaguguagggcuggaaagguagcucagcacccccacgggggcucgcagcugcugcuaacuccaggggaucugauccucuccuucugaccuccucaagcagcgcacacaaacauaagcagguaaauaauaauuuggagacugguacccauggcaaaaaguauccucaaacuuaaaaaaguuaacuaagccuucacucugucugucacauaacaacuucuucuagaugacaccuuagaguucagcuucaucauuuagaggccauggaaauccuaggggcugaagaacuguauguugcgaacuauuccaagugggucuucacggagaaagaagucaggcacgguggugaaugccuuuaauccuagcacucggaagggagaaccaggcagaccucuuaaguccaggcuagcauggucuacagagcaaguucuaggacagacagggccacacagagaaacccugucucaaaaaaaaaaaaaaaaaaaaaaaaaagaaagaaagaaagaaagaaaagaaaagggaaagggaaaagagauaacaaauaaauagagaagaaagcacaagccccuguaacuuaacugaguagccagugacuucugcccgcccgugggguccuuucguuaugaacccgcucgaaagcuagcuucuguuuguauccuccuucccguaagccgccagguccacaguggcaagcggugaggcucccuuugaccacguuguccaacgcuugcacauugugacagccauaaacaaagaugguggcuucaguggaagugccgaccaaaccucacagugagucccauaguuggugcccagccccaccgcaccccagccuagagauggccccacacucgcuccuugucaguauccaggcugcagacucagcccaggcagaacucagucugcagcagucagaaugagacccacccacgacgcacaaugaaccaggcgauuuguugguuuucugucucuauagugucugucuucugcuaggauagaaaacuaucaaacccauugaaaaauagaacguaaauugaguuaaauaagacuguccauccccaggcuggggaccacaagccugcaaguacuccugcuguguguguugugcugagcaccugauagucuugcaaagagcugcuuccuagcacauugaugguuuacccugggaugcaccuccuaccauaaggagaacuccauuaaaaccagaccagguuucacaaauaccauaccaagcugggcaaugguagugcaugccuuuaauccuaguacccaggaggcagaggcaggaagaucucugugaguaaaaggccaaccuagccuacaacucuaguucuaggacagccaggaccucacaaagaaacacuugucuggaggaaaaauagauaaauaaaauccauccuguccaaacacaaauccgucucacuaacacauguguguuucauggcacgguaccuguggaguggcuuuucauuucaauccugcgcucucacuguuucuacugaagcgcccaggcagaagagagcuacgcucaggugaggcugaacugaguguggcaaagcuaagcgcccuucgcacagcgcucuugcuggaaaacuggcauucgcagugggcgcacacaaauggaaugaaagucauuguguaaaaaguguaaaauauuugaggggccagaaggucacaaaguacaaaacuguccagagaauuuccucccgcacugugccugucuccugccuugugggccaaauguauccguuggguggagugaccgauuuucuauuccuuugcuggugucauagcaaagucagaauuuuuuuuuuuuaauuuguaacguuucuuacaaaguuacuuuaugguuuacaagcaacacugaugcagaaggauaugucgauuuucuuaaacuaaguagcagcauuuuguuuacagggcuuggauauuguagaugacgugggauccggucccucaucccuagcacuagaucuagguccuagggagaugccgccauugugcuguucccugguguaccacagaucagugaaaguguuuuaucuuuuuuacgucguuuguauggauuggauuuuauaaugguaagaaaacagaguguuguauuuugagcugaaauuuguguauggucaaguaauucuguuuuauguauuggaaguccguuuacaacuugaacuauuuucuagaagaguguuggacaaaaugaauugucuucaagcuguuucauuaacuaauaaagucauuugauggggaagacauuuga

SEQ ID NO: 4816 - RNA, 1717 nt, Mus musculus
cuuuuuuuucuuuuuuuuuaaaaauuuuuaauuuuuuuuuuuacuuuauuuuauuuuuuauuuucugcuucugcuucucucugcaccgggugcugugaaauacggaaaccagggucgggguuggaagaaagcaacaagagaaaucaacagagaaacgaacacaaaucagaacucacuccacacacacacacaggcacacgcacggaagaaaaccugccacagaaagggaauuaagaccgagacucgaacccaaagucucuguguuuguuuuguuuuguuuuuuuuguguguguuuuuuuuuuccuuuuuuaaaaaaauuagggcauaguuggaggugggguggguaauaaaguuuaccuggcaaaguauaaaacaaccgaagcauggucuccaucgaauaagauuaaauagauauaaaacaauuaauaucgacugguagggggucugguuuggagguuggggggagauuugugcuaaaccaacauaaaaagggcuggagucggggaaagagaggggggacucccaaaagaauugucaaaggguuguuucuguacagugaaggggcuugguaagaaaaagccaacugucuguaaaaagaaaugagguuggucugccucgggacacgaugggaaggggaugcugcaguguccacgucaguggagggaagguguggacagucgggugaggucaggcuggcugggugaaguagcucuucucucccaagagaccaugcaaagaagugggcguggggcaugcuuagugaaccacagagggcugggggggggaggccacagguugcaagucucaguaggggacaaggacagcuuaaaagggggugagggacaacagcuggaccuuggaggaccaacucuccuaugggguauacagggagggaaggucaaggcccuuccaaauucacagaagcagaggaggggaggugugagcuacaacguggagaaucuaucucuuucuuccucuucccucccaccuugauccccacccacaaggaaacuggagacacauggaaauuauacagaguagcgagugggcagacugacugaccaggagagcauuagcauacaagagucccuuaagaaaaaaaagcaauuaaguuuccaaaggucuuuuuuuuuucccccccuguuguuguuuguuuccuuaaaaaacaaaaaacaaaaacaaaacagaaccacuagcacuaacccgacagcugacugguccagacaguacuacacgccaugggggaggugagaagggcaggcaagugggggcaggugaggagggagggccggucaaagacuucauaaauaagagcgggucccagacccacaauuugucaacguuucuuaaauaggugcguuauuuaaaucuuauguacaacaagaaccacuuugcauagcgauggugggagacacaggacgauggggugacaugacauuccugucccaaugguaggggcgagaucucggcucggugcaccuccaggaagaaagcguccuccuucuggcccgaguggacagcaucaggcuggaugaaugcccuccccccgccccccccuacgguaucacacaacaaaaggcaaagaaaauccacaaagggaacccccccaccccuccccugcccucccuacccgcaguucuuccucuuguugccaccaaggcugcuuuugaucaaggucaaagguuccaauaugaagcucuaagaauuaggugggggc

SEQ ID NO: 4817 - RNA, 136871 nt, Mus musculus
caaagcagaaguaaggagcgccgcugagcaagaccugcgcugccggacugcccgggccccaggcggcugcugcacgagggacccccgaguccccccaacccguggcuggcaggcccagggauugugcggguggcugcgcuccggggguaccgccaggugaguagccaggauggauggagcuccccggggacuugcgcgugugcggggacccuagagcuggcaccgcguuggguggggacugcgccggagcccaagagggcgcgggcagggcuggggugcgcgauccgggcagguggccgggugugcccuggggaacccuugcuuagggacagccgggcccggcccagccgccggccacuuccucuccuggggcuggcgccaccucuccagggugagcaguggccaacuaggguuugaaugagagacgcggcuccgggugcugggguggccgaagcgucuaccucgccaccgagaguccuacgcgggagccgcgucccugcuugcggggacuugauuuugaacaguacuucccaguaguacacagguggcuccgggguggggcggagcagcucuuucuccacacgcgauucugggacccgccccucccgcaauucaguucaguuuggggaucucaaagaggucauuugccucgcggggagccagaauucgaagggaagguggguuguauccggaccuaggagguugauaccuggaaagucaggagcaggcccuguccguacccugaucucgaacuguugagagagaggcuggcagggcgaggggccgacacgcccuggaaacagguggcuuucucucugagaccuaaauuugaauuucaguuccauuuaugugacacagcacacagagaggagcccccccacccccaccccccgaguccagguuucucucuugggucccguacuagaccagagccuguuuuccggggcaucaaagagacucccugcaguuccugacccugguggcaaaggcccuuccuggugggcacaggucauggccccugcucuuugcuucugcgggacacuuacaggauguuggggucgggacuagcccuaggcuguuacccauuuugcacgguugugggcagcaguguagcagucccaggggauuuuggcuguggauuuuuauugaugcuuaaaauuacucggugcuuggccucccaggcaaggcggcgugugugggguacucugaaggagccccagcggggacccuuuugcaccuccugggcgaaguuggugggaaguuacuggugggaaaacuucugcaaauaauuaauuucgaaaauaggcaacccucucccugcccugucuccgcaaaagggcuuuucuguuucaacuaacagaguggacccauucauaugucuugucccauccucucucauuggcccccucuagauuuacaagcaaugcuuucgagauauauauauauauauauaucacuaauaacauuuauauuauaacucauuaauuuguaaguuucuuuuuuuuuaaaucaaaauagcucacaaaucucccaagaucaaaauuggcgugugauaauuuauaaauccacucuuuuccguagcuucuguacauuuuaaauuuuuuaaaauuauuuuugagacaaucucauuauauaguucagguuagccuugaacuucugaucuuccuguguccaccucccaagugcugggaugaucagugugugccaauacucuuggccuguaggggaugcccuccccccaccccuccccaccccaccccccaccccccaccccccaaccccccuuccccccguaccccccccccguaucccccaccgcccacuucccagagaugaggagcccaaguguuucugguuuuaugguccuguaaggaucuuuccggaugucucauuuugcacaagagugcuugcuggaucaacuuuauacuuuagaggugcuuaccagugcccuuaaaaaaaaaaaaaagucaacccuguuuucacuuccacguguacagguggacauuguugguucuuggauuggaccuucccaugcuuuuaggaugaccgucaaaugaaccccgauaucccuggugcagugggaagggcaggcaauauucaaggguucagcugguccaaagucuaguagaauucuuccuuggguuuuuggcugaaauccagcacugacccacaugugcagagacuguucaagagauggauagucccuguuuccuguuuugggguucuugugugugagaaguugguuucaaagugugaaggacauagaaacgugaaaaaaaaaaaaaaaaagaaaagaaagaaaagagguuucuucccagcaccaccagccauguuuguacugacuaugugaguugaucagguuacccauaguagggguggagggaaggggaguccaggcuaauucauucauuuuggaaagaacaaaacagaagcaaagagggaguuaucuugauggcuagggcccugcucugggaauacagucagcuggaggagaccuucuugccuugggcguuggagcuuggaauacucugccugaacuggccacugccuggugcccuguccagaaucuguuuccagugugguguugcuucagggcuugggaucuugcugggggaaaccuuuccugggcaucuaacagugagaaacaguggggaugccaggauggagcauucuguauagugcagaacugugcaacggggaccuggaucuuccacuuuguaagcugggugaccuuggacaagccagucccccuacccacucuucaaagagucggccaguuuuguuggcauauggccaaguacugccagcauucugaauucacaaaaagcaagcccugaaaggaucagaaucauaugacugucugucugucugucugucugucugugugaccuuggucauauaauuuccuccucucuggauggauuuugauuuuuaaagcugucagcuuuucucccucuucccccggugcuaggaauugaacucaggacuuggcucuuguugggcagaugcucuaccccugagcuguauucccaggcauggcauguauuggucuauaagguaccugaggguaaaccggugucaugucuagagaguuuuauaauaacagcuacuuuccagggggccuuugcuucugucccguccccccccaacgaugaacuagccuggaaacuccccucucucaucuccaguggcuagccugcuuaacugauagugucaauauaaauagcgcguuuggcauggguagcucccaaguggacaggagagcuaagaguguauauauaucuugugaggucacauccuggcuuguguugaagccuguuccccaggcuagaugacuguuccucuaccagcuuuucacucuguagcgcaggcuggccuuggauucuuagcaacccuccugccucagccuccccaagugcuaggauuauagcugggugcccuguuguguguuuuuaucucauuuucacagggucuaguauaagucaaguuggccuuaacuguggaugaccuuggacuucugauuuucuucuccccaccucucuuguguugggcuuauggucuauggccaccaaacucucucauguggcacugagaaccaaacaugcuaggcaagcauucuauccaccgagccucacccccagugccucaucuuuuuaccaagauggaacucagaagccuuccuuccucagcugauuucucuugaguccuuuaggccucagguggggggagggaggcagaggagggggagggggagggggagggagagggugguauuacaccuggcucugcacugcuguuucuucccaagccauaggcagggaacagguggagacaaugccuccccauggccagcucucccaccuaggagccuuucugccuuccuucgagcaaagggcaaggucugagccucucccuguucgcugacauuugcauccuaguucccagcccaagcagaguugauacucagagcuccgaucaccuggcugauggauagauaagcauccaucagucaguguuuaguuccccaaaucacaccauccauaccucaggguauuuuguccucauuuugcaagugacaggguugagguucagagcaaauugccuagagacugagcagauuggaggcccccacaguccuaguccaaggccugccucucacuuccuguucuuuggccuggguggaauagcuuucuagugcugcuugguaauccugguggauacaaugacaacugugggaccuggcaggaggagcugagguugucacacaguuccacugagcacccucuuaguugauuuuaaaaaaaccauauuuauuuacuuauuaguauuuacuauauauuguuauaugugauacuaugcaauauaauuaauuauauuauuuauuuauguacauugguagguuugcuuuugccuaugucuguaugaguuugucagauccccuggaucuggaguuaagcaauacaguugugagcugccaugugggugcugggaauugagcccggggccucuagaagagcagccagugcucuuaacugcuaagccauccucuccagccccuaaguugacuuuuuuuuaauuaaaaaaaauauauaugaauauuuuccugcauauauguauuguaucaugcgugugugccugguaccugaggaggucaacagaggguaucagacccccuggagcuggaguuugguggucuuaagcugccugacauggggguggggacaaaauccugaucccuugcaagagcaacaagugcucuuaacugcugagccaucucuccacucaacucuuucucuccuauuuuuuugagauacugucuuguguagcccaggguagccccuaacuuacuacguagcugagguucuacacuccgcuuccaugcauuaccacagcugacuugugcccuuguuuuaggggccugggaugcauagauuauuuuauuuaggucuuacaaagucuucaggaggcugguaacauugccguccuuugcauggcuggaaaugaggucgaaaggguguggugucuagguacaggugcaccuaucuccgcauccagcaggcucaaggggcuuugagcugagaagugaugagauugaguuugcguucugaaaugcugccagccacugggcugagaaccucaggggcucggggcaagaagcuggguacagcagagagcuccucggaggagccagggagagggaagaaugcuuggauucugaauuugcccguuguuuuggggguaugagaacguccagacaauggcugggauacucgcuuaagcacuaacugcccguaggagggcgcugcuccaaagacacuuggguacucugcuuugcuguacacgggaggcugaggguugcccucugggcuuaggaaucccuugaggagggauggaauggaagcagagguguggagaagccaccauuaguaggggggcugccaggccuggacauuuucuaccuuuuuggucucauuguuaugcagaagaaccagcuguucucauuuuuuguuauaaauggaugguuaggcucuagcagguuagauacggugcuggagagagguuaccgagccugucagaacggcuuugcuuauucaaauuuggacaagaagagaggguggagauuugguuauucaaagucugucuagcgguggggagggucaaggaggccaauagccccccucccccaucuccacccagacuuuauuuaaaccugcgcucucuaaguggccaagggcucucagcacuagaaccuucaccuauaacuucaccuauaacagggucuuggcuacugacacuccagucacacacccaccucaguucauuaaagccaguucacucuuuuaucccccccccccccccagccuccaucuuucuccugcuucucccgucucccuggagcggcugacaaugaccaccauggucaacguggacacccuuccagaauaugagaagagucagaucaagagagcgcuggaguuagggacggugaugaccguguucaacgcccgcaaauccaccccagagcggaggacaguacagaugaucauggagacucggcagguggcauggagcaagaccgcagacaagauugaaggcuuccguaaguacuugcugggcagagcagcgggguccauaagcccugcugccuaccagaguagcaucugcucauucacccugcuuuauuuaaacccgucugucaggaugaguguugauuugguccauucuucuuuuaaagauuuauuuuaugaguacacugucguugucuuuagacccuccagaagagagcaucagaucucguuacagaugggugugagccaccgugugguugcugggaauugaacucaggaccccuggaagagcagucagugcucuuaaccacugagcuggcucuccagccucauuugguuccacuuugugugggugggggcggggugagguugagaucaggugggggaaguugauccagggaaguucuugugaaacgacagcaaccccaguuggucaacuuggcccugauagugaaacagaaguggggaucaccuggucccaaagguagcgagcugucugacuucugacaggccuggggaggcugggggcuuaguagccaaacgccuaacgauuuauuuauuuuguugcaaaccacagcagcaaggagcucuguguuuaaagguacagggaaggagaaaaaaaaaaaaucaguuacuguuugcagccuucagaugaaauucugguccugguggcugugccuucucuagucaccuuauacugggcuguuggcucaguucugggacuuucugaggagauuguagcaaacagaguuuucaguugcagaugugugcuuuaauuugauuucuuaccaauuagcgugaguuuguuugaaguuuauuuguucauuuaagugugcaugugugggugcgugcacgcucauagcauucguaugagggucaggguggggcacuugugggaguugccucuccccuauguguggauucuggggacagaacucaggcuaucugguuuggccacaagcaccuucacccacugaggugaucuugcccgcccucuuuguuuuagaagggucucauguagcccaggcuagccuggaacuuggaaaguagcugaggaugacuuucaaccggcgaucucccugcuuuuagcucucagagcuggggagagaggugugcaccucaacacugcuauguauguauuuauuuauuuuuaugcugggccaggaauggaacccagcguuugugcauaauagacaagcacucugccaaaugagcuauguccccagguccguacugaaaagcucacaugauuuuuccuuacaguaauuucuuuacuuguguguauguuauggcaugcgugcacaggucagaggacaacuuauaggaguugauccucuccucuuaccauguggggccuggggaaucaaacuuaagucgucuggcuugguggcgagugccuuuucccauggagcccucguggcaggucccugacuagcuuuucauagaaaaauuauaauguacuuuugaaauagcagugcuaggaguugaggcgggaggauuguggguucacuguggccacauagugagaccuugccuuaaaaaugaaguacugugagaagcuagagaauuaacucacaagugccuuucaccucugacccucucuucaccuguauccugcauaagcgcugaccuagcuuguucucuguugcuguauauauaccaugaccaauggcaaauaggaggaaaagauuuauuucaguuuacaggcuacagcccaucuuugaggaaagccagggcaggaacucaaagcagaagugaggagacaccauggggguagaacgcggcuuaccaauuugccuugcuaucucuggcuugcucggcuaguuuuccuaggaugacaccgcccauggugggcugggcccuuuuacuucuauuagccaucaagaaaaugucccacagacagggccacagggcaaucugauagaggcaauuacuuuccccaggugacucugggauggagaggcuuuacagcugaagcuaaggguggccagcucauuagucguuuagucuucugguaauagucugccuucaugugacaggugugucuuaaauauuucauauaaccucugcuccuugguuucuuuucaccuggggcugguuccuuaucagcacacguugaucugccucuugcuuucacgggccuggcugcaccguggcaguuuaacccggagugggacgugugcuguucccugccauuugucaggaacugcagcaguggguuuuugcagucuucuuaaaaaguaagucauguuuuuauugaaacaagaucgacuuaacacacaguuuaugguucaaagagacccugcaaagccgggugugguaacucaaaccaguaaucccagccucuggagguugaggcaggauuagaggauuauggauugaagagaaucuugagccagguagaguggcaugcgccuuuaaucccagcgcuugggaggcaaaggcuggcagaucucugugagguagaggccagcuuuucuacauagugaauucuaggacagcaggguuauguagggagacccuagagagagacggagggaggaacagagagagagggaggaagggagagggagggaaagggagggagaggaagggagagagagagaugcugagcuacaaaagccaggcaugguggcagacaccugugaucucagggcuggccagccaggguaaugacaaucggugaggugcagguucagugagggauccugacucagaauauaaggcagggagcagcgaggagacaccagucacugccauccacuugcaagcgcagagcacauuuaaucauuuguuagcaucagcauggucaguucugguacacuuucaguaaguggcacuuaccucgucccacugacccccuuccuccaucacuccccccccccaaccgccccccccccccagcccugaaucuacuuucuguuucuacaaaugccauuuauagaaggcuguguuguggccauuucauggacagggaaucguaauuuuggcuuuugcauguggcuucuuucugcuucgugucuuagaauuuauccacauuuuagugagaaacagaauuugauuccuuaagauauccaggcaauacgcuacaggaaauuagucuauuugcuaauuuuaggucauuuaucuguuuucccgucucuuaucuaauccgaagagcgugguucugagcauuugugugcagguuuuuaaaauuuauccugguauaugugugcgcaccuucgugaguucaugugcauguguguucagguccccaugggcaccugagggucacuugaugugggcgcugggaauugaaccuagauccucugcaagagcagucagugcucuuaaccacagagagagccuucucuccauuccugguguagagguuuugauguagguccuugcgcugccccccaccuucaccccccucccgccccugugcuuaaugugaaauuuaggugucauaugcagugugugugggaugcuguccuugcuuucuuucugcauacaagcuguaggcgccucaugccaggguacgguguguuuccgccuuauagggggaaguuggugucacuccacaaaagcagcagcuuuacuuugcauuggagccucgaggucuguccccacaccuucuccugcacugccacugacuucugugcuuguccauucacuggucaagcugagcgauucugcauaguccuuccucccuuccucccuuccucuuucccucccucccuuccuugcuuucgauuuauuuauuuuauguauaugaauacacuguagcugucuucagacacaccaggagagugcgguccaaucacauugcagaugguugugagccaccacgugguugcugggaaucgaacucaggaccuauggaugagcagccagugcucuugaccacuggcccaucuauccagcccucugcauaguucuuaauaauuuuuuuuuguuuuuguuuuucgagacaggguuucucuguauaucccuggcuguccuggaacucacuuuguagaccagacuggccucgaacucagaaauccgccugcuucugccacccgagugcugggauuaaaggcgugcgccaccacgacaggcaaaaaaccuuuuuuuuuaggaaacaauucauuaucacaaucucucucugucuccaucucuuucugacuguuucugucuaucugucucccauucuguguguguguguguguguguguguguguguguguguguguguaugacacaaccuguuacugccucuuuccuucucaaccuacuuuaguuuggagauagcucugccagguaccuaacagagcucuggcaguugcuaaauacuauguaaaucuccuggagcccacagcguccugcuggggaccagcaggcgcuugccuucuguuagcuuggccuuuccauguuugcauagcuuuaucuguauugguugccacugcacgugcuauggcugggagugaggaugaggagucucaucaggggagcucuccugccccacagcaucugauaacccccccccccaugcuccuccucugauuccugcauccuuuacaguagaaggaagacucacugcuaguagaagagcugccuuguguggagagugaggggcaggaugugccagccggccagugaggauggcacauuggaggaggcacugugggagccacagaugcaaaugagcagauugugggucagaucuggagaggguucaguugggucauuguggccuagccagagggacuugaugggagugcuuagcuaucgugguuuggggucgaguggugaugaugaugaugauggugguggugaugaugaagaugguggugguggugguggugaugaugaugaugauggugguggugguggugguggugacauugaggcugauugugauuauugugguggugaugguguugauugguggugguggugcugaugauggugcugaucgugaugguggugguggugcugcugauggucugauugugaugguggugguagugauugauggaggaggugguggaagagacuguagugauaaggaugauggugccaguugugaugguguuggugacgaugaugauggugaugauguucaugagagacagcuaauguucagugugugaguaaacauagccugggugagagauugcgaagucagucuucaugaugauuaaacaguaggaauuacacccgugaugaggaggauuacguccugggggaccaggugacaugucacacaguacaggaauaggcuggagggcuuaaaucuuccugcuguguugucacugucuucaucacuagcucaagcaugcuuucucagucuguaggcagcauaaguuuccggcuggaacccagaauggugaucucgggugauugccacagcagggggaaagaccacaauccccguaugcagaagccacuccguugagugccuggaugugugggaagacuggauggaggaugagugggaaccuaaucaagugugcaaauggguccauucuuggauguuguacugguuugguuuaugucaauuugacaaaagcuaacguugucugagugaagggaaucucaacugagaaaaugccuccauaagauugggccguaacaaggcuauugauugcuucucacaaacuuauggcuagccccaguugcugaagucaacaccuauauaacucauugaacuuggagaaauugaacuggugccuaccagaguuaguugucacugguucugcugacuaguguucauggugcuggcagguauccuucaugcuauccgagaggaaaggcaaacauuaacccagucacaaauccuuugaucuaccauggcuaucugccuaaaagauacacagguguaauagcggcacaaaaguuguaggcguaaccaaccaauaucuggauuuaaugagauggaauccaagccugauacgguuuggguggcuaagaaucugagacuagauagaccacggaccuaggguaaaacaaaauacuacuguucugcuaaaggaauguagcaaaaaaugagccccucuaacaacauucugcuguacucacagauaaaugucucucuuggccauuggcagagaaucuuucuccugccauagaugggaacaaauagagagacccacaaguggucaauaugcagagugaggacucugggaccucagaccuccguggaggucucuaucaaaugccuccucucagggcuuaggaacucucuggaauaagaggaagagagauuguaagagccacaggggauggaagacaccaaagaaacaaggccuucuagacauggaggaaggagugccacucauaggaacgcagagagacuggcggcaggcacagagccugcacugaucugaacccugugugaggucccagggcugagaggggacguggaugcaaaucccacccucaacccagaagacaucuccaauucauaacuccucacaaaggagaaaugauuuuucuccaacauaaucucacuggguauacaaaccacacuuaaugauaggccccguacccaauaguugauggucaucauaaaaugugugguauuuuugggguugguuuuguuucauaaugcucugucugggcccuguuuuguuuuuguuuuguuuuguuugguguuuuuuuuuguuuuuuauuuuuguuuuuauuuuaaaccuuacaggucuuuuacuuauauguuaugguuucugauuuuuguuuuuauggauuuucuguguguuugccaauguauguaucucuguaucucuguguguuucuuaucuaucuaucuaucuaucuaucuaucuaucuaucuaccuaccuauuuauuugagacaggguuucucuguguagcccuggcugucuuggaacucacccuguagaccaggcuggccuugaacucagagaucugccugccucucccucccgagugcugggauuaaaggcgugugcugucuauuuuauguuaauuaacucauuaguuaauuauuauugcuuguuuguuuucuaauacaagagaaagcaagguguggaugugggugggcggguagggucugggaguaguugcuggaggggaaacuguaaugggaauauauuguauggaaaaguauauuuucaaaagcaaaaauuaaugaaguugaaaaaaaaaaucaggcuguaagcaagcauuuucuuaauuagugauugaugugggagggccagucuaugcaggggcucuaagagagaaggcugagcaugccaugaggagcaagcuaguaggagcaagcagcaccccuccauggccucugcgucagcuccugccuccccgcuccugcccugcuugaguuucucccuuggcuuucccuaacagacugugauucgggauauauaagccaaagaacuucucuccuaccugagcggcucuucucuugcuguucuuucagacagagaggaaacugcagaggaccugggaggucguagcuggaagcuuccuuucuagaauaaccuuccuuuuugcgcaugcagugccccucucuggggugccccuucuguaucggagcagcugaacaacggaugcuguuggcguuuugguuuuggcggugguguccuggguuuugcugacggugggggcuuguuuggccuugauagucugagggacuuucuuccauccuaaguaaugauugccguggcugucaagcaaauacgcaaagaggaccugagcuucgucacgcugccugguacuugugccuuggcuuacagaugagacuggacagugaugaucccuagagacccaaggaacucucaccggggcuuggagcuugccacauaggccacguuggcuggucagugagaucuggggcucuucacucacuugaccuccccagugcugggauugcaaguguccgccaggacauaggcauuuguaugcagggauugaguuuggguccuggcacuaacgcagcaaagcgcuuugccacagagccagcuccgaaagguaguagucuuuggugaauccuuuuggaaagaacuuguccccaccaccugucuacauugagcgugagcagggguuacaccccagagacaaccgagcccugugccacugugaacgaaacuaagaugcccugaugccaacugcccugcuugugggcaguguugggcuucagugccacgccuuacucugcaauguggcuuugggaggaaggagacagucuguuuagaggggagaguccaacccccccccaauuuaucuagacaguaaaccaagcaggaaaaggaccuacauguacccuugauucccaagguuugucccugaauauaucaguauguggguuucagacacagacaggcagugacucugagcugugcggcucuucacccacgcaaugugauucuguuucggccuccccgacaccccugacuucucucccuccguucuuccuuuccuuuucuucccuuccucuccugagucuuucucuacaguucaugguggcccuaaagcuguagagcaagcaucuucugcuucugucccacuuugaugcugggauuacaggcaugugccaccacacauaccuucugggacuucaguuuucuuauugguauugacagcagagcauauuuguccccaggguaucauggggcugacuuugugaauguuuguaacagggccgauggaggguucuucauagggugucucucagccucucagauagguggcugaaacacuaggucacuagcagguaccagugugugucauauguccgccuccugcuccucuguggccaaauccaggguccugccagagcuggccuaggaugugaggcugugcgcugacgggcagccuggcuccuugccuccucccuuccacaggccaggggaacccgggcuguucuggguuuacaggaguggugugcgcaggcuguggcugguucugcagacagcuccagguggggucaauuuagugcauaucucugcagcagcaagagggacuggggagcugcagcuugcacuucuaaguggaguugguggucaugggugggcagacauuuuuggggugugugugugaagugcuggugugaaggagucugugcugagaaagaagaacaugggaacuuaaguaaucuguagaaaagaaaguagcaacauuggcuuagcagaaggaggggcuagccagcacuccaccucccagaggggaggaggaggagggaggagaaggagggaggaggaggaggaggaggggggggaggaggaggagggagaggaggaggagggagaggaggaggagggagaggaggaggagggagaggaggaggagaagguggggagacucggucaggaacugaggucucucugguuucugcagcaucugcagacuggcuugcugcaagccucaccgagccaggagagucauccagacugacuguguggggaagggucgugucucugagauacaagaaguaccaggccugguaucuugaggguuuacuguggaaauagaccucagaguggucccucuccucggcuuuaucauucccaagugaaacaaaccaaacccaccccaaaggauccugcuguagagacgauucgagaaugcacccaugaaugcauuuaaaacuauaacugggcgagaacacacccuugguucuccaccugggagaaauguaaucagaugcccaaaccaaaccccucuuguucguuuguugguuuccuuucaaaauguaagaucuagaugugcuuuuacagaucuagaaaaugcuaccuuuuaucauauacuccagauacgccccuuuucauuuucuggcuauuugguugcauaauuaugaauuaguuuacauauugaauaugagauggaaggcaauguagcauaugcucuaugcuggagagcagagcuuagccaggcccgaggacacuggguucucucccccuggccugcugucccagcuguucaggaggaucauagguucaaggccugccugggcuacggagcgagcucuaagcugggacaaggaucuuuaauccuugcacuugggagauggaggcaggaggaucugaucagcuacacaggaaguucuugaggcagccugggcuacccaagacccuucuucccuuccucucaaaguaaaacaaaacaagaaagacaaaagacaccguaaaugcaaggucagccugggcagccauagcaagguugucucaaaaaaaaaaaaaaaaaaaaaaaaaguguguguuugggcagaaucacagcuugggcuggcaagauggcucaguggauaaagggacuguugucaaaugugacaacaugagguauggugggaugagagaaccaguuuccccaggcugcucucugcucucuacuuguauaccauggcauaccuguaugccacaggcaugcacacaaaauaaauaauaugaaugggaggaguggcugagcaccugccuagcacccuugagauucuagagcuaaucggugcguaggaagaaaaggaaagugguucgagaccugacuggcugccuuucuuggcuccucgguuuaagagauucugucauugggcuuguuguucccaucuguaaaaugggauguuuugaugcccacccgugugaugucagggggauuagaggagugagauauuagggaaguuagauaugucccacccacuucaugagcuagugcuugauaagaagauacuauugaggucucagcaauaagucuguaaaguccgcucccaggagaagcuuuaaacccuggaaccuuugaaugucuugcccuaccuggugaaaggcucuucguagaggggauuaugggauggauuuugagaugugauccuggagcuaggacugauguagucacaaggguucguagaggugugagggucaaagugugagagggagacguagaugguauuuuguuggcuuugaggaaaggggucacacgccaaggaaugcaggcuguuucuaaacacuagaggcaccgugggaacuaauuucugagccuucacaaagaaccgguccugcucagagcugugagauuaaaaacuugaguuguagggccgggcgugguggcgcacgccuuuagucccaacacuugggaggcagaggcaggugaauuucugaguucgaggccagccuggucuacagagugaguuccaggacagccagggcuacacagagaaacccugucucgaaaaacaaacaacaacaaaaaaaaacaaacaaacaaaaaaaacaaaaaaaggaaaaaacaacuugaggugucuucaccugcucguuacagcagaauggaagcuccuguguucucuugaccaguguggauaaguuggacugcuggcuuugagccuuuccuauucuuaugaagucaaauaaaaguacagcuaggucuuucuugcacauauccucuaaaaagccguauggugauucaguagugaccaucugcauaguaguguaauccgagcccuugggaagcagaggcaggaagaucaaggcaaguuuaaggccagcuuagucuacauagucccaggucagccagugcuacauaguaacaucccgucucauccaaaggaaacuuuaauagacaacaaacacguauuuugucuaugaaaaacaaaacaaaacaaaaacaaaaacaaaaaacccuguaauauguagcccucaaacaauuugcauuuuguucugugucuggggauauuuuuaauguacauauuagaggcuuuaguaguaaaucuuuuuauguucgugugugugugugugugugugugugugugugcgcgugugcauggagucagaggaauggguuuauuuauuuauuggacuuggggggggggugaguuccuuacuuucuuuuuuuuuaagauuuauuuauuuauuauauguaaguacacuguagcugucuucagacaccccaaaagaggucaucagaucucguuacggaugguugugagcuaccaugugguugcugggauuugaacucaggaccuuccgaagaacagucagugcacuuaaccacugagccauuuccucagcaacuccccccacccaguuacuuucuacuguguuucuugaggcagagucucucacugaaccuggcugauucagugaggcuggcugccugugagcagcagggcuccuccagucucccugucccuggcagaggccguucaccaacccaaccccaccccaccccaccccacccuuaucugaugauaacugaauucagauccuucagaugauuccguggcaagaacucuauuugcugaggccucucccagcucccugacacuuuaaacauaauucucucgacuaaugcauuugcuagaccuggcuuuccaguuuuugguaguuugaaucugcccuacaucagucuuccucccauguuguuugaaauuagucccguguuuaagguuuguuucuucaacgggugucugcuuuuuggguuuuuauguuaucccauguuuuccuauaucaaauauuguuucugggaacuuuuuuuuuuuuuuaauagcuaaacuuaggcaaauucucugugguuuucacuggauagauuucuaaacacagcuguguggugggcuuggaugauguggucaguuuuccuaaggagacucuagcuucugucccgcucccgccccaucauccacucucaccaggaugcaggcuucagccuuuagaggccugcaguggagcagcagaaacugugcuugcugcagucagguguggcaaggcuuucuucccgccugcgggcuguuuguucuggcccaggcccgccaagccaaaccucaggacugagcaggcugcuuuuggcuggagggcugcggaggcugccucagcaccagcuagauggaauggaggaugggggaacuuuggagccuuuuccuguguggcugaggcggccagcccagccuuucuuucacuccacaugucaggucugggaaguaguaugcuuuuccagucuccucagggcgagaggucugguuugagggaaaucaggaagucccggguggggguaggcaugaagauccaagugcagcccucagcaucuaagugaaacaguugggugguuuggcacgauguuugcuauccaugcgcuggggaggggagcagagauggauuccugggacuugcugaucagcauccuuuccaagcauguaggcaaucccacuccaucccgcuccccgccaggcaucuccccuugggaacuucaucagguaagcuccaggggagagaaacgagguguguaguuccugaagaacagcaccugaguucuggcuuuggcaugacuauguacauguauguacauaugugaacauacgugaugguuaguuuuaugugauucuuuuuuauuacaucuuuauuuguuuugugugugugugugugugugugugugugugugugguguguguguauaugcaaaucugccauggcaagugugaaaaggucagagggugacuugggggaauuuguuuucucccccucucugggaucgaacucggguccucaggcuugguggcaggcagcuuuaccugcugagccacaucacuggccuguggggggaguuuuuguuguuaacccaaugaggguuggucugggaaggaaagggcuucucugaaggugggccacaccccagcacugaaagggaaggugugauggagcgagcugacagugcaacugucugucugcagcuccugccacucagguccuccucucacagagcgacuguggccgggaucugugagcgaauagaaacucccccucaacaaaacugaaacuuagacaguaugcaaagaugcuguacacauagaguaaggccugaacgacuuucugacgggggugggguagguaggugggugggggggaggggaugugguuccaaagacagggccaugcagaguugccaaggagagcugacgggagugggugguuccguguggcuguguccucacuggugcacaggggaagcuuaauaaaugcagacguuagaucauaacccccccccccccccauuccuccauuccuccagcucggacugaacaucuucucugucccuuaaacuaccacugaauuuuuuuuuuuuuuuacauuuacuuagcauguguguguguguauguauguauguguauguauauguauguauauguguguguauguguguguggauguauauauguguguauguagguguguauguagguguguguguaggaguauauauguguguauguagguuguguguagguguauauauguguguauguagguguguguguguagguguauauauguguguauguggauguguguauauguagggauauguguguauagguguguguauguguagguguguguauguguagguguguguguguagguguguauguagguguguguguguguuuauguguguauauagauauguguauauguagggguauguguguguguguguguguguagguguguauaugugggugugugcauguguaggugcuaaggugugcauguggaaaucugagaacaaauuaggaaaguuauuuuucucuucucauuuucacguagguccuggggaucaaacuuaggugugcagaguuagcagccgcugaauuuauaugaugaauuuauaugaugaauuuauaugaugaauuuauaugaugaauuuauaugaucuugcuggcucuacuuuacuguugcuagagaaauuuauagauugcuauugauccccuuucuuacauauauacaaugcauuuuggucauaacuaccccauuaccccucuuacucccuccagaccuccccccccaacuuccuguucucuccuuuuccucauuuucauugccucacugagauuugguucccaugccacggaauucacucagccgaguguacaguucagguagugaaucacacuuuguuugugggguguuuuuuuuuguuuuguuuuuuguuuuuaagacaggguuucucuguguagcccuggcuacccuggaaucgcucuguagaccaggcugaguccugcaaacacaaucauagcuaauuuuagaacauuuugaauccuuucuccuuuggagucccuuagcucuggugucauuucuccuucccaguguuggugacaagugucucuaacgugucugcccacuggacauuucguauaaggaaaucauccagcaugugaccuuuuuuguuuguuuguuuuguuuuguuuuguuuuguuuuguuuuguuuuccgagacaggguuucucuguauagcccuggcuguccuggaacucacucuguagaccaggcuggccuugaacucagaaauccgccugccuuugccucccaagugcugggguuaaaggcaugugccuccacugucggugcaugugaucuuuugcccccuccuacuuccuugacagcacuugcuacuaaauuacuuucgacuguagcuguccuaggaggggugaugcugugucccacugugguucugauucgcauuuugcugguuguugguuguucucuuguaaauagaauuuguucuaguagccaggcuuggccgugaggccggccuuuugucaucccugcuacacagaagccugaggugggaggcucacaagggucaggcucaucugggcuagggaguucuaacuaguaaguucaaggcuaggcuggacaucuuagaaagauccuauuucaaauacuguaagcgcugggcagguucagugagagaccuugccucuaagauagauagauagauagauagauaguaggagcuacugaggaacacauccuagggugagugucuggguaucaggucuccacaggcgucugaauggacaagcaccuucuaccucccagccccacccccacuaaacauagaugacauacccuuacacagauacauuuuaaaaugggcuggggauauagcucagugauagaguggcagauacuaagccauggggucaggcuucagucccuaccaccucaaauaacuuauuauaugauauuuuuguuuuuguuguuauuuuguuuuuguuuuguuuuguugugauaggguuucucuguguaacagagcccugguuguccugggcucacuuaguagaccaggcuggccccaaacucacagagauccaccugccucugccucugucuccugagugcugggauuaaaggcgugugcuaccaugcccagcuauuauacaaguuuuguuuuguuuuguuuuguuuuuuugguguuuuugagacagcguuucucuguguaguccuggcuguccuggaacucacuuuguagaccaggcuggccucgaacucagaaauccaccugccucugccucccgagugcugggauuaaaggugugcgccaccacgcccggcuuacacaaguuuuaaaaucaacaggcuuucuggcuaaaccagugcuuauggcaggggaauugucuuuuuauuuucaucuuuuugagcuccagggcggccaucuuucgcagauguggugcucaugacagauuugaugagaauauucuggaagucugagcacagagcacauggacgugagcagggaacagugaagcaugaguucugggcuggggagaugccucccuggguaaagugcuugcugcacacaagugaggaccugaguucagaucgccagaacucacugggcacaguagccuguaaucgaucacaguguuuugggcaugagaugggagaugaagaccagaagcucacaggcuagcccugcuagcuuuggaguacagcugagaacaagagacucuuagagauggaaggccaggauggaugccagagguuguccucugaccucuguacguggucgguggugcagauagagagaaggagaggaugugagucccugcuggagucuagagaaauucccuacgucucuuguuucuuuuguuuguugcugggaaguaagcucagaaccuuauauaugcugggcaagggcucugcuucagagcuauaagaaguccuugccuuauaucugaucuuuuaggggacaaaagaacccccccccacguguguguguguguguguguguguguguguguguguguguuauagacucuccuccugccacgguaucuguguuuugugacccuauauacugcauaucuguaugaccaaagaugucuaccuacuacuuccuaaaugucccacacccccaaguuccuuugccugccauuugaucagugucucaagaaaauggcagaaaggguguguccugggugcugggacaugggugcucuuaagaaguugauggagcagcugucacgggucagcuucccucugugcaccuguaaccaugugauguguauggauauuccugaguaaugugcagguaucacccccagccugugacucucuuacccauuuuacugauccauaaagugaucuugagggacccaacaaacucaccaggcugucuggggaacuacagcagacaguugucccuagucaccuugugucccaaaccuuuagauuaagagauagaaaaagacaaacuccaggcugggaaagaauguugacaaaacacagugacaaaggaccuguauccaaaacaaggaguuuuaaaacccaacagaggacaggcaacccaauuaaaagugggccaaagaccugaccucccuuccugcucccauccaccucccugccuuccauccuguugaagccgcacgaagcugcuucugggccagcgaggcucagaugaccccagaguaggucauguauguaguuuaaacacugcuaguuaacacauuaaaaaaaagauuagaaguaguaaaugaaacuaaauauguuauauuuaauuuaguauaacgaagguguuauuuuaacauauguacuauaauucaugaaacauuaaauuaaaaguauuauuuuauacauacgaguguuuuucuuaugugucuauaugggcaccaugugugugccuccugccugcagaggucagaagagggcaucagcuaccccgugacuguaguuacagaugguuaugaaccguuaacguaagugcugggaaucgaaccagggacucugcgagagcaacaggugcuacuaaccauugaaccaucucucuagcccugagacaguuaaccuuuuuuuuuuuuuuaagauuuauuuauuuuauacauaugacuguuuugucuguaugugugucuguguaccacaugcaugccuggugcccacggaggucagaagauccuuggaacuggaguuacggaugguugugaucuacaauuugcauucugcaaaccaaacccugauccuaugcaagaguagcaagugaucuuaaccacggagccaucccuccugucccauuaacauuuuacauuauuguuuugggugucuaacucuuccacugauuauguuuguucgguuuuuguuuuuguuuuugagucaggggucuaauuuaguaacucaugauggccuacaacucgguauucuucuuagugcugggauuacaggcauguguaaucacaccuauuguguguguguacagguguguauguauggguuugugugagugcauguacagguguguguguguguguguguguguguguacagguguguauguacagguuugugugagugcauguacaggugugugugugugugugugcauguacguauauguguguguguguguacagguguguauguacagguuugugugagugcauguacagguguguguguguguguguguuuguguguacaggcguguacagguguguauguacagguuugugugaguguauguacagguguguguguguguguguguguguguguguguaugugcauguacguauauguguguaggaaucuauguugaugcaagcaagccuuaguguguguuuggaggucagaggauaaccuaaagggaucaauucuuugcucccgucaguggguucuggagaucaacccaggaugucagguuugacuccaaguaucuuuuacccacugagccaugucaccagccccaguuuuacuguuuaacuggccccucagcgcacagugccuucuucuguugucccuucuuucuucuucuuuuauauauauauauauauauauauauauauauauauauauauauauauauaugauauuuucuuuauuugcauuucaaauguuaauccccuuuccugguuucccucccuccggaaacccccuaucacauccucccucccccugcuucuaugaggguguuccuccaccuacccaccuacucucaccuccccacccucaauuccccuacacuggggcaucuauagagccuucauaggaccaagcaccaccccucccacuaaugcaugacaaggcuguccucuguuacauaugcagcuggagccauguguacuccuuuguugaugucuuaaucccugggaguucuuggggggcgggucugguugguugauauuguuguucuucuuaugggguugcaaaccccuuuaauuccuucgguccuuucucuaauuccucuauuggggacccugugcucaguccaaugauuggcugcgaacaucugccucuguauuuguaaggcucuggcagggccucucaggagacagcuguaucaggcuccuuucagcaugcacuucuuggcauccacaauaauuucuuugcuucuuuacaucacacacuuauccauugacuagccaucacuucaccaccaaggagcuaggaacuguugaguugaacacaugguauagguauagugcgccuuacccuuccuucguuggugacaagcaagcagacaccgugaguucaccauagugaaaaugaaggugauugcugcugcuuuagggggacccugggaaguuucauaccuuucgcaggaaagugucagcaaaaugguggcacagcgauaccuaccugaugugccaguaggaacaccagagaccugggguaugaaccauugggcucagcacucugucugaguauuuccauugucaggaccauccuuagaggauaguuuugcuucuuugggauccagggcaaggugaguguucauguuggucacccuggagaagagagaauaugaucuugggucuaagaacaaacuggagaugguaucaauuuucuugugcagcauaguaaaacccaucaaauaacaggcucagaacaaccccuuggugggcgaagauuucaggagggaucaaugggcaggugugccuguguuucaacugauguuggcugaaagcccucacccagacauagucugcugaaggcugggguggaagauaugugacaguagaagcugugggucauucugccauguccucucaugaacuagacagggcugccauguccucucagucaaaccaaucacaggggugguucucaugguggagacuguggucacugggagcagcucaccaggccuugacuuugguguuuugggacugucuagaagacagugcuaaggaccuucaugaugggagagagugucugguggggaucugggagcccggugccaaucaguagugguagcuggcgugucuuguccuuuauguggccucucccucugcagcaguccagugggcuuucuugaaugguaggcucaaggaucgguguuccuaggagguagacagagggccucaagguuucuugaggucugggcucugaguuacaguaucacuuuuguccucuaauggcgaaaguggguagcagagcugaggaguucugguggcgucgguaaggcgguagcagccuagccuuguguuccgguggcuccugguggccuccuuguccacugcugaccugggaggugcugucuacccgcaucucguggggcuuugaaguggucuuggauccugggucagguuuuuggggguuuuuuguuguuguuguugcuaaugacagccucaguaaacaaucagcucagagaaguuuccaggccucaccuggccuucaagacacugauauauguggacaaucagagaaggugccaugaaucuuuucucauuacuuuuacuuuauuuuacuuuguuuuauuuauuuauuuuuuuugagacaggguuucucuguguagcccuggcuguccuggaacucacucuguagaccaggcuguccucgaacucagaaaucugccugccucugccucucaagugcugggauuaaaggcaugcaccaccacuaccuggcuuuauuuuauuuuuuaaaguuuucauauaauauaguuugagcauauucccccucccccuauuccuucuagauccuccuuacuuccuacccaccccgacucuuauguucuuucucucccucuuugaaacaaauacagaaugcuuuuuuaaaaaaauuaauuacuuuuuuuuaauaugcgaugugcacauuuguaugaauggcugugugugccugugucacagcaggcgggagggcacuugaugcccuuucccgugauucaccuucacuguugcugucugccuuagucucacugagccaagagcuugugguuuguugacuaaacugcuggccggugggucgcagccaucuuucuguuuuuguccauuacccuguccgucuucuaguucuaagguuauaaagugcggccaagccuggcuucuuaugucuacucuggggaucugaacacaagucuucacgcccuuugagccgucuccccagccuucuuguuuugagacaggauccgaguuaucccaggcaggcuuugaaagcguuaacucagcuaaggagccgauucuccugccucuuccucccuagugcugggguuacaggcaugcacuaccaugcggugcugaggaucaucaaauccagggucuugugcaugcuaggccagcccucuaccaacugaaccauauguguuucauauguuuauugagaauacacccugugucugaccagggcagguaagccuuguuggaccguuggucuugugacccuguguucuuggcagacaugggggcuugcaugaggccuagaagcugagaggaaauggaagucccauguugggagggagggagggagggagggagaaagagaccuggcugucaucuccuuucugguccuuccucucaugggaccuaggcuccagcacuuccucucuguggcuggcaugccuggccugcucuuugaggguugcaacaucugcuucucagggcuguugugaggauggaggaguguccgugcucucagcgauuaccacagcccucugagccucagggcuucucaucagggaggcccuuucugccugagagggcccaaggcucaguuacucuguacuucagucuccugccugccccacuguuugucucuuuccuucucuuugggauuuggucaucccauaauuacacauuuguaugggcagauguuucccuccuccagucggcucuuggaagggugauuuguugcuucugcuguucuaaaaccucacaugaccagcgcauuccaggcacaugauaugcacugagcagguggaggcuguaucccucccugccccugcuccccuggccucggggacaccuaucugccgacgugacguggugcucuauguguucagcaaggguuauguuuccagaagccucugcgggccugaggagagccaggccagagccaacuagccaggaacacccuuccuuagaugugggaggcuuggccggcgcuguggguagaggaaauguuuagaauggguugugugaggauggccccuugccuugaguuuccaaggaaacucugggcugcccaaaccaucucucuggcucaggggagcacugacaagaagaggagcguuaugggagugaguguuuaaguggcuuuuugcuggugaaacacuuaauucuuuuuuuuuccuucccauuuucauauauauguguguuguaugugaguaugugugaguccacacguguguaggcaugugcacauguguguguaaguucaugcagggguccagaguuggugcugagaauugcucucagcuauaggcuagcuaacgggagugaggcugccuucccccuugcuggggagcaccccaggaucugaagacacacucaugaaggaguuugggaacaccaccauucccgccuauaaaacggggcacaaugugaaccccacuuuaucagauugcuguggggacggaguaaguuaagaucugagggaccagauugugcacagcccuggugcacaugcuaacuguguggcagcuggcgacaguggcauaaugguuuuuaaucuauggccgugcaguaaaccaccccaaacuguaauggaggcuguagagaaaccaggccuuuaagguaaccaguaagggcugcgagcagggcaaugacacacucagcuccuugcugccaggggaucgaggcagccugacuacugucauauugcauggcccacacauuaucagagccucgcuccuccacccugccacauagccccauuccucuacuuugaucacgcagcacauauuaacuaagccugcuuccugugauguaaggucuccccuucacucaggggagaccuugaaaagcaggcacccaggcagaaauucuccucuagaggccuccuuauggacucuuguagacacccggaaaucucuugcccgagagaugguuugauucagcaucucuugcucucaaacucccucccuucuucugcccuaaaaccagacaggaggaugugcgaacgagcaucauguuggagcugccaaccuggaguuuugcagccuucggggauggcucuguggcuuccucugggucccggguucugggcagucacugccuguucugggauggcuggaguuuguuuucagaugggcccugauguucuaaugggcuuggugaggcuuugcuagcuguuauacacccugccugugcugggcuggcccuccagacuuucauuugagccccaggaaguggcuguguagagaaaagcacagaggagggugggggagcuaugggucacuggugcgcaaaaccccaaaauagaucaucuucuaagucgccaagcccgggggggcggggagggggcagccgcagaugcuuuacauaaucuccuacccagaaggaaaggguuuuucuuuucuuuuuuuuuuuuuuguuuuuuguuuauuuguuuguuuguuuuguuuuuuugaacaaaagaauccccaaggaacuugaaaauaucccgguguuugguucagagcaucacaaaaugagagccagagaggcucagguucaaauccccaaccuaccauuugcaagccgugugacuuggucugagccacaaugaugaagaagaugagagcagaccuuccaguauguaugaagcgcagcuuacguuguauuugauacaugguggauaggcuguguggaguuucccugucucucuuccauuuucuuuucuccucuccucuugguccuggacuuguacuugguuccugguagcuucaucauugcggcuggcagggaggagaugggacaaauaucuccucucuugcaggccacuggccugggagggaagguugcaggcaugaauagucacuucuguaaccuccucccccagacccccaaaaccugugagccugagaugcuccuuggcucaggcugugcguacaggcaagugaggcucacugagcggggagaggcuccugagcuaugaagguagauccagugugcucaagaggccuggugacaagcagaucaggugagccauggcauagggacaggaagagaggguggaguggguacagaaugggacuguguaucaaggaaucugggcuagguuuguagcucagcacagugcuugucuuacacauauaaagaaaagaaggaccagacuaugggucuccugagccucagggaguagccaggcuccgagcgccccugauuucagcccaacaagaagccauaggguaugugggacuuugugguaguguggagaggcagagacagggugcugagguuguucagugcuugcuagguaacucaauugcuggucaaaucuugguauuucugcaccauacccccccgacuugaacagucuauucucugaggcccaagugucugguguucugaagcuaauccuguaggcaggcuuguauggccacguagcagaguccugugguuaagcuagcaccugcugcagaacuguuucuuugagcugguggcaggcucuauauuagccagguucuacauuguucugucugccaccagcugccuuacccagccggggucagggucagggugagcugaggguagggguguggagagggugcucuugggguaaugucucguuuuuuuuuuuuccccucugugguaugagcuucaaguuguaaaguucuugccgaguguggugacaaauguaaucccaacacccagggacuuugaggccagcaugggccccagguuagucugggcuacagaagaagaccuaguuuuaaaaagaaggguuggggcuggggaggagauggcucaguaggcaaggugcucacauuggaagugucaggacugggauuuagaucgauagcacuuucauacaugcugagcagcggaugagugugguggucugccuguaauuccugggcucagagguggagagagguccucaaugcaagcugcuggcuagacuagcuguccuugcaagcucuguguucaacugaaagauccugccucagugaauaagguguggagugacagaggaaaaugccuaacaucuggcguccuugcacacacacacacacacacacacacacacacacacacacacacuauacauauaugcaaaagaacaggagggaaggucuggggaucucagugggugaaguguuuguuauccaagcaugagaaccugagcucagaucccaacacccacauaaaaaagcccgccacggugucacaggucuauaagcacaguacugagggauuagagacagaaggauucucggggugugcuggugagccaggcuaucugaaugagugagcuccagguucaauaagagagcuuaucucagaaacugauguggggaguggcagauaaaaccagugaaagugagccuuuggcugcuucacacuuauguguaagcagguucuugugcacacacaggcauauacuacauauacuuagacauauuagcauacaagauacauauacauauauauauaucacacacacacacauauauaaaucaaacuagaaaagcuguuauuucugcuuucuugggggugggagccuuugaaaguccaucaacuucugcagaagaggcaauccuaggcuugguaggacacuucaggccuggcucuuugcugugacugcauuuggcugggucaugacccucuuguaugugucuuacaugccauacauuagguacuagaauuaaagaguaaagccacagcugaggggacaucccacgucgggggcaucccauuuauugccaccugguguccuuuacucuccuuguccuuucucaugacaccaccuucauuggugaacaccgacucccaagggucaugcauuugggauuaaggaggauguccugagcuggggcgagauggaccuggaugaagaaaagaaauucaaagauguuggcucugaacauggcaaaaguagccaugggacaaagaaggagaaacacuguccuugcuucaaaagacaucagacagauuacaguguuugaaucccucucucaagugaucuuagauaaggcuuauagcuuuguucuugcugcuuuugagccuagccuggucuuaaacucacuauguagcugagguugaccuugaaccucugauccuccugucugcugggauuauagguguaagugccuacaccuggugugugcagggcuggggauugaacccaaggccauucgugagugcuaggcaagcacucuaccaacugagcuauauagaugcagggcugccuuggagaaggcuugcucaucuuucaagcuauguucuggggcugugguggagcucggugguagaacccuugccuccugagcucauguagggccucccccagcucuacagugaaaaagagagcaagucuguuuccggcucugcucagccguguuugagaucuuucgugccucgccucaguuuccucuuggguauggugggaaaucauaacagcggcuacguuuuaggggguuuuaacauaugcacuaccacauacggagcaguuacagaauggccaucugucccccgaggugucauggggcaggggcugggggacacguuguguccuguccacuaccaaaugucaugcaugauaggugaaauuacuuguuaaccagauccuugguccuugaaaaaucccgauacuucuugaugaaucuacccauuuuacagaugcaauugagucucaaaaggcaggaggugcuuucugaaaucacccagugagcagggccuugguugugguuuucuaggacaacuuuguuguuuguuuguuugcuuguuuuuugagacaggguuucucuguauagcccuggcuguccuggaacucacuuuguagacuaggcuggccucgaacuccgaaaucugccugccucugccuccccagugcugggauuaaaggcgugcgccaccacgcccagcuuuuaggacagcucuugaggcagccagagucuacaauucaggaccacuggguuuuccagagaccacuguccaccucuuauuagagucucuuugucucauuucccuguugaguugguguugaaauaagagaccauccuaaguuggaagugcccuggugaguucaaggccaguucagucaugaccugugcuuuaggaucuuggcgucuuucuauaggcacagagcuguuuucagacccucaaaacaagccuuugcauugaugagccccaaggaaagaaguagauuucggcugaggggcagacaaaugacuucaaauccaagcuucaaggagggaccagcugagccaugacaugccugcuagagaguggauggaucgagccucccaggguggcucaggcucugcaggucuguggugggggauugcaggcuguuaaugugaaaucucaccuuuaauguguugacucaguuaaacacauaaacgggcccccaccauccggauuuacuggacacaucaguagccacaguggcucacaagcuauaggcucuuccaggcagcugaacacuuuuuuuuuuuuuuuuucgagacaggguuucucuguauagcccuggcuguccuggaacucacuuuguagaucagguuggccucgaacucagaaauccgccugccucugccuccugagugcuggggauuaaaggagugcgccaccaccgcccagaagcugagcacuuucaaggcucugagcagccaugugagcugccucuucuuccucuucuuguagcagccacaguguugaucuguguggucuuguuuggugguggcgucgucgucgucauccuaggaagacaucuaaaguuaaaaaacucacuuuccuuucacggacgcuuuucauaccagccucacagagugcagcugugauguuugaacaugauggcagcugcagagagccugcugagcuuucugcucaguuaagugagaaacuccuuccucacagucuguguucugcucuugccacgaacugcuaaaguucagaaagcuaacggggcggggcgcagaaagaacggagagaugacagagcucuggugcacaucacuagaguccugcuuguagggugacauugagugccauguaggcauccugacaccuaucccacuguuggggcucuuauguauuuguuuugcuugggcagauuugacuuugggcaagagauguccuuuggcaggcauagagggaacagaagauaauagcuugugcauucuagcaagugucaagguccugugaccagagaguggcucugcuaaaaccaaaccaaaccaguaaggguagaguagacagaagggacaguggcuggggagaugggaauauauguccacagaagggaaaagcuauguugaucuuccuugccaucccacgccuucaaaaauaguugacucaaccgauuuaaguauucaauauaaugauuaauuauaggcagagccauaauagggccaucaguacagucuagguuaggaccuggccagcuuccagaaggcuccauggcugucugucguucuugacuauccauucucuccuuagcugcuucccaucuucuccuccccccccccccgccccuuuuugagauaggguccccucacauacccuacagugacuuugaacuugcugcacagccaaggaucaucaccgugaacuucugauccuucugucucugccagugcugggcugacagguguggcccaccacaccaguuuuaugauggcaggggauggaacugugcuagugcuccacugauggaguguccacuccagcugcuccucgcucucugauuauuggagcacacagggguuuugccuuggcuuauaugcgcgugggggacauuuuuaccaguacugccgauguguccuuguugguggcuggaugaugucccgugguggguaggaccuggcagucuuuugggucuuccaucacugugacuuuugcuuauucagucucugccaacaguggaaccaagggucuccggcuuugcccuguuacuguaagauacccaccugcuucugcccacacucagcaucagggggagagauggucuuucuccaaacccuacagguaggacguaguuacuguuuagagcaggguugaaaaaaaauuucccaaaaagguuuauacacacauacuuaaacguaaggguuucuuuucuuuucuuuucuuuucuuuucuuuucuuuucgugcgguguuauuuauauuuaaaauuauuguuauuguuguuuugggugguuuuauuuauuuauauuuaaaaugauuauuuuuguuggugguguauaugugugcaugugcacgggggcaugugugcauguaggugugugugugugagagagagagagagagagagagagagagagagagagagagagagagcacgcgugcgcgagagagagauugguauguuuaguguuuaguucagguccuucccuuuacuugaguuccuggguacuacaguuacccuggcuguauuuucccucaccaggccugcugacuuuggcagggaucauggggugaaucucuacugcaaacaguguccuguaaacacgugugaaccgaggcauagcaaggaagccuuuaaucaugagaagggugucuaggucugggcuucagucuugagaaggggugccugggucugcuuacugcccuugccccguccucagcuucugccgcuuccauuccauuauaggggugacacguauuuuauuuucaucuuauuuuauuuuauuuuauuuuauuuuauuuuauuuuauuuuauuuuuugagacgggguuuccuuugcagcucuggcugucaaggaacucacucuauacaucugccugccucugcuuauagaauguugggauuaaaggcacgagucaccauugccuggcucuuuaauuaauaacuguuuaugaaaaaaauuaaauguaaauaccaacacauaguaacacuguaaacaguaccaugcaucuaccuagcuuguucauuuguugucacauauauauuuaagaucugccucccuguuuauuuuguuugcuuguuuguuucuuuguuuuuuaugugccaggaucaaacccaagguccuguacauaguugauacagcaguaaagaaauacucaacaaagaagaucucgguauggugugguagcucauauauguccuagcucuugagaggcugaggcaggaggaccacucugaguuuggguucagccugggcuacauagucagaacuugucuuauaaagcaagcaagcaaacaaacagaaauuagaacagagacaaacauauugaucucagcuacauugcagcccuccucuggcuuuuaugccucucuccauuuauguucuuuugcuccaggcuccagcugggugcuuacaauaucuaggugcucagaacucaggucugcuucucuccgaugcacuuggcaguggggccagauccugguuuguguugagcccuucgcuuuccaggaggugccgugggcaagcaugucauuuaccaagguuguaggccagcacaggguccuggaggugaggcuguguaugucuagucccaccaacacgugcccaaucaagguggaugugguggucugaaugagacuggcccccauaggcucauauauuugaauauuugguuucccauugguggaacuguuuaggaaggauuaggagguguggccuuauuggaggggccaugucacuggccagggcuaggggaggcuuuuggguuucaaaagaugucugcaauugacagucuucucccucugcuuugugggguuguggaucaagaugugagcucucagcuauuccucugucccacuagcauagacucuguuugaaacuggaacccaaacugaacaucuucuuuuauaaguugccuuggucacaggguuuagucaggggcuuggucugcuuucccaccgaguccuuacauggcaucuggcauauuccugaauguccugguugcaaacuaaaggauacagacgaaagauugaggguuagggaggaaauaucaaauaugcaauuggcaaguugucacuugcugagggucacagaaggcaccagaggauacuuggggguggggugggggggcgcuaacagaucauagugaaaaggccugaaagggggaagaauagauuguggguaagagaagcaaccaguguauguguguguggugggggcggggggguguggagcuggugugagcacguguccaggcuguguggauuuggugugagcacauguccaggcuguguggagcuggugugagcacauguccaggcuguguggagcuggugugaguacuuguuaaggcuguguggagcuggugugagcacauguccgggcuguguggaacugguggagcacauguccaggcuguguggagcuggugugagcagauguaugggcuguguggagcuggugugagcacauguccgggcuguguggaacuggugugagcacauguccaggcuguguggagcuggugugagcacauguccaggcuguguggagcuggugugagcacuuguuaaggcuguguggagcuggugugagcacauguccaggcuguguggagcuggugugagcauguguccaggcuguguggagcuggugugagccuguguccaggcuguguggaacuggugugagcacauguccaggcuguguggagcucgugugagcagauauaugggcucuguggagcugcugugagcccauguccagccuggggaggacaugcacagggagagggugucaugaggcuccagggaacagcugcagcgugucccagcagggaugucauugcuuccccuagaccacaccucacgcuucuccaucuuacugcugcucugccuggaauacuucucuuuauuuauuuuagauuuguguuguaaauguacguguauaugugugugccuacaugaauuucugugcaccguggauaugcaggcuccuugagaggccagaggaaggccugagaucaccuggagguggaguuuugggugacugugggcccccugauguaggagcugggaacugaacccaggcgccccccccccccccccgccacacacaccaguaacugcucuuaacugcugagucaucucaagccccucugugugugugugugugugugugugugugcugcaguguaccgcacauguguggugugcucgcucaugcauguguguguagaucucagagguugacaguaccugucucucucucucuccuacuuccuuuccuuguucucugagacaaucuccuggaaccuggaguuuccuguucuggcuggcccggcuggccauuaagccccaggaguucuccauuuucccuuccucccccggggcuggugucgcugaugucugauccuaucucaugcuuugacauggguucugagugcaggcccucaugcuugcauggccagugccuuacccacugagcugagaccugcggcuccuaggguaaccuuucuuagaugucagcuuccaugucacuuucugagggagaccucccugaucacucagagagcaucccucccguccugucauggcucacucugguuaagucuuaugguacuuauugcugccaaauguuguacuuacuaauuuaccggagaucugucucguccccugcuugaugccugucuuccagagcaaugcccggcaggcaccugggucugacacugucacugaccacgagaacuuuugauugacagcagcuugaguguaggcuuuugccagguacuuguuaagcucuugaauaugaacuuauuucuuuaaacccucagguccccuuguguauguuuuucuuuuuucaccuuaccagcaggaaguggaggucagaggggugacaggugguguuggugacacagcaggcuagggaccccaagcuggggcccuggacacggcugcggggaggggaggccaguuguagaucuggccacggagcaaauuaaauuucuguuuccguuaauggggagcucaggcugccccaucuaccugggcuggaggagguucaggacccaggcucugcuucuggccccgugcugccuuucugagagggaagcaauugcucaucuccccacuggcugcagcgggggaacugccaggagaugacccugcccacccuaaggcuugguuugcaaaacgcugagccugguggggaaaugaagggcuggccugcuaaccacagcagcaaggaggacucauuugcaagagugaggcuggcccggggcccugcucuguccccuagcagagccauuucugugggcaguuguccuguaggaacccacugggugcaaguccuuagcuugagcuuggagcggggugaggggaggggaggggagucaugcuagagccucagucuucuccucugaggaaugggcugguugugauaucaugacaggcaaagaggcuggugcuugagagcccuuuacuaaccaugagugcuuggccaggaauucccgcuauuacgcuguggagcuaggcgguggacaugaccagagacccucucccagucacuaucucacguagcugcuacacuucuggaaacaauucccaguuccauagcaguguaucgccuccauaucuuuuugaacaguuuacauuuaucuauuuguuaugucagagucagggucucauacagcccaagcuagcagagaccuugcugucuacuugaggaugguuucgaacuucagaucuccaccuccugagugccgggaugacaggcccgcagcaccaugccccgguucgacaguccuggggaucaaagccaggaccuugagcaugcugugcaaacacgcuaucaucugagguacauucccaggccuaaugccaccucaauuaaacuuccgggagucugauacagagcuggcccaaugccucacugucacacgaccacgcuuccugcaaagccaaggaugaggcagagaacgggauaagcgggccagaaggaguuugauggucccuugugugugcagucuggugcugggcccugauggucacccaugggucaucuugagugguuacaguaaaaagggagcaagaagcaggaaagaggaagucugggagaggaagaggagaugcacagagguggcugucggagcaaggcuuucguguggggcacucgaucccgcuugggcugucuuguggagcuggugccucuagagcuuucuccucccucauccugaaggaggugauaccaaaccaaggguugcauuuaggguucagggacucagacgggcucuaagggacugugggaaaaucaagucuuuaaagaacgagagguucugaggaguugggucaguacauaaggugccuacuguccaaguacagcgacuugaguguagguccccagugccuauggaaaaagcugccuguagagguuuguaaccccagugcugaaggggcagggccuauuggccagccagccaagccaaacugaagagcuucagguuuggugagugaccucugaugucaaccuugggccuucacaugugugcaaaugcaccugaacacacacaugcacacagccacacuaacugguucacucaagaccuacaugugugcacuugcacacaccccgcccacaugcacguacauacccacacuaaguaguacauacagcacauaugugcagguacccacacuaacuagugcaucacacacacacacacacacacacacacacacacacacacacacaguaagaucugugcuccccaaggcuuucaaucccagggagccacuacauaggccgaggcuuagguguaggguagagucaacuagggcucuggaauaaucucccagagaccaccgcccccacccccugcccacaccucaucugcacccucuucuuuuugugugguguugucagccuaacguuccugagcuagugugaccuggcugcaguuucucuaacccugucacucaccaccccaggguguuuggagaaggccuugugggaguuuccuggaaaacaggaggagugggaaaccagccuugcucaccuuaucuucuggccuuacacuuugagacacuaauuaucacccugauagcuuuggcaucaaaccucaaccagguggcccuggcugcaccuucugaggguggcucuucucaggaguuggugggaagaugaagcggcuggucaggcuggagcuaggccucuaccucaaggaagcccugucuguucucuguccaagucagauguuucuagcuggaacuugacauuggcagugcucugugucuacggggcugcugauggaauggccacccauccgugggugugagugucuuggcuuaggagcugagcccugcucuggaccagcagggcuugggcagagcuucccugaccuuuucaagccgguuuccuuuucugcaaaaaggaaacaaugaagaguuucacagcucagagaggcaggagggacucuguagaaaggccugggccugggccugagggaugggaacccugaauaacuacuucuggggucucggggcugugguuucuugcaagagugcucgggaggggaagucugaggaaggcaggaaauuuuuccuagaggggaacucuuggggaccaaggcccaccuguccuuucugagaaucuuuuuuuucccuaaagaauuacuaucuuaaaauuuuauuuauuuauuuauuuauuuauuuauuuauuuauuuuugguuucucgagaugggguuucucuguguagcccuggcuguccuggaacucacucuguagaccaggcaggccucaaacucagaaaucugccugccucugacucccaagugcugggauuaaaggugugcgccaccacugcucagcacuaaagaauuuuuuauuggcauauaucuaucaucgccaaaaauuaaugcguaacccauuaugacauguucauacaugaauuuacugcuuuaaaaaaaaaauucacucccauugucuucucuugugccccucccacucccccaguggucaccugcuccagccuacucucaaaucuuuuuauugugagcgugacuaguggguuuaauuaggguuaguuacagggcugacaagcauaaacaccuuaccaguggcuacaccacuaaagaaaaugucucuuagcugggcagugauggcucacgccuuuaauuccagcugccuggagucgggggcaggcugaucucucgguuuaaggccagccuggucuauaccuugaguuccagggcaccaggucagguuucuuaacaaagccugugaggggcggggggguggggguaaggaaagaaaagaauagaacagaaaaggaaaaaaaaaaagucucacccuuucucagcaacugcugccugcuuauaggucuuccgugagggguguggcaaugugagucccgcccccuccaugauggacuguugucggggcccaauccuuugcagguaaucacggaugucguacaauagccaucucaugcucgaagacagcaguucacagcacuccaaaccuuccucuggcucucaccuucuuucgucuccaccuccuugagccuuggacagagugauguaggcucucaugugaggcugagcuccuuuuucucagcaccugaccggcuaagggucucugcaguaaccgcuggccaucgcacagagaaacuucuuugaccuaaguaggcagugaugcuaaucuaugggcaugcacguaauuguuucuaagguaauuucacauguguauuuuggaggaggcuguccuuucacacgccccccugacagcccauggccucccugaugaugaccugaggcguguguugguugcauugguuaguagcugacucugauuuaaguucgauagcaaggaggaagucuuugcuuggggcuuggacgacucuugugcaucuuuguaucauucugcucuccagagcugagauauuugacccuguaggcacagagagaaaguugccuugcucccgcuggucugcaggaugcugcccuucucagcagaacaggguagaggaagcccggcuucacggagccaccaccuccuccucauucuggguguuggcuguaucuuggacugggugaccugggugaccuuggaucaacuucucaucugcucugaggcugaguuuucacaucugcaaaugagugucaugacuuugucauaggguugcugagagccagagcggccccagguaacggaguaacagcuaucaauaguaaagguauccagcgcguccucuggaacugucauucucuuaugcuggagggaaggcagcugaccuggaggugcuggcaggccugugguccccugaaggccuggggaagcucugcucuuaccuccugcucaccucggguugcacuugguguguuagauucccucacaucucugcuucugucaguagaugguccucuucccucugugugggccuuugcccaaauuucccucuuuuucuuuccuuuaauacuggggauugaauccagggcuuggcauauauugggaaagcauccugcucccgaacuacacuucagugcuugcuucuuagagaugcugucucuugccaugucuuacaauguauccuaggcugguuuggaacgccuauguagcccaggcuguccuggaaauguugcccuccugcucagcccucugagugcugagauuccagguacguguccagaugugaugacaucugucuucucucuucuuacaaagaugcucugggcucuggcucuucuucagucuacuccagcuuggccccaucuuaaauuggcucuauccucaaggacccuauuucuaaagaagauugcauuugguugguccuggcgauugggacuuacacguauuuuuggggggguggggagcagaaugcaaugcaaccgcuaguauuauccauucauacgucgucuccagcaugucgucuccaggugacaaaggccaaggcuggagccaucuuuacucugaaccccuguuauucagguuuucacacccuggggucugacuuucaguugcugagguggcucucacuguccacaugaugugggucugagauucagagagacaguacaacugcauugaaguuacagagugagggaggugggccuggauucuggguccccagauccuagagccaacucuauuccaaggaaccauguccccugugugcaugugugcacacagccuaugaauguucauugucccauguggugugugugugugugugugugugugugucugucugucugucugucugucugucugucugucuguauaccacaggccuguuucaacuucuggagccaagacacucuggaugugagcaguagugaccagcuucaggggagaggacuuuugggucuuggcuucuucuaacuuccucuuuuucuggcuagcaguuaacaaagaacccugacuuuggggcuggggauauggcucagggguagaguacuuaccuagccuaugugaaacccugaguucaauuccuagcauugaaaaaacaaacaaacaaacaaacaaacaaacaaacaaacccagugacauaauuuggaguuagaucacucagguucaaauccuggcuugacugguauggcuuagggcgagucaguaacucgcugccuuaguuuccccacgugugcugcaaugacgauacuguagccuuauagauggacacaagugacugaaacccuacugugugguccugugugugccagagcugacuuaaugagggcuccuuccccuuuaucccguuugguauuuuucugguaccaggagguccugggaaggaggauaagguguggugcuuuccaggggaggcaaagcuauagaaagcucucugcacagcgguaaaagagccaggagucaguggucuaggaaccuuuccuuuccauaaagaacacagugcacagaaaagccauguccuguaaacugcacacgcaugcauaugcuugcguaggaccacugguuggcugagguguguggaggggcugccuuugagauugggaccccaacuucccacuuccaugauagcucugcaugcccagccuuccuuggugcugaucacaacuggauucccagcugauuucagaagcgguggucuucaccaaagaacacccagugccaggccaacucugggccuccugcaggcacuuccucuggguuccaguacccugcuuaucaggaggccgcaagagcaccaucuauuucuggccugucuggaaauaguguggucuugaaaggguggagggcggagucagcuuuaggaacagagacaucgccaguggagggaggaggacucauuugacuucugugcgugcaugcgugcauguguaggccagaggucaaaaucaagugucuuucuguaucacucuccaacuuuuuuuuuugagacaggguuucccuguauagcccuggcuguccuggaacucauuuuguagaccaggcuggccuugaacucagaaauccgccugccucugccucccaagugcugggauuaaaggcgugugccaccacgcccggcuuccaacuuacuuucuuuuaaagauuuaucauuauauuaauuauuuucuuuuaaguauuuaucaugaugcauguauguggguauuuugucuauaugcauuuaaagggcaccguguguaugcaauaccuuuggaggccagaagucagcaucagauuccccuggaauagcccuaaagucacagauaguugugaagcaccccguggguccucugcaagagcaacgagcuuuuaaccucuuagccacaucuccagucccuguaccuuaguuuuugagacugggucuccuacuggaucuggugcuugcugaccuggcugggcuggcuggcaggaccuaccugucucuccugccgggugccaggguaaugauauauagcccugugccuggcuuuuacaugguuucugggaauggaaaucagguccuggcgacuguucaguuucgcugcacauguagaaguuuguaugcccagggagguacuggauagugugucgaaauaagguacuuuuuguccuuagccauacauacugcugucaccuucugaaaugcuagucuuuugaaaggcccuugcugauaugaggguagcauaaauggagaguuauccccugcaucccugugacugccuccccuaacccagaccuugcucugaccucuauuuccauuccuuacacagcgacuuuggcuucauccucugggcaguucguuucuuccuacgcuuuaaaacucaguagcaagcugacagacaguugcuucuggguagaauuuaacaaucuggucucauuuccaccgaagccaugacuauuugaucguucuucugcugcuugcugaauggcucuuguuuucucucugucagaguugcgaaaacauccucagaauugauuugcuacaguuaaaaaaaaaaaaaggcaacuugaggaaaauauuagcuacauaguaucaacagcgugcagccauugcuuaucacaaagcucuauugcaguuggagaaagaguguucaagccgaggugcugaagccaaacacaacaaagaaaacaaugcccagaccaagacaaagaaacuggccgguccuucaggggcuggaaucgagaaauagauuuuguguacugagggcuuaaugugaugguuaugauaaacgguagcaaagcacauuaaauauuaagugcucuuuauauaagguagcaaauccuuucugcauuguacuaacacuuauuuguaucagugggugugagugccagagaaaggggaucgggucgggggaggaagagagagagggauugagagagagagagagagaggagaaaagcucagguuauuaucccauuauuccuuaggucccaggucccuuguuuucuucuugagacaagggcucccacugguccaggacugaccaaaugaggcugucuggccagugagccccggggaucugccugucucugccuccccugugcugcguacaagcauaugccacuguagcagacauuguuacguggagucuagggauuguacucagguccaccugauugcacagcaaccacuucgccaauggugccaccucccagucccugacugugugauuucuagacauacacuauacguucagugugacaccuagugcucauuuuaaauggccacccucucuagaaucuuacauaggaaggaugacugauuucacaacuuagagguauaagauauguauuuguguguguguguguguauuaagauacauuacagggagacacagcaaaaggggauuauucuaacuuaguuuccagcaggaggagaaagggccaaauauaagggccacuguagcauugaacuugaaaggauuacaugcugggguuuuuuuuuguggccagagacuaaagcucaucuuccucccuaaacuugcaaacaauugagcugaaaaaaaaauggggggagggcaaggagggacagaguaucacguagcccaggcuggccucaaacuuaccauggauguagccaaggaugaccuggaacuucugauuuucccgccuagaccucccaaugccgagauuccagauggacaucauuaugcccaguuuauggugagcugguacugagcacagggccuggugcaugcuaggcaggcauccugacagccaaacuacauccucagcucagaagauaccuaccacaguguguccagauccugggcgcgugggcuuggugagcugccuggagagaggguuuggaacuauggccuuguacuuugguggcuugcucacccugucuccagcacucuugggugcucacagguggccuguagccaguuccucccucaguggcagggagccaagcagggcagguggcugcuucgggguuaauagaaccagaaaaggacuaggaggcugagcugaagcugaccugaccguuccagguucauuaucagaaaguaucccugccucucccuugacagggagugucuggggcagaaggugggaugguuggggcuuuggcgaccucaaacccacccagggacuaacaucucugcaggaacacaaaacauuucagcaaacagcuaccacugugugcucaugguugccagcauacucucuuuccguggaagcaggaggcaugaacgcucucuucuguuggcucuuaguacagucucuagaacugcggggucacuuucucaccaagacaguaagagcagucuuucccccccauccuuagugcuaaggugugugugugugcaugaguguguacacucaugcauucacacauauguacucuugcccguggcggucagagaacaaccuugagugcccauugagccucauggauucuucugucuccaccuccucagugcugggauuacaugcaucaccauacuaagauuuuuuuuuuaaaugugcacucugugggauugaacuugggcccucaugccugcaugacaaacauuuuacccacugaucuauaugcccagcucccaagcaaauuuuaauaucuuaggcuuuguucagaaggccagaccuggcucugcauuuuauauccauggaacaauggcagcuaaaccagaagagagugacccacccugggucccccagccaggaaagaguggggcuucaagccuaggucuucuggaugcuuccaagucucuaggcuacucaggcugcugugggcuagguuggucucuggucacaugcaguugcaugucaaacagccuggcaucuuuaguuucuuucaccacggucucuggcugagcucuuggcccuuguucuugucauauaaacuacaagcagcagaagggacuguuaagagguggccggaauaucauccccgguagcugacguaacuuugacagagacuucuuggggcugcaguuuguuuccuucgguucacagagcaguggaauagggucucuauccaugagaacugcgguggggugacgacuaggccauaacgguagaaagcagagcugggguuugaaccugggucuuuggacuccaggaugugcucaugggcuuugcucucucuucccuaccugagcccaucuucaagaccugggccagacaaacacauguccacucagaacaggcuucuccccuguagguaccggauccuacuggccucucauuuuccuguacauauguguacauaucuguacauauguguagauuuauauguguuggugacacugggcaugcucuauauuucuaggcuccuagaacuccugggacagagccuuguuugucacgucaucuugaaauccccggugcuggcuccuuuuggugcugagacuacauggguguaugaaugaugacuuggcaaggaggugggagcacgugugugcacgugugugcagcugucuagccuuccgucugucuuuccccuugacuaugucuugaggcuauaugaagaugcaguuugcuggcaaacagugccaccuaaggucagguacagggagagagagccaugcucuaggugugaaggauaggaggacaucaccaggggacacugcuggagguugaagaucaggagagggagaagcaaggagacaggaagauuuuucuggaagguuuuucuuucuuuuguucuguuuuuuugaggaagggucucaggcagcccaggcuggcuuugaacuccugauccucuuguuucagccuccugggauuaacagaugugagccaccaagccugguaaaaagcugaauaugaagacucaugucccaucccaggcagggcaaccaaggguagacgauauaaggcaagggaccgagacggaguguugauggggaugcaccacaaggguggggaggacaggaaguggaaggguggcuaacuccaggaaccagggugcagaggguaucuagaucuggggaagacccaagaugaugccaggaaggggugggacaugcaaaggccaggccuuguuuguggcuguuaucuugcuucuacaagcaggaagcccagccacgagccccaccacauaagacaaggucugagcucagcuacucuuagcuugcucugcaaagacaggugauuguuuuacugugugccugaagcagaaauccccaccagcacagacaaugaccccugaccauucugccccauauccuucccauuagugguauuuguugucaggaaacugggguggguggguggguggguggagagucuguugucuucuugugcuguuucagauacauguacaaauauggcucuuucucuuuggcugaacugaauauauuuguguguguguguauguguguguauauguauguaugugugguguguguaugugugugugcauguguaugugugauguguguauguaugugugauuugugugugcauguguguguguguguggguguaugugugcuguguguguguauauguguguguauguguguguaugugugauaugugauguguguguaugugugugugcauauguaugugugauguguaugugugauguguguaugugugauguguguguauauguguguauauguguguguaugugcauguguguguauguguauguaugugugguguguguaugugugugugcauguguaugugugcuguguguaaguauguguguauauguguguguauguguguguguaugugugauaugugauguguguguaugugugugugcauauguauguguguaguguaugugugauguguguguauauguaugugugcauguguauguguguguauauguguaugugugauguguguguauaugugugugugugcauguguauguguguguauauguguguguguaugggugauguguguguaugugucucguuuggcccaugaacuccaaggacuugucuuuaucccccagggccagccuuacagccacacccagcuuuuauguaggugcugggcaucuaagcucugcuccucaugcuugcauagcaagcacauuacccauugagccaucucccuggcccuggaaucuaaaacauuucugagaacacgaaggaaggcccguuuguggggcuagcaauauauucugucauauucaugacacaaaggcuauaggauugucacuuaaucugggcaucccaaccaguuuccuaagcacugcguagcacucagagcagacucuuuuagucuccuuccccauccuacccugccccccaguuacagagcauuuacucaaagaauaccacuuuuuuuuuuuuuuaugcuguagugauguaauggcugaggauguguuaugauuugaaugggaagagcccuucuccacagacucauguauugaaggccugguuccuagcuggugguauucuuuuggaagguucuagaaacuuuaggagguaggaacuagcuagaauguuccuggaguauacccuuuggaguuauaucuugccugggccucuuguucaucugucuguccacccauccguccauccguccguccauccguccguccauccguccguccauccguccgucuguccguccaucugucugucugucugugucccuuuccccuaaauccuucuccuggcugaacucugcucugacaccccauauccaucacgagggaguaaaacuugcaacugggagccaaaauaaacuauucuucccuaggguguuuaugugagguguuguacagcugcaccuauccaguguggugugugcgacaugguguagaggugguggggagauggcucauucgagaagugcuugcuggguaagcagguggaccggaguguggauccccaguguucacauagaaucugaacacagaauaaguagcuguaaccacagagccggaggggcagaggcagacugaugcguggggcucacuggcugccggucuagcugaauuggugagcuuucgggagagauuguugagugguuaagaguacuggcuucuuuuaaagaggaucuggguuggguuccuggcaugcacauggucacucccaacuuccugaacuccaguuucagggcauccucuucuggccuucacgggcacugcaugcaugugguacacaggcauacagguaaaauaaaaguaaguuuaaaaaguaaaguggagggcuagagagauggacugagaggguaaagguuuuugcucccaguucugacaaccugaauuuuaucucugggacucacagggggagaguugacaugcacaaguuguucuuagguuugacauguaugcugagacacucgugugaacauacacacacacacacacacacacacacacacacacacacacacacaaaacaaacagacagacagacagacaaacaaauguuuaaaaagcaagauggaaagcaauagaggaagagacccaguguugaccucuggccuuugugcucacuaguuuguccaagggaacccuccauguacacacacaaucauguacauagucauauaacacacauacacacacucaugguagaauugguagaaugcugaguuaccauguucuucuguguguagucugcuuugcauugucauggaaacaguaaugaaguaaucuguugaagcaguaacugaagcucagcucuguuagugugguaccaggcuuuugagcugucagcauuaggugucagaagggaccccauugaggggggguuccagguuuuacacaugaugcucuucaccaugcagagcggugggcgugcucuucucuugcugcugaccaaugcaagccuuugcuguuugugugccguuugugucguguuggugccuguacuugaacaccuuacaggaggucugaggucuggauggcgcauuuugggcagacgguaguguugauauccggaaagcaagaaccuaacguguugguuuggaggucagaggacaagcuuguaggggucagcucucuccuaccauuguguagguucuggggguuggacccaggucauuggccuuuacccacugagccaucuugcuggcccuauacuguguuauuauuuauucauuauuauuauuuauuagguauuuucuucauuuacauuuccaaugcuauccaaaauauucauuauuuuuuaaugauuccugaguauuguucaauuguauuaagaauuuaagaauggcauauguugcagaggauggccuugucaugcaacaaugggaggagagguccuugguccuaugaaggcucuauagaagccccaguguaggggaacugagggcaaggaggugggagugauggguagguggguggaggaacacccucauagaagcaggaggagggaggauggaauaggggguuuuaggggaugggaaaggggauaacauuugaaauguaaauaaagaaaauauccaauaaaaaaaaagggagagaaagaaaagaaaagaaaaugacuccgcaagauuggauuguaagccuggugguggugccuccagguuccugcccuguuuaaguuccuguccugaccuccucccaugaugagcaauaauauggaaguguaagccaaauaaacccuuuucucccccacccaaaagaauuuaagaauggauaggaaacauacauauaaguuucuacacuuagucuaaacuccauuaggagcuguuagguacagauauacaccugcgaucucagcgugugggaggcugaggcaggagguuuaugagcucgaggccagucgguuacacaucaagauccuaucucaaucccgcuagccaccucccugaagaugauuagaugcugucuuaguugggaacacuacacacacacacacacacacacacacacacacacucacacacacacaaacacacacacaaguucugagugauguuaucacuuucauaucuggggaaacagaggcaagcagagugaaauugcuaccugaagcuaccccgcugauggggagguugcaagacaaacccaggcuggcuggcucagagucccucagccugaacaccagccauaucaugucuugugaguuggaugaacccaggacuguggagucugucuacccaacucuagguucuuuuccuagccuuaggucauaugguaccuauguugcucugugccugaggugguaggauuaucacccugugggaugagccugcuuauuacaggguuccugcugggcaugucacuagagaugccacaccaacaucucagcuuugcagaugaucaugucuuaacggcacacucucauagauggagagggccuuuucucuuccugggagcucuuggucacugaauggcgaugagcagagaggagaacaccucagcuacccauggacuucaccugcugcucauccauagacuccggaagugucagucacggaugugaagggcuuggugaugcagccuccaggccugggaagugugaccuucaaccuguggggccugggcuugaagucuucugcuaucccagcauccccaagggucugauggauggagaacuaguuccuagcccucaaucuccccaagagaauccaacauagcacuugcccgagaugcuucacagcagccuugucaccagaaccaaguguucaucugugggugaugaacgggaagggaaaacgaggaauucaaguacucggggaggcggggguggcaucacccauagucaugacuggagugcugacucacgcuccagcaacagggagacuuugagaugguccuacucagcacagguguaccuugaaaaggucaugccaugggaaagaagccagaccagagaccauguuccuugauuccauguauaugaaauauccagaauuguugagugcagagaagucacgugcaguuuaguuguugcuccuggcaaugcggggcugaaaaaggauggggugggguggcgugacagugaagguccagguuuuucgcugugucacagaauauucuaagauuggcugugcccauggccgugcauauuugugaggcuuuacaacucaaugcacaggucacucgaaguggacggccuucucugguaugugugcuaugaauauuaucuuuuuccucguuuuguuuuguuuuguuuuguuuuguuuuucauggcaggauuuuucuguguuucccugacuauccuagaacucacucuguagaccaggcugaccuugaaugcauagacauccuccugccucugccucccaagugcugggauuaaagguguaagccacuaccgccuggcuuguccuauucauuuucuuucuccuucuccucuucucccucuuccuucuucucugccucuaucaccaccuucucuuauaaaagcaagccaccagcgcuccaguggacaccagcuaggugcccucugauucuguucaguuuugauaguucuuggcagauggugugucugaucucauagauuggggugccauccaucccauuggggcccccucacuuuacugguuuagauccuuugcuucuuacugaucaacuacagacuuaugaugacaacuaucuccuaggguuugaggacuuugcuaaaauggcucauggaccucagagaacccgucaucuucccugguuuacuguaaaaccuauuacagagaaggcagguagaugucuagauagcagagaugcaugcccagggcaggacauguguggagaguccugucucagccccaucccauguagcuuggcuugcuuacauccuccaguaaccuucguauguucaacagcugggaagugccccgaguuuuguauugcgcucauguaaaaacuucauuguggaaguugcacagugcauuaaaccauugcccaucggucauaccucuaccucagcccugaugaaagguuggggcugaaaguuuagauccugaaaucaccugcuauucugucaaccagcucccauccugagacucuaucaggagagcuccuggucacaggaaagacagaucaguuuggagauacuaugaguuuuagaaauugugucccaagauuugguggggagggugucagagaucaaauauguaccucuuauaucaauuuaucaauaucuauuuaucuagaaucuacuaagucugcuuaguguugauuacauguaaccacuugagacccgaugacccauagggggcucuucucuggagaaaacuguuugucucucagcagucauugauugccuguaacucaucuagggguuggggucuugugacauuucccgccuccauguugguuaucucagcuaguggcgucauuauacaggucuugcuuaggugaagauauuacgcauauuuggcugagaagaugcuguguugcaacgggcauccuggucgucugguucuugcagcuuuugcaccugaaugcagccauucagugccccccccccuuuucuugcuucaguugaagcgaguggcauuuggggcuguuggaacucaagggaaaagaagaugacaagcagaauuagucacuggcaugggugguacucuuagcaacacccagagaggucuccagugagcaucagucccucuccugcuaugauagaguaaucugggucuuaucccuaaagaccaguuccauuggcaaagcacaaagcuuuaguuuucugugucugucuugggaaggggaugcugugaaguagggaaucaccaaagccuuugugucaaccagcuuuucauugugacaacacagcagagacaacccacuaagauauguuugguuuugauccuugguuuugaagguuucagcccauggccacuuggcucaguugucccugggcuguggugacacacggaggaggggaacguguggugaagcacaggugcccaucucaugguggccaggaaggggaguguagguggaacgagggaaggaggaugaaggaaugauuuccuuccggccagacccuaccucuugucuagcacuccuaaugacccaucagguucuaaaccugucacuugaccaguucaucgacaaggccuggacucugauccagucaccuccucauggccccacuucugauggcuguuuucagugucggguucaagcuucugacagacaccugaguguuggggcacauuuaacgaucacaccauagcacccuuccuccugggccgccugggaggaggcagauggccugguggcuuuugguuuccuguccacacucaggagaauuggacccugagcucagaugggacucuggucagagauggacucacagcugucuucuaggaccgaggugcuggggucccagggcugcagggcggggcucuauccucuccugcagggaacuggggaaucugacaagcuuuauuuguuuucucucaguggacaucauggagauaaaggaaauccguccggggaagaacuccaaggacuuugagcgagccaaggcuguccgccacaaggcagaauguugcuucaccauccucuacggcacccaguuuguccucagcacgcucaguuuggcaagugggugcacauuugucuggacaucccuccgcccaccccccugccaccuccuccuccuucugagagagaucauacuucaugucugcuaaugcaugcucugggaacccuggucuuggguccccauccuacugcuuuguagcuugugucuuugggcauggguauuuaaccuuuccaaguugcaguuugcuuggcugugaccuggggacagcgauguggcuuucuccuugggacguugugagaaguauguuaccugucugccuggcucaaguugagaguuaaaugaagguaguuaacauggucacugagagauaggcucugcuggacaaacaugucacuuguuuccuacagugguugcugcacaauaaacacucaucugaaugaccuuggguacauaugcaggcacagagcacacacauauaugcaugggcauacaugaacauagcacauauggaugcaugcacacacaugcauguauauaguaugcaagcaugcaugcgugcacacagcauacacauacacacagcaauacauauaugcaugugcacacacagcauacauucauauguauccauacagcacaaacauguaugcccacaguauauacaugcauggcugcauacagcaauacaugugugcacauaugggcauaacacaugcaugcaugaacaugacacacacgcaacacacauucuugaacacaguaaacauguaacauauacgcauagcacauacaaugcacacacagcacaaaaugcaugcacauaccacacaugcaaaagcacacagaugaauccacauaucaauaaacacauguacaugcauauaacuaucacauaugccucugcacagcacacauauggaugcaugcacauagcacacauggauguacauauaaaacacuuaugcagaacucacauaugcacacagcacauacauguacacacuacacacaugccuauacacaugacacagcauacacaucucacauauguacauguauaaauacacaugugagaacguauaaacuuacauauccggagaugggauuucuggccaucucaaugguauauccaucuagagcucagagguagagcuaccauucacaaggucccagauuccagcccccagcagaaacaacaagagucacccagaguucacugcccccucuccaauucugucuacagcggacucaaaggaggaugcggugaaguggcucucugguuugaagauccuacaccaggaagcgaugagugcauccacccccacaaugauugagagguacacaacccacuggcaucauccuccuuuguucuagggucuucgggaauagaccaaagggagaaaaugggacaucgaguccccaaguucaucagugcccugugugcagcagccccugauaguggcuaagaacucuccagugcuccacauaagauccuuucucccuaguguugagccuugaccuuuggcgugaagagggcacuucagcugagauggaaacacucauugguguaugugugcaugcacacauguaaaugaaucuuucugugaauaucugcaagcauauaaauauuuguucauauacauucuucuauaugcccuucacguggauuguuuucagugugauaugugugcauaggacccagggcugggccacuaccccucccgcaaugaaccaacaccuucccacauauaccacucuuucuucucagcugguugggaauuagugauggggaguuguccuuuauggaggccucacuugaucucauggaugcucccucggggcucagacaggggucuucagccacagguggagucuuguuaccaagcagccuugugaggauguuggggaccccuucuccuuuuggggacuuuguccucauucccuagagcucuuugaacuugcaguauuuuugacucuccccucuuuuuggcuucacauucucuuugcaguuggcugagaaaacagauuuauucaguagaucaaacccgaagaaacagguaaggcccaucagcgguuuucugugaacugugauacuugcuuguuucaguguuuggggggcaggaugggucaguacaugcccugugguugaaagggucucagguucugggguugacgguaacccagaaugauugaaugauugaagcuucugauggagugaagcuccugucgugcugcugaggugacauuugacaugggucugggaccuugucacaaaggcuggaacaccuaccacguccugggaacccagcaggaaacauugugacgccgugccugcaauguaugaugggagagacugguccugagggagcaagcuuuguuuggugacaguggugugacucugggcagggaugaggguaagaugcgaugaugugccucucuguguauuucacagucccuggaggaugggacuuggccagccagcacacagggucucugucagauucuguguuuaauucccucccucucuccucccuccuucccuccucccucccucuucccccucccucuaccccucccucuuuccucuuccucucuuccucucucucccuucaccccaucuuucuguucuuagaauugaaccuuaggucuucugcaagcuaggcauucacucuaucccuuagccaugaccgcagcccuccacugguggauccuagacaagaguucuacugucucuagcuucuucuuuuuguuuucagacagaaucucccuagaccauucaggcuggccucuaacucucucuguagcccucaacuggcuuugaacuuuaaucuuccugccucaggcccuugcauagcugagcugagagaccuguaccuccaggccuguuuuguuuuuuuuuuguuuuguuuuguuuuuuaaaaauagauacucugcuuggguuuuuccuuaggcaaaggcagugcucacccagcaacuguuuccccauugguaaauacauaauggcuucugacuucauguuaauuuugugagagccaaccuuggagugugaacuugggugcuguacgugugagucggggacuuccuuaguugcccgaugccagcucccgguguaugguggcagaauauggugacaggggugacuuccagcuguggcgcugagggcacugaccugcccacugucucugcugcacuggucuuuguccuuugcuggccuggaggaugaauggccauagcauccuuuguuuaaauuugccuuucuuucugaguuggugacugguuagccucuuauuuccuuccucuaauuaauaaccaagcaauauaggccacccugggacuggagagaaggcgccgcaggcgagagcaaucuuugcucuugcaggggauucgaguuugauucucagcacccauauggugggcucaugaccaucuguaacuccaguucuaagggacccaaugcccucuucugaaauccacagguaccuggcauacacguagugcacauacauauauguaggcaaaacacucaugcacauaaaauuaaauaauauguuuaaaaaaaagaucccuacagacaaacaaacaagcaaacacuacccugcauggagaacuuggcaguggaugguguuaacucuuuauaauccuugucucgaguuugucucacauuggaccuuuuguuuaaaaagguuuauuuugagaccggacuauagcuuaucuggucgagugcuugccuagccugcaugcaggcuugacuuccauccuggcaaggguggagaugcagaccacuuuugcccuagcccuugggcgguugaagcaggagggucagaaguucaaggucauugucugcuguagaaagaguugggagccagcuagggucaugugaagccuuaucucaauuaacuaacuaacuacuuagcuagcuaaguaacuagcuaacuaacuacuuugucuuuccuugauuuugguuuucauauucgagacaaaacuaaccaacaccaacuuccccauuuugucccugcaucauagaggugacucuguccgucugucucuugcucauuucugucucuuguuuaguguauccagcuggggcauuugugaccccuagccacaugcauucucccuucugccucucccucucaucugucaucuccuggcugcccucugguguaccaccaggguugagcuaguggggugucguggguuuuacacacugaggucuuaggguguugucaucucugagacugugcucacugaaaagacuggcucagggugacagaaggggucacucuggucacacugucuccauggugguggaguugucuguccacuucugugucuuuguuuuguuuuuugagacaagguuucucuguauagcccuggcuguccuggaacucacuguguagaccaggcuggccucaaacucagaaaucugccugccucugccucccaagugcugggauuaaaggcgugcaccaccacgcccggcaccacuaucgugucuuauauggagcagagauggaugccugcuucuuccuggggauggauucuucaaauccugccuagaaacccaucuucccaucugccaagagggaaccuguuucuggaggugcucccucccuguuucuggaggugcucccucccuguuucugggggugcccccucccuguuucuggaggugcucccucccuguuucuggaggugcucccucccuguuucuggaggugcucccucccuguuucuggaggugcucccucccuguuucuggaggugcccccucccuguuucugggggugcccccucccuguuucuggagaugcucccucccuguuucuggaggugcucccucccuguuucuggaggugcucccucccuguuucuggaggugcucccucccuguuucuggaggugcucccuggcugucccuccacccagcuccucuuccagcucccucccagcaggcaggcccugcugcuugucagcacugagaaauagaaagucucaccuucucuaggaggcugcagggauacuucagaaggaacuuugaucccagagugcuccagaaagagcagccuggccaguuucccucccuuuccugucucccacagccucugacuaagcccguuucucagaggaaaacagaagcugccagaggcaagaauggacuggccuagcucaggcggagcccgaaccccagauguuuuccuuggcccaaguucuguccagcuucuaacuucuccuagggcaaaaugguagcagcuggcuuuugugauggacuugcuuggcaacagccacuggauuaggcacaucccaugccaaccaaaugcucccagccaaccacugggcgaggcacccauuuuacauguaaagacacugaggcccagagaaaucaggucuugugccuaaagccagccagcauguugaggauaacacaccacucuuuguaggcuugcucugcuuaucaugcagacauuguuucuuacccuagccaaauaacguugcaagaaaaaagaaaaauaaaaaagaauuuaaaaugacaguaaggcuucuacagcgucacgcuuaccuuguaagaauuuuaagugcacaguucugugggguuaauugcguucauagcauugugcagcuguugcuguguuccaucucgugagugggcggcaaguuccagcucacggacagggucaucauuaaaccaugacaccacaggccccccucuccccuccccccuugugaaauacagugcggcgguugguugggguuccugguggguccaugccaagcuacuccaugugacaaaccugguauaagggagguuuauuuggggaagggaggggagugaguguuagcauuuuguuuaagcuccccacaguuaccuggcaacggccagguaugccugacucacuguaaaaggggcuguucgcucccucuguccucucuucuugcuuucuugcucccacuccguccucucgccccuuccacccucucucgccacgugcucauggccggccucuacauuuuucucucugucuuucucugucucuaccuggagaaaagggguggaggcaggcagacuggagcagagccacgaaggcagaaggggggugggaguggggggaggaagcccggcugggaacacguggggagagaggggggagggcuccgaugaugacauaagcuguagcuaggucccugggaggagucuagcagaaucaccuguaagcuaauaccucccuccuggaguucugggagccguguccuguucgauuuggcugccuucagugccguaacacucuugccgauuucacuuggaguaaggcucucaaggggcuuauccccaccgcgggcaagcgcuaucccguggagcuacauccuucuuaaagccuucuuuuuacuuuuucucuugagagacagggucucacaugguugucuaggcagcaugccuuggacuugugauucccccugccuccgacggcggaguagcagaaccacuuuauuuuuugaggccgaauaauauuccaaaguuugcucucucucgugcuucugccauugugacucagugugcacgcaugcguagaaacaccggcagggagcccugcccuuccuguuggaucagugggaacugguuacgguucugaggaacaccugcgcuauuuuccauacuggucauguccucacauaggccccucagcagcgcacagauaguuuauuucuuccucauccuuaucaacacgauuucccuccauccuugccccuuggguuauaccacugaauuugcauaagcagaacagacuuucuuguucagaucugcagggaccgagggaaggcuguugggucugcaagggauauggaaggggaggcgcugcaggugggagagcuccuggaugcaaauagguuucaugugguugauaacccaagccacacuugugcggauuccguugcauuggccaucauuguagguaugggauuuuuuuuuuaaaagguuuauuuuauaaguauguguuugcauguaugugugcacacuguguguauauaugaugcucaagggaggccagguaggcuucccuggaacggaguuacagacggcugugagcugccaggugggugugcagaauggacccccccccccaaggucuuuugaaaagaggagccaguguaacuucuccagucccagcaaugucguuugagacaauguuucacuauguagcccaggguugagaaauaguucucaagggaaaugaauucucacuuccugagggcauggugaagcagcccucuuccuccuccucugccaguuuaaauguggggguccagaccccgaagaaugugcaguuuggcuaauccuugggaaguaguggucccuaaacagcugcaaauagcagggcccuugaucuacacagugaauguagggguugcugagugcaugggccaguggcagauacagugcguggcccaguucacccaucagaguagcugugugggguuggcugcuggugugccaaccagcaccaauagagaacauaggcacugcucuagaaaguuuugugagguuagccgcguuuggaggcacacaccugucaucuuugcccucagaugcugaggacuacauggugagagccugucccaacacacacacacacacacacacacacacacacacaugcacgcgcgcacaggaauagggagagagagggaggggaagacagacagacaggcaggcagacagacagacaguaagagaagcugcaacacugcuugugugauauuugggauaauugauuauuucugucuacaaagagcccugauguugcucucuaucuugcauccuggcuggaugccggcuugugggauucagugaguucacacuguaaagugccuagauaggaccuggcuuacagaaaagauucuacauuaaauauuuauuguugcuuuuauuauaaauagcuaugggugagagugggcuuuuuuuuuuuuuuuuuccuaagcaggcagguuucaggggcuccucuggugauggguguagccuugaaggcacccaggacccagccaggcuuuauagugauugguugaugaugucuguauaaaagacaggugucagcugccccuugggagaaguugguuuuugguugucauucacaaaagagaucagccugguuucugguugagcucuaggaugggauaugaguuucugauuuguguccaggaagcugaugcuggggacuaugaagaagcacaggaugugcaggcaacaggacuggcucuugcuuccggggugggaucaggcguggggguggggguggaggugggugugggugugggugugggguucugacgcucgcugcccaucagcucucuggaaugaagauccagggagucaaaucugcuuucuagcuuggaccugucaccugguccuggggcccccugccacaggaugggcuugugaguaagguacucgccaucuuaugaggcagguguggcuaagagcuacugacuuccuucccuccaguugcuggggaguacuccuguuagguauguguuucuagagaugggagugaggagagaguucugggaggggauucaguuguuccuaucaugaagaaccugaaauagcccuuuggucccugcuucugcagugucuuugguugggugucugguuggagugcauggguuuagcaucucagaugcucuugacuccugugccugcuccauuacucaauugcuaaauagcugcauuggcucuuggguccccucuuucuuacucucaguuuccagaugggggcauuuccuuuacuggugcagccugggcuccuagggccucugauuuugucuuuucuuuucuuuuauaaaauuuauuuauauuauuacagcuaaguucacuguaauugucuucagacgcaccagaagagggcgucagaucucauuacggauggccgugagccaccaugugguugcugggaauugaagagcagucagugcucuuaaccgcugagacaucucuccagccccgaccccuauguuuucaaucucucucucccgugucuugccauguggcacaagaggaaugucaccuucugaggcaccuucuauagucugcuggcaucucagcauagccagaccucuuggcccaguggugggagccugugggugccccuguaaacaccagagccagcagaauguugcucugagggaggcaaguagggagaaggucaguucagcacaauucacuaagagaguguugguuuaaguuuugagugucugacaccgggcaguuucuuucacacacguuuaaguacagcacaguuugggaaaaaaaagauucuugggugcugaucaacucaaucccuucuguacaguaaagcuuaaggcaugacugcauugacacuucuuuguuaaagucugugugaacccuuccauagagauggacuuuguagcuugggagacaaugcuuaacauaagggccucgguaggauggcugagauaaaccuaagugucuggggagccaggucugagcucacggggcuaucaccauucucagccuucugggcagagaacagguuauucaucucuucccuugaagggacuaccccgugauucuaacaucccuggauucccuagugcuuauguguaagcacaagggccucgcgcccuccacaggacccuugaacgcucuuugugcugccgugggagagcaagggggcaagaaggcuggaugugacugcuguaguguguggagucacacacgcggcucuucucugacgaugacaaaggccagguugauaaguguggagacccacacuugaggccggguucuuucugagcccuuuucuaacucugccggaugcuuggcucuuuggcuagaaggacccgagucucuuaccugugacccauccggcccccucauuucuggugucuuccgaaggucuuuggaaugugguuguucugggugagacugcagugagucuagucuaaccuugcucacacagcaggcuucucugagcuucgguuuccuccguggagguggcaguggcccuaagggcugccuugggaggcuuuugaauccugggagucuguagcuggaccuuggggagcagaccccuaaacgugauggguucuauuagcaucugcgucauuguucccuuuguccccuuuuugacccuuacucuccucuucucuagaagcucaggaguagcuccuggaaaauucugauaccaccuguucuggcuugaugacuguugugggauuugguuaggaucuaggcugcccuggguccagccgcagccuccacccauucugaacggugaggcuagagcuuggugcuguguguguauagauacaagggaguaggguggagaagugccauggcuuagcugacacuaagcuaccuggcacauagcagguaccacaugccuucccaucugccccccucugguucacucugcuuuaaaaccacgugagcauguuuccgagacucuucgggugccugaggcuugugguguucuacaaaccccauugggucucccacagcacuggcuuccagagccaucucccacgugacccaugucuacuaccaucgcugaggggguagggaccagccuccacuaucagguuguuccuuuccucuggcuuaaagggccuugcuucuaguugguuuucucauggaggggugccaaggugggggucgguagaguuguacaaugcuucccacucuggccacccugaggcuauugggauugagauuucugucuuugcagcaucagccuccgggagcugaagaccaucuugccccuggucaacuucaaagugagcggcaucaaguuucucaaggacaagcuggugguaaguauggcagcucagcugggggacaagaauuuaggcuugcuuagugccucucucaggaacccaugcuggccuggggcucuguggaauggcauccaacagagcccucugccuccgagcacauuaguccugguuuauccaauggaacccugugacuauuggaagacuucuugaggauggagcaagugaaggcuauguugcuggauggugugacuugggacaucugugcagaucugucugaaccagucugccuuucagcacuuucuggaccuucuugcaguuggucaccuuaguuacaggagcacauggguccuuuguaaacugcugcggcagaugccuuugagaggguacugaggacaucugccauugcguuuuguccucuuacucuaacugcccauuuuccuaauuguuguccuuucuucccccguuacugaaguaggcuauguucuugagcugugggugggacagccagcaaagucucucugccccaggaaugaugggaugcagggggcaaggauagauggauggaggagaugaaggugaaacuuucccacagagagaugcugucgggaaaugaacacgugguccggggagcccccauaggaggcucacccagucaugucagugucauucgugggauuccccuugcugaacaacuucauuccuuugaguacuacugaguuccugggacagcagacccaagcugauccugacccugccauucuuggaccugcccaucuccuccuccucaagacagaaagcaggcgugagagacagagagggagaagagaaaaauguuauuauuaaucccugugugguuuucucucuuucuuuauacauacacguauguauguauguauguauguauauauguacaacacuuacacacacacacacacacacacacacacacacacacacacacauacacggguccacucccuggccaaaauagacauguagucacaucaucaugcaaaauguguuuacuccaacuucaaaguccccauggccuuuuagucccaagacuguuguaaaguccaaagucucuuaggagacucuuggaauuguuguauauaugcauauguauauauauauauucuuauguauauguguuuacauaagaaugcacauauauauacauauaggcuagggaaucacugacuucagaggacguuggguugauuccuccagcuguucaguucuuguguagagggcggaggugugaggguggacacccgacuaugugcgcucaccuuugccuucugugcuugcaggaaaucggcgcacagaaagaugagcucagcuuugaacaguuccaucucuucuauaagaaacucauguuugaccagcaaaaaucgguaagaggacccucggcucuucucguguuugcuucaggcgcagagccgagaagcccacagggaaaggcuuagcuucccacugagucaaggacgcaugggcaagagugaccguggaugacuucaggagaccagcaaacggccgcaaccaugguggagcuguaggagacacgucagggcauggggguugcugaucuuccuggugggaauuccauagccauaaauuugaucauaacucugaguauaugaaaaacaaaauacaguauaaugcacagcacacuauuagaucaccuaggaaggaaauccugcaaauuauucauagccuucucugaguuuuaugauuuuaugacuuuauuuuugagacaggauuuucuguaguccaggcugaccucaacuucauguaaagcuggccuugaacuuccaauccucuuuccuccagccaaugagcgcugggauuauagagugaguuacccugagguagcagguuauagggucaggaggggaccagggcuuuguaugugcuaggccauacccccuaauccuuacagauauucaacuggggacuaaacaugcaaguguaugagccuauggggcccauuuuuauucaagccagcauuucccacucccuggccaaaauaggcguguggaacaucaucguacaaaaggcauucaguccaacuucaaaaguccccauggucuuuuagccccgagaccaccguaaaguucagggucucuucugagacucuuggaauugucauaaacuguuaaccccugugaaaucaaaauuaaaaagcagaucacaugcaauguacagugacacagaauauauguuaucauauauauaucauauauauauauauauauauauaugaccacacauacaugacacauacacuuugccacugucuucuggguuccuacuaggaugccuccuuaagccucacuuaaauuccuuucuuagucacuuucuguuguuguuaagacagcaugccucauccccaauccaagauguauuucaacuuacacucuuucacguugaagugaccucgauaguagccuaggcugucuuagaacuugcuauguagcccagguuggccccaaauugacucuccuacuucagcuuccccaaugcucagccacaaccuaaacuuuuuauuacagcuuaaaaaaacaaaaaguguguuucuguguaggcuugugugcaugugagagagaggagagagggagaggaaggggagggaggaugguagaaaggagagagggggugaggaggagggagggguggggagggcggagaaacauacugauugaauugagguuuaaggacucccuauucucccuggaaugugcuagguggaacccugggaaaacauucagccaugccaaggucgcccucugguggucagaaugccacauggcaccugaguugguaucucauuuuugguuuggccuguggguuggcauuuuaaaauuaaugaccuacauuuaaaacccagaggucuaggugaggcugcugcugcugcugcugcugcuucgucuucuucgucuucuucgucuucuucuucuucuucuucuucuucuucuucuucuucuucuucuucuucuucuucuucuccuucuccuccuucuucuugcugcugcuucuccuccuuuuuucuucuuccuucuuccucuucuuccucuuccuccuccuuuuuucuucuuuuuccuucuuccucuuccucuuccuucuuccuuuuccuccuccuccuccuccuccuccuccuccuccuccuccuccuccuccuccuccuccuccucuucuucuucuucuucuucuucuucuucuucuucuucuucuucuucuucuucauucucuuucuccuuuucuuccuuccccuucuccuuccccucuuaggucacagagcccaagagaccaccuggggucaggccagggauuguguguccaguaagucuagagguugcccacccagcuuguucauggccaagugucggaagggaagggcccacauucccugagauauccugauggcuugauggaucauuuuggaugcaggugauucuagccugagguagcugggaugggggauaggaauccucagauuuagcagugacacucugguugguuucuacccuggugacugucccugggcuccugaaaacucauugcucccaccuucagaagacgagacugucagcgugcugugcuauccuccggcccuuggaaacucaguuccccaucuucagcccugugggucuuaccgucuuccucucccuuugucggucccuuccccuguccagcuggggccuuccuugagcaugaggagaauaauuccuccauuauuuuagucagucaucugacuuguacaacagcuguuugcaugacccaaguggguaccgugcuuggcacagacauguccucugacccugcugacagcucacugggguggacaggcucacugauaucuggaguuacucagaccccaguguccacccaggcucccuguuggguuagguuugaccacagagccucaccaagaaaugcuuucuacauccucauuuggcuugugagccaagugccaaaugaggccaauaaucuccuugccaugccugacaccccaccuucucaaaagaaacgugugugugugugugugugugugugugugagugcuucugaauuugaacggguaguccaaccuucaggcuggugaugagagauguuuccagacaucuuuccagaguaugggacacccagguaccuggggcacccccuaucuccagccuguggguggccagaggacuugacuguuggacgcagagcuguuuacaagaucugucacaggccagugacuagagggucauuuccaccuagaauacaucucaccuuuacacaaucacuguguuauugaucaggcaggcaagguggacagaguguuugccaggcuguuagcuagaaacaguccaggagcauauguguauguacaugcgugcacacaaaaguguguagguacaccugugugcauaugcguaucucaaugugugcaugugagcauguauguuuguguuuacaugcacacacacaugagucuuguguaugagugcauaucuguaucuauacauauaugugcaugugugugcacagggcucagccagugagcuggugcagauggagaucagaagggaggcgcaucucagcuccucgaaugugcgguugacauuucagagggcacaagggaagagcugauauggcccuauguuccuuuucugcccugaaagcagaaugguaaaagggucaucugugaaauauuaaaggucugaaauacagcaguaaacacagaacaguguaaguuaccgcuuguugccgggaccacaguacccagauagaagaccuccaauggggaaaggcugaguuguggcccacggucucaguccacugugguggggacagccugguggcacucauggagucagagacaugugacagagacaccagagguggucucugguggugguggggguaguguguguaugugugaugaauguauguguggugugugcgugugugucaaugugcauguaugucaguguguauguauguaguguauaugugugugguguguaugcauguguguguaugcuguguauauauguguaaugugugcuguuuuugugaugugugcuugugguaugugugguguguauguauguguguauaugggguauguauacuauguguguguaguauguuguguguuaugugugcaguguguaugguguuugugauauauguguguuugugugugcauguuguauguguagugcuaggagucaaauccagguaaauaccugucuacccugaguuguaucuccagccuuuguaaaaacaacaauaaacaacaauuuaaaucucucucccuuucucucucucucuucucucucucuguuugaugggggcaugggaugagagggcuguguguaccauggcaugauuguagagaccagaggacaaccugugagaguccauucucuccuuccacugugaggacccuagguuguaagguuuggcagcacuugccauuaaccucugagcagucucucugguccagccucuauuuauuuaugaaucaaggucucccuguauagucuggguuagucuugaacucacgaucuucuucuucugccuuagccucucaagugcugggaugacaggugggugccaccacauucaaaauaccacauugauauguacauuuuauuuuucuuuuuucuaugccuguugagaugcugugauuucuguugcuagaucagucuaggcauuguccuacaucaguggguuuugcccaggcugagccaucuuggcugucucaguaauguuuccauugcaugagaggugcuguggucgaaagcaacuuggggaagaaagggcuuauuucaucuuacaguucucaggccgcacucugucacucugagggaagucggguaggaacccuagaaggacaggaaccuggaggcgggaacugaggcagaagccacggaggggugcagcuuacuggcuugcucagcauucccaggaccauccgcucaggggcgucaccacucccaguaggcugggccugcuuaaaucaauuauuagucaagcaaauguacuacaaacuugccuauaggcauuuuuuucaauugaggucugucuucccaaacgacacuagcuugugucaaguccgcaaaaaacuaacgaggacccuugcuuugauaauuuuuuaaaguaauuuuuccuuuauuauucuuuagauuuauuuguauuuuauguauaugaguaucuugccugcaggcacauaaugucaccauaugugugccucgugcccacagaggccagaagaggguguuggaucucuggaacuggaguuguagauagcugugagcugccgugugggcucugagaaucgaacccacaucuccugcaagagcagcaacugcuccugacugcugagccauuucuucagcccacugaugacuuagcaaacaacaacaacaaaaaaucucaccggcauaagcugauuuguccaaugcucuuaugaucugcuuguuucucguuucagauacuugacgaauucaaaaaagacuccuccguguucauccuagggugagacaccucgggcacguugcugcuguucagggccucuguguccuuguagcucugguggcggguggggguacugugugcaguuacugaccccagcuuuguaggacagcaggagcgagugaacagaauccguaagguguggaguauugugaggagggucuagaagauucuguagggaggaccgugaccucaggcuuucuucccguagguucaggggaugugacaaaccaauagguuucucuuucccccugcuuuccccuccuccccacccccaccccuucucuuccggaugcgccucuucccucucugguuccauucuguuuguggacuccacauucugcugugcuccccagaccuccuggagcuccugagugcuguccggggccucuaagacucuuugguugggaucccucuuugagucucuuaaaucucgacuucgagggucaguggugugcucagcauggcugggcugggguucaggguagaggugaacccucucucuaaccacccugugucauuucucugaggacagaaacacagaccggccggaugccucggcugucuaccugcaggacuuccaaagguuucuuuuacaugaacagcaggugagaggauugugagguggggugucagggacaaagugcuucccuggaugccugcugucauagaauagcuguggugucccugaggugggguagggccuuagacugcuguccaauaucaccagguuuccucaaauucccagucucucucucucuuucuuuguuucuuucuuuuauuaagauuuauuucuuuuauguauaugaguacacugucacugucuucagacauacuagaagagggcaucgaagccuauuacagaugguugugagccaccaugggguugcugggaauugaacucaggaccucugggagagcagucagugcuccuaacugcugagucaucucucuagccccuuccuuccuuccuuccuuccuuccuuccuuccuuccuuccuuccuuccuuccuuccuuccuucuucccucccucccucccucccucccucccucccuccuucccuuccuucuucuuuccuuccuuccuuccuuccuuccuuccuugaaaauagauucuucucucauacaauacauccugacuacaguuccucccccacuucucucagucccccccccccccgccaccuccccucuccuccagaucuacuucccaccccuuuccucuucagaaaagagcgggccuccaagagacagcagcuaaacaggaccaaaccgcauacaacaaggcagggcaaaaagcucucauauggaggcucgacaaagcaacccacaaggaggaagagucccaggagcaggcaaaagagucagagacacaccugcgcccauugcuaggaguuccacaagaacaccaaacgagcauuccuaacaucuacaugaggacugggugcagacccaugcagcucccaugucugccgcuccagucucugugagcccaugaaguuuuaguuagagcaggaagacagcugaaggagaucaagggcguucacauuggaaaaggauaacauggcgugcugaaucuugucgcgacuuccaaugagcaagcaauggcaggggacuugagggcuugaauaagaugucccucacccuggcuggugccagaucauccccaggggccacaccaggaguguuuuccuggguggccauuccuucuggaugggaggaggugacuaggcugaccaaaccugcugguccccugggggaugagaacuaagacuccccagauggcaucuaugugguggcuccuagugugguggaagagucacaggaguuuccuguugggaugucauuaucugaugguacaaagucacccuaguauguguguguguguauucuuggguaccaugcuggugucuggcgagaagaugccguuaaacguuccccugugauacacguuuuugagacauguuuuacuaaguugcucaaacugccauugaacucccucuuuagcccaggcuggccuugaauuccuucuauagcccaggcuggccuugaacuugcuguccuccuggcucagcuuccugaauagcugauacaaccauucuguaccuucacacucuauguuugggcucuaucauaguauagugauagaaagggacuagugaucagagagggacauuuaccacaagguuaacagccugagguugggcaguggcagcugcuggcucggggugcugggcaugcauaccacgccugacagcauggaacacugaaugcaggugauggaggagagagguucuguuugcuuagccugagugagcucuuaagacccaaggauguuaaacacagugggcagugaauucuguugggcagucugaggacggcuugcugggacugcuaaaagcuuuccuccuaccacuaguguccuagcgaucagauuuuagguuguugggcuugguggcagguaccuuuacccucaggccaccuuaccaucccacauuugaaccccuagcaucuugggauucuaaacuucuuuaggaagauccuggucucugcccagccagaaagcagccuccaguucuauuagcaagugcucaugucuuuugauaaacgcgugugcuuugcaggggaaggagagaagggccauucaggcccuuugagguacccagggagccaagguguuugcacuaagcauccugcacuugugguguugcuucuugguucuccccccaccuccacccccacagccgaggacggaaccccgggcuagugcucuaccacugagcuaaauccugaaccccaugcucuaugcuguuaacaaccuuccauucagggaacucacagccugcuggcuauuuuggugucuguggucuggggagacuuguuagcuagccacaguccuguguugcugaaguagggccucaccauccuguuucagucugucuuugggcuuuuguucuuucugacacacccccguccccguccccccacccccaccccaccccgugucccuuccuacccaaucacacauucaucucagacacaaggagagacacuggggaaugucugaaacccagaaggcauuggccagcaucgggucugugguaucguucaucuuguugccuguggauauuugagguuucggagaauguagcagaagaaaggucacugcaugcugugguuuuuuauuaaggaaauguuucuggaauguccagcauuguacugaaucugcuaguggggcuggauuugucuaucgggguggcucugccuggcugaccccugggggaggggaugcgagguguccaucucaguucuuuugcccagguugagugauuuggaaauugacccugguucucaugagcucuggagaccugggaucgucuugaagucauccugagccuguguguccucuucucuaugugacagugacaucauauggcuugcaggguggggcagguuagaggaccauacggggacgaggcuguuagaauaaacuaccagaaacuggaggcuuccugcagcgaagaacacugcacuaagcacacaacugacuucaugugguccuguuuccaaaccugcgcgguguauaacuuuugggacccuccuuucauggaugaggcuguauaaagaagacacgugacuugucaccuuggcugagccaggggagacaccccaguaggcuggcuauacuguauaguuacuuuucucguugcugugaccagaagaaacuauuucaacugggcaggcuuuauucuggcuuagacuuagaggggcuauagcccaucauauuugggaagagauggcagccugugggaacagcacagugacaggaaucggagcuggucacauggccucucucgucaggaacaggaaguggggcuggacuauaaaaccucaaagcccaccccuagcgaccuacuuccccuagcaagccucuuaucucuggaagguuccacagccuuuccagacaaugccaugaccugguaacccagguguucaaacacaugaacccguguguguguguguguguguuggggggggcggcauuucauaauuaaacuguuaacacuggcauaguccaccacagucccuggcuguuucauacugacacccguggccuagugcucugaguucuuagcagaucauagucugucguuacuuuuauugauaaaguuucauugcaauacagcuaugcucauuuuccuguauuuggucuguggcugcguucacacgguggugacugcugagugaggauagcgggugacccaugcagaaggcaucugcucgccccuggcaaagaccaugccaggauggagccuuauuuauguggcucugaaugacauagguuugacauuggguccagucuuugaucaccuugacuagguccugaggaggaccuugccuguccuuuggugacuuuguguuaucuucgacaucuuuaaggagcuaugggcucaggaucugaacaaaguccgggagcggaugaccaaguuuaucgacgacacaaugagagagaccgcagagcccuucuuauuuguggaugaggugagugggcuggggcaugucacgugagcaggacuuccuuuaucccuuccccucggaaggugucacugucagguguccgggggacugacuccguguaaggagugguuuucccaggguggggauuaauccugcuuuucauuuuccugauucuuaccugggugggauuaccuguuucgccacuagagggcguucgccaucagggagaagccaacugaacuugacaaauguuugaugguugugugagccauuuauagaggacacuucuuuuuacagguggccggggaggaucagaagggacauggcuugucacuugcucgcuggggcuguuuauggcaguaaaauguaccucugagccagucgguguuucugauuuauuauuauuauuauuuaaaugcuaggaguggguagaugggaaagucccugggccccuucucggccuccuuguuuuugccaugguaggaacugaacccaggaccuucugcaugcuaggcagggguucuaccacagaccuauaacagugggacucuuuguaauguuuauuuugucccuccacccggcccccaggaggucagaggacagacagccuuaaguguagguccuaguaugcauccuuauuugaagcagggucucuuuaugcugggcucccagaccuuggagcuucugggguuuuccccaucuccauuuuacaucacaguagaggaaccaugaagccaucucuccagcccucuucucuuuucuuauuauuuauuuauuuauuuauuuauuuauuuauuuuaaagcuuccaggaguugggacaggaaacucugucccuuucucucuguuucccuuuuaucuucaguuuuuuuuuuuuuuuuuaaaaccugaggcuuuguacccauuagccaaucacucuaccacugagcuaauccccagcccuccuuuucuuuuugcuuugaggcagguucucaguaauuuguccaggcuagaccugaacucccuguagcccagacaagccuugacucugauccuccugaguaucugggaugacauagcugagccccuaggccuggugucuuuccacccuuugauguucucauauccagagugcucugucuccaaagcugugcuggacucgcagaggcuuagucgcugauacaauguaacgcuucggugugggcagcuggagcucugacagcagcagacauuugggauacacguuaaaaagggaaaugguggguagguccaggaggugcuuauguugauacggggugucuaaguuaggguuuuacugcugugaguagacaccaccaccaaggcagcucuuguaaggacaacauuuaaaauuggggcuggcuuacagcuucagagauucaguccauuaucaccaaggcaggaacauggcaguguccaggcaggaaugaugcaggcagagcugagaguucuauaucuucaucugaagggugcugguggaagacugacuucagggcagcuagacugucuuaaggcuacaccaacagacacacacccacucuaacaaggccacacgcacuccaacagggccacucucacuccaacaaggccacacccacuccaacagggccacucccaauccaacaaggccacacccacuccaacagggcuaugccuccuaauagugccacuuccugugccagccauauauaaaccaucacaagaaggauggcugcaaucagagccauuuguacugaaaccucgagaaaccgaugucuggggaccaucuauaaguuucacaggucagagccgccuugccuggcugcucaggugccagcuaagaauaaguagacucugugccucuugugccacggugacuccguguuggucgucucuuucaguuccucacguaucuguucucccgggagaacagcaucugggacgagaaguacgaugcaguggacaugcaggacaugaacaaccccuugucccacuacuggaucuccucuucccacaacacgugaguuuccggaugagcccaggcuggcuccggcagagcuggcugugaauggguggggagggucaaagggguccgggaacacagcucucuuuccagccaguaucuauggccuuuuaaacuuuuuuuuuuuagauuuuuuauuuauuauuuauuuuauauguaaauacacugucgcugucuucagacacaccaggagagggagucagaugucauuaaggaugguuguaagccaccaugugguugcugggacuugaacucagaaccuucggaagagcagucaguguucuuaacugcugagccaucucuccagccuucuauggccuuuuaagcaacuuuacagagcagauguuuuaugacuuggucaucacaccaucaaaacguucacucagccagugagcugguauuuguggaaacaucugacaugggccaggcucuucgccuaugagguguguggacuccucagugaacgagggagucucauucccuggugcuuagagaagaaggcuuccagugacugucaacccuaggcaucagcugguggcugaacagaggcagggugagaaggagaguuuccugcaugugcuaaggcccuggggcaggaacagcugggaggcauuuuuaaggcuggagugagaaugaagagucugggaggguagcagcaggcuagagggccagcuuauaagucacagagagucacagggagccuccgaccucuucacccagagagugacagagcucaucuacuucuuuggguaauuaugcugauugcaaaugaguagggugaugaagggagugagcagggaugcugccuccuggccucaguguucagucagacuuucagggugaggguuuguuugacuucuaggcugcaaagugcucuuucaaacaggggaugagaaaauccccucugcccccgugugucauccucuagguauuugggaaggugaccccuuuuccaggggaauggguaggcggugcaucucgaguucuuaucuuaggaugguggauucuccaagccuagagacagcugaggaauuguccugagaaggcagguggucuggagagaaggcaaggcgauagucauuugucuuucaaaacaucaaaagcucucuuaaauaaccuaaucaaugaaugcucuaacagaggaauggauacagaaaguguaauuccuauguaaugcauauauauguuacacauauaucacgauagaacuuugcgaggcuguggaggaaaugagaagucaugacauuugcaagaaaauggauugagccauaaaucauuauguugagugaaauaagccagaucuagaaacaugacuacugcaugcuuuuuaaaaaaaacauauuuuaugguaguuuugcugacuagguucaugguaccguaaauucuaccaggauuugcugagccugcccacgcuggccgcagaucucagugaugaagcaugggccuauuucugcugauacccagagcccagugggcagcuccaggggucauuagcgcggguucugcuucgucuucacuccugacacccucagcucaggucuccaaaagguccauacugucuucauugcauucagauugcuuagguagcuaucgugcacaucuuauuggugguucuggacccaagaccucaggauggcgugcguguggcccagaccuuagccuggguguuucuccaucagaagaucuugggcucagacggucuccaagcaugaacuguguacaggauugccucucugacucgggucauucugucccucagguaccucacuggggaccagcugcguagugaguccuccacggaagcguauauccgcugucugcgcgcugguugccgcugcauugagcgugaguuuuccgucuuagccaagaugaugcaauaagcaaagcuacgauugcucagugcuugcuuguugcuuuuauuuuauuuuacguguguguguguguguguguguguguguguaugagacagagagggagagggagagggagagggaaagagagagagacuucaguuuuggugggagauggggagggagacaggcugagaaguccccaugcagagcaacucuaggcagggaacugaggugacuaaggauuuuuuccuaaaagauaacuguccccaagcaaaagugacaucugguugggcaauagauuggcuggugcaccuagaaagagucuuuauaaagugggaagcaggggaccagcagcaagguccacuuucugcuaagaggaacacagacacauacuaguuagcaugacacaccacacccaggagccacaugucuguaggugagggucugagagcaagcaugacagggacagucaggggcagucuguggcugagcagauggcaaagccuugcuuuugucugccuuuuuuccucaccucuuuggcucuuuguguguauguguguguguguguguguguguguguguguguguguguguguacaugcacacauaaguguguucacauguguguauauaaccauguguauaacccagagguugacagcaguuguuuuccucaaucacucuuuauuuuuaagaaagcguuucucagugaaccuguagcucuagccuagcuacagcuugucucauacaucccuugucuccacuugcccagugucuacaugggcucugagauuugaacucugguccucaugcuuacagaguaaauacuuuaucccuugaacuaucuccccagcucaucuuugguucuauccuucccagacucauucuaucaccaaagcucuuaugugucuggauuaguuagcauccuaucacuguaaaacaacugagguguugagcuuuuaauggcauauuguucuguaucuuggguugggagcauugcuuugggccuuugaugauaggucauggcaagaaaacguggcagaacaaacacuuugaccauaagguagaaacugggagaggacaaggaagaggcuggggucccacagucccuuucaaggacacagccucaaugacgcuacuccaggaaccacgcugggugacacuuuucuaagccauagccauguauguggcuaagaaaauggcccagaccaucgauggcaccuuaaguguuucaaaccugcucguucugugccagagauuaguagcaguugcccucaggcuuccuggguuuaugcuuuuuccuuuggaaaaagagcugugagaaaaugaagucagaagucaccagcuuugauauccaccaguuuguuaccaugcucccacagucuuauuccauuugcauaaugacugaaccuuuaaaaaaaucugucuguuucuaacuggcaaaagaggggagccuugaacagcggacacaagcaaaucaaacccauuuugaauauuuuauaaugaauggcucacuagaaggaguuucucaggaagugugucauguucugcaagucuguagauaggaccauggaugugugggugaaccugggucagccuugggaacagagcuguuauggguaccagagccuagccugauggccucagcccaacacgugucuuguauacugguucacucuugguggccgugguugaugguggcugaugcugagggccuguguuuuccccucaguggacugcugggacgggccugaugggaagcccauuaucuaccacggcuggacacggaccaccaagaucaaguuugaugauguuguucaggccauccgagaccacgccuuuguuaccuccaggucaguggcugauuuccuggaggugugggccuguaagggaaaagcugcuaggacuggacgcauggauggauggacaggcagacacagauacacacauacacacauugcccacuucucccaaagccugggggagcuuggacuccauuuggcuaguuacuaucaaguggccuuuguguccuuaagacaugauaauggcccuuaaauauuacguuuauuauuguaauuauguuuauguguuuguguguuugagugggugugugcccaugagugcaggugcuagcggaggccagaggcauuggcucuccagcugaguuacggguggcugcgagcugccugagcuuagugcugguaacuaaacugagguccucggagagagcaguaugauaagcucuuaaccgcuuagccgucucuugggacuagaacccaagaguucuagaugcuuuuguuccgguuuguccaguguaaccgcuacuuuauuggguucuucuuucuaccacccuucuccaccccaaacccuuucaaccccccaacaccagguaggagagaaaggaggugagagaggaaaagggauaucaauccuguuagacuauuuccugcugauuagcgguguugaguuccuugggggcaaguccagucuuugucugcaggauagccacuuucuuuuuccuaucucuuugcucacgaccauugacaaacugcagccacugcaaccagcuccagcuucagccucugcuucugucggggcucuggccuuuuuuaauguccuuucaagaguccccagaauuccaagcgugaaguaucaucagcuggcagaaucaugccccuggcauagcacgagacaaaucacagucagcugcuauggauaaccugaagcauccccuguaucccgcaccugggauugaagcaaaaacauagucuuaaguaacauuucuaugucuuuaaagacgccaaaguucucauaguccugcucugugaauggccagccuuugugguucuuugccaggauccucacaucuuagcagccauggugaucacuguauggaccuggaagggucguguguugaacgcuaggugccaggcacggucagcguucaguaaauaggaccggagguuucugaggugauuccugccugaguuccuuggaucaagugugggguggggcugagacagggaugcugcugcaagcaucuucucuccucagggagccuuuuagccagacuacagggcucauauacauccuuccccauguagccucagcccuuccuugggcauuccucucucuaucugccacugaagccccgagggacccuguguucccagagauggucaaugcccacucagacuuuguuagcuuccuaucaugaugaaaagaugcugcuauaucggauuuacagagagaagggggcucaacugggaucaugcuucagagaucccaauuacugaccuaccguccacccugccccagugccugagaaauggguguuuucugaccaguagaggcaaugaugaaagguuccuggaucuugucccccugcugacucuguccugugccaccugcagcuuccccgucaucuugucuaucgaggagcacugcaguguggagcagcaacgucacauggccaagguguucaaggaaguguuaggagacaugcuguugacgaagcccacagaggccagugcugaccagcugcccucgcccagucagcuucgugagaagaucauuaucaagguaggcguguggggcugcugucuaccugggacugccaucauugagggucuguaucagaggucuggugccagacuccaggucccaucuuccuuaccaucucucugaucuugguaagaucuugaucauuuaaccucugggugccucugugccccucugguaauggggaugauauagaaucuaguuacauagugaccuugguaggagcaguucugggugugugugugugugcagaaugguuggcucauacuaccaauucuaacuuaggaagacgaugaguuccagccagcuugggcuggagacucaguccuagugagacucugucuuaaaaaugaagcaaauggaagcugugugagcguugggguuccaguggcucaggccccauuccugcccuuggggucucucacacuaugugagauguggauagcugcuuaacaggguuugagugacagugggaugcuggggcugguguucuuguucuauggaggcgacacgugauaucggacuuuggggacaucaacauuuguauacuuguguuguuaggauaaaaagaccagaugaguagugaaauaaaguaugcacauguuuauauuucucauacaagguaggauguuuuaggagcauuaggcuuugguccccaaagugauuuggggacuaaggauccugacguccuacuguagcugcaugguggggauuuucagugggguuuccacagguccccaaaaagucagaguuagaauuuagcauggaggaagggaccugggagauuggauggggaauagcgcagcuuauuaaccuauaagcgacaguaacacuucuucucuuuugcucaguccccaccucccacaaaagcacaacuuccuggagaauaaggaaacagaagcagguuuccagcuggacagaaggcagggaugggauaaagauggagaggcaaggagggauaccuccgagggaggagaguucgccaagcacagagcugagauuauagggcaugacagacgaguuggcaaagguggagguggagagagcagugcaugccggguggcggaugguggcugaauucuuguugcuucaaagacucugaacuugggucuccagugaggagggcuaugugaacuuucuccccuucagcauaagaagcugggucccaagggugaugucgacgucaacguggaggacaagaaagaugagcacaagccccagggcgagcuguauaugugggacuccaucgaccaggugagucugggucccuccuccccucacagagccuugggugcugacucucagcuguccuaggcuuccacccuaaagucuggcacugucccugccuuugcccacuuggagccaugugacuugucuuuuuuuauggcauuagaauguuuucaaauaauuucauauuccauaucauaaguacuuauacacagaccaaugucauagacccuagauucauaacacucccaugaugcaccacagcugagggcuccuuacccccugcccugccuugaccuugcagaaaccucucccaaauaggaguaucuacuaugacugcaacuaccggagcacccacagggcugugacaccaucagcuccuuguggaucuucuuuccguaucgugcccuuuccucuuuguuagaugaacccuuuuggagggcucagucuguggcugcauggcucuguugcuucugcgucguuaguucacugugaggcagagcauccugacagggaacuguguaugugugaacaagccaagugccucacucaccucauggugaauggggaggcagagaagauaagagauaagagguuagcccuucagcugggcgugguggcgcacuccuuuagucccagcacuugggaggcagaggcaggcggauuucugaguucgaggacagccuggucuacaaagugaguuccaggacaaccagggcuacagagaaacccugucucgaaaaaccaaaaaaaaagagagguuagcccuucagaggcaaagccucaucuccuucagccaggccagcucccagcugucuguucacuuaugaacuuaucaauaaauggacuaaccccccucauggcgugggucauucccaaaacccuacugguugacaagcaacccuuuaauacauaguccauauaggaacaggcuuuggauuaagcuauagcauucacuaacauccuuuucccaucacauauauuagcagucaacuugcugcuauguauuagcaacauuuauuagcaggcaacuugcuguggccuuccaaccugggauuggguccacccuagguaauccucauuauuaucuccuucuccuucuucccaccaccaccaccaccaucaucaucaucuuuuucuuccuccuacucccccuccuucuccucuuccuuuucuuaauauuauuuauuauuugugguggaauaaagucuuucaagcuuuaaugcuucucccauaccuccugauacuccuauucauuugaguuauccaaaggccugucuguucuaguacccuauaaauaugaaauaaggagaauuuaaguaaaucucaacaaaaugucacgcauccacaguggaguccgauucagccucuaagaaugaaauuauaucauuuacauguggagccugggaugugaaaaagauaaacaagaauauuggugcuuuaucucauauguggacucucuauuuuuaagaaaauuuaaauaucugggggauggagagaugucugagaggcuaauugcguuugcugcucuuccaggguauuuugaguuuggugcccaggauccacaugggaggcucacaaccauaucuaguuccagccucaggggaucugaugaccucuuguggccuccauggacacugcacucaugugcacucacacacacacacacacacacacacacacacacacacaccccuuuucauucauacacacacacacacacacacacacacacacacaccccuuuucagucauacacacacacacacacacauacacacacacacacacacacacacgauuuguuacauauaaaugcaugcaguuauaagcauuuaaauuuguaugugugucauggauaugagugguauaaaaguuuauaucacuauuuguugggaaugggagaagcacagggagggaggaucaugaaagaggcaauagggggacggaucuagucacacaaugauauguauguaugaaaaauaucauaaucaacucuauuaaaaauuuuuuuuuuuuugagacagggucucacuauguaguacuggcuggcacugaacucacagaaauccaccugccucugccuuuggaguacugggauuaaaggugugcagcaccacaccuggcacaccuacaauauauauaauauauaauauauaauauauaauauauaauauauaauauauaauauauaauauauaauauauaguuauaacacuauuuaauaacuauaguuagaauauuuaacacuauauaguaacuuuuaaaaauuagugaaauaagaacaugcugcuaggucaauuggcugaaaggacccagaaaggcuuacaaagcaggugacaggcuggggacguagcucaguggcaaagcucuuaccuaacaugcauauggcccuggggucaguuuccaguacugaggaaaaugucagugaaugaggaaaaguuacuagugagguugcaugaucugaucugcugcugacugucaaugcagcaggaaaucuguauccgcucuuauccgcucccagaccacccacuuaaagaguccugaacaauaccaagaauccagaaguagcuguuuuaagagcagaucuuauaaaaaaaaaucauuauaaaugugaaaacuggcgccgggcugccccagugaaugcuggggugaugucccauagguccucagagucaauagggcugagaccuugggggagacuaaugccagccuggcucucuagaaauggacgcgccacuacugugccauugcugacgccaagcuguccuucggugaugacauugaacaggcuguggaggaggagccgguccagguggguggagaccugcuugccuucagccuucuggucuuguccuuggagaauccccaccuggagacuuacuguguggcuucucauaccugggcuggcuugagcauccuuagcucuagggcgauauugcuuuggguagcaaagcuuaacuagcucuuccugauuggcuagcuagccuagggcuuaaccaguaagauuugaggcucuuuccugcuuccaauagggucugacuggccuuuguccaaugccagcaauccccggaggguguaggugggaggugugauggaggcgccccaugcccugcgcugcauguucccucuagcugcugcccaucuuuggccuuuuucuugaguagaguccaggccuaguucaggcuucugguacugggacuccugaaccccugccuuaggacuccuggaaacagccaucaaugaguugucaggagagggcagagcgagcuguaauaagcccuuucggaugcuuguggcucaggacacuccccccacggagcugcauuuuggggagaaaugguuccacaagaagguggagaguaggaccagugcggagaagcugcugcaagaguacugugcugagaccggggccaaggacggcaccuuccuggugcgggagagcgagaccuuccccaaugacuacacacucuccuucugguaacgcccccuuccucggaggcuggugggugggaggugguguggucaggcuguguccugccuggcucugaugggacaucccugucucuauucccaacaggcggucuggccgggugcagcacugccggauccggucuacuauggagaauggggucaugaaguacuaccugaccgacaaccucacguucaacagcaucuacgcccucauccagcacuaccgugaggcacaccugcgcugcgcggaguucgagcugcggcucacagacccggugcccaaccccaacccacacgaguccaagccguagguuccuaggauugggugggugacccauggaggugugaccacuaugggguucucauuuccaggaccccguucucuuugacaauguggguucuuagaagucuaugauaacuauucccacuugucagacuuugucccauccucucucucucuucucucuugcuuguucuuuaauaauuuuauuugugcgcucaugcgugagcaagcaugugugguauguacacgcgcguacagggccaacugaagccagaagagggaguugcauccccuagggcuagaguuaaagacagaugugggcugucugccauggauccugggaacugguuaagagcacucacucuuuuuuuuuuucauuucagagauauuuaucuauuuaucuaucuaucuaucuaucuaucuaucuaucuaucuaucuaucuaucuaucuaucuaucuaucuauuguggcuggccuuguguagguacuaggccacauguccuggaaaauuaggucacauggcugcuuccaucuuggugaggucagcagcuaagauggcugccaucaccauggcagcuucuaucuuggugagauguuuucucgaaaauccugggcucauccucccaguccuguaugaacuuggguguccuggcuguaaucccaggacucaguagauagaaacagaaggaucauaccaucuggaccauugccacuccuguucaaaacgagacacuuguuaugguggcuccuggagcucccaugaccagcuucauucuuuuccuuccuccgaguuucugaaucuccacuggucugccaugugccuccggaauccucugcuucguccuccucacagccucacagcaucgcuuuccuguuugccaccauucacugugauuugggggugggggugacucuuuuuuuuuuuuuaagcuaaaaaaaauuaugaguaugagcgguuuugccugcaugcauauaugugcacgguguguauaugaugcccacagaggccagaagagggugucagauccucuggaaccggaauugcaggcacuuuggagccaccaugugggcccuuggaucauaagcgccauuagugcucuaaccacuaagcuaucucuccaguucucaauguuuuguuuucaacccaggguuucucuguguagcccuggcuaucuggaacucacucuguagaccaggcuggcuuuagauucugagauccaccugccucugccuccugaggggagugcugggauuaaaggugugugcagcccagcuuuuuuugcguccuuccuuccuuuccuuccagcuuccacuucucucuccccuccaugauuucuucccccuuucuucucuuucagugcccugaggucuggggcuuugaucucagagaccgguuuggguccgcagugucugugcuugucaaggcucccucuguggucaaaggaaucacaguauagggcucacgauagcaaucacggcaguacguaguacucacgcuaguccguaguacucagccaguacucacacuagcacucacgaucuuuacuuacgauuagcaaucacaaggacgaguuccuuucuccuuucccucuuuuauccgcgaaagagagaguuccaggccaucccuggcaaagaggucaacacauuccagaaauaccaagauaaucguuaagcagguggauuuaacauuuuugcuuuuggaggaagcugaauaauuuacagugacauuauuauuaguguuguuauuauaauaaugauuauuauuaacauuuccuguuuucauaccaguugccuuuccaaacuugucauuuuguaucuuuaguaaccaaaaucuuucugagccucacccguguucccugccccagauguuucccugcgacacugcuguagcucuccagccuuuggggcugggcaggugggcagagaagagacuccccugaguuucaccuugaccuccucauacuccuggggucuugauaaaaacauugcugccuuucuuccagacaggggggcuuauuccuauacccccagcuacuugggaggcugagcugcagguggaucggaaguucaaggccagccagggcuauaugggagggcacgugccuggagugcaugugaccuuagauuaacccuuagugcugcaguaaaauaaagcaaaaguucaauaggaaucacugucuuuggaggugugcaaggucagggaagucacagcaugguuucuguggcaguuucaucgucagccccaggugucccugucuguugguauugccuccugccggcucuccaucugggaggacccucaccagcuuguuuuccucuucuggaugcaggugguacuaugacagucugagcaggggggaagcggaggacaugcugaugcggaucccccgagauggagccuuccucauccggaagagggaggggaccaacuccuacgccaucaccuucagguaggcgugcgggcacuguuuguaccugagggugagugcuccccagaggagacauagaaaggacacgaaugcagccugaggaagggggaacucugguggaagcagagaugccucuccacgaccuugaccccauugucaauggcaaggacagcaauauacagaacugugugaguccacaguaauaggugcaagugcucucucucucuaauagucucuaugguccuucuguuuuaacuucaaguaaccccaggauuuaggagcuaugaccaccauuuuguuuucuuucuuucaaacaaaaauuguauuauuguuguaugugggcauacacguucuauagggucacuugagggucagaggacaguuuuguggaguugguucucaaucccacuucccacguguuccaggcauugaacucguggcccguugggcuugcacgccaguugcuuugccugcucagccaucucacugauaagccuaccaucuuucuuuucuaaggcaugaaaugaggcacagugaggcucaguggcuucuuauagcaugugggggugggggcugggcauagaacccaggucugggcuugcuccccuggcccccacucccuuugcugucucuuaggugugccagauuucaaccccagcaccacacuccuuccucucccacaaguauuuccccagccucacgucagguguugugccgauggcaguagccuguauuacugucucccacacuggcuugucuguggugggcugacccaguuauucgaagugaggagauaguaguucggagcgauuaagugaugggucaaguaccacacagccuuggaguuggcugagcuggauauccaggacacguacgcagccugugccagucuuuccuggaucugcuccaagaagaggcuggggcccaguugagaccugugguggcccuugccucagccugccugauucgaaagaccgagucacuucacucugaaguucauauuuggcagaggggccgucacaguucuggguccauguuucuguagcuuccagaugugcgcagcugccgugggguaucuagugugcugcugcugccccuuuguuuugcaauugguuaccuugucacccugcgccccugucaucgggccuuuucuucccuuccuaccugcacugaggcuucuacucagauaccuccuggaggucauuguuauuggcuugcugaagaccuaccagcuacugugccagcuccagucagagaguccuguguccauguggcaccacugggaacaggggaacagcuggcaggcccugggccucuuuggcaccuguguuguuuauucucucuucuuuagaacacucuaagugguggugcccgcuuagccuugaaggaaguugguauguuuauucaugggcgugcuguggacgccaggcccugcgcaggggcagggaucucacuguuguaguccugucagucaggaugcuuuugucugucagugacugguugcaucuggcugaagcacugaggguugaagguguggccacaagaugaggaguucaggaccgagucuggcucuguguuaucuauucagccaucuacccaagggaugccagaggcacgcucagcccucucagcuagccucgcccugggcucccaggacaggggcuuuuaucucacaucuaucugucugucugucuguuuaucuacuaucuauaucuaucuaucaucuaucugccuaucaucuguguaucuaucuaucuaucuaucuaucuaucuaucuaucuaucuaucaucuaucaaucauguauuugccuauaaucuauuuauccaucaucuaucuaucuauguauccauuuauccauccauccauccauuauuuuuugagauagucucuccuuauguaucccuggcuggccuggaacucacagagaucugccugcucugucugccuccggaugugggggucaaaggccugcgcccccacaccuuuuugauaccagcucuucugaccuaugagagggcuggcuugugguggcuuugguuuucauuuuuagugagguuuaacaguuuccacucgcugguuggccauugaugucuauuuagagacguugcccauuuucugucagauuuuuguuguugcugucacuauuccgucacuugcguuccauaaaucuuugaaccugaacagaucgugaucagaugauccguuugcaaauguucccuucaguucuguucucuucuugaaguccgugacaucuuuggcuauauagaagcucuuugguuuaauguaaucauacuugucuauguuuacuuuugcacucauggggcucucuggcugcuuuuaaagguuugcaccccaaaaacucagcuauuagcuauugcacaauaauuccaaguuggggagugccacguguuugacuuugcuuuuuuuuuuuuuuuuuuuuugcuuaaauuugcuuuggcuguucagggcuaacgucacagaaauaaaaucaaucagcacaugauauuuguccaaauuuguagugugagguuuuggcucauguauguaugcauagguagugacuacagacuuuugucauuucuuucuggugaauacacagggaagacacuugcuuucuaaauuaauuacuuaguuaauuaauuaauuuguguauuuugcuugcauguaugucuguauaucacgagugccuggugccuguaaaggccagaggagggcgucagagccccuggaacgggaguuacagacaguuaugagcugccauguaggugcuggaauugaacccagguccucuguaagagcagaaagugcucuuaacaacagagucaccuccccagcccagauacucuugucucuaaaguuaggaucagacccgauuuuucuuauuuuucuaaaucaauaaggcugaaggaucaguugucuguucuguuuggaaucuuuucugccucuuguuucaaacagaugaaaaaggaaaaaagaccaaaacaacuuaucauccuuuuugaaacaaaacaaaacaaaacaaaacaaacaccaaccauuguaacucugggccacuggaggcaagauucaagaaccugaggacugauuggaguuuuaugcaaggacuggaaagcccuuuguggaagggcccacggagcaaacacuuucggcuucacaggcugaauagucccuguugcagcuauguaaccccaccauccaugagagaaaaugaccacagcauagacacaaaugaacaguggucauauuucaauaaaacuuuauuuaaaaaaaccaaacaaacaaaccagggagcagguuuagcuugugggucauacauaguauggcaccucagucagguugaaagaagagcuggguguugagcaucacauauggguucuuucagaucugaacugaaaagaccccagugucucguguuccauaggaggacugaauucucuucauuucgguccccuaaggacggguaacaaggcuguggcugauugcuguagcugcuagcauccuugguuuguuaauccccugugguccucucccuuaagggccaggggcaaggugaaacauugucgcaucaaccgggacggacgccacuucgugcugggcaccucugccuacuuugagagccugguggagcuugucagcuacuacgagaagcacgcgcucuaucgcaagaugaggcuucgauaccccgugaccccggagcuccuggagcgauauaauaugguagguugacgcccuugggcuuguuagucauaucacggucuacauuuuagagauacaaugugcauacauuuacauauauuacuguaugucugcgauaggagguccugaggaugcagacuuggccaccguuuacaaagacucuguccccaugcgacugauaguggagguugggagaggcaggcgaugcauuagaaauaaacacagacagagucagaugguaauauauguaaagagagagggcugggacggcguagcaggguaugaagagauggggcaguggcuugcaguuuucaaagguucuggggcgaucuuccugaggagugagccaugcagauaucuggaggagaaagaacagcagaagcaaaagccuugggguggucaacaggcaugaaaugagcccagcgagagcaacgcugaaugaugaaugaggcuggggcugagauuccagaagguucauguagggccuggugggccaugggaaggcacuggcucuuuaucucguacacugcaggguccugagugcacagaaggccggauauggucaugauaucucacuuccugucagaaggauccuugauuuccugagaggagacagauucugagggcugguuaguguugcuugucaacuugacacagccuagaaucagcaggaagaagucuuagcgagaaacuuccuagcucagguuggcccaugggcaugucuaugggaagcucucuggauuguucauugauguaggaaggcccagcccaccgugggcagcuccauucccuaagcagugagcccagaacaguaucagaaaggagaaagcuggcugagaucaagucagugaggcuacagguguuuauuuucucugugcucuugacugucccugccuugacuuccucaugacgauggacuaccauccuuuuuucucuuaaguugucuuuggucaggauauuuuaucacagccacagaaaugagacuaggaccuaggacccaggacccaauauuccaaccaugugccagggagugugucuaaauucuuccuugagaaaauuuggguccuagaggagaaagcacagugugccagagugagguguuugggucagcacuggcuccuuuggagcacacugaccuucauagcaagaggagaagacacuacaguggacaggggaguggccaagagaggcgcuuuaacaggacaaaagugugagccaaaaccuaggagacagaagugaacgaauaaugucugaggagaugaggaaagacugacagcagugacucgggguagagggacaggaaggcuggggagggucaggguaggccaggggccuuggcaguugcugcauaugccugccaguuucccugguaugauucucuugagcugcagauaugcuaucuuugaacaggguaucaagaagagauccuggcauccucuggguagggauaggguaucuaugauuuccagguugcuuccaaauuugggggaacuuuuugaaucuucuugcuagcucucccuccgagccacacaagaaucccgugagguuccaacucuucuuuuuuuuuuuuuaaagauuuauuuauuuauuuauuuauuuauuuauuauuuguuauuauauguaugugaguacccuguagcugucuucagacaaaccagaagagggcaucggaucccauuccagaugguugugagcuaccauaugguugcugggaauugaacucaggaccucugguagagcagucagcgcucuuaaccacuaagccaucucuccagccgccuccaacucuucuuuccaaagaacaagauaccccgagaaagccugcagccuggcuguugccacaggccauucuaggagccuggggugccguacuuacuuccuguuugguuggugcugggaaucgaaccgggggccuugcccauggcaggcaaacacuucuuucccugagccacacuccucaagcccuuuccguuuacucuuuguccuuccucuuuuuucaggaaagagacaucaacucucuuuaugacgucagcaggauguauguggacccaagugagaucaacccuuccaugguacggcaccaguccuacccaguagagugagagggagacccugccccgccacuggucuccaccacaguuauaguggggaguauucugggacaccugaccacagcuaacauuucauggugaaggguaggacauaccaugugguuucacggagguuaaucgaauuccauccagauggaacugagucucgcuagagucccgaguuucggugaaccaccuuugggccacacagauucuaauuaaaaaaaucuuccaaaaacuccuuuccugcuugccgacggagcccgaggcguuuaugaauuaugucugguucgaugcccuccucgcgaggccagcgcuaucucggauucccacccugccgcugccucguaacuuuguguaggaaaagguggauuuugcuuuuugccuccagcugcuccaucuccaucucagacuuagugggggaagagcuacagcggauuuucugccugguacacgugacuagggugcggccacucucuggugggcucugcugagaucccggccucaauuccuuuccuuuuuuuuuuuuuuuaaaaacacauuuccaaucuuugguggaugcaacuucaaagcaggccaugaaggcuucagagugaggaggugaggagagaguggcuaacuuguaugggcagcguuucagagggaaggcugugcugugacgaggcccagcccggaugguuagguuugggacauuuucccagcagcccccggaagaauauugagcugaccuccauccuccucccagaguuacggacucaguuugcucugaagggccugcgucucuucuccuuuuaaacacaguuccaugaguuaggucuacuggcucacaagagcgucaggcagaugacacgggaggguggagcuguaaguaugacaucacagccccaccucccaguaccggagauggaacccaggaccucucauaugccagggugagguguaugcauagcugaggugcauuuccagugcccccccccaauccccaucuugacuuuuucagggugaccuagguaaguucacaggacuggaaggauagcauuugggguaacaugucaaguguguugaagacaagaguccaguaugacucuaagcacuuagccuugguuagauccuaauuccucaugccagcuacacaaagcagguaccaucgugugguacccauuuuacuggugaggaaacugagguuauucaggugacuccaagcagcuggguuggaagccuguccucuuggccguguggauacgcccaguuccuacaaggccacacagagauuggcucguuucucacuaguccccuugggccuuuuuugcugucccagaaaagcagucucuuccaaauacuauucaguagaaccucuuuaugccaugccugugccucucucucaccacgagcccggcucuggcucucacauuuagaaugccggggaauaauccugccagucucugguugggguucuacauggcagaagcuucuagaagcugcauuagucuuuauagauucugguggaggauggcaguaucucgcagucacugacccaguucugggcucagcuacuucucaugugguuggcucuggaccagguucuucaugucucugugcucagcuuucccaucuguaaaaugggcaugauggcaccaccuccccguuagagugguugugacaguuaagggagucacuguagguuagaacaguaaguucagggcagcucuccauguuggcagaugucuaagaaaugcagggcacaggcauuuuuuacugucacacgaauuauuucacugauuuuucucaggagaugcauaaaacuuuaauuaccauuucagcuggggaaauggaggcuuagcgggcuccugcuuacacagauaggagugggcagagccgcgguuacaacuucugggacggacuuaguaucuagucucccagaagugaucuuucccgaguccuuucuccuuugucagggaagagaggaaagccaaagaccuaagcaggcuugaucauuuuagagauuucucuauuaguauuucuuugcuguguguggguuuauuuuuuucuuucuuuguguguuuacuauuauugaguagcaggcuucaagaaaauucuuugaaaauuucgccuccauaaauuccaucuuuucuugcucauacagagcccagcuuuuguuguuauuguuguuugauuuagggaggggugugagacauugagacagucucacuguguagcucaggcaggcuuugaacuuuuguuccuccggccuuagcagcaccccaaccaagcucuggaguuauggguaggcaccacuacauccaggucccuagcaugacuagacgauagugucugaacuucugggagaaccauuaagaacugcagcucugagguggcgaguauggauuaaucuaagagauugugucgagaguuuagucuuucuccugguugagcuagucuuuaacccacuuccugguggacugcauguguuugguucccaugcaauaccaacucucaccagcagauggcguaguaacuccggccucugccgucucuggcuuccuaaaggguccugcuucccucugcugccucugucauccaacugccccucuuuucuuccuguuccccccccccaagccucagaggaccgugaaagcgcucuaugacuacaaagccaagcgcagcgacgagcugaccuucugccgcggugcccucauccacaaugucuccaaggagcccgggggaugguaagccugaccggggaugggccucuugggggugaacuugacuggucuccuauuguggugacucuaaggggcuggguggcgcucugagcccucuugucucacauuccagacuggaugggugcugauucaccacggaggucuucccaagguugcaucguuacugugcgggcucuagcaaugacacaagcuuguuugugguuaaaaauuaaaaacaaacaaacuaaaaaaaaauauacacgugugccuauuugucugaauaugcacacacauauaugcagguaccuaaagagucccgacaagggcaucagaacccugggaacgcaguuacagaugguugugagccaccauguggaugcugggaacugaaccuggguccucugaaacagaagcaaagagcuuuaaaccacugagccgucucuccagccucucaaguucauuuaaaaaaaucaggagacccccuugauuccaaacugguuuucaccuaaccccucggcaucaaagccauacgacagcaggugaggaacggccccccucagucuuucugacgacgccucuguccucacagaggccgccugcccucacugauuggugcccuuugaccuucucucccagggcaggcgcuugacauuaccgaggccucucccacucugggcgucucagcugcaggcgcucccucacugucauuuugccccuugaucuagggaauucccaggcacaguuggugcccaggggaagagaguauguguagaaacccccgugagaacucccaagucacacuguuuguuuguuuguuuuuugcccggggaagacucugacaugucucaugccuccccgugguucuaaugugaacuuuccuaaaauucuaacucuuguuugagaugaacugagagacaaggguacagucaucuggcaaggggcuguggguaaacggcagcugccacccaucucucucucucucugauggcaagcccgucagucaccugcuuguaucagauccugcucccaaacuacucagggacaaccaaugguuuuugucccgguagaaacacuuuugagagugaaagcaagguggacauuagugauuacaugucaguaacaauuaucaaguucuugguccugaaauacagguggcgcccaugcuuaugaugauucauagaaaggaagguggugaggagggugcagaaagggcuggcacuuggcagccgcuaugugcacaguaucacauauccuuacucugcuuguucaggccaaagaagcaaauuaggugcuuccugcuacugccggguacggauuugguuauguugagaaagaucucaggccguguggaaggcaggcgugugguucuaaguuagggguaaggugucuguuuaaacaguggugggcacaggggccagagaggcacagaggagcagcugccagggcucucuggaggagaagguaccgagucaggucuuagguaguuaggaggcuuaguuagcagguuaguagccugcuugucgggcccagcagcuaggcagugcagcaggggcaguucugggucguggagcuucccugggcugagacccaguugggcuaugacaggcuccugaggcuggaucuugugggaucuggaaugcugcgacaugguguggcuggagguacuuuugaaauaagccuucuggucacagaaaguggaccagugaguggccuugaaaguaugagacccugcaaucaggaauagacuggagguguguaaguguccagcguggccacagcacauccacaauggguuaugucgaauguggcuggugcuguaaugaggggcuaggccagugcucuauggcugagcauucccucacccccacucagccucucauuggcagagucugggcaagugccuacacugagcugcauacugagccaaggauggacauugucauaccugggauggaugccggaugccacuugaagcacuugguaaacccagacuguucuaauaaaacccaaggcagcuccagcauugccccaauuuacagauggggagccuaugguacagagcaccaguguagucacugaaggagauggaauuucuuuuagaaaaguauuugguuuuauuacuuuaaaauuacgagucaacauaggccugugugugugugugugugugugugugugugugugccugccuuagaguguagugcccacagaggccagaagagggcagaagauccccuggagcuggaguuagagcuacuugguauggaugcugaaccaucucuucagcucuaaggagcuaagauuucacugcaggccauuuggccccacacacucuugugucuggauucacagccuucccacaaauggcgugggcgcucucugagaggccguuggucccucuuaaagcccuggaagcuuugacaucucuuaguguugccaacaccagaauuuagucaugaggaacgaguucuuagucaucugacaauaaguauuuuuaaaaggcguaugcuccccuugaaaugcugucaucauagaucaugacagccccucgggucaccugagcacucagagcugagcaggcuaagcccuccauggcugugguucuccacagguggaaaggggacuacgggacccggauccagcaguacuucccguccaacuaugucgaggauaucucggcaggcgaugcugaggagauggaaaagcaggugggucuccguagucuguggugaaggcuuugggggagucccuugagcuaucuuggggugggggugggggugggggaugacuuuaacauauacuuggugggggggggaaggucucugcagagcugggcaguggagcgggcagggugaugcagaaauugggaccagcccugagcugcugcggguaaaagccuccgugacgagccgguuguguuuuaaucaggcagcgcggggcuaagauuuugaaagcucaggagaauucccacuggagugagaguggccagacggggaauuuguccucugcucaaagcaaugugcaaaugaaacacauucgguuuagagaggcagacaugcagaacgugcuuagcaugaggaaggggcagugcuuugcuggaaggugagacagggccuucuggugacuuugccugugagccaggcuuugguccccagccaccuuguauuagagugcucuugguggaagaaaggggccacuugggcucaucagcuugccccagggaagaaucuguagugugggcgcgcaucccuuuaggguccgcagcguuuauucccuaaggguggcaacacaauuggggaagggcuuucuggaggaagcaguguuugagucuuaaaagugaagcuggguuaauuaccaagagaugggcacaggaaggcacagccuaagucagggugcggugaguggaagacaguuguccccagguggcugggacagggacaggacuccucacugcaucugugugucaccggaagccuggcagagaaggcuggggcaguauagcaauaauaucagcuuugccuucucaguugguucucaggacggacgguucgagugugcagcacagaggggauaaaggccggcgagguuggccagggcuuggaaagccacagaagccagauggcagaucccagcuguagcuuuccgugggacguggggggagccgcagaaguucuccugagcugcaggagucgaaggccaaguggccucguuucauaugcacagcagauggggcuugagauugguuuuaggacucacaaggugugucucuguggacuggaaaaacgcaacacagauacuguagguaucugugcacugcugggucuccgucaucgcccuccccauggacucuguaaugaaaacgcauuuuaagccacgccacagguaguggcggcguggcgcuaaacggcaugucuagaaacugguugucguuuuauuauuuugcuuaugacuacugagaaucgggucucauuucuucacagauuauugaagacaauccccucgggucucucugcaaaggcauauuggaucuuaauaccuacaacguugguaugugcacuuguuuucuuagcuugauuccaggccagauccaccccgcccuaccaaggcuggcuuaaggacuagccucagcagggaggcgggcuggcgcaugucuugugccuaccagaccuggaugagguggggcugaagcaugcauggggacugauaggucccugaugguggggccugcugccaccaucugcuaacacaggacugcccucuaagaaguacuggugacuuggcuguugucauggugucaacaucugcccaugugucugcuuuacagagagcugagcugcugauuggucaggguuggguacgucagccgcuaaagcucccgaggcucuugccuggcucuucucacuagaucuuagcucccgcaagaaaccuguccugcccugguuagcaugugugguaacagggacguggcggggcauucuguguauagaugagccgugauuugcacgcagcucuguguucagggccugcccacacugaugugggugcacgguagcuuccagggauguagcuuccuauuuguagcugcagguccaagcacagagcccaagcucccuccacgguggcccacugauucuugagcugaguccccucuuucccggggagguccgagcaugguccccuuggguuccuaugacaacaaucccaggaccgauacuccugcccuuuuauacaaccauuacuuucuuuccauccuuauucucuucucccuuuucccuuccugugacucugguagggaagguggagggguuuugcuccagaugagaaaauggguaagucucuggcaacuccccgaugugccaggacugucagacucaauucucaccuuuguagcugaugcccuggcuugcccccucccuguauuguccuguuagaggacauggggaugucgcucacucagcaguagggacuugucaucaggguggagcuguccuucagcucugcccgugugacuucgcacauguugcugucaccuugagccucucggucuugucuccuauaggaugagugucacaguguccccgugagguuugcuaaaagcuaaaaccacacguguagucgucugcuggggacgucaccucagagcucagaaagugcagacaccaguacggggcagaucaggguaaccuucauguuccuaucuauaguuaucuuuuuuccuugucaucugucagucagccuuagugugccacagcguuccugacuuuccuucauccucauaggguugcuuucugggucuggguucccacaccccauugucuuucucuucuagggauguuguuccuuggauuuaagguugaucuuaugucuggcacaucuuuuuuuuuuuuuuuuuuaagauuuauuuauuuauuauauguacacuguagcugucuucagacacaccagaagaggucaucgaaucccauuacaggugguugugagccaccaugugguugcugggauuugaacucaggaccuuuagaagagcagucagugcucuuaaccacugagccaucucuccagcccaggucuggcacaacuugagauaguugguacaucuacaaaaauuccauuucuaaauaauguuacacucgcagggacaggagcuugauaauucuuuuuggaggauaauacucagcccgguacacaccuuuaccaguaacuuguacaaaagguucaagacacugccugcaagaaggugggaguccccaucagcaugugacuauagcuguggcaguugaggugggggcacuaguaugaggugcggucuugguggucaccuccugggcccaucaggacuuuccuuacccucugucuacagugaaggccccccaggggaaaaaccagaaagccuucgucuuuauccuggagccuaagaaacagggagauccucccguggaguucgcgaccgaccguguggaggagcuguuugagugguuucagagcauacgggagaucacuuggaagauggacaccaaggugggucuaagcacacuggggagcgagguaccuacccaucccagcccauucugcccuggugaggccagggauggguucagaggccauugcuguguuucaaagggacccugaauucuaaacuccggggcuggguacaggcaucagcuguaaucugguggccaguggugccagaguucuaacguggggcaggaaggguaagagaggggacuucaguguggggagcggguguggcggcagucccaaaggcgccagggacugcagcuaagucauaugacuugcaccugacuuccucauauaaaccacaaacaucuugagugcugcgcagguguaccaggauacaggugaauccaauuugguggagauuugccccugcugcccugauuagcugaagcugcaugccuggugagguggcguggccugcugugcguggaugggaacugagaguauaaaagagugagaggcccaggguucgagggagauauaaacaagggagauauagagaaaaaaagaaacaggacugaauaaaggugugcagaaggauccuguagcagcgucguucuuccuggccaguugagcgcgcgcaacacuucaggccaggccaccagcuaacaaaucuggucuugacauugucuggcuacauggcucagagcuggaggcaauucugucucuugggauguauggaccaaucuagacaacaucucuaaagagcucagcguaggaugcuggaagccagugagcuccuagaugcugacgcucuuguaaaagcauucugucagccauugccccggccaacgaaaggcugaagagucuggagcagugcgagaggguagcucugugugcgagaaugagaaguuaacccuuacccgauagcacuguacagugcguguguggagcggaguccucccuccccagguccauguguguggccugagccaugcuaaggagacagcugucuguacugggcugugcugggggagcuaggagaagggggaggcugcauagguuucaaagguagagagaaaagagaugauguuucuugggguccacagagguuuagaguacugaguccuguggaccaccccaaccaguguggcuuuagggagggggucagacaggaggcaggggcauaaugggaugacagaagcucccucuucugcuaucagggucuccaccuacuucagauugaccuugaaccuucaaauucuccugccucagccagccaagcacugggauuaaagucauguucuucugcuuguggcucuccauuuaccauuuauuaucucugugugugugugugugugugugugugugugugugugcacaugcgugugugcaugcauggaggccagaggaggguguuagauaccaucuuuuaucucucuuccccuuauuccuuugaggcagggugucucccucaaccuagaccuuaguuuguggggucacgcuggcaacagaaagccgcagccaccccccugccucuuccccacugcuguguuggaguggcagguaugaaagaccacaccuggcuuuaucaugugggugcugggagcugaacucagguucucuuggugagccgugcuaaccacugggacguccccccaguucacgcccgugugacuuuagagagcagcagcggcagagccauccuagacuccgagccccgggugggaacagcaugguggagaaucuaaagaggguagaagagaggggagauugucuucaggacagaaaaacacccaacccugggugcugggggaucuggguggaaagcuggccaggugaguggagugugccaugguguagaugcuggcucgguacuguaguguguucagggagagcuggccaggugagccagagugugccaaggugcagacgcuggcucagugcuguaucggguucaucucuacaggagaacaacaugaaguacugggagaggaaccaguccaucgccauugagcucucggacuugguuguauacugcaagccaacuagcaaaaccaaggaccauuugggugagucuccuggggaagacccuucccagcgaacucugcuguuugccggugaggcggguacucucaggauacuacauagaacaugcacuuugcuuccuaacggauccaggcagcagcccuguccauguucccauagccaagauguguuggugguucuaaauaagacgugaaauucuguuaugccuagaaagaaaggcuguggggagaaucgggucccuuuggacugcacaagacccucuuuguaaugcuggacacugccaagggcaagagguaccaauuaagguguguaaggugugacugucaugccccuuagguaucuuuguguaugugugugguaguuacuccccgcacagucaggccaauaggccaaccugauccagacaguuccucacugagacucucuggcugcgugacuuuaggucaugucaaguuggcgagaaacacccaucauggugaguguuggugcaucuuggcugugguuccucagcuguccaucguguuugagagaggcucugucacugggcuuggauucagcaagcaggcuaggcuggcugaccagcgagcucuggggauccuccugcaagccugcauacugagauuacacaguaccauaccuggcucucuucucuucucuucucuucucuucucuucucuucucuucucuucucuucucuucucuucucuucuccuuuccuauccuuucuuuucuuuuuuucuuucuuucgucuuucuuucuuucuuucuuucuuuuuuauaacuuguggacucgaacucagguuuacauaguuggcacuuuacagaguuggccaccacccuaucccuucagugucuuuucuuuuuaaagauuuauucauuauuauacauaaguacauuguagcugacuucugacacaccagaagagggcaucagaucucauuacagaugguuaugagccaccaugugguugcugggauuugaacucaggaccuuuggaagagcagucaguguucuuaccugcugagccaucuugccaacccucauggccuuuucaagagaguucuggucucuuuuugucaccugggccuucugccaucacauccagaaguaugguugacugucuccucugucuuagucagugcucuauugcuuugaagagacauaaccaugcaacucuuacagaguaaaacaucuaauuggagacuugcuuacagguucagcgguuuaguccauuguaaucagggugggaagcaugcaggcagacuugguguuaaagaggugccugagaggucuacaucugcauccucagguagcaggaggacagagagagcuauggggucacgcuugggcccuugaaaccucaaagcucaucccugugacauacuuccuccaacaaggucacaccuacuccaaugaggccacaucucugaauagugccccucccuggugaccaaguauuuaaaucuuugagccuauaggagcuguucuuauucaaaggaucauauccucucugcagaaaaucccgacuuccgagaaauccgcucuuuuguggagacgaaggcagacagcauugucaggcaaaaaccugucgaucuauugcgauacaaucagaagggccugacccgagucuaccccaagggacagagaguugacucuucgaacuaugaccccuuccgucuguggcugugcggcucccagaugguggcacucaauuuccagacuccagguaagggaugaaggcagccagucuguccaggcuaggugguggcccugucauggccagcaaugucacuugggcagcuagugggaugugauuguuucugaacaagugacugggcuggcccgucaagguugaacuuggaugcugguuaguacaaggcccuagggacugacaaaggggacaguggacauauggcugaagcaggcucggugaccacgagugacagagagguauuaugaccauucugguuuaggaagggaauguaauaacuuauugaacuaguaaguguuguuuuuaaaacaacaucccaaacaucugauuuaccaaaugaagacucaggagcaagaugcuggggugaaagcaucuugcuagcucagagaggcagagagagcacccagcugacugaugccccagaaggaaaaggcuccuucuccauguugucuuaaacacccuucaacucacagacccucuucuccuucuccuggcuucucuuauguucacucccugucaacugguugcuugcuuugccucuugaccuaugguugauuuaauuuaauccucuuuacacaaagcucuugggucaaaggugugcgcuagggcugagccacaccacaacaagaaaagguuuuuccaguugacaaucucggggcuuacagugugaucaaauauccugcaacagguagguaagucucagagggacugauggauccaggugugacuggauccaagcucucaguggcugccuuaccucuuugugcgcuuucucuccaagggcuucaugccuacccucucuagacucuuauauaguugggaaaacccacgcacacaaauuuuagacguugcauccugugaauucguuuguucguuucucuuauuuauuuaacaacuacacccaccucagcucuaggaaucuguaggucaggucccaucccugucuaccgcagaugccacugccuccuggacccguggcucuuguucccaagagugggugcacaguguggggcagacauuucuuacugcugaggaauccucccccuagccaacccccggaccacugggcaccuguguccugaggcacuugcccaguuccuccucuagagcaugggcacacuccuucagcauaggucacuacuguaguuucacgaagcucaccugcucuuggcuccucagggagaaaacugacuuguccuuacaauuucugcucaaggcucugcucuuugaguaacauuaacucuuuccccucucaccaagucaagggauguuugccauuuguuucccugcaaagcgguggguccucuugguaucccaccaagcuggcuuuuuauugauagugcuaacuaucuaccuguugugugaacugagauuaugugugggugugcuugccaugguccacacgugauggucagaggacagggcaugcgugccaugaaacaugcguggaggucagaggaauagggcauacauagauugcacacguguguggagguuggaggacagggugcuuaugccaugguccacacuugaaggccagaggaacagggugucuaugucauggaacacacguggaggucugaggacagcugguagagucuuuccuucuaucuuuaugugauucuggaggccacacucaggucgguggcuuuaucuacuugccgagucaccugucccuugaacccugugauuuacccugugguguaagcaagcguucuaccccuggccugcacccaguuucaguagauucuaauuccuuaaggcuuacaccucuccagacucccuguaagaugguuuccuggugcgggauucuuuccuaacgcuccccauguuucccuggagucagaugucuuuucugaaccgcuucccccccccccccccagucagugcaggaaggucacguggccugugcccaugugcgcccggagcugguguucccuggcugcccccacagcgcccuucggcucucuuuucagacaaauacaugcagaugaaccacgcgcuguuuucgcucaaugggcgaacaggcuacguccugcagccugagagcaugcgcucugagaaguaugauccgaugccccuggagucccagaggaagauccugaugacacucacugucaagguagagggggcucccuggggggcgcucuuguccuguuaauccagcaccaucucaacugcaaccucaugugguucaccuggggucauucugggcugaaaacccuuccugucacuugcccuagucugggugugacguaugcucuugggguucaugugaggucaaccucuagccgagaggagaguucauuucuccuuugucuuagagaggucacagcuuacucuuucucucugucugucucucccuuuguuucucccucucugucucuuguuucucucucucucucucucucucucucucucucucucucucucucccuuccuuccuuuuuuccuucuuguuuuuuuuuuuuuuuuuuuuugagacaggguuucucuguauagcccuggccauuguggaacuugcuauguagaugaggcuggccucaaacucagagaucugccuaccucugccuccugagugcugggacuaagggugugcgccacuacugucuagcaugaguuuucuuaaauucaucccguccuuggcauuuuaggcagauaugagagaaaguguuccuaagauccaggaaguuaaaaugaaaugagcugggagguagcuuagcuuuuggaguguuuauccagugugcaugaagccaccgggagcaccauggagacaagaggcaggaggauugucaucaggguaaggccagcuuuguuuacauagcaaguuugaagucagcuuaggauaaaugagaccucauuuuagaaaaguaagacaaaguauuugaagguguuuaguaaauaagggucaguuauaaacagaccacccuaccgucuucugucugggaaauccaguaugaaggucccaugaaccuguacucaggugagacucuacuggugagucacauggcccgggaacccacuaugucuuuuuaucaucaaagagugauggugggcugggucagcauccaugccucugagagcaguggugacuucuccacugaauaaggguagcuuugaacuuguacagucagacuuuagggucccgaaaaaaauccacaaagcacuacucugugguccaaauuccacccucccagcgcagacccgggagacuuccaacccuugccuucugugucccagguucuuggugcacgccaccucccuaaacuagggcggaguauugccuguccuuuuguggagguggaaaucugcggggcugaguaugacagcaacaaauucaagacgacgguugugaguaaguagcgggugaucccuguuuguguggguguguccaggcagugcagaggcuggaggugucuuccucagucguucccacuuuagguuuugagacuagugucuucucucugugaaccugaaccuucuccguucagguacucgggcuggccaggggggcugcagugaucugccaguguuucccacugccuuacauauaugugcuugguuuuacauggaugcuggggucuacccuuggguuguccuguuuccuacagcgggcacuugacuuaagcaccucugcagcccuguuagucuuucuuuuuuuaaaggugaagggagcagaccgauacguggguuauggcuccuuggugauuuuuauaauguacuuuugcugugguguguuuuccuuuccgagcuccagccugugguuggggaaacagagccaccugcccagggaacaacuuaggugcagaccaagucagcuggccuucucuauaggguggcagguuugcugugugucuugccuuacaagggugguucuccacgagaacucccaacaggcuucagagacacccccccccccaucccacuuuccuucucaggccaagggguccaucagcucacacguguucugcucaccucuuuucuugguccucucccccuugaguuccacucuacaguucucugcuucccuucaccuaucccaggaggagagaugggugaggucuccuguuggcucugguccuggaaggcuggccugcagcaggauugccugcugcaaaagaaauaaccaaagcuuauuauuauuauuauucagggauucuuagaccugggcauagaugcagaugcguaugcaaguuuguggagagguucaagcugaggcugaagagacuggcuuaugaggaggcagggcacaaguugcaguaagcacaagcuuuggucucuuucuagaugacaauggccucagcccugucugggcuccaacucaggagaaggugacauuugagaucuaugauccaaaccuugccuuccuacgcuuuguggucuacgaagaagacauguucagugaucccaacuuccuggcucaugccacguaccccauuaaaggcaucaaauccgguaaggagcguuggcaaggauguucaguuugggggagcccaguucuuuggucugugcugcuggcuguaaaaggaacacaccaacaucuuuccugguuuagaguaagucacaacaaagccauucagaaggguacuaagcacaggggcgggagggggggguggagaaaggccgaauccuuucaacuuuggccucuuugaggaaaccaucaauguuagacuaucuucaaccuggcgcuguuugcuuucauuuugagaugccucgggcauuuuaucuucauuaguagauggagaaauauguucuaauaugagcaagccaugcaugcccuuggccugugucaucaggacgaggcccuaagcauccaugggguccaaguuuccuaagcaucccaaacuuacugucucgcacuagacuuggaggcugacuugcuugcuagguuuauuuuuaugcugaacacaauacaacccccucugccauuaagccaaagugggucacguaugaacccguuaauuugggcaucucucagcacccccccccccaucacagaagcuucuugucacaggagaugauaauaaauacagagagaagaagaccauggagaucuuagaucuagauauaucaccucccuccccaaaaguucagggagcauugaggaagacagaacagaaaggucaccagagcuacagagguacacacagcauaagaccaguacaagaacaagccaguccaaaccacagcccagauaaggggagggcucaugaagccucacuccacgaugaggagcuguuagcaaccgauggcuauugggagaaggagcaccccaucuucuucaggaauuuagccccugggaggauacccagcuccaggagauggccccacauuuacaccuguccuugggaggggaaaacagugaugaagaacuaggggauagauuugaccaaagcacacuauaugcagauaugaaauucccaaacaaacaaacaaacccaugaaacaacaaaacccacucuauugaauuuuuccagggcagcuaagacagugucuugugagaccugggguuucucugaagguggcugucuuagugaggguuuuacugcugugagcagacaccaugaccgaggcaacucuuauaaggacaacauuuaauuguggcuggcuuauggguucagagguucagcccauuaucaucaaggugggagcauggcagcauccaggcaggcauggugcaggaggagcugagaguucuacaucuucaucugaaggcugcuagcagaagacuaacuuccaggcagcuaggauaagggucuuaaagccuacacccacagugacacacccaccccaacagggccacagguucuaauagggcuacucccugggccgagcauagacagugacuauucuuaugugggaugguuucucucaggaccuuccuccccggauuucacauguaacccaacacgcagaccagcuaugugguggauuucuuccucauccacggcauugccaguucaugaggcagacaccguagauccuucugaauuccccaggaggucacuguucccuuguuucccagagcagucauuuuucaagagaaagaaauuacuaucauuuuuugucauuuaugucaaauuaccaucuuuugauguuuggaagccuaggcucuauucagugcugagcugggucuuuugaaaacuuggaccacgccaccccuucuuucaugaagucucucagcuucuguagccauuuuucccacucccugcuagaugcauuuccaaccagcagaugccuuaggggcuccuguuugaaaaugcugauuucuggguccaccuugggaugcuccgauucagcccaggguggcgcucgggaaucagccuguauuauggccagcucccugggaggaccugggcaguacugagcuaaagaggcuaguccccagcugccagucuuacugcugagggcccagacacuagaggaagagucugggaaaauguauaaagccucagauuucuauuuagcaauuuagaaaucacauuugagcaugucagacaacaacaacaagcacuccuugaugguuaacauauaugacaggugacuuuaaagucagcaccugagcggcuggacgcugauuugcuaugugcuucuucagauuagcccagcaaucaggguucagaggcgaugcugccucuucacaucaagaaaagugaaucuuugccguucuggucuuaaugaccucauggcauuaaggaaccagggccagcucguuucuggaccaccuugucccgccccuggcccuaucauccuuugggagauggggaggugacccucaggaugcagucagagcucaugguacacugacuuuccuuacugggagggaaacaauuccccuaagaugaauucgcuuggagacugagaagaaaaacccagcaaggaaacauggagguggauuaauaaugggagccuccuccccguucuaaccaggagauaaucacagcacggcucuucucccucgccuugcaggcucccggcauaucuauauucaugagaggcaggaaauaaaaugaauaguccuuuugugcagauggcucccagggccgucuaaacucgaaaauaaacuuugcccauuguuaggguggcugcacuuaagccuucaaaccggcugggcccgacucaggagggagacaaacuuacaguacucagcuaccuuaauuuccuuuucuuuaauccuuacaauaauccugugagcuagcacucucucucucucucccucccucccucccucccucccucccucccugcagaugugaauucacucauucaaggucacaggcuggcacuugcccccuuguuuuuccuucucuguagacuguccuugagggaccucuucuuucaagugggcacuuaaagccccagggcaggccuuccuucacuuccuuucuccacgugaaauaaacaaaacuaaaaauaauacaauuuucaugguuggugaaacugagaaauagcuuggcuuuaguccacuaguggcuucccagaguugggcaguaaguggaaauaugagggacuccggccagagcccauucuuccuagcucaagaggcacacacccucagucauucuugcccuaaagcuggaguuuauagcugccuagcauuguccugggccaccccugaauaccccaaggucuaguuuauucucccaauccaucaacacuaaacucuccucaggucggccauuaagaugcacagaaucugugucuuaacaggguucacaagggguuagagcacagaaucugcauuugcaucuuaauggaagucacaaacuacauuaaucuagaccaguauuaugcggauaucuacagacagucugugauuaucaacccacacagaagcuagagcagccaacauaccaaacacugccuaaagucucaucagucaucaggugggaauagguuagacaauuucagcacagcaguauuuaaugaacucagaaugccccccaaaugcuauggggugugugugggggauguggccugagaguuuuauaccuaucucaacuaucacacaucuauaaacucaaauccacuuaaaaugcacaauuggggauucugugucacaugagcacaagagaacaaagccagguagcuaagacaugcacaaggaaguuaaguaaaaaaaagacugggagaauugagcaauuuaacaguauguuuguuugaguugggcagugguggugcaugccuuuaaucccagcacuugggaaacugaguuugaggccagccugcucuacauacugaguuccaggacagccagagccaauauacagagaaacccugacuugauacaacaacaacaaaaagccaaaucaacaaugaaaaauauacccaagccuuucuuuguggagaauaaugguuguaauaauggcuuauuuccaagacgcccugaaacagggaguuguuacuuuaucgcucaauaaaacuuuucuugcucaugcucuaaaaaaagucaacaggaugcaaauguucuauacauugguauagaaacaauuacaccuuaaaaauauccaaaauugggaggggaaaaaaagaaggaaggcucaggguuggguggcuauguccuuuuccuuauccuaagcaguagcagcagcagaggagagauucaauagguauuguguaaaggugggaagcuggggcuggugagauggcucagcagggaaaggugcuuguggccaagccugacagccuagguucaauccucacaugguggaaggagagaacacgcuacauacacuacacauaaacaaauguuaauuauaaaggugauaggauaauagauaguguagauauucccuaagaguaugggccaacacagggaugaaggaugguguaaggaaauggggugugucuaaucugugcagcucagcagauaccauauaaauaaaaagcucugggaacaaaucagccauuagaagggauggcuaagauggaagguuguaugaaagcuacgagggaccaugcacugaucugugcuuuuuauuuuuuuaaaaaaauaaaccuauuguaaaaauucaaauaaacauuacacacugaaacagaccucuuaagucucuauaucaauaagcuuuuauacaguuagagcagccauucuguagcugcagcuucucacuggaucuuacacuugcacuauucaguguuuuuaugcacuucuccgcugcccaaaccaaaaaauucaaaggacguaauuagaacuagaaaacccauuagcuuuauauugucuuucguaaguugugucuguuaccugcagccaguccuuguuaauugccuauuauuuagccuuucuugcugucuuuccucagugauauaucguauccacacauguccauuuguuuacauguauaugucuauuauuggcuagggaucuaugcaaaaagaaacacuaacaucugcuuagagaggaaaggcccuucacagugcugugcuguaggcuagggagcagguagccuguuuucuauggauuccuuuagacaagccaacccaucagcuguugagauggagcccugcaacugcuguuuaacagggcugggggugcggaucugcucaagcucauccugcgccaauccucaauaaaaagacacauuucaagguccgcugcacguggacccugauuguaaguaggaagugggcuccagagagauugaucaaugcagccauagacagccauagacugccaagggguagucaaauaggaaaucauugaagauaaaggcgacucccuagcccugugcuuugggaaggcccaagagaaggcaguggguugaagacucauuaccguucugacucuuuugacuuuaugaguacuuaaggaauuaaaccacaauaguaucaaucacucuaauuucaauggggagggguaagucuguagauucucacuucuuucuaaaauugcauuuaucaguugugccuuuguaaguacguguguggagaguuguaucucuccuuuccuaugggacccggggugucaggcauugcagcgggcaccuuuaccugacgagccgucuugucagcccaguuuugauuucuuuugagccaaccauuucuaguuggcagauguuuuaacuuuacuauguggauguguucaucaagaacacuagucucucucuguaacuuuaggacagaaacuugggcauggcacacuggccucucuacccuuagaauggggaugccaucuccaggauaucacaagaaagcccagagcugaugcugauggccugccauuggcucuucuccuucuguuucugcuccaggguuuagaucagucccucugaagaauggguacagugaagacaucgagcuggcaucccuccugguuuucugugagaugaggccaguccuggugagucaugggcccugaccaguuggccaggggugggaauauaauggaaauaaauacucuggauuaaugagcugaaacccuucccaggaccagucaagggucuggguuuuuccccucagcauccuuucuugaggauugcugaaggauucuggagugggcuguacagucugcggggagaggucuugggaaggaguucuuccugguuacuuggcgccaacagccugggcagaugaugcuuuuccaggcaagcuccuccuuucuggauguguuucucaccuguuggccuugggucauugcuucaaagggucugugugggggaaggcuggacucugauucccaugggcuggugacucucugcacuggagggaccuuuguucuaguccuguuugucugugucuugaagaguucucguuucuccuuugacuaaccagcuugguugugcguugaagucacuuugucaccgugacccacacaagaagcaccaucagggaggagagauuguuuggcucacaguuugaugugagacaguccacuuuggugagggaaguauggugacgguggcacuguggugggggaguuuggacagcuucuugcagaggaaucaggaagcaaagacugcauaggaagugggacugggcuaaaaacuucaaugcucaccauugccaucagugagugacucucuucuuccacagcuucaacaccacaagguggggaccauauuuaaacaaacacaugucugugugaggucauuuugcauucaaaugguaacauguaaauguggugggaagaucuuggcuucacugaaagacaccaaagagugccauggacuuagacuaggcucucauagcugguaaccuguguagcaaguuuuuuuuuuuuuugucucauuuuucuuucuuuuauugaaauuagauuuuuuuauacaauauauucugaucaugguuccccuuccucaacuccucugacauuccccuaucaucccccccaucagaauccacacccguuccauucauuaggauacaaguagacaucuaaaggaugauaacaaaacaaaagcaaaccagaacaggauaaaacaaagaaacugaagaaaaauagccaaaggaaaaagaaaaaagcacaugauauacauguaggcacagagauacacauauuuguaugcacaggaauucccuaaaaccacagaacuggaagauaucuaucuaucuaugcauauauacauauauguguguguguauauauauauauauauauauauauauauauauauguauguauacacauauauacauauacacacacauauuauauauaugcaaaggauccacguaagguuaaaaaauuuucccugucaaaagcguaugagacaaaggaccuucaaggaugucacugauuucuucuguguuggcuaacuacugcuggaccuggggcuaacccuuaagagugguuuguauccucagugagacaacuggagauagcugcuggguccacuucuaucugagcugggacuugaucuggugcagacccgugcgggcccugugcacacugccauggucuccaugaguucauaugugguccuguuguguuuagaaggccuuguuuccucagagcccaccauccuaacugggucuuacaagcuuuccacuucuucucccacggucuucccugaaccccgaagggaaggauggugaagacaucccguuuaggacugggugucccaaggucucucacccucugaacauugucuagcugcagcuccuucucuguuguuguuaucauuugcugaaggaggaaguggaguaacaaauacuaagagucccaauucgggcguuucuucccuacuuuagaccacuuauguucccagaugaaagacacacacaaccucuauauuuuuaaauagccuuaggcagcacaauaacugggcagcugcuuacccuccaugucauuagaaucuacuuucuuauugauaacuccaaguuaucacuauuuacuauauauuucaucuagguugcucuuaacccaagagaacccacuucucuuggcccuuagccuauggcagcucuccuccucccuccuguauguucuuuuucuuccauggugacuuauuccugccuuuccuccucuuugugguuccccuguccccaagcccuugaaaccucaaccccaccaauggcucuucugcccaacuauuggcugucggcaucuuuauucaccaaucagaauuaacuuggggcuucgugcagacuccaggucuugggggccuacacuuagcaucacaauagacaguaauagagaaaaccucaccaggaagcuucuuugaggauggcugagcaaaaccugaucuguaaauauagcagaaugucauuaggagcuauuuaugacuacauuccuccuguaguaucugguuucccccgagaucccuggccuaucugcucuccaguuuuuggcuacccaagcaguguugggaucauggagugaaccuuaacucaaaucagauauugguugguugcacucauaagcguugugccacuauuacacaagagcaucuugcagguuggucaucauuauagacagaagacuuuguagcugggcugguguuuacucuucuccuuuggcagcacgcagagggcuucaaguaucaugaacacuaguccauaggaguuaaggcucuagguaggcaccggcuccacuugucuguguucaaugggcuguauagguguaauuuucagcgauagagccgucacaucaguuuguggagaacaauuaguagccuuggcacuagcccucauuguuccuaugggguauuuuuggccaacuuuucaauuagaugugacccguucuuggcacucacuggaagcaucauuuggugaugagagauguccagaugggccuccaucuuccacaucauuuggcaacuucauucagauugacuucauauauauauauguauauauauauuucacauauauauucacauauauucauguauauucauauauauucauauauucacauauauauauauuaggaaacuucuauuguaguuaacuauauaacuauauaacaccccuuccauggcccuuaguuucagcccuccucauauucccucugucaccuccuucccucccaucuccauuuguccguccugcuccugcccucccucuguaacuauauauucuauucccccuucuagggcgauccauaucuccccacucccacccccuuucccucuauguaaccucugugguuauacauauuauaacuuaucgaagacuuaauagcuaacaccacauauaauacauauccuauuuguccgaguguaaaccucacucaagaugauuuuuuucuagcuccauccauuuaccugccaauuucaccauucauuuuuuuaaauggcugaguaauauugcauugugcaaauguaauacauuauccauucacccguugauggacauuuaggcuguuuucaauuucugucuauuaugaagcagcaaugaacacgauugugcaagugcucuuauugcaaugccuggcaugcagauaauucauuuuuccaugacccuucauucuucuaccaaaaccucagaaagcuugccacgagucagggaauuuuauuaccccccccccacucauuucccauugggaaaccuaagccaauuguggcccccagugugcugccauaugaugaucuugcuauuggaccucauuguguuuucugguaggggaacuguuggccuguggucuucuuugggcuguaagaauuaacauguuggcaguuucuugauugucaguuccuggaacauagcugagagcuuuccaauggggcaggaguggcaggacugggagacgccuuuuacagccauugugguaauccagggagugaaaauugcugcauuuauagccaggcaugguggcacauaccuucaacucuagcacucaggaggcaggggcuagcacaugucugugaauuccaggccagucuggucuauauagccaguuucagaccagccagggcucuaaugaaugaaugaaugaaugaaucuauccugaacuugacugagaguaacuuggcuuccuaguaugaugguuucucaagcacucacaaaacaucaggguuaaagaggacauaaaaauauaggaagcaaggcaggaggcagagaguaacagacgguagguggucaacgacccagucagccaaggguaccaccacccucuaauguaagauagccucaggaugaggaaauucuaucugaaggggauagauaauagaauaguuuccaucuugaaaauaauuuuaaauguuaagcuaaaaaauacaguuuucacuugacccuucaguggagacccccuccagccaauuccauguuccuucugugguagaaagacccggacaggaaccuuuuuuguaaaguucccuccuauacuguggcugagugagcaaaaugcuuaaguccucaugggucuuaaagcacuccucuucagaaugaauuauguacaagccaacauaucacaaauaagaccaagaugcuuagagaguauauuccuuaugguaugauggcuuaccaaucccaccccccacccccguuagucuggggcaauggauccccugguaacaugcccaugggcaggaggaccugagcuuugacccuugacacgcucauaaaagccaggcagcagcagugcuuaucuguaauggcaucgcagaggugcagagcagaggacuccuggggccugcgggccaggcuagccagucaguaaaauccaggugugugagagacccugucuuaaacacaaaguacaaugugauggagggagacauccaguauuggccccuggcuuccacacauacauguacauacacagaaauauacaaaugugcaugcauguacacacacacacacacacacacacacacacacacacacacacacuccucaguacagaucacacauauagagagaaaagaaaucaguauugaguucguucacuucccuuucuccuagggugccucugccucugccucugcauuaauuucacacccacccccccgacccccagacuuugguauuguucagcuuuggcaccaagauauucuuuguaagauguucaguagcaucugugccuuuuguccacuagauggcggcagcucccaccucacacaaugguuacuaacucuccuggcacugucacaccucccuccgguggccauauccuucuuugagaaccacugcucucaaaugagauucuaagcaccuuccuauuccauucugccauuaaguagauuggccaugagcucaguauuccuccaauacuuagaugggacccauuuaccccuccggcucucaggcccgucucccuuaugucugaauuauucgcuugggcuccauucccagaugcggaaugaguggggcuggauaacugagcaggguugguagaaccgcaaaccuaaaccuugaagacaaggaagcuagaagaggcuuugccaagucagacucccugccucucagcuccccccgcccccgccccccccgccccgucagcgcuugggcuucuuucucuguggccuggggggggggcggggggaggagaagcuugcagcccccccucugugcccauaaaguccaucugcaggcaguucacaggaaaaccagucagcacuugcggcugcggaaggcaguccgagaacacuuagggaagcugucgcaaaugccccccaaaaccgugaucaauacauuauuaggaaucacugauagcagaagaagugaauguauuucaaagagaacugcgcucagcuaugcuuggcugccuuguugagggaugcccugguauguugggggacccauguugggggaccccacuguugaacgagggaggcugggagugggaggagguuuugaauggauaacguccccuccugcggaucugcucuuuaagaggaagccucugaaugugugcaagugucauuuuggcggcuggcuccugagccuguauuuacucguacaucugucaccugguucuguaccaucuccagcugccaguuggcauuuccauccaugccgggaugaagccucucucagaggcugugcaggccacacgugcaauauguuaggcuucccccuugaugucuaggggguccagcccugcuggaugucacugugaccuccggaugcgagagccaucaagacuuucccaaacaagggauugauccccagagagcccugauggaguuuuuucaugaaguguuuguugaaauaaagcuuaaagcuguggaagucuaucaauaaagaauucaaaucucuuccgagguggccauuuacacuacacagauacucuaagaacccuugguucuuuacuguguuugcugaauguauguuuuuaaggaguguuuuagcauuaugauauuacguguuauauuuaauuuggggagcaggauaagaaaggagugagguuuaaaaaaaaaauccccacaacagccugcuuauagcuuguugucuccucugcccugucucucuuuuuuuuuccugcacgugauauuugugaaguuggauucacaugugugugcccuuucccccucugcagacagcuugaaaaaguccuucucuggcgugugauuuuucaaaguccugaaugcuuugucuugucagcuucagguuccugagucacucggccccucuuccaccccugggcgcugcaguuaguggcaggcuuuuuuuuuuguuuuuuuuuuuuguuuuuguuuuuuuuguuuuuauuuguugacuuuguaaauauuagaggccuuuuuuuuuugauuaaaaauauucccuauggacuagauaucugacaguggaauaacuagaacaagaacaaaaagaugcuacaauuaaaaaaagggacagugguucucaaccuguggguugcaaccccuuuugggagggucaaaggacccuuucacaggggucaaauaucagauauccuacauauugguuauuuacaucaugauucauaacaguagcaaaauuauaguuauggaguagcaaggaaauaacuuuacaguuggggggguggggcucuccacaacaugaggaacuguaucaaagcguggaggcauuaggaaggcugaggacaucugcuuuaaggggaaaugauuucugaaagucagggcugggguucaguucagccuugacauuuaggggaaggggucugugcccagaugaccugcuuuugggggaacagaacagagugugaccaucaucagggaacaagcugguggucccuggcagggacauuuagaaaacuggcuucccuaauuagccuggguuggguuggaauaugcuuugcucugggcugguaggagaaaggagcaagagguagugagaucuaugggaaacccagcuugguggcuuuccagccaaaggcacacauagcccagcagaaguguuccuucauuggagaaaagccaugacacauugguggcuuugagauucauaaaacaauagagaaauaaacacacugagagccacccgugagguagggaaagggcgcacauguccguucacccagaggcccagaggcccaagcauugagcuggaagcuuuugcaauugagaaugaaucuucuucuacuggggagggaccuaaagacagauuaagacccuccuggugccuaaccagguagaguuuggccaugucagguccaaagagagaggggcggcuaugcuugccuccccagauccaucgauaggacacagauaccaaccaaacaaagccccaagcuguaauggaaaaaaaaaaccaaaaaccaaaaaccaaaaaaccuagcccacacagaggaagaaaggucuaccaugcagcuauagagaggauggcgggcaguggagcuggaagauggaagucagaggcaccuugggagcuagcucguggagcccuggaaaaggaucuggaacuggaaacaaaaaaaaaaaaacaaacaaacaaacaaaaaaaaaccagacucugaccucuuauguaaugaaaaucucugaguucaaggccagccuggucuacagagcuagcuucaggacagucggggauacacagagaaauacugacuugaaauacaaaaugaaacaaaagaaaaugucaauuuaaagaaaggugccgccgggcagugguggcacacaccuuuaaucccagcacuugggaggcagaggcagguggauuucugaguucgaggcuaaccugguuacagagugaguuccaggacagccagggcuacacagagaaauccugucucaaaaaacaaaugagagagagagagagagagagagagagagagagagagagagagagagagagagagagaagaaggagaaggaggaggaggaggaggaggaggaggaggaggaggaggagaaggagaaggagaaggagaaggagaaggagaagagaagagaagagaagagaaaaaggugccuauguuuaaggcagagugcugaaguacuucagaaucuagaauacaauaccauuagagagggagauuguugaagugacaggcugggccacucuucaggcagagggacagucucuauaggcucguucauuugauucagugcaaugaauagaaaauggcugauacacccaaacacgcuugaguguguauaagguaaagucuaguauuggacuuguccucauuagcccuggagacuggaggacagggacaugccagcagcagucacagggaaaugcuguuuucacggggauuguugaaaucacaggacucgagcaugucacagcggggaggaagucaccaccagaaacuuaaccaugaggguaaacagaggaacagaucaggacaggaguuugaguguguagcaagcacuuccaccuaacugggcaacugggcuggacucugaugggggaaagaauccgacagucuaggguuuucaaaaaagccuaagaacaaauuacaaaaggcuggaaguggaugggagaguauuggggaaagcaguaaugcagacguaaaacuaaagauggcuaggugggguggggcacacccggagucccugcuauucaguaggucgaagcaggauugcccaagccuguaaguuugagcucagccuggaccacacguugagauucuaagaaauacaaaauacuauaaggugucaacaauauagaaacgauauaacgauauagaaggcuuaguuuccaaaggacguggcagugaaaagcuugggaaguaaaagcuaauucagauucggauucaggucacagacacgacuuugagccugcugaggugcucagugguaaagauguuguguuugaagcaugaagaaccugaguuuaauccccaggacccgcaggguggacguagggagcggacucugcuaaacucuucucugaccuccacgccugcaccgcggcucagcuccugacccuaagucaauaaagguaaaacggcaaggauauguuuucauaguccgggugagccaguccacacacaaaaaagcccacaguacccugacuucagaagugagccuuugcauucugcaaauggauaccaauggauacaaauggauacaaaucucuuuacuucuuugucuugggaacuuuaugaacuugauugugggucagaaggcaacccuuccugcaccuuuaaacauggcgaccucccugagucauuauuugccuuugauaccauaaguuggacagauguugagaaugcgugguauucgagacuaagagccccaggggcuggagagcuggcucaacaguuaagagcacuggcuacucuugcagaggaccuggguuugcucuccagcacucaugggacagcccauaacugccugacacuccaguuccaggggaauccaugacucuuaugacuuccacgggccucagacaugcacauacaaaauacuuacauacauacaauaaaaauaaaccccgaaagaaaaaauauucuaaauaaguagccaaaauuacuugaaaagacuaguaaaaugcaugucacacuuauacaggcaaaccuuacuuuccacauacuuugcacauguugagaauuuugaaaacggaggcuugggacaacccuguauggagcccuucaugcaggcuuuccuuagcagcaccugauagcuucgagugguccugcgccaucggaaucuauuuugaauuuucagcauaugguagauuauuauagccacuguggagaucugugaccucugaucuugcugugugacugguugggguuacuguaggccacacucuugugagacacugaguugguaaauguguauguucugagcgcucgcucuguggauuggccaguauccuucacgauuccuccucuagcuuccuuaucccgagacacaguuaagagcaccaguuaauaaaauaccccagggacaggaagagucaccugucugucacuuuagaucaaagcuagaauagguucagcccaggaagggauaucaagaacagagacagggcagaagccaggccuuguaaucagucaagccaugaacgccagagaagggcucuugggggccagggggauggugugggugggcaggaaagcuacucuuauaagcacagacagagauaccuuauuucaguauggagaaagcgccaguggucugguuagaggaucaaggcagccacagcacucacaaagucccgacucaccgcaguucgagaaagcuacgaugggaaaaaugacagucagcagggaggcucccagucuuuaaggaaagaauccgguccagagcaucacagcaggagaugaagcagagggugcugaugcaggagaguuagccgagucacuggcugugugaccaaggaugaaggaugcugggcaguacagucucagagcggaugaaauaaucuccacgcgauaguggauucugccacuauagagagacgucaaugcuaagcuucgaaagccuuggguuggggcuaauguagcugguggcuauaugugaagagcuaguuuaccguucuccugcccccccccucccaggauuaucuuaaauccacuuugcacuccgaagccugggugacaguacauccauuuauuacgacaugauuuacugaaacauuugagccccgccauugagaccucaaaagaaaaguucucaucccggguaucgcugugcauugauggugcgcuggucacccaggggccugguggagauggaugguaagauccauguuuucgugccugcagaugucccaugcuuucugcugcccacauaucaagggggcaguuuugacuucugaggccuguuauuuaggaaaugcauuuccuagagcugcgguugccauaguuauucuuuugguggaggucuuucuggagaggauuugcucuucuagaagccauuuaggacaucagugauucuugagaggaaagaaaaaaagcagccuguaauaaauugaugcucauucguguggaaguagcuauauagaugggcuauggugggaagccaagccagaagaccugacucagcaaaacacuacagcagugguucucaaccuuccugaugcuaugacccucgugguguggugaucucccccccccccccaccauagaauuauuuucguugcugcuucauacaguaauuuugcuacugucaugaauuguaauguaaacaucccugucuuucgauggucuuaggcaaccucugugaaaggguuguuugacaucccccccaaaaaaaaggggucacaacucacagguuaagaaacacugugcuacagucaaauaguaacacugcuauggaggaguuguguauggaugaaccaagagagagcaucucuggagaagaugcugccgaggugagacugcagcaagcauaggauuguaguuccugaagcagcggcugggguccaugagagagacuucagcuuuauggaaguuguacaauguaucagaagaaccugcuccucccccaccccgcccuuguagcuacccacagaauguuaacaugagacaacggaaaguaugcaggggucuaugugcaugugagaccaggugcuagaaacaguguuggauccccuggaguggaguuacggguggcucugaguugccggauguggguguuuggaaccuaacucuggucccugugggaucagcaagaacucuguuuuuuuuuuuuuuuuuuuuuuuuuugguuuuucaagacaggguuucucuguguagcccuggcuguccuggaacucacucuguagaccaggcuggccucgaccucagaaauccaccugccucugccucccaagugcugggauuaaaggugugcgccaccacucccagccagcaagaacucuuaaugccugggccauuucuccagcuccugccuugguuuuugggacagcuucucucacuggcauagagcuuauuaauuaggguaagcuggcuggccagugagcccuggggauccaccugucuuugacucccuugacgauauuaaguuuguaucacuugggucaagguuucaggggaucaucuucaugcguacagcccaagcucuuauggaccgagcauuuccccagccuuacucugccuuuuaagucccuuaaugaaugauacuaaguugucugcucucagcaccucuguccucaccuggugccacccucuuccucgugaacacgugccugcauagacacccaugagccaguugaucugaccuagugaugcgcagauucaacucagaaagacacacagugcucuuguguuucaggguuuuauaucaaagccacauuuggaagaccaaggacuguggcagcugcuagcuuuuguguaggcgaugauggaugaugguaaagcagaggccagaggucaacaggagagacuccaaccuuggaaggaaguucuacuauguugcaaaagucaccuuugcuuaaauuaggcccugcccuccaggagcugacccaguugcaaaaccucugcccucgguucuuccaggcacucaugggagacucuaggugugucucccauacgggcuuggaagaggucacucacaagguuguucucuccccccccccccccccccccaggagagugaagaggaacucuauuccuccugucgccaacugcggaggcggcaagaagagcucaacaaccagcucuuccuuuacgacacgcaccagaaccugcgcggagccaaccgugaugcccuggugaaggaguucaauguuaacgagaaucagcugcagcuguaccaggagaagugcaaccggagguagguguacccauaaccccuccaaccccuccacguccccuccaauccccuaaagucuuggagcuucuaggagcgaccuagaggcuuccuaacaccuuaagcaaaugaacuaaccuucaaagaacacugccuaagcuccgcccaccagguguguucucauuggauccuuaaagagccgccauugccaaggaccaagggggaaguggacauuccccaaggcucaggggguaugcuaggagcccagagccuccuccacucagccacaggugaccugcgagguagggugggaguuacccacugaugggacucaaucuccuguauuucaggcugagagagaagagaguaagcaacagcagguucuacuccuagaagccgugugugcgugcgcgcaugcgcacgguguucacgagcgcaucuggguacgggagagccuuauaaacagcccccaggaagagauucaucugugacauucaucguccucucuccgagccacucaccauagagaugacaguucugaagacgcccccgugggcaggaggcguugagaccuuccugcuauuuuuccaccuuggacaacuuucuuaacuuauacuaccccugauagaggauccccccaacugugugccuuuugaacuucccuguucucagccucauugaauaaagacaacaguuucaugccguuaagc

SEQ ID NO: 4818 - RNA, 1895 nt, Mus musculus
ugcaaaauguguuuacuccaacuucaaaguccccauggccuuuuagucccaagacuguuguaaaguccaaagucucuuaggagacucuuggaauuguuguauauaugcauauguauauauauauauucuuauguauauguguuuacauaagaaugcacauauauauacauauaggcuagggaaucacugacuucagaggacguuggguugauuccuccagcuguucaguucuuguguagagggcggaggugugaggguggacacccgacuaugugcgcucaccuuugccuucugugcuugcaggaaaucggcgcacagaaagaugagcucagcuuugaacaguuccaucucuucuauaagaaacucauguuugaccagcaaaaaucgguaagaggacccucggcucuucucguguuugcuucaggcgcagagccgagaagcccacagggaaaggcuuagcuucccacugagucaaggacgcaugggcaagagugaccguggaugacuucaggagaccagcaaacggccgcaaccaugguggagcuguaggagacacgucagggcauggggguugcugaucuuccuggugggaauuccauagccauaaauuugaucauaacucugaguauaugaaaaacaaaauacaguauaaugcacagcacacuauuagaucaccuaggaaggaaauccugcaaauuauucauagccuucucugaguuuuaugauuuuaugacuuuauuuuugagacaggauuuucuguaguccaggcugaccucaacuucauguaaagcuggccuugaacuuccaauccucuuuccuccagccaaugagcgcugggauuauagagugaguuacccugagguagcagguuauagggucaggaggggaccagggcuuuguaugugcuaggccauacccccuaauccuuacagauauucaacuggggacuaaacaugcaaguguaugagccuauggggcccauuuuuauucaagccagcauuucccacucccuggccaaaauaggcguguggaacaucaucguacaaaaggcauucaguccaacuucaaaaguccccauggucuuuuagccccgagaccaccguaaaguucagggucucuucugagacucuuggaauugucauaaacuguuaaccccugugaaaucaaaauuaaaaagcagaucacaugcaauguacagugacacagaauauauguuaucauauauauaucauauauauauauauauauauauaugaccacacauacaugacacauacacuuugccacugucuucuggguuccuacuaggaugccuccuuaagccucacuuaaauuccuuucuuagucacuuucuguuguuguuaagacagcaugccucauccccaauccaagauguauuucaacuuacacucuuucacguugaagugaccucgauaguagccuaggcugucuuagaacuugcuauguagcccagguuggccccaaauugacucuccuacuucagcuuccccaaugcucagccacaaccuaaacuuuuuauuacagcuuaaaaaaacaaaaaguguguuucuguguaggcuugugugcaugugagagagaggagagagggagaggaaggggagggaggaugguagaaaggagagagggggugaggaggagggagggguggggagggcggagaaacauacugauugaauugagguuuaaggacucccuauucucccuggaaugugcuagguggaacccugggaaaacauucagccaugccaaggucgcccucugguggucagaaugccacauggcaccugaguugguaucucauuuuugguuuggccuguggguuggcauuuuaaaauuaaugaccuacauuuaaaacccagaggucuaggugaggc

SEQ ID NO: 4819 - RNA, 4480 nt, Mus musculus
aaugccucgcggucccgugaccguguagucgcgagaacugucggcuugugggcgucugcgccgagaaaccgaaguguaggugacgguuccgagacaucgccgccaagcugggcaccggggagauggccgagacggaccccaagaccaugcaggacaucaccuuggugguaagcggcagccucauaugggccuggacaccccggggccgcucucggcccuggcgugggguguggccagcggccucggcccgcgcaccugcggggcucgcccuccggucggccccgacccggacccuccggaccugacccgcagggacaccgauccgagcuggcaggcccuugcugaaggccucacacuccagccgggaaccaccaccaccccacccccccuucaugccugcguccucggcuccccaacgccggucccaggaagggggucucggcauagguugggaucggcugacuuguccugguuucucuuagguggagacgcucuugcagcagaugcaagacaaguuucagaucaugucagaccagaucaucggaaggaauauccuuuugauuuggaggcaguuucuuaacugugggggugagcggggugguuuacaaacagauuucaguuagucauuuagaaauugccuuuuuuuuuacaaaggguuuauuauuuuuaauuauauguauaaggggguacugggagugacugagaccagaggcguuggauccccuggagcuggaguaacaggcgguugugaacugcccaguacacucgugcccucugcaggagccucgcgugcucuuaacggccgagccuuuuccccguccccacuuagaagugucuuuccugaucuuggcuauauuguguucccguggaggacugugccaagagccagagacacagcgagaccuaccccaagcccuuguuggugccccuccagaacaccaguaaagggguuugcaugguaaccguugucugggaguacuucuagaguuggagguguagggaagaaaacucaccccaguccccccgaaccccgaccgccaggcugucacuguagccagaugaaacuggggaagcagcuguuuaaaccagugggcgggggccugggggggagaggccgaggugaggugaugcugccgugcgggcucuuuaacugugccacuagaugacaugagcagucggauugacgaccuggagaagaauaucgcugaccucaugacccaggcuggaguagaagaacuggacccugaaaacaagauuccuacugcccagaagaguugaaggugagggggggggguuaccucagcguaaaacgcccgucagugcgacggggugggggggugucguugaucgguuaucaggagaccucucuccuccccaccggugaacucccaaguuuuugaaauaccacccgaagugagaucugacgcccucuucuggugagucuguagacagcuacaguguacuuaucuauaauaauaaaucuucaggccgaccugagcgagcacagguccuaaauucaauucccaacaaccacgugaaggcucacaaccaucuguacagcuacagcguacucauauacguaaaauaaauaaaucuuuaaaaagaaaagaaauguuccaugccaaacuaguuccuuggguagauuucacauuuccgaguuguauuacuucaaacuuacuguaucagugccaggcaugugccaaucuuuuuccucauagcacgaugucagcuaugaaauucccaccuaaucccagcacuugggaggcagaggcaggcagauuucagaguucgaggccagccuggucuacaaagugagcuccaggacagccagggcuacacagagaaacccaaucucgaaaaaccaaaaaaaaaaaaaaaaaaaaaaaaaaaaugagauugauuuuuccuuccuuccuuccuuucuuucuuucuuucuuuauuucuuucuuucauucauguacgcugucacucucuucagacacaccagaagagggcaucagaucccauuacagaugguugugagccaccgugugguuucugggauuugaacucaggaccucuggaagagcagucagugcucuuaaccucugagccagcucaccagcccugaaauugacuuuuguuaaaagacuuauuuacauaugaguguuuuaccugcauauguuccucaugccaugggaggccagaagaaggcaucgguucuccuggaacuggaguuacaggcagcacuugccaccacaugggugcugggaaccaaaccuagguccucuccaagagcaaaagugcucucaauugaugagccuuguccgucccaugacgguuucauuuuaaguacguuaacaguuuguguugggccucacucgaacccuaggcccugcauggacauacgugggacucggacacaugucuauccgguaagcugcucacugaggaccacuggaugauggcaguuuggggcaugugguuuuggugcccugcccuuaccacugaaauagcucauugcuuuguuuuuggaaauaguggagaacucaagccaccuucaugagcauagauaucuuaaguccuagagaugugcgugugugugauuuuuacuguaaacuugacgccuuuacucuaaaaccaccuacugaggugaauuucuucuuguagccugcaccugugcuuguugggggagaggcacuuuuuuguuuuuuucuugagacguaaucuuaugcaacccugccuuguuggccuagaacuugcuguauagaccagaacggccucagacucaaagagcuccaccugccucugccucugccucugccucaagugcugggauuaaaggugggccucacuuuuaccaucugcagaguccuaauuucuuaaugaaguuuaccaaggauuuaguaugagaauaucaagaucauauauaauggcugauucuuagcccccaucuuauuuucugagcgugggcuggaaccaacuuuucagugacuauaauagagguuggaauccaagagacucuucggggcugggaaggucagguagugaccgacaugcugggcugccucaccgugagucaugugcuauauugcagccaguccuguccagagaggagcugaaguauacagugggccuuggagcugccagggagcucugcugcguuacggcaggaaacugaaagauuguaggauuaaagauguucaccggauggguauauacaaagaaggaaauggaaacaggaaguagagucagaacucugaauaaagaugucuaaauacgaggcuagagacguggcucagcucuuagagccguaagcucuuguagaggacccaagaucgguucccggcugucccgugacgcugcucaccacucugcaacuccaccuucaaaggccuccucaaggacucgcacucacccgcacauacacacacaggaauaaggacucacacucacccgcacauacucacacagggaugccagacacauaagcagacugcuuauuuaccauggcauuuuguagacuagugugcacggagaguggggaauugagcagaugacucugcuggagcugauacuaauggucauuuucuucucccacaggcugccgguacugaauccagaauguuguugucccgagccaagacaaaaaccaaguggcuuucugcaacuaacuccuauguguggacagguuuauaaacgugcauucuuaucacagccugcauagccuagaguaccccuacaccccaucccucaaacuugcuaucuucacauccuggucaguucuauuaauuauuaaacacuaaaauuuuggcgguuucuggauaagauugucaaacguuuuagugauuuuuuucugaguuccccuccccacugcuccucugugguaguugcugugugauaaaguggcagaguacucgugaucacgugaccacagccccuccccuggcagaagccguucgugagccgugaguguguaggguucuuugauuuucagugcaaagugacuguugagccgcccgccacuggagugucagaaguacuucuccagauggcccaggacauuuaauaguuguuugugccgaagcgucucucagaguuuugcaugagauucuaguagcguugguaggaccugccaugcucauccggcaggguaucagagcccagugacccuguccucccuucaagcuacugacugaaagggaagagaccaaaagacccaagugagcccagcccugucagcaaggcugaaaaaugcccuuugacuugugggaggugcugguuuuuaagaaauacuauuuuacuugaacuauuucuugucuaaauucuugcacaaugaguucuauuauugauuaaagaagacagauuuacauucaggauucuggugucuggaggcuuagccucaaagccaguuuugaugacuuagaaggcaaucuaugucacuguccccacaaagugauuucauacaauaaaaaccaagaguaauuaaacauugaagaau

SEQ ID NO: 4820 - RNA, 4480 nt, Mus musculus
auucuucaauguuuaauuacucuugguuuuuauuguaugaaaucacuuuguggggacagugacauagauugccuucuaagucaucaaaacuggcuuugaggcuaagccuccagacaccagaauccugaauguaaaucugucuucuuuaaucaauaauagaacucauugugcaagaauuuagacaagaaauaguucaaguaaaauaguauuucuuaaaaaccagcaccucccacaagucaaagggcauuuuucagccuugcugacagggcugggcucacuugggucuuuuggucucuucccuuucagucaguagcuugaagggaggacagggucacugggcucugauacccugccggaugagcauggcagguccuaccaacgcuacuagaaucucaugcaaaacucugagagacgcuucggcacaaacaacuauuaaauguccugggccaucuggagaaguacuucugacacuccaguggcgggcggcucaacagucacuuugcacugaaaaucaaagaacccuacacacucacggcucacgaacggcuucugccaggggaggggcuguggucacgugaucacgaguacucugccacuuuaucacacagcaacuaccacagaggagcaguggggaggggaacucagaaaaaaaucacuaaaacguuugacaaucuuauccagaaaccgccaaaauuuuaguguuuaauaauuaauagaacugaccaggaugugaagauagcaaguuugagggaugggguguagggguacucuaggcuaugcaggcugugauaagaaugcacguuuauaaaccuguccacacauaggaguuaguugcagaaagccacuugguuuuugucuuggcucgggacaacaacauucuggauucaguaccggcagccugugggagaagaaaaugaccauuaguaucagcuccagcagagucaucugcucaauuccccacucuccgugcacacuagucuacaaaaugccaugguaaauaagcagucugcuuaugugucuggcaucccugugugaguaugugcgggugagugugaguccuuauuccuguguguguaugugcgggugagugcgaguccuugaggaggccuuugaagguggaguugcagaguggugagcagcgucacgggacagccgggaaccgaucuuggguccucuacaagagcuuacggcucuaagagcugagccacgucucuagccucguauuuagacaucuuuauucagaguucugacucuacuuccuguuuccauuuccuucuuuguauauacccauccggugaacaucuuuaauccuacaaucuuucaguuuccugccguaacgcagcagagcucccuggcagcuccaaggcccacuguauacuucagcuccucucuggacaggacuggcugcaauauagcacaugacucacggugaggcagcccagcaugucggucacuaccugaccuucccagccccgaagagucucuuggauuccaaccucuauuauagucacugaaaaguugguuccagcccacgcucagaaaauaagaugggggcuaagaaucagccauuauauaugaucuugauauucucauacuaaauccuugguaaacuucauuaagaaauuaggacucugcagaugguaaaagugaggcccaccuuuaaucccagcacuugaggcagaggcagaggcagaggcagguggagcucuuugagucugaggccguucuggucuauacagcaaguucuaggccaacaaggcaggguugcauaagauuacgucucaagaaaaaaacaaaaaagugccucucccccaacaagcacaggugcaggcuacaagaagaaauucaccucaguaggugguuuuagaguaaaggcgucaaguuuacaguaaaaaucacacacacgcacaucucuaggacuuaagauaucuaugcucaugaagguggcuugaguucuccacuauuuccaaaaacaaagcaaugagcuauuucagugguaagggcagggcaccaaaaccacaugccccaaacugccaucauccagugguccucagugagcagcuuaccggauagacauguguccgagucccacguauguccaugcagggccuaggguucgagugaggcccaacacaaacuguuaacguacuuaaaaugaaaccgucaugggacggacaaggcucaucaauugagagcacuuuugcucuuggagaggaccuagguuugguucccagcacccaugugguggcaagugcugccuguaacuccaguuccaggagaaccgaugccuucuucuggccucccauggcaugaggaacauaugcagguaaaacacucauauguaaauaagucuuuuaacaaaagucaauuucagggcuggugagcuggcucagagguuaagagcacugacugcucuuccagagguccugaguucaaaucccagaaaccacacgguggcucacaaccaucuguaaugggaucugaugcccucuucuggugugucugaagagagugacagcguacaugaaugaaagaaagaaauaaagaaagaaagaaagaaaggaaggaaggaaggaaaaaucaaucucauuuuuuuuuuuuuuuuuuuuuuuuuuuugguuuuucgagauuggguuucucuguguagcccuggcuguccuggagcucacuuuguagaccaggcuggccucgaacucugaaaucugccugccucugccucccaagugcugggauuaggugggaauuucauagcugacaucgugcuaugaggaaaaagauuggcacaugccuggcacugauacaguaaguuugaaguaauacaacucggaaaugugaaaucuacccaaggaacuaguuuggcauggaacauuucuuuucuuuuuaaagauuuauuuauuuuacguauaugaguacgcuguagcuguacagaugguugugagccuucacgugguuguugggaauugaauuuaggaccugugcucgcucaggucggccugaagauuuauuauuauagauaaguacacuguagcugucuacagacucaccagaagagggcgucagaucucacuucgggugguauuucaaaaacuugggaguucaccgguggggaggagagaggucuccugauaaccgaucaacgacacccccccaccccgucgcacugacgggcguuuuacgcugagguaaccccccccccucaccuucaacucuucugggcaguaggaaucuuguuuucaggguccaguucuucuacuccagccugggucaugaggucagcgauauucuucuccaggucgucaauccgacugcucaugucaucuaguggcacaguuaaagagcccgcacggcagcaucaccucaccucggccucucccccccaggcccccgcccacugguuuaaacagcugcuuccccaguuucaucuggcuacagugacagccuggcggucgggguucggggggacuggggugaguuuucuucccuacaccuccaacucuagaaguacucccagacaacgguuaccaugcaaaccccuuuacugguguucuggaggggcaccaacaagggcuugggguaggucucgcugugucucuggcucuuggcacaguccuccacgggaacacaauauagccaagaucaggaaagacacuucuaaguggggacggggaaaaggcucggccguuaagagcacgcgaggcuccugcagagggcacgaguguacugggcaguucacaaccgccuguuacuccagcuccaggggauccaacgccucuggucucagucacucccaguacccccuuauacauauaauuaaaaauaauaaacccuuuguaaaaaaaaaggcaauuucuaaaugacuaacugaaaucuguuuguaaaccaccccgcucacccccacaguuaagaaacugccuccaaaucaaaaggauauuccuuccgaugaucuggucugacaugaucugaaacuugucuugcaucugcugcaagagcgucuccaccuaagagaaaccaggacaagucagccgaucccaaccuaugccgagacccccuuccugggaccggcguuggggagccgaggacgcaggcaugaaggggggguggggugguggugguucccggcuggagugugaggccuucagcaagggccugccagcucggaucggugucccugcgggucagguccggaggguccgggucggggccgaccggagggcgagccccgcaggugcgcgggccgaggccgcuggccacaccccacgccagggccgagagcggccccgggguguccaggcccauaugaggcugccgcuuaccaccaaggugauguccugcauggucuugggguccgucucggccaucuccccggugcccagcuuggcggcgaugucucggaaccgucaccuacacuucgguuucucggcgcagacgcccacaagccgacaguucucgcgacuacacggucacgggaccgcgaggcauu

SEQ ID NO: 4821 - RNA, 25924 nt, Mus musculus
acacuguuccuagccagacuuuauuugguggcugugggccuagcgugaugcuggggaccugggcucuccccaagccuagguuggguacuacagggucacagcuccuacuagguagcgggccaucacagaggacggaaguagaggaacaggccuguccaucagaggugggcccuacugggccucagcuauucagagucagggaugccagaggcuggcuggggugggaagcuguggauggaagguuggccugggaagccaucccuacuaaccuuggccuccucugccagguugagucagguguggggaauaccaggggaugggccgccucugugccacacagcagggggaaguuaccaguccuuugauuaguauauugaaaagacagcaguuuaccaaagucucuagaaaagggguguugcccuuuacaagaaggggcagggcacgagaguagggcuucuuaacagggaggggucagucucggccagaggugcaccaggcagcuguaagcaggagagagaauaguggucagugguuggguuuauggagaugaaggcugggauggcugugggcagaguacuccaggccaggcucugugacccuaggcuccucccucaggccccguagggaggugugcggugagcuuuucgggugagccccgauguaucccugucuacacaccaagccuugggucgggagcuugcaucuggacugggauuccugauaggagcaagaagucccuguaggccugggaagcccuucucugagguugguguggccccacucucaugcgguuuguccccggcccucuaccuggcacggagaucugggagagugcuucaggcuggcucagcgugucaaccuugacgugucggaaggccuugcacacagggcucugcaggugccugcaagccgggagcacggguuaguccaggagguggggaugaggggagcuuuaggugugggcccaggucuaguccugcucuguccuggaagagaggcugugaccuugugagaagccuuugccucuaaccugccuaugggaacaggguuagaccucuagcccugaccuuucccaugcugaucagcugcagcagcaggggacagcacuguaggagccucuaugcucauuccucccugaaguaccuggguucuuagccccaaggcccugaguauucacugcagggaagaacaggggcagaagugacacccuuugucuuuguuguguguuagguuguacaugggaaacuagaaaccccugcaguacuguggcuccaucuggggaggucaguggggugccugggcuguggcgcucuaaagcagccuuguggccaggcccaggacacuuagcagcuuuacggauagcaaggcuccaugacccagugccugaugaugcaggcagggaggcuguggggaaacugagucaguccuuagagcagagacuuacauauacagugccauauggagagccugggucaggggucucaguaucucagaaucuggcugccucugugugaaaggcccaagcugaccagggagcugggcucuucaccguccuccccacccuuuuccucagggucaagaaacaggugccuagaggcagucagccccaccugcuggcaugggguagggacaggguagggacccggcugcaccaaccucuuccacuccuccucugucucccagaacucguagaugacgaagguuaggccaucugccauccucacugcggcaacacugcggggaagugacaugcacauguguggcaggcugugacugccuaucgcaugucacagcccccuuagccucucuucccacuggucauucacggggcaacgggagcuggagacaucagagaccaccaugacuccaagccuccgggagcaucgggccaccuggcuuggcaccaugguccacaacgagagcaggguuuuuaaagaugcgcuuaaaacaccugguuuugagggguggggagaugcucaguagaaugugaggauccaugugaacaaaacuggagauccugucucgaaaacaauguuggggccaggaauauggcucagccgguaaaggagcuugaagcauagcccgauagccugaguuugauucccaggaccuacauaacggaggagagaaccaacuccuggaguuuccucugcccuuugcgcuggcuagguuguaugccagccucacauaagcccgagucaucugaaaggagggagccucaaauaagaaaaugcuuccagaaggcaguaugcuugccugcagggcguuuucuuaaucagugauugaugggggagggcccaucccacggugggugugucaucccccagcuggugguccugaguucuauaagaaggcaggcugagcaagcccugggggagcaagccaguaagcagcacccuucauagccuuaacaucagcgccugccuccacguuccugcuccgacugccuuucaugaugaacagggaucugaagugcaggugagauaaacucuuuccuucucaaguugcuguugguuaugggauuucaucccaacagcagcaacccuaacuaagacacaccacacccuaacuccugguacacaagcuggacauucagcucaggaccccaccccaaaaaaaauugacuucugaccuacacacacagagggauguauacauacaaaauacguggguuuuuaaaccaaagcacacagccugugccuuagucucuuuccugccuuuugcucuuaagacaaccccaggaagcccagaccggaacugaaaagauacugucccagaaucccaggcaugucacuugagugacccaggaugucacuccaucucagaggggcugaagcaguggugugaccacguggguucugguggagucccuguccccaccagcuccuccuggccccuggaugccuuucuuucucacaugagaccgaagugcacccgaguaccacaaggagggacucucuuuagggagaaggcugugagggaacccuacugcugccccaucauugguuuguuauguaccagccuagaaucacaugcagagcucgggguucaugaguggaugggggugccaggcugccagccucagucuaugccagcccguguaggugccugcucuggucucucucucuaggcacagcaaaggcuaccauggacaguuggguucauaagaguguggcucccacgggacgaucacugccagccuggugacugccuuugcccagcugaugguggcacggcagggcagguguggguauggaggacacacuaggaggaagccuugugcacugguauaucucagggucccauccuucaagaaggacugggaggaggggcaacaguacgaggaaggcccaggugaggaaacaggggugccugggguacaggguguaguuccccuucccucucuuccuuuaagaaccaucauugcaggcuggcgagauggcucagugguuaagagcacuggcugcucuucuaaagguccugaguucaacucccagcaaccacaagguggcucacaaucaucuauaauggggucugaugcccucuucuggcaugcaaguguacauacagauagagugcucauauacauuuaaaacaaucuuuaucauugcccccauugucagucaaaccuccuggccugaguguguggcuucucccuauaaccccgcuauuucucgaucaaucuucacacagaagacaggacggaucuggcucccaaugacaucauuucaaugcacagccuguggcagcccuccuuaggcuguucacccauuccuuuguccagucaaaccacugucacccuuucuugauauugacaguguacagaccccucacuggugcccacaguccccugcucugccuugcugagcugcccaggguaaaaggacaggagugguaauggcaagcgaccuacggucuagaagacaccccuccuagaagcuguagagagcuucucuccuuagucaagcggguacugacuugagucaggcucuguguuauagugggaaccagaguggccucagccaggacaucuguuuacccuucccaacaaacugcuugcugaggaagcccaggccugggggugaacucacccaccaccuccuacagcuggcauggagcugagccccacuuucuaggcuuuccugccauauucauccccuagggaagggcuggcucugccacacauaccccugccugcccccugccagccagagaccuuggccuucucccccaccccaaugcaguaagcgcuuuacuuacuggaagcaguuccuuucuucagccgugcuccggagguacugucucagggaauccaagaacucacucagcugcucagggcacacggccauuuccugccggaccagcugcaggugcugugagccacaguggacaugaacaugcaugccagggccuuccccagccacgugggcaucauuucaacccuggcagccuaugccucgcuucggaggggucacaauaaaauaaacccacugcacuauuuuuuguuuguuuguuuguuuuucaagacaggguuucucuguguagcccuggcuguccuggaacucacuuuguagaccaggcuggucuugaacucagaaauccgccugccucugccucccgagugcugggauuaaaggcgugcgccaccacgccuggccccaucgcauuuuuuagucuuaguugugaaaaucaaucagcuaaaggugacagguccaaaugggucaagucccugugggguccccacaaagagggcaguaaguaagaaggcugcaggaagccccaccaagaggcacaaccauggaccaauggguugcuuuucuggcaaaugcaccgucugaugacugacagacgucagucugcuuuuuuaucagucucagagccucagcuuaccaugccucuuggggagggguggccagagaggguggccagagacauggagucaccaccucggagagcuagaggaacaggucagaggagagggguagaaagggucucaccauguuggugccuucuucauccgagaggcgcuguugcaggucaaacgagagggucuagaacaagacagugauguauagauuggaggccaccuccagaaaggcucccaagacuacaacucaggguauaggguaccgaacaccuggagaguuacagucccugcccucgugugccagggguucugagaucucccaggcuggaagcaggguucccagggccaggccuaguggacaggcuacuuaguucccagguauagagaggucucagaggggacccuagaaccagugagccaaggaaauggcagaggguuccuuaugguccaggccucugaaguacugggagguucagagaccaagaugggucuaaauaaacuuggcgaauguggcuggagccaggaaaucuuaguaacaggcacccuggggucccccaaaucaggacaguguuuuaaccaugauuugauaagagcccuaagacccccuaacauguguaccucaccccuagcagcgaccuuggguuccccauaaacccaugguauacacaggguggccugcacgcugccucccccaaaggccagaacugaaaaauuuccacuuacauccuauuucccagccucccuggccagcugcugccugauugugcuuugggaacgcggaagccaugccagcucugcgggucaccagcaccuggcgcccgagcacacagugauauucaaucauuacaucagagcccagaaccccgggccccaaagguuccucaagagggcuaagcaguagagucuggucucuuugccaacugaaaaaauccguucuuccuucagugugggucucccaagaaccacagucccggugccuguuuacccucccaaccagcacgcguguaagcaagcaagaggcacauccauuguuuaaaaaagcagccgcagaugggccgaugguucucaaaugauuaaacaagggccugcucccugaaucgcauccccggccuugacugacuucuuguccacacaucucaagaaagcgcccaguggacaagauguguuugcagguuuagguuuguuucuaucacuuaacaggcacucgggcggcuacuggaaggcuggagccccaucagggacccucuggccucuccacagucagauggagagagagcccagcagcacccaggauacgcccaccgcccuccagguacaguuggaggcggugcuuggccacaugggggcggagccaagagcagguuugaauuggcccgugcuugugcuuaggccaaucagagaccucggaggaucccgucccaucuccaggacgccuaggugcuccuaguuaccagcaagcuucguuguuagggcgaccggggugcuaaaaauaagcuucaaagcgccucccuccuggggcccccacugaguuguuaugacaaccgggcacaagguccccaccgcgcugcucucacccggggcaggaggcuuaaaagaggugugggaggggugacccucgcuucagccacagcccugcagcuggcaacacauuuacggacuggauugccucuccucccaucagaccgccuuuccacugagaaggcccaugguucccucccaugagucgcucagaaugaacacccaagccccacuaaguaccagagcucauugccaaaagacaaaacaaaacaaacaaaaacaaaacaaacaaacaaacaaacaaacagaaaagcugaagaauguuaccucaaucucggggcucugacacaccugucgcuggaugcaggcaggugcggggcgggggaguccugcgcgcacauguguggugaacuugguaaagggugacuagcaaugcuaacggggcuaauguuagaugcuaacgcggacagcaggcucuaaccugagccaccggugccuuuggugaggaacaacugcucuccugacugucuccccugucaccagagcaggagguucaggcuuaaagagggcaagucauggacucaaaaccaaacagcagaaacccagcucuaagagaggcaccccugagccuacucaucugcaagccccuuugagaguacugugggucacauacuguccgcagaaacgucucuauaagggcuugucugcuccauacucccacacuauauuaagucgucaguaguuuccaguuuggaaccugcccuggaccaucgucccugguucccucuugcaccugcuuuuugccuccggucuuggagccaccguucuaggauacauccauagcacaggcccccgggguuacucucugugccugggucacucucugcugccugcccucccacagacaguggccccucugugugccucucuacagcccacaacccaccagggugucucagcuucccagcaagcucuaaaguggguaaggcugggagaaaggugagaugggguggggcgggccuaccuugcucuccagucucccaaucagcucugccaaccggcuuaucuggcccuccagcccauccuccuuuggcuccccuguggcugagaaaaaagagagagaccauggcggugggcggggccgucccgagggggcagagccccagccccagucuaggccccagggcagauuacucggauccccuuggagggcagugcccaccggugcucucucacccacaggcaggcucuucaucggcuccggggccacaagcuugugguuggggauguagggaggaguagggccuccguagcggcucucguugacggcauggcuggguuugcagugguccugucugcauugcacggaggagaaaugggguugaugagggcaccugugggaccacaacuaccucaacugccuucaccgggcacuuacaaaagcacugaccauguccugaaaugugcccggacugcucugugggccccgagucugcgggaugggcagaggggccuucauuuucucugaggaggaaaaaccaucaugccagacucuagagcccaggcgccugugcaucacaggcucauuucuaugacggagguaaagcugggccaggcgucuaucuggcagaccucauaguucauagcuuccggccagaacaggcugagcccaugcugaggagacacuaugcaucuuccuccuuuccuaucucuauagaggccacugugcuguggauggaagaccugguuuugugucagugagacaccccccgcuccccccaaacaaggcagcaagaaaaaaaauggagccuggcccgagccggacucaaccccucuugcccauguauccuuccuccaugcacaugacucaacaggcaugcugcacuccuagugcagugacuggcacccagcagggucuccaaaacugcagggugagcggccaguuccauaugcacaaagggggccuugcaaaacuaagaccuaccagucaacaggguguguggcugacacccccacacccugccucugaacucuuuaguccguuuuuugaaaucugucuccugugaccccugaaaacuuaacaagucuuucucugcucagcucgcucagugagacaaggcuaguggaagcuuugagcugucaaucacaaagucuguacaaaccagcaaccaauucagugucccucagaccaugaaggguugcgugggaggccccucaagcagcagggucugcauaaaagcucuuccuggaacacagcacccuuggggguuguucuagggcggugacacaggguagcccugggaaacucggggccuggagccaaaaguguugauaugugggccagcgugagaugucugugggcguggagcugguuucccaucaagacacaccacccacuccuuccacugacaccccaggguuaucuccucccaguggggacaagcgaguggaaccacacaguguaggaaggcagucaggaaaauugcccaaggcugcuaucugucugcagcaggagaaaaaggacgaguuugaugaagaugauagauaauaauaaaucaauaaagggaaagcugucuguuuucagaacgguggcuguucgacacuggggacucgggaucgcaaggcuacccacauacgcagagucaugaacuguacuuccaggugcugagcgcaaauauauuuggcaaugucauuaagagcacccucacaauccuacuggguggagguccucacuggccaaauuucacccccucaaacccuaccuccauagcaaaaagaacauccugguuacacugugacucugccaggcacacuggaguugggcuuccaggcaccugcccaccugugugugggucccguuucuccuucacugcucugaacagacaggggugugcucagcuagcuauagggacgggaggggaagagggcgcucaaaguugagcaagcccuucuuagcuagaaagacuaaaguguccccguccagauaccaggcacacagcacccaccguguccaugagaaacaucugggugcuugccagaguaccuggaggccaaaagaacaacacccugaacuccaucccucuccauagagucuccuuuaguauuaguuuggucccgcccuaccuucaagaguucccucccccuccccagaucuccagguaacaagggagcccuuggagacccacaggguuccugacaaaaagacacuucccucagauacuucacuuuuggcauguggccuuguguucccaaccugcagccagaucccacuucccaaacugguuuccaguacgcggaacuaacccgggcggcugggcauuguugugcgagaacaagaacuaugguaagaucugcgggccucaggagugcaugucccacaccagccauucuccuaagcacauccugacccauguaagccucuugacucgggugcuaggucccaaguuuguccucagauugcaguuggagaaacugggggagcacaugaacagguacccagaucugaggggcacaaagagucaggcugccgugagcaccccaacaugccccauggacacaccggaucuggcuggucuguucuucgauggcuucuacagcacuuuccacagagcugagcagcgacuggaucugauuggcugucuccuucagaaggaagcgugucacaaacugguccacauugcucccaccuucauacaccuggaggcaucgggagagaaccgggaugugagugggcucaaauggcucucgauuugcacgguggggcucugaacuuucuccugcaucccggaagcugcaggguauaccaagcaagguccccaccucuagaggccaaagguggaacucuucgguuucauuuggaucaucucugcaaguccagagagcagugguacuaucuuacaucuuaccccuuggugaccagagaguauacugggcauaaagacaauagcacugugagagcaauaauaauagugacacugguauuggcgaaccaaugauggugaagacggcaauggagaugcuggugauggugaugugguggugguggugguggugaugauaauguugccaaugguaaagauagcaaaagagauguuggugaugacaauuuugauggggguggggguagaggugaugauguuaauaaauggugaugccggcgaugaugaugaugguaaugacaccaucaaucacggaugaugguguuuugguugcuacaguaggcagaaagcaccaggagagauggccucugcucccuucuuucuucuacaagaaaaauucuuugugcccccgagucuucaugcugccaaucagacaacuaacugaagagaauuauguccgcaagagggcuaaauggcuccucaggcaaucccccaaagccugugcucaggagugggggacaaagcagagaggugggcaggugcacauggugaggaaugagcucuggagagaggaugacaagggguucuccugcaggcucuggcauuuggugcauggccgagccucuccuggcaagacuggcacugacaucccuugcugugauuccugccucugcagaagguugcagaggugggagaagcuugaccucuuagcgucaauggagugcggagguaaccagcacuggggagaggugcugggacucaguggcggagacuucccccucuggagccgccccucccucugcacgcuggaacgcugcccagucccuggcaaagcaaggcucccaaggaaagcaaauuaaacuauccaucacucugacugggaauuaauuagcaauaauuacacauugggcaacaugcagggagacagagagccugaggaacaaggcgugggggcacagugaggguacacaaagguggacauucugucccgaggcuuggcuccgggccacuguggguacaguggagaagacauccuagcccgaaguacaagcaccuucuagcugucuuucuaagaaucuggcuacccauggccuagagagcaauggacuccugaugagcauggugacagaacauagccaaaaccaccaucaccaccaucaccaccaccaccaccaccaccaccuccaccaccaccaccaccaccaccaaaacccuaaacccacaggagaaaggcaggcucugggcaggacaggaguaggaaguauguucccaacaaaccgccgagggccugacaaggcagucgcuaaaugcaauaaaugugaauuccaaacacaggccaccuuuugggggcauuacccuuuucuccuccaccaagaauugagagagagcagcuccucagugggaugauccggagggcuguucugcaugccccguggcaaagccauuugcaggagccacccagagccuuguaggacacucagauuugccagauggcucuacagacagccauugacucuccccuaacgggcaugcuuaagccacagggaaacauccccuaagaggggagcuauaggugagccguggcuucagaggcgaagaaggaaaccuguuagccacuaacaguucacuuagauuuauuuauuuauuacaugugugcacgugugugcgugugcgugugugugugugugugugugcgugcgcgcuugugccaugaugcauguaugguggucagaggacacccugugggucucucccuucaccacgcggguccuggggauugaacucagaucggauccuuagguuuggcuguaagcuucuugaccggcagagccaucucaauggccagauuaaaucaauaaacugcugagauucuaucuucccaucucagaauucccaaggugaacaggacguguuuuaauggccuaagaacaggaguaaggauguuuccagagauguuucuuguguguguguguguguguguguguguguguguaugcgugcuugugugucuguguuuugagacagggucucacugugcagcccaggcuaaccuacucuugcuaugcaaaccaugcuggccaugaacucacaaagauccaccugccucugccgcccaaaguguaugucaccacgcccggcuucagaagccacuaaauaaaauaaaaaugaagauuuuuuuuuuuaaucuucuaagucauaaucaaugaagcagagcagaaagucaaaaggaagagcgugaaagaggugaagaaagaccggagcugaggaagaacaagagccaucagccgagacggaacauucauuacgaagaaaggcauccgcagucccccgggugcaggcaccauucuggagcugauuaaacaagaggcagccggggcgcgccccaucagagcagcaaaggcuuugcagagagaagugggagcagaagguucugcaaucacccucaaucaggcagacagggccagcugcaauacugccaggacgacagagcuuaaaugagaaaacacggcaagagauaaggaggcugaggacuccgugugcggccaggcuguuauuacauccuuuggggcuggagcgggggccgucaugagccucgcuaaccuuggggacagggacccagcugucacauaaagugggccagcugaguaucaagagguuucaacucuucauauucuuuucuuuucucucucucucucucucuuuuuuuuuuuuuuuuuuuugagucugugucucuggcuggcaugaaacuccuaacaauccuccugccucagccuggggaguagcuagaaauggcacauuuguaucacuacauccgacuuguuuguauucuuuuuaagauguauuuuuacgugucugcaggugcccuuaggaagccaaaagaggaagcaggaguucaaagggguugugagcagggaacugaacucgggaccucuggaagaacagcaagaacaccugucaccugcuugaguuccuguccugacuuccuucagugaugaacagugauguggaaauguaagccaaauaaacccuuuccuccccaacgugccuuaggucgugguguuucaccauagcaacagaaacccugacugagacacaccaauaaucccgguacccgggagcaaaggcagguggaucucugcgaguucaaggccaucuagggguuugugauaagacccugccugaaaagaaaaauaaaaagauaaauaaaucgacacucuuaaaaauuacgggggacgggguggugguggcgagaugucucaguggguaagagcacugacugcucuucugaagguccugaguucaaaucccagcaaccacaugguagcucaaaaccaccuguaaugagaucugaugcccucuuuugaugcgucugaagacagcuacaguguacuuguguauaauaauaaauaaaucuuugggcuggagcaagcacggacugagcgagcgguguugacuagagcugaccaaagugaguggggcccaccagagagagcagagguccuaaaaauucaauucccgacaaccacaugaaggcucacaaccaucuguacagcuacaguguacucauauacauaaaauaaaauaaauaaauccuuuuaaaaaauuacagagaaaguguuaaaaauauuugguacaaggaagcaaauaaaacauugggucuggagagauggcucagugguuaaggucauuaucugcucuucagacaacucaggugugauuccuagcgccuacagggugcuucacaacccacuguagcucugguuucaggggaccugacacccucuucuggucuuugagaacacuuaaagucuuaaaguaaaaagaaagaaagaaagaaagaaagaaagaaagaaagaaagaaagaaaaaaccacacauuaaaaaguuuccaguaaagcagggcagugguggcgcacaccuuuaaucccagcacuugggaggcagaggcagguggauuucugaguucgaggccagccugguccacagagugaguuccaggucagccagggcuacacagagaaacccugucucggaaaaaaaaaaaaaaaguuuccaguaucauccaccaaaaccuacuucguccucgagguucugggugaauugugaccaaaccuggcacuucauaguuuguauucugaacuuugcuuuacugaauaccuaugauuucguauaauaaaagaaaacacaauaaaagucuaagugcaucaaacaaaauagaugaaaauauucagagaaaaacaauaauuaaaugacgagauacuauuuagugugaaaaguuagcauuccacuguuccaggaggaagaugcauuaggaaaucauaaacagggaaaagggccagcaagcuggcucagcaggcaaaggugcuugcagccaauucugacacccugaauucaaugccuaggacccaugguuguggaaagagagaagcaacacacacacacacacgaacacacacacgaacacacacacguucacauaagcaugaaugcaugcaugugcacacauacuuggacauggucacacacacacacacacacacacacacacacacagggauaguguuuugacuucucuaaagccagcugcaacaucacagagaugucauucuaaugugcagaagagacuagcuuugucuuuuuuagagaguagguuucagcuguaugcauuucccaacagaaacucaacgucuauuuucaggucuggucucccauagucuccaaaugucccucuuaggcuccugugagaaagugucagguggccaaaagauggguccacacaagacaggaugggugaggaagcuuacuggucacccgucuuuaucacuauacagugaaggcaagagaugggucagaaaaugcuggggacaaagacacugcaugguggcaucugugguggcugcgaacauaccaaaggucaaugguuuguauuucaaaauuucaaauuuaccaaagcacuccauucacaugaaggaaaaaagaccagucaugaccaugaacccaagccaacggaggacaggaauuauaagacgaagcauggauaaauuaaaaaaaaccauaacacauauuaaauaaguguaugaggcugguaugagaaacagcuaaucaaaauagacaaaacuguuaaaaauaguugaaagugucagaugcucacauuccaggacugaagaagcugaggcagaaggaugguaaguuaggggccagccuggucuacacaguaagaucccgggccaacaaacaacacgaaagaaaagaaggaagggccaggcgugauagcaagagccuuugaucucagcacucaagaguuagaagcagguggaucucugaguuugaggccagccuggucuacaaagagaguucuuuguuuuuuuaauaggaaaagaaaaccccacuucuauauguaccagggacagugaaucaugcagaagauguccagccauacgaccugcuccccaggccguugucccacccaacucccaacgcagagagaaggcacucugggggugacagagccgagugcuggaugaugaaggaugacgcucugaugcgagugcauugcggagcguggacuguucaauaugagggaaucuaaaaauagaauccacccaucgauggcugaggccaagucaucagaccacgaaaaaaaaaaccccacaggcaucugagcagauuccucaccaucacccaagacagaacaaagaggaagaaaacaacauuccccccccccccuuguacaggcugaacugaagaggguucuaaaauaagagcuggcauuaauauugcaauuaguggaaagaugcuggagagauguacuugaaaggccggggccuggcgucauuguagugcguuaguuucuggggaauaugccacaugcaccacaggcaucggaggagccaaggcuagcccccacacaggaggcuaacccagcuaaccaugaccgaggcuacuacaacagaaaucaagguaacagaauucaguaaccagcagagaccggaaggugccuuaguuagggugucucuggcuaugcagaaacccugugaccaaaagcaacuuggggaagaaaggguuucuuucagcuuacacucccacauuacuggccacugacagaagacagggcagaaauccaaggcaggagcugacacagcggccauggagaaaugccacuuacuggcuugcaccccaagccaguuuucuuacagcaucuaaggcuaccagcccagggaucgcaccccacaaagugagcugggcuuucuccuauccaccaucaaucaagaaagcaccacaggccaaucuguugggggaaaucuucucaacugagaucaacucggaugacccucgcuuaugucaagucgacauaaaaacuugucagcguacaaagaaagcaucaaagauuagcaucaggcugccuuucuacaaacaggccagcuaggagaaaccugagaaggagaaaaauacucagugacaguugucaggcccugcaaggguauucccgagucacccaggaccacggugaccaccugaggucaccugaggccacccaaggccacaugugcaagguccuaguggcaccacagcuaaggcugcgcagauccuccugggaguucagcuccucucccucauggagggugagguucugauccugagagccaugaucaaagaguagguggaacacuguaaugagggcccagugccucuuuacaagccuuacagcaacagagcaacuccuaggugggagggagaggccaaggagcucuugcuacaaaauccaucuuccccuccccuccaugucgcagccagccacaacugagcaggcugacacccuucccuggaacacccugcuaauguuuaagccaccacggacacuggggcugucagcaaaauugccacgaugacagucuucaagaggagcucuuguagggucuuaaaauaauugcaaacagcaagcacaaugccagaaugucaguguguguguguguguguguaugugucuaugcaugugugucugugucuguguguaugugucucugugugugucugugucuguaugugucuguguuuguguguguaucugugugucuguguguguauguaucucuguguguguguaugugucucugugugucuguguggguaucuguguguuuguguguguaucugugugugugugucugugugugaaugugccuguguguguuugugugucuauguaucucuguguguguguaugugucuguguguguguuuuugucugugugugucuuuguguguguaggggggguucagacucagcaauguuuguguacauggcaagaaggagcccuccggccagcuguggcagggcauggcacaggccacgugugagaagccgagggagcugguauugaccuaugcaguccugcacucagcagcucagaggacccacuuccuucaguuccuucaaggccuggaauauggaugcucuggcuucacagacaaugaaaguaagacuacaguccuucaaccuggucccugaccagaccagcuaaguauucuacugcauaugggucagcugcuuaggagacaucuuugcacuccugagucaaguucagauagauaaaccugcagucccugcuuucagaucccuaggucuacacuguaccuuaagcagccaaccccuuggggacuccugcuucacaagacuuccacuccaggaccacccuugacccugggaaaggcccucacacucugaugcacagccuacaggacagggcucgccaccaaggugcuccucuaaguacguggcuuaucuccgcucuucagugaguccucggucaaacauuugccgccacaaauccagacacccuuggacagcaaugaucugaaagaucuagaauaaacuagcacucagaucuuaguuucccgaaggcacuacccacaaccacugaccuucuuaguguagcccauggccuucaggacugagugguucaaagucuccagggaggccaggacaucuucauagucucccaugugcuccacaaaguagucuggggcaggagauugcaaaggucaggggucacagaggacuccaccccucucccuagggcccucccaccaggccccaaccuaggcccauacugcucugcccuccucugauugccguugauucagguaccuaccacacaguuccuugguguccacguggcuauaaagggagagaaggagggagggaauaaaggagagagagagaaagaaagagggagagggaguuagcaguccuuaaauugcuuguuucugacccucugugcaguccuuaaagugcuugcugccuuccccccauccuagacacugacgugagccccacuuucuagaagguagaagaagaugcaggguaagccaccugccugccuccuguucugcuuuuuuuuccuuauuuggagacaaaguuauauuauguaauccaggcugaccuagaacucucaugauccuccugccucagugucuugaguguuguggucacagacuuaugccaccauaucuggugguguguuucucucucucucucugaguucgugggccauauuaugaguggauggaacuagucaggggcugagccuaggagaggggaaagggccgcagggugggcugugacuaucgcagcuugucaaaacaauaacccuuccccuccugggacucuuggagcccugggucagccuccaucauagcccugaacuucacuccuuagaccaaagcagagaagggguugguccuugcuggggguugggggagguguauaaaggcaucaacaccagaugcugcagcagagggaccaggcagggucuggguggggucugauggcuccuuucugggcuuagccucuccucuggcccagggcuagcuuugguagauccuauguucaacagcauaugucuggguaaaaguuuucuguagacuccaaggccgguggcagugacugccuuggaauuccucagacagcccggaauguugcuucugaugagugaguugucuggguaagaaaggcuuagcaacucaaggggcugaugaacauucgcaguuucuacuucggggaauauuggaggcaagaauccagaauguuuucagaauugugaccuccccuaaaguaagucuccuacuccguccuccaggacagccucuguuuuuuguuuuuguuuuuguuuuuuuagacaggguuucucuguguccugcaacucacucagucuggccuugaacucagcgaugcaccuaccucugcaucccaagaaugugugacucaguguguucccaggaggcugcagagaagcugagaccucaugcguccuggagacaguguccccugaucuacugugagaaccaaagucacuccuacaugguggcaugcccagaaaaucauacccugucaggucuccagccucagcucugugcuaccgcuuucuauacaaacagcaaacuggccugguagcaaccguguacccacaccaccacuagucucugggccccccaagugauccaaccugcccuagcacccuagaaacauuaguccucagcaccuuaguggggcagaggaaggugaccagguggcuguugcccaccuagacugaauucaggagcaucagauaaaggacagugcacacucaugcuggcuuuggaggccagguacccugugagacugcuacgggguccaagucaugagugaauuguagaaaacaacucaauuggcuucaaagccagaagugagguucaggauagaguugggauucauaugcauuacagggggugguuugggauggugguucacaggaacaggaucuuagaauguagauccugggguaguucugggauuagaacagaacggagagagagcaggcagggucauggccaaguuccaucaguccuguguauacuacagcaggcccagggucucuuaccccuugguagcacauaggacaaacucuguggcagucacacacacacacacacacacacagagagagagagagagagagagagagagagagagagagcgagagcgugcuuggcacacagcuuggcagugagagccaaacaggucugauguuuggauuacugggucaggggaguuccagaccucuugcccuuaaacaggaccuuggcauuguggagaugggaggagccuauacauccccccccacagugccccaugguagcccgggcucacuugguguugucugaaucgaugguauggaagaggcccuccagcuccuucucauuaaggacgccaucugcgaagaagaguugaaacuccuccagggacagcuucccaucaucugcaaugggcaggcaaggaagcaaguggcuguuugucuccgagagaagagcacacagugguagcccacagccuauccccacuacuacugacucagcugacaaacucccugugaucagccugaggccucccgacagguaaucccaaaccaucggaggcaauggaagcugguuucuggggagcaaacaccuucgugcccucuaccaggcaaucaccccuucugcucuucccucagucaucugacacagacacuauuuaaguaacaugcuuaaccugacaccacuagccuauagggaucacguucaaccccggccccacgucccaggcucugggauagucugaggauagucccucuauugcauccuuccucaaggcaacaacaguuugaacucagaccuucaaccuaaccuagagcaggacuuugugccacacgguaggugcuagcacagucccccacccuuuggguggcucuaucuuucgugaaguagcugggcugcauggaaaagcugaggccaaugcuaggcucaacacaugugugcuguaauugauuagucaugucugucccgggcacagcauggggugugccaacaccagguccaguuucccucuugacugcuuccaccugcuucucaugggugguaccucaguguccuccguacccagagagaacaggaagcuggaagacagggcuugcagauucucugaucacaagccugcugacauuuaccuugggugcuagccacaggccuaaugagcacagaugagcuauuaagaggaaaaaauauccuccacuuggccucugguccaauuaagagaugacaaguuauccuguagcuucaucacuucugccaauaacccaagcagggcuguuugcagguggugcuacuaaugagcaggagcccggccugccgcagugaccuuucaaauagcaagagccugugagucucacaucccgggaaggagagacugacugauccucacccuucugcuaaacgucuaugcccgucuuccagcgauacccaggggugccagucaggacucucauacuagccuucccucgggcuaucucgugcccaccacguccaagcuagucuuuaucgugagagccucccagagacacacagccuuguucuuauguuggaaggcauccugaauacauuggcacaggcccuccuuugcuuugggcauagugcccucaccgagaacacaaguccaaacacccaaccugcgggaguggagggggucaggagggugcagucuaaggcucacugcaagcugaaguugacacuccugugaccuguguugggggcggggccaggccucuuucccuggguagugcgggcucugcacagugcuaccacaucuuccguacuguuugauuucccuacaucccuguguugugugugggaucugcaggugauccuucacugccaggccugggaagaugcguaucaccugggacaggcccaaugagggcaacacuccucugcaaugauccuaacccaggccugcucuucugccuuuucauaacccaaagggcuccaccccaccccacaaccacaugggacgguuaacaacagcuccuaggaaggacauaggaacuggacaaaacuggagccaccuugaauugaaggccacuugggaagggccucagggcaggugacagguacaggccucgucaguacuuccuuccuggaugaacaugcuacccucugguucucuuuugaaaugucguaggucacucacauacaucucuuuaccuugccccaaagcucagagcaacacaggacagcuguuaccacuucagcuuacagaaggggaaacugaggcccagaacagcggcaggacuugaccucuggaucuucuugugcucuucaucuucaggaccauagucgucccuguccccaccccuagcucuuucccaugaagcaucaggacagggagugugggcagcggagcaccuggaaggaacucaccauuuuuaucggcgcggcggaaaaucuggagagaggagggcuggagucaguccugagaugagccugggcaggugcccugagcagccucgugacccagcugagaucccucucccaggagcagcuuggaagcccaaacuuccccgggagaccucgaggcugggacccagcguggagagacugcagcaggcagaggcccuccccagccuucacaagcuaucaaucccucuucccacugcgcugccagccugcccacggcugcugacagacacacacauucgugcuacacacucacgcacacccacacgcaucucugcaggugugcgcacacucaucccccuagacucucccaucacugagcacacagcugcacccagccaugcucagagaggcccacgagagcuccacgccuuccuacuguuuuuucaggacccaccuccccuugcucuggcuugccuggguuccuucugaagguggugaucuugaaaccuggugacaagaucagcccacaagaaguauggcgucauguaugggauggggagagagggcaggcagggauguucugguugcaacuagcagagacgggauuggggagcaguccuaaccugggacccacacuuugagacaaagucacuuccugcucugcugacauuuaaaucccuuaaggucaguugauggugggugcugggugcccagggccaagaggcuguucuaauaauugcagggcacuuccaaaagcugcucuguccaggccauaccccagguagguggaccagcagcuccugacugaccaaggugucugcuaagaccuccccaacucguagaaaagggaauugaugucuaacccugaacccacugaaucaguauugucuuuuaaccaauucugugugguguugaugucccaguaucguaaggucugagacaguucagggcccuggaggaauugguucccuuauccagaaggagaagucagccuauggcaugcccaggcccuccaacucccuucguuuuccuagacucagggaggucugucagggaucugcuaagccagacaagacgugccacuccucaagucuccgugagucaaaagacagauggcucugcuuaccugcagcccacagaaacagggcaagggagcugugcgcucucuggguaccccuuggcccucaagaaaccaaggugucgaaaugacuagguugauguggccccauaugacaucagguaaauuggcucccggagccagcaugagugacacuuuccuucuacucuguaucccaccucacaggggaggaaagaggcucagacagcacacagcgccaagugucgagggcaaggggcugaacagggcuucccugaaagagggcaaguagccaccucuacucuggacucuggauccuccugcccugugugugcacaucucugugugugcacaucuguguguacaggcaucucuugcuuguucccagaggcacuagaacacccauuuccaaagcccuccugcucagacacacccacagguucugagaucuagcaagggaagccaaguggggaauaggguuuccaguccccugacacuuguagggguauguggcacccacuggcaugcgugggcgcgcgcgugcgugugcacacacacacacacacacacacacacacaugaacucaugaacacacucaaaaauaccccgauucucucagaaccccauaacauguacaggcaccccccccaggaccagucccaucccccagaagccccuccacggaccaccaacucuuuccugccuauaugccaccccacucugcagggcugggguggggagagcgguguggugcaugaggcacgaggugggaugaggagugagucugggguccaagagugaggacaggaagacagugaaggaggacaguugcucaggguggagcugggggggggggugaggacgccuagguccaggcaaugauucugauucuauggaaagagaggagcuggggaaggggcuucacucgcaaagcggcacagcacgggggcucaucuacauccgcagagaagagaacaguggugguuccgggcuguguguggggaagugcagggaagaauccaggauagagaggagggggcuagcagugcccaguucuugucccuaucguagggacucaagugaugguuugguuaggaccugaagaggggaauagcggccagacuuacagcaguucucggggacugggcuaucggaugcggggaugcgggaaugugaaggaggagauguagagggucgugcgguuccaguggggaccggugccccagccacgauggaaggggaguagcguggguccgugcuauguaauuaguggaagcgggaacguggaggggggcgacugaggagaggguccucggugggugcggacccaagccucagccgcgaugggguggugggagggcucgcucuggagauccccacgcggaggagggucccaggcuaugagauauggggaugcaaggaagcggaagaagaggauggaagugaggguaauacgguccggguggaguuggggucuuggacgggggugucccugcgggaagaagaggucccagcuaugggauguggagaugagauaaaguggagggaggaauggagaggaucuugaggucuggguugggggacaggcgucucagcggcagugagaguuggggcuugcgcucgggguccccgcgccaaggagggucucagcaauaggaugcggggaugcgggaacaggcagggagcgaaugguggagaggguccuuaggucccggguguggacuggcacccagccgcgcugggcggagggucccgcgcguacucacguccaggaugacggcugugcccccucgcgaugcggcgggcccggggccgggguccgcggaggggaugucggggacgagcggugcacgggguucccccauccuggcgcccacccagcgcagcagcccgcccagcgcgcggcccugcggcggcggcucccggagcagccugugcgcgccggcccugcacaggcgcgccgcccgcucgcacaucucgcccgccgacccccgcccggccgcgcccccgcgcgcccccugcccgcgcccgcccgcccgcgcacgccgcucccgccgccggccccgcggcccggacaccgcggggaccgccagugccgggggugggggggcuacccggaccccgagccacgugcuccgcgcccgccacccccaccccgccggccaagagcggaggcaggggacugcccgcggggacgcggggcccagcgaccggacccuggcacggcccccgagggggauggcuucguucacgcagaacuuagggcggguguggaggagggugggggccccgggauugugcccccguccccgc

SEQ ID NO: 4822 - RNA, 50752 nt, Mus musculus
accuagugagaacaguagggcucaccaaagcaucgccugacuuggacacuuuuacagaguaugcgcuagcuaaugcggauacuacacugucagagagaaugggaaggugcagggggcuggggcacgacacaugccagcuuuguaagguuaugcauauuuauugaaaauuuccuucaccaacaacggugaaaucaagauccccaaauuacaaaacaugauggcaguugauaguuauaaaaaaauaaagcgaaggcuugcaucucccacauccgcgcaaguccccuucaguucaguguguccuccaucaaagaggaggucacggaaucugacuccuuaugacaucgcugcagaaaacugcacucgacugacaacagcaacagcucuguuuccaacuagcacagucuuuaaagugacucucccacaauaaauauagaaaauagccuguaacaagcaugucuuugcuuggucaggguuguagcguuauguagaaaguaugucccgacagcccuuccaggcucugugucuuuggugcacugucacugggccugaugccugaugucacugggugccuucugccagagccaagcacagagaggcacugcaggauguaccucaucaggugccugggcagaacacaguaagauagccacaagcuggagacaggguuccucggaaacaggcacuucccagaaugcucucugaggcgcuguguggccaccagagugguucaaggcuuguuagcuucuguggcuggcuacugcgaugcucacacugaugggguccuugcagggugggccugcugugcaaguuguggacgcuuugcccugggccuccuccgcuucggccggcucuuggccuugcugaucuguaccacaaagaaggccagggccaccauggcuccgaggaaggcgaagacggggauggucugucccaccuccugguuguagcggccaggcaugaucccugcaagaggacagugacuggucaauggugccacaaugguguacagcuacagccuuucugagaauccgagaccaaacuccacuagcugggcuagcaggguaggcaucacuuuugagccagaguuaaguagcccaggcugcuaaccauaguaugggugagaggcauuuuagacuguuucuaacccugacauguguggggcagacagaccuuuaucagccagccugcaucagcacggcccagagaagcuucuguuccccagagaucaauggauauacuagucucaauccagagaggaagagggcagugcuagaguccuacugagaagagugaggcagaggucucagaggccugcuggccauguucccaggggcaaugccuccuggaggugccaucagaugagccucagguuaagucagugacacuggaaccaggcaguaccaagggcucccgaguucagucucacuggcuuucaggaucuuggugucaucauaugcaguguccauuguuggccuccaagggcugggguaccuuuucccagccaauuccugaaacccagggaaaaccuucuuaggagcuaugacucucugaggaugcugugggaguuuccagaauaaaaggaccacacacucagcuggaccaauucucccagcuaaaauaugagaaccuggaguaauaaauaugcucaggccaaaaggcucauccaaucagaugacaagauggauuaccucgggagccuggugcagcucagccgggugccaguccagcuguuaagccccccagagggcagcauaacagauaagccucauagagaaaagcuguuucccgggguccauaauacguaucugcuuacagaacuuuagcaaagagcauucaaguuagucuggaaauuuuucaguguaccaugcagccaccacacuaaaaacuggucuguaaaauguguguaucgaggcgguggagauggccccgggguuaaguacgugugcugugguuguagaugcagggucaggguuugcuucccagauccacugauggcucacaacccggaacucuaguuccgagggucugaagaagagggcaccaggcaaaccagugacacacauacauacaugcaaacagucauacacaaaaagggaaacauuuaaauuaaaauguauauauagaauuuucuaaaagaaauggcgucuuuacuuguaggccuggcuuucccccuugggaggggacaccuggggacccuucccaggguuuagcccagcaagaugccugccauuaaggacucaccuccaggaaugucccaggcaccacucucuccaggggacaaaggucucacuugagggcgauuggaucgaaaguuggguaacacuacuuuguccaggucaauggagagcagcuucugauguuuccaaagauuacuuccgggaaagaggugaaaauuaaagagguaagcaguuguccucaucuaggaugcuuagcagauacacugcaaacuacaaacaacauaagggccacaugagacccucuaccucuggucaucugaucgccagcagagcagccagagcaagcaacugcuucccaguccugagaaaggcacgggucaaauccacgugcugagaucacagcacggagcgaggaaggucuguccuggauuuauaauacagcccacccaggcccauuucuguucaucacugggaagacugccaagcaaggcaagagggcagugcagguuggagcucuggaaggagccgaggccccagggugugacagaaggccuuucugagguuccaaguaacugcagcaaugcaaagcaacacagggagggaaguacauaacugcggucagcacuggggccagaccaacagccugcugggccgagagauagcacccacaacgagacuaggacagaucugcacgucauugaguacugaaguacaggugagcaggaaacgucugucugccuguggugacagccaacagaaccugugugcuggaacuuuggguucuugggugggaguaaggcaucacccaugucugcuuccucguuaggucagagcaaucagagcuaaagacuauagugaccgauguacuaugaacagcaggggcacccuguuggcaccuuggggagagcuaaaguacaccaacggaaggaaggaaggaaggaaggaaggaaggaaggaaggaaggaaggaaggaaggaaggaaggaaggaaggaaggaaggaaggaaggagucugcaaaugaacuccuucucuuccugcggucaguccaccuacaaaggguuggucugugucuucuuuacuguagcugagggaaggccaucaguccccgcagcagucgucagaucugagggcugggacgcagaccccagcagcucccggcugagcugacacagcuucagcagccuguccugcacaacucaguguugcugcucaggguuagucugucugaaaugucauuaacaaagucaucggaccuggggggcagcucaggcucccaaguauguggcuaagcagacauucuaaagguacccuguguccuggagcugguaguggggacucacugcacuuccuagcagggcacugagguaaaagcacucauguuaccacaggagucucacagcacucggaugagagaugggggcucugugucaauguucccacagcagugacugcuaaggaugccugaggcucagccaagaacuggggaagccucccucccagagacgggagcuugcccuuaguaugucagccugagcugucuaacacugggaagaaucuccuagggauucagaaucuccugagucucugaggacagaauaauuucccucaagaugugacaugugcgauaagagagcagugcagcgcugugguacggagggagagaacugcugagagcaagucagaauuaaauccucagagcugggcaggcauuaucagcacacuggagagacuugagugggaaggauuauucgauguggccagccagauagcacagguaccgccucuguucucagccuucagcgcauugggggaagagcuggguuucuggcucuagcuaacauggcugcucuuugagcaagaacugucgaucaugucuagaauauuaagucugauuugaaugcuaagauaacagaagguucuaaauaaauaaggacucaaaaauggaaauacaaguuguaaaugauacagggugauuggacuggaaaagcacucgucaauggaagcuucgggaagagcaagcaaggagugcacacgugccuaggcaugcgcugcuuagaggacaacagugcugucuucuuugcucuugaucgguuuagcaaaggcuauuauuucaugaccuccggcugcugaucccacuagacaggcuggccaguaggcucuggggauucuucugucuccgcuucccagugcugauuacaggcgcacgcuguugcacccagauuuuauuuguuuguuuguuuguuuguuuaaaccaaacaacaagugcacacuguugcacccagcauucauucauucauucguuuguuuguuuauuuaaaaccaaaccaaacaacaccaaaauccccauggguccuaggguucuagcucagcacauggcaagugcuuuacuaagccaccucuauggcgccaacuuucuugcuuccugugacaguauccuaagacauggucccugaggagggcgcugaggccugagcucaugaggaugaguaaagcacacaggcucucacagcagccuggcuggcuccucacagcauggauggggagcccacugcuggcuauaccacaucuguccaucacugaaccaagcauagcggcagcuuugaaaggggagggagacgagaagagaggcaguguucucuaaaggaagccugugucaggagaggcugagagagcagcagccaccugccccguaaggggauaucugcagggcccugggacaccaagcccuguuaacuuucucccaucuuguccugcuuaaacaaaauaccagagacagguagaaggacaaguuggauaaacaguuuggcuugccuggcugcagagaaauuguagugggaauguagaucugagaaauggaaugggauaaggcaaaugugaugguuuguauaugcuuggcccagggaguggcacgauuagaagauguggcccuguuagaguaggugugucacugugggugcgggcuuuaagacccucauccuaguggccuggaagucagucuuuuccuagcagccuacagaugaagauauagaacucuuagcucccccagcaccaugccugccuagaugcugccaugcucccaccuugaugauaauggacugaaaucugaaugugugagccagccauaauuaaauguuguccuuauaagacuugccauggucauggugucuauucacagcaguaaaacuguaacuaagacagcagaugaacaacaugucaggugagagagccaaagccacacggggcacacaugagugcagcaccugugcacaaaggccacagucuacauaacaugcacuucuggcuggacugucacagcagaagccauaccucuuaggagcagcuccagcccugggugcagaaggagagcaccaccugcauuccauacacaacaccuuggacaggaagcacagcuauacauggcagcuuucaaauccuggacagcagccagagcucggcuccugcucaagugacagcacuuggcuggacaccaccuuucuuuccaagucacucuaccguaggacacuaccaaaauaugcuuccaaagaucaauauaauugucagaaaaggagaacuagaccgcauuauuuaauaaucacaucagcagaacugcacugucuccuauaaacaaggaaugagucacggcccuggggaacagugaggacagcacugcacacacacacuuaccugggugccgucucauucaaaggcuguggcuuggcccaugacaaauguggacaggcuggcaggggccgagguuucgggucucccaagugggcuucaagaacuuuggaguaccgauggaggugguuuccugaggucagcagcaguaagaaaagggcagugaccaccauuguagaauacagaagaaaagguggcucuaagugacuguguguuucuggugacaguucacuguguugucaugcuacaccccacaugcuucaggaccacacucgacagggugccugguuuccuuccccacagcauacuguccuggaagcaccugccucugccucccaagggcugggcuuacagacgugcacaccacuguccagcgaugcuuacauuucucuaaucuugcuauccacacuacagccuccacacauggcacacaugggaugggugccgcagcccugagaaacuuuuaaacauuagauucaaauauguuauuaaauuuaauuuuaucuuuucuauuuucuuuuaaagguuuauuuuauguaugugaguacagaagagggcaucagaucccauuacagaugguuguaagccaccaugugguugcugggaauugaacucagaaccucuggaagggcaggcagugcucuaaccacugaaccaucucuccagcccuuaccuuuucuacuuugugugguauguguccauacauguucgugugucuguguguguguguaggucagagaucgaugcuggaggucauccucacucugaauuauucucaugggaucuggaacucacagcugacuggcuggccaguguccuagcucacgcagagcugggguuacagccgugcucugcugcagccaguguuuaugaggcugcugagaggaucugagggaaguucuuacacuuuccaccccccagcccuccuuacauugauguaggcacugagauuccuuucuucaguuuuggcuuccuuuuauuuugagauggggucucacuguaacaggccagucuggcuuccauguagucucuucccuuggccaccacagugucagaacauaggcauacagcagcacgcuggcugcugcucuaacacucuaacuggcaucuguggccgacauccugauucugcagacagugcugccagggaggaacaugagcccaacccacccggccccucacauggcccaagugaccugagcuaacuguuuaacuccuguuccuguuucuuuaucugcacacaaaaaugaauacuaucucuuuuuacaggcuuacugagaggcauuugugagcuaacccuuacaauguacccagccaagugccugugcccagagaguaccagaagauacugugccuuaggggugggaugacuugguagauaagagugcugcugucuugcagagaacaggaguucaggcccaggaccuauguuagacagccuacaaccccugcaagcuccagcucuaugggggcucucuccaggcacuugcauacauauguauagauccccacacacaaacacauuuuaaaagaugcuggacuccaugagcguacccacacacaggccacagucucugugcaccugggaagaggagaugagccgucagcaaccacugggaaggguucaaagcccucccuaaagggcagguccccggcuggcaguacuuaaguggcucaagucucugcugaggcaccagaagagacacucaccuuccauccuuucaggaggggccaagccggcuccgcuaggugggcgcugccgguucccugaauggcugaggcugggaggggucacgccauaggauguguacugaaggagcgcauccagaagccaaaagcagucugcaaaguugacaggcacacuacuuaggaacuguuuuuuuuuccccaaggguuuccccaggguuucucuguauagccccggcuguccuggaacucacucuguagaccuuguccuuaacucagaaaucccaucugcagcugccucccaagugcagggauuaaaggcuugcgccaccacacccagcaggaacugauuuuuaaaagagaacacugaaguggguugcccugaugcuguuuguauucugauguuaauucugcuuccucaagaggggcgguccccucccccaugcccuuaagcaguagaccaugugcucaggugacagcaugugaaccuuuugcccauuuuaacuggucaaauaaaggcuagaggcugugauugggcaguggaaggaaaaggugggauggaaggaaaagaagggaucaaggucuuugagaguuggggcagguaggaggaggaggaggagaaaggauggaagaggaagugaagacagaacagaacgaagucaggaggaacccccccccccccaggaaacugaagaggaggcucagaagugagccgcuuaggucacuguggugcugacagcccuccaggcucuccuacuccugagaagaguguuuucucuacaggcagggcucuagccucccagacaaucuguuccagcacccagggacuggaggcgggcuuuaucuaugucccaggguccugggcagcucagcaccaaugugacugcauuagaccagcucaugagcaaagacagaaugauguucacuuagggauggcaaaaccaugugauacccauugaaaaaagaauggccuccacacaaggagcgccgaggacaugagcugccaccaaugacccgaagcuaucaagggaacaggaaauaggucugaacuagacauggggaguccaggaucagaggggaaagugcauuaucugagucagugguccucaccaggacggucagcucuucucugcaugucagaguccagguccgagaauacaagcagcugucacucagagcuacccaaagcuucugucccacggaagcugcagaugcucuagucccagaccuggucucugucugucuauccccccccccccccauuuacccagcccaaucccauuagcacccaucuggaggacagcagcuccgugagaggggaagguugcuaagugcucugcucaggaaaagcaugcacuucuggccaagggccaaaagccccaaggacccaaaucgcugccaucugaaauguacaggcguggacagucccuuuagacacuuaaaacuuuaauaaagacucuuaccaggagagcucagaucuuaaagagaauuucuguggcaauaaaacauuaaucuccuaucugcugugacuuuaaaccuuacuuuuuaaaaccaaucacauucucaggauuuauguaagcuacugaaauucugucaacaucaacuugaaaucggggaaaggagcaacauccagcacauguccacaccggugaccccguccccagcacucugcaggguccacaccggugaccccuguccccagcacucugcaguguccaagacagagaccugcagcauuuccacuguccccucccugaaguaagaaaauggaaguccagacacaagcauaugagcugcauaccuggagagcacaagagacagcugcagugggggcacaacagagaacucauucugaccucuuuaagcucugucuuugagacaaugacagaggccccucacugacaaaagcucuuagcacccaacuuaggggagagcacuaugagggccucuaagacauauggcuugaagaggggccagaccagagaagacacacauauaggucacacaaccuagcaagaagccugaaaaaggcaggagcugggccaauuggguuaaaggaauuuuuuuuuaaagauuuauuauuuuauuuauaugaguacacuguagcucucuucagacacaccagaagagggcaucagaucucauuacggaugguugugagccaccaugugguugcugggaauugaacacaggaccucuggaagagcagucggugcucuuaaccacugagccaucucuccagcccaggacuuuguacuaagcaagugacagugccucaugccugucacagucaguugggaaaauagagaugggauucuaaggucuguagagguuuguguauccugaguguuaaccuucagguauaugcagaaauauuccagcaaucacaguaccuguuuauucuccagcuucuggccaguaucauuccagggacaacggaaagagggcuguguacacaaaucuucaagcucaugaacgucuuauucuggucaugcuggggauugaacucagggccucgcaugucugaggcaaacugcugugccacugagcuacagucgcaguccuccuauguguucuuuucuuacccuucugucugugacugucauccaagcaguuggagucuccauacagcacgauccggccuccaccuucagauggaaucugauaaagccccaaaaugggaacauuuuccacaacugcugucucuuguuuuaagaccuccaauccugcaguaaacaaugagaagagcacugaguucucaugaggaaauuacugauuuucuaguugccacuuaacuggaaacugaccugccuaagacuagcaaaauacaacagucaaucagaacuguacaaauccuuagaacagggaagcaguauuuucagcauuacuaauuuccauuuuaacaaaauccaacucucacaaaacuguauuuacaggaguaggacaagcguaguuaacuuuuaaaaugugugcccauccacaugccauuuagauauaagauguaagcacaggcauuagcaauagaaccccuaaagugccaagcagacagcacaccuugaaaugcucgaugaaucgagauguaaaaagguauuagugcccugggcagugcuaacagcggagucacacuguuuaagcuaaggugccuuagcacgaggggccauacagccugagaauccaggagugugccugcacaucagcucugaaaugccuaaccucucuguggaacaggagaguuaacacggcaguagccccacagcuagacaagaguuuugauacuugguuaucuuuucucucuaucuuguucuguuuggugauaguggggcuugaaccuaggacuagcuaagcacacugccacugaacugcagccccaccccuguccugccugucucucacacaggcaggcaucaagcuuguguucuccugucccagcugucuggagaguuagcacgacaagccucgcugagcuuugaaagugaggucuuuucugcucuagcguaacaagccccacagugucccaccucacauccaaagacguccagguuuacgucaagcagucaacguuuagauggcacgacacacaagauaaaguaugcauuauuaacucugcuuuugcuacccccuucuccaaauuacugaacugcagggggcaacaagcaagcuaggaggccauggcucuuagcccuggaaguggcaagccugagauaacagcauuuagaaaggacuaauuuacagugaggggggccaggagcugagaagauaaaauugccaugugcuugaagaggccucacacaguuacacugagaaaucuacugucacauuuucaauuguuuuguaaaagugucucucaguuacagaaaaauaaccaucuugauugauggugguguggcuggucgcucugaagccaggccaucgguuuucaggaggaaauggucccaccagcacauggucaccacaggcuaucuuguuagucucuuagaacuuagcagagauaugagauauggcugacagcucagaaucccagcucuggagugacagucacaggaagagcuuccugugguccagucccacugcccugcacauaacuuuaaaaaccagaggcuguauaguuuguucccgcuucucccaacucagcaggucuggggacuaaguggacuauuuauggugaguucaccuucucagccuauacuggggccuggccuggcuugagggauguuugcuguggguaaauacagacaaucagaaaugccucuugaaagggaagauggugucuuacucuuugaauuuucaucaggcuaagaacucucaaaaucauugagacuaugccacagcaguaugccuagcacagaagaacccuuugacugugacuaagaccauuuugagccccauccuggagaacucccccucuuuggguagacuauacacuuauauucaaauuuucagcaagaauucgucuugcucauuugggauucccccagaauccaugccacagucaguacuauacaaauaauacugcagugaguuuuaccaggaaccagagaggauggaagggaaggcccauacugcuaauggcacuccuaaugccacaaaauacacacugggaacauagcagacacugcuaaagccacacuuaggagaaaguacagcagguagggcauauggggagcuggagagggaggggaagggcaccaggccugugagcagcagcacccuuccuuuaccuugguccuugaaagucugugugaucacgacgccaucuucuggaaacuuggcgaugcugcaccccgacgcauaguacacuggaagacagacaggugcucagcauuaagggguggagacguccaacaccugccucacugacccaacaugcaucucacacagggucuacaccacucacucacguuuggacagucuuuaaccugaagagacaaacugcuauugccuguuacauaucaacuacaaguaauccuuucaaacuucaagggaaaagugcuaguagcaugcgguuucugaagaaaaaauuuaaaguacauaaauaaacuuuuuuuguuuguugaaaagaguuucauuauauaucccagaguggcgucaaacaccugucaggcuuugccucccgagugcuaggauuauauggucaguuuauguugugcuaaggauggaacucagggcuuugugcaugcuaaguaaauacuuuaucaacugagucacauguccaguucauuuuucuacagugaugcgaacugaagcuaaguucuugcacaugcaagacagguaacuacagagguacagccccggucccuagugugcuauuuaaaaucacuguaggucuuucugcacugcagcuaacuuuugaaucccaucucucugaaaccuagacuuaagcauguagcccacacccucauccuuuugccacuuguaugccucuacacacagacauaaaaccuuacugucaugguuugccaggacaaacuccccuucauauaggccgucacugaaccccauguuccacacagacagcagcucauucagagcugggauguucgcuccuccggugucuggcauccaccacugccuauaaaaguggcagaaggcacagagaaggcaagaauuaaaauccucacauacuuuuccucuuuccuugacaaaauccaguccacacauacauauaaaagugucaacuuaaacaagccguuugguuugagaaauauguaagcuuacuacuccagccaacugucugccucuacacacagacacacugaacuuuucuuuuaugaaaugaaaacuggcauuucacuggcaugcaguccagacaggccuagucuggaucuaggcggaccagugaagcagaagugagaaaggaggcaaauacgcuaaaggaaauccacaacauaagacgacauuuacagcggcacuccagcacccagcgccacaggucuuaggugcacaugaacuuucuuauguuugguaugaaggacacaggacagaacagcaugcgacagagagugaagaacaggugucugugcucaggaagggaggacacugaccccuuagugagcacugagucuagaaaccugucucucuaccaggagcuucuuguacggagaaaagagcuuucuccacgaucuagaaagacaaacccaagcuaggacagucacacaauagccugcuggggagcugugacaccauacugcuaugcaagcguaccugguguuuucaucauaaaacuucacuuuucucauaacagaaguguuguaccagucacugaagaugacgagggaaaggccauuguccacaucccuccucagcuuagcaaucuccucagggaaguacucuuccucacuguccaccagcagcaaagugccugagggaagcaaugccacacucugauaacugucacuccuaaguggcagaaaacaauuccacagugccaucucucaccaguguccugccucuaggagucuggcuggugccagccugcaccacuacagaaggagguaagcaagccacaaggaccagcuaacugugucuuuggcuuuuauauuugcucaauauaauauuuugcauuuacuuuggaaaaaaguaguauauauauauauauauauauauauauacacacacacaguauuuuuuaaaaacaaaacaaaacaaaaacgguugggccagcaagauagcuuagcauauaguuccuucuaccaaaccugauuucacucaggauccauaaacgugcgugcgcacacccccccccccaaucucugcccacaaucagcucuauagucagcugagcauuccgaccacuagugaguaugaacaccaugggagccuugcucugcaccuccgcuuugacacggggacuccacgcugccguuacuggccuaucaguggucaucacgggaacacucaagaccuggccagcagggcugcugcucaccauacuguguggcgucaaaacaugugaauggggcgccgagcaccuccacgaaguagcccaugcugcgcagaugcugguacaugucccugaaguugguguggacguggucgccauuccugaaaagcaacaagcacacgguucagaccaccacucugcaggaaaagacggggcacagggcugauccucuccagggcugcaucgccugugucagacaagcuaaagcaucgaugagagagaccugugugcacggcacgagccaugguaacaugaugcagggauaaggcucacagaguccugagcaguacuuaacaggagccaccugcacgugacaagcacuauggggcugcagagaugacugacacacacgauugcccgucgcccugucuugcuuuccuuccgaaacauguucacucuuccucugcacagccaggucaacugucuaagugccuggcaaaaaaacuuagagcccaucuccuugcaacgcccaccugacaggcuccugugcagggccauggccuugccugcuggcugucaguuuccccuauuuccacaccaccugccuuucaggaaaaucuuaacucuaaaaggaaaucuggggcuaaagagauagcucagugcuuaaaucagcuguucuuacagaggacccagcacccacguggcagugcacaacuauuuccagaagagccaaugcccuuuucuggucuccaugggcaccaagaauacaagugaugcccagacauucaugcagauaaaacaucuaaacacauaaaauuuuaaaaauuaaaaauaaaacaagcaaaucugacccugaaucaggauucugauucccagaaucaagccagaguggaggccacgccuuuaaccccagcaaggagaaggcacuuuucugugaguucaaggccagucugguuuaaagauugaguucuaggccagccagggcugcacagaaaaacccuaucucaaaaaauuaaaaauaacauaggaggaacaacgauaugaacuaaucaguacccccagagcucccuggaacaaaaccaccaaucaaagaaaaaacauggugggacucaagacuccaguugcauauauggcagaggauggccuaagucaaucaucaaugggagaagaggcccuugguccugugaaggcucgaugccccaguguagggaagugccagggccaggaagcagaaguggguggguuggggagcagagggagggagaaagggauaggggguuuucagaggggaaacuaggaaaggggauaauguuugaaauguaaauaaagaaaauaucuaauaaaaaauaaaaaucuaaaaaaaaaauaaaaauaaguaaauaaaccaaaaauaaaccaaaaucccagucacacggucugaucccuuuccuccucaccccuccaccacggagccuaagugccacuucaacccagagccuaagccccacucugcauuaagagaaaccagccugccuuugaggccaagaggaguagcaaggaguagcaagcaggacagggccugaggcagucacagcagccacacagagcuggcucgagaggcaggggagggacagucugaagcaagcugugaggagugacugcuuucagauaaucauguggccaacacacagcggauggaauacagggaaacaacaacaacagaaccagaaccugucaagaggagagacaugucaccuaggccuaagacagagccaaaggaaggccacacaugggaggcuggagacagagcuggaggacggacagugggacugaccugacuugccacugacucaguggcagacagaaaacaaaagacaacagaggauaaggucagagauucuguugcacaaaugcaucucagaaguuagugucaucacaacacaggcucccaacagugccaggagaaagcacacacagcccugggggacagcgugcaggcaaagcugcugcucaccagucuaaagggucauucuucauccgcaaguugucccuggggaaguagccagguggguagcggagguugugguacuggucccagaggacucucuugcuccgaggaggggugggaaugaucuucaccuugaugggcagcuucacgguggaagugugcuccgcaccacuguguaacugcaaaaggagacagagaaaacagaaacuugaaauguaccuugcgaguaucugaaaagucuuagucuggguuuuaaaauaccuuuuucuuuuccucuuucccucguuucugagauaagauaucaaacucaggguauggauuccagaugcugggaugacccauacaguaccauaccacacucagaaaaacuguuucuauuuaccaguuuaagucacauaguuuaaaugcaauaauguauagcaauaaaauauauucauguguugcaauuaauucuguucaaacucaagaagaguugaagacuuaaaauucaggcauuuuauuccuaaaagccacuagagcacacaaagccaaccucauauguccuaccuggagaccaauuucagaugcauuaauucugagcuagaaauuaggcccaaggaaguccugccugcuaugacgcagcagcagagcauaagcacagagugggucuaaccuccucagaguguaagcacagagcgggguucuaaccuccucagaguguaagcacagagugggguucuaaccuccucagagcguaagcacagagcggggucuaaccuccucagagcguaagcugcucugagggcaauucugcuccacugcucauggccaugaggcuaauucagucaaccugagugauucauuaaauggaaacccccagcucugagucuguuccccaccucugcucuccugucaggagcuaguaaaggguaaagaaaaacaagccacaguguccuggugacccuuaccucugucucugcuggggacgccacugugaucaugauguggcccugagcgaugccuucccaggaagcugccuucuuggucacagaaauggagauggcaagguaaccugaccagggccacaacacugaggaguaggagaaggccacuucaauguugucuccauucugugguaaauagggucgccacucaggcugcauggaaaagaaaucaggucaauagugaagugagguguguggaacacaagagugacccuaagggagcuacccuggcugcgcagauggagucuuggacauaagacaggauguguguguucugcaagguuauaaagcugccauuccauaagaaaacagggugcacuugucaagaguucuccugucagaugaagagaacugacacaagugaccccuuuagaccuauccucagugucacugaaaugucacugaugccagcugucaccaaccaaauccuacaacuacugaagggcaccuggaggaaggucugugacugcccugaugugugauaugcacaccccaccaugggccagaggggagaggaaaaggaggcaguaagagagcuccagaaaccguacagaccuaagucacugacucccucacaagccacacagccacagagccaggacaacugcccaggagacuaggaagaguucaggggaaaaagaccaugcaggguacaacaccacacaccccagcguuaaugacuacucuugggccacugguuagcaacuuaggaaaaaauaccaucaaucucuucuacaacaaacuuuaacagaugaacaaauucaauguuuaaucacugaguuagugaaguauuaguauaaauauuaaaaaaguacagaauuagccuaaauauaaaacugacuuuauuauaccucuguaagggggaguuguaauuuucuaaaaaacagaagaaaaaaaaaaucacacaagaaaaaaaugcagggggcuggagagauggcucagcagcuaagagcacugacugcucuuccagagguccugaguucaauuuccagcaaccacaugguggcucacaaccaucuguaaugggaucugaugcccucuucuggugugucugaagacagcaacaguauacucauauacauaaaguaaauaaauaauucuaaaaaaaaaaaaagaagaagaagaagaaagaaagaaaaaagaaaaaaaugcaacaauaucaaaauagaaaacauuuggguuggugagauggcucagcagguaagagcauuaacugcucuuacgaagguccugaguucaaaucccagcaacuacaugguagcucacaaccacucgucaugagaucugaugcccucuucuggugcgccugaagacagcuacaguguacuuauaauaauaaauaaaucuuagaaaaaaaaagaaaacauuuacacaagugaggauuaauaaaaccaccacagaaagucauaucaaguauaagaaaacaaugccuggggguggaguggugagggcaacucuacaaaacaaacaagaaccaccaagaguuaucuuuucuaaaacggagacugucagagcagcagaggaaacuucaauuccaguaaaaaguagacaaggacacaaaacgguaacuggcacugagagaaacaaucgguaaacacagaggugcccaccccagagaguuguuuuauacaaacuucacuaaccagaucaucuaccucuaaaaggcacagacagacagacagacagacagacacacacacacacacacacacacacacacacacacacuaaaaaaagugacaauauccacacaucagaguaucacuagccauaaaaaggagcaaaacacagaaugacacacgaggaaccuugagaacauucucagugagaaaagccaggcacagcaggacugucucgagcaggcagauccagagauggaaagcugacugagcaagguguaaucccagcauuugggaagcaggagcaaggggaucucugugagcuggaggccauccuggccuauacagcaguucuaaagcugccgguacuauaaaugaagagauccugucuccaauacaaaaaagaaagggaaaggaaggggaggggagacgagggggaaagaaaggaaagcaaagcagacugagggccaagggauggggaggggaggaaggacagagcacaugcugauggacacauuaucuucaggggugacagaaauggucuugaaugcagucgaugcuggcacagccgugugaauacauuaacaacacacucaaauuuaaaagacccucaugaaauacaaaaaugagaaaggcaugucacccaggacaggcauggugcagacaucuccauaaaccccagcaacagcagucuuggagagaaguuaguguacgcaccaacaacugcaguaaccuccacccugacucaggcaggauucucaucuagggaggacaugcugaggaaauaccucagaagaaaagaaaacucucuguguaaccagacucuuuguagacaaaagccaccuaagugcucaagugaaggcacacagugagccaaugcuaacccaacgcccaucgugcggagacacuaaagcacacugcuguuucagaugccuacaguggacagacugaaauacaguuuuguucaccacacaaugacaacaaacgacaagugguugcaauaaggucugguaaagagccgggagugguggcgcacaccuuuaauccuagcacuugggaggcagaggcagauggauuucugaguucaaggccagccuggucuacagagugaguuccaggacagccacaacuacacagaaaaacucuuaucuugaaaaaccaaaaaucaaaaaacagcaaaaaaaagucugguaaaggauauguuuaagagcuggagagauggcucagugguuaagagcacugacugcucuuccacaggucucaaguuaaauucgcagcaaccacaugguggcucacaaccaucuguaaugggauccgaugcccucuucuggugugucugaggacagcaacaguacacugacauauguaaaguaaauaaaucuuuuuaaaaaauguuuuaaaguaccugguucuggaggugagguuagaaaaccauaaaaguaaaauucaaaacaagaaccaggccuucuauaggccuacaagugcucaguaaggaagaaagucauuuucaucgggcaguagcugugaaaacgaaaaggugcucugcuguuaggagccaaagccagagaaugaacugaggccuuggcuuuucuauagaggaacaggucuaacuuucuguacagcaucugccuacccuaccaccgucugaagcuugagcagcugaaaggagcccagcacccacucccccccagacaguuucucugcacagcgcuggaugaccuggaacucacucacagacuaggcaggcugucccugaacucagagaucugccugucccugucuccugagugcugggacgaaaggaguguguaacacgcccagcuaagcccuucucucuuaacuucaggagggacaguaacuaagguacaaagucugggccacgucacacagagaaguuucaccuuauccacaauucuuccugugacgcccaugccauugaggauggugacauuaacgauuguuggcauuccuccauaguagauaggcugggagcaguagggccacauguagggacacucagucaggucgauguagcuaggacucaggcugaaacaagaagagaguguuacuguagaccacaucagagagugccgggcacagguagcacaguggggcugcacacuaaaggccugcuuguaggguguccuggcuggcacugagggugugcccacugugcugcuccugacuguuacagugaccagcagagaugugcaggaagcaccuccuccuccugcaguugggcucugucagcucuauggcagcagacuauggacugaaguuucaggaggcuuuccuggcaggcacacccauuuaccaaugcagucugcagucaacggaacagcucugugaaacccugcucgggggcggacaggaguggacagcacaggaacugagucuagauucccccagacuuccugcacgucagcugcccuccucccuuacagcagggauucuugcucuggugcaccaggcacccucagcugagacccaugaaacauucccacagaaugcugagccuggagaggcuggggccuggccgagaugcgcacaagugcugacaaaaugauccugcauguucuuucaucuguugugucugaacugcaucugugccagguuaacagcguuccuagccaacccuggggucagcuaucuaugugcaggaaguguaugcagccgcagacagugggcaaggcuguuccuuacuucaucucacuauggugcacucaucuuaaccauagcugcacaaacugaauuacuacauaaaagucuaacaguaucuuuguguacauauuuucaugugcaagugcgcauguguguaugcacaugaaggucagaggucaaccucagauauuguuccucagaaugaauguucaacguguuuugugggguagggugucucaccauaaccugagccucauagauucaguuaagacugguuggccagcaaacuccagagagcgggcuacugcacucagcuauuuauauguacucuggggagagaaugcauggccucaugcuugcacagcaauuacuuuacagacugggcuacauccucagcugagcaccgagagcucagagacacacacgucaaaugaagcacacauaacacaagcagccuauugggccuagaccagaagggccugcgugggagcacagguaaccugacugcagcuugcccuggugccaucaacaugccaacaucagggaaggcugagaggaaaacuucuggguucucaauacuaucugugaaacuuggaugcaaaucuaaagccaucucaaaacagaagguaaagaacggccucagaccaaccaugagaaaauggcagauaaacccucaugaagacagcuggcucuuuauuccaacuaucgaagcauaaauaacagaacaggcaaacugucaggggccagugaccagagaccagggguaagaaaucacaacauagggucuggaaccccaacaguuaaaagacacaaggggaucgcauacagucugaguggccacagaggcccuaucuacaaagccaguguuacaugugacuuccaauacucucaggucagcuaagcuguuggcccucucucacuggggaaucagagcaaacuguauaugacaacucuaucuuugcaaacuuucugcaaacuuaagauugcuucaaaaguguuaaggaaaugcaaacucuucuuuuuucuucuucucgagacaggguuucucuguaacccuggcuguccuggaacucacucuguagaccaggauggccuugaacucagaaauccaccugccucugccucccgggugcugggauuaaaggccaccaagcccggcugcaaacccuucuuuuugcuacaccauuacggugcauagcauuagcgggugcagaggccagguuucugcaggcagcaccuggagaagcagccuacaaccuuaccacugagcccaaguguggggccaggagcccugcugucuagcuacugcuaugugcagaggaggccagaaggaaaggccugcugagcaugccagcacauacccaccuugccugcgguuuauagcugcugaggaucugauaagcucgcagcagauccaacuugccaugaccuugcucgaacauguugaccccaggaagucuccgggcugacgcuaucaaagcuugcuucacacuggcaggauucaccagcucccgcuucuguacugugcugggggaggagaagcagucauugcucacuguucucaggaugggaugaaaaccaagcagccuccaacuggcaagagggucaguauguggccugcagucuguguuauagcuggcuggacuuccugguccaguggagccgugagaugagaacacuaugaacuuaacaggcccuuguggcagguuucaccgaacacucaguaaagcuucauauaaguuuccuagcagugacuuuguaggcucaugccuauuuauacaaaauucauaaauaauacaguuuccugauaaucugaauaaaucaaucacacagguuacaagagggaaaaucaucauagagguucaagguccacagggagggucaccugcuggcugagauauaaaggaagauagguggguauuggagaggaacccaacacagggugugcaggagguacagggugaggggagaccacugccuccagggcgagcccuugucuuuggguuggguuuggaggccugagaccacugagcaugcugccggcacacugcagcuccacacacuaacauggagccuugcuugcccagcauggaucacucuaauucugaaauuucacauugacguaucauagacaaauagguuuuaauaacuagauugagagagcaguugucaggcaaaacuggaaaacuuacuuuucuacguagccccauaaagaguaacuaaugguggagggguaaccugagagccaaggcaggacuguuaacagguaaccagacagucaaaggagaccguggggcugggccuuccugaggaagaaucagaguccuacuggaagcuguaggucaguagaugucacuuccucaaugagcaccuaccacagcaggacagcuccugucagcaccacuucugacuagcacacuggcaugcgacaugaacagagguagcugaaggcucccucgacgcugaaaccacuuguguugagcgcugcuacugggacagcaagcacagcuccucaccucccacucacuuggcaggagacggaggaugggcuucacagagaacugggaagccuggcuuccugcuaacaguuaugugacagacaaaaacagagcaggaguuucuguuucuagacuccacagugcuagggccucgggccugcggguuucuuuacuccgcacagaacacauacagaagucuaagucugccuucccuccuuuauugcuucccaggggagagccaagcagugcuucugcaaggcacacacuuucaagaaccuggcucuaaccuauaaggcaaagucaggcaagagaugcacugcucccgucgauguuaccaauaauauaaucucugcuuuuagaaacugagcauacaauuagcuaaauuauaaaaugagcauagaaugcgaacuucaaauauguagagaugugugcuuauguguguuauuacaacaugguaucucaacagaggaggagagagccugaugucaggggaaugcaagugcuucaaagacuuaaccgagagaaagggagcacggcccaucugaccacgcgccagggcaggcgugcuucaguucugcucuaccacagcccagaagcugcuucuaguuucaucaccuacagaaggaagggccgaggacuaagguccacuccaacuacagaugagagucaacaggacagaaugcguggcacagagacaccugucagucaucaaggacacuggcuggcuggcugucaggaccuaaguggcuucacagcuuagcuaagagcauggaaacaaaacacgaggugauggcuauguuaacuugcuucuuaguagaaaccaguuauucucugggucccaggacauaauguuacagauguuaacuuugcacagaacuuuaauaagaggguucagcaaggauacgugcuuguuuugugcccuugcccacccgguacauauguuguaagaacagcccagcccagccuaacccagccaagccaagcaaagccgcaucucaauuguggagccauggaaacaauagaaaugugcccugcaggguuucuggcuuacuccaguuuccagcuagcagagagggaucguuggccuccugugggagaugagggagcagagacaccaacuaucagugugcaauacucaccuuacuaacaaggugacggccccagcgaccacuggggaagcgacacuggucccugagagugcacggcagcccccuuucacaccggaaccccgcacuccagcaccauaggugacaaugucaggcuucacacgaccauagccuccugguaauuccuauaaacaaggguagcuugguuucucaucacaucuauagcccuuagccacacacggguuauaugugaauaaaaucagacagauuuaaacauuuaucugacaagaugcugauuugagucugaaauacucugcaaacugaagacaagcuuuagugguaacaaaaacaaaaccaauuuaguguuuuauaauacuaaaauagcaaaacaaggaaagauagcuuugcuaauauuuuaauaauugcucagaucagaaaguagccacugacgugucacugagaaccagcagccgcucuaucuucugauagucgagaaauaugucagagaauuaagaaacuaaaaccaaaaaaaacccauuuacagguaucuucuucauaaggaaaauagaacaugguuaugauuagcuguuucaaagagcaagggaccacugagggcaggcaugccuacacagacaucauucuauucagaucccuaaaaaguggaccccgaugagaaauauauacaaagggauuauaaacucucuuccccauacccggccuuuucucugaaucucuagacacagccuugcugggcagcaaagacuagacuugagcuuuccugaaaucuuuuguucuugucuucuuagugcugggauuauaagcaugugccaccguagcggcccaagaacuuaaauuauauucugcugagaaaaaaaguauacuuauuugaaaugcaaaucuucuccuggcaaucaguaacaaaaggaguguagacacaugggcaaagugugaagacgcuguuggccacagcugcauagacaacucaggacuauuucuccacagcacugaaaaauaagcccuugaggaagacugaggaggccacaguugaagggagcugcagacuccugcuggcaggugcucugcuugcugcuaccugacagcacaaagaacaugcugcggaacacacagcacagugcaggccugacucagaggagggucuaccagaccagaccaugcaucauggcacugaaugggucagcucuagagauggcauccuauaugugaggacagagacuuagcagcuaauggagcccacaauguacagcugagcuggcauggaagacuauucuagaguacugcaugaugugggguggggguggacaaggccuaugugcgcccacaaagcugucaaccuuucugggcccuucuugauguuucucagagcuuugcacauauucaaauuagagcaaacagacauguucuaaccccaaagaacacuaggggcaggcgccucccagucacccuugaaggaugaagugacacacucugacuccaugcagcuuaaucucuaacacucugcaauggcugugacagaccuggcaucagcuacucuuauugggcuuucauucugacuucagugcuagggauggauuuggggucuggaacuugccagccaacguucucccaugcggcuaaaucaccaaccucggaauuuacuuaaggccaaagacaaccugagcucguacugaggaaagcugcugucuuccucuccuucaccuauacuugugcuucagaggaugguaaaaaaaagacaugaacugggaaaugacccucagaauccacccagaucuucaagacagcucaauucacugaacuaaaaggugguuaacaccaaaguuccugaucccuuguccucacaggggacgggugguguguguacauacccacagcccuggcuacuucucugccugugcauugacaaaacacauagcaaugcucuuagaccgagggcucugugagucccauuaggcuauuacagaaagcauacccagguagucauuccccuggaagaaaagcgagcgauguuaucuucaaagucaaugccacccacuccaaucacauccaucugaucagcaggguuauucagagugcuggauugagacacacaaaagaaaaagagagagagagaaaaaaaaaggaagaaaaauaauuuaaaaugaauaauucaaaccaggucaagcacucccagagaaaucuaaggucauuucugucuucuguccgaaagugcgcagcuuugacaggaggcugcaccuuagcacgcacgcaucuggaggguuucuuuccccugcauuucagguucccucaaucucuccuggccaugggcuuccccagagccuccuuagccgucucucacucuucuccauguucucacaccaaucugaggccgucagcgugccucgucugucucuuccaccagaacagacacuauccaggugugaugccacaguuacaucuacuguaugugccacuuccucaggacaaugcgaggacggcuacuuucacccugcaauuuuaagcccuuagauaacagacacaugccaggaccucacagcacuagagcugcacaaaaggcuauaguaaaaugagugacgaaaggguuagucauagccaggcaugaugcugcacaccuuuaacuccagcacucugaggcuucugaguucaaggccaguauugaaaaccuuuagugcuucucccggagacacaggagggacuagacccaaggaggaugugcaugggucagugguaaacaaggcaggccaaaagcucugucaaagagcuggcaaacugcugcaguguuguccugcacagcacagaaagagacagaaggaaagcagcagcagcugcagucaaggcagaucuccccgaugcuccccggugcuccccuguguaugagcaucaccuacccagcaucagcaucugaagagcagccaugagcucagaagggaaggucugcagccuggacagaccccaucauaccugucugaccacaccaggcuccacuccuguucaugcuaacacagcuaagaaagcugaaaggcaggauaaggguccaggaaacagacaaccugggugacucugaauugaguggggcugucagaaaugggagauacagcaucagggggaauaugcaaaaaaaggaaaaagaaaagcugacaucaaaugccccaagaucugaugcuuccuauagaagaggcaauuagggaaggucauaucacuuacauuuaugaaucacugcacaagaaacguggacccucaaaagggaugcuuugcccaccagcugaaccacaggccugucacacaaacaccaaguucacagcguuggcuuugcccuaugcccuggacgcuccgcacacauucugcuuguccuccagccagucugccuccccucagcaagacaucucagacagauacaaugugagcaauggacgaauguguacacacagucagucucuccccuacugcacauggcauguagcacauacucccugcaucuucucuuuucccugagaugaccucacacucuugguuccaguacagacauggcccuguccugagcacuauggccaagugacgagcacucugcugcagaagcaugccuugagcuugcuuaggaaagccaccugcacaaggaaaggcagggaacugagacccuugucuguuggucgaccguuagguuuuuagaguccuagcugugcuggaacucacuauguagagcaggcuggcuuggaacucacagagaucugccugccugccugccugccugggauuaaagguaugcaucaccaugcccagcaggugguuuuucaguggcagguguuuccgugccucacacugcuugaacucuaacaacuggcauagcacauaccuuaacucugucuucugaugcucuccugacugacccugucagcccccaaagcagucugugcuccuaucaggcucccagcacaugagucucgcaguguuuacaucugcucuucuggaacaggcagacacgcauccauuugcauuugauucuucaucacuguguuguacacagugaaucucaaaaaguacucacccagaacccacuuuuucuuagaaagcucacucuccuaauuagucuugcuuucuuugaaauagggucucaugguccuagcugaacuugaacucugauccuccugccuccaaauucucccagguacugggauuacagguauccaucaccccgccccacuccccaucuuuuguguauguguggggcauauguacauuucaguaugucagcauggauguggaugcacacacgcucauaggcgccguggcuguggagguaagaggucaauagucuuuucucuaccuucuuuucugaggcaggguuucucacugaaccaacgcucaccgacugguuagacgagcugaccagcaagccccaagcgucauccucucuucauuccuucccuagagcuggggcuguaaguacauucagucacgccuugcucuuaugugaguguuggagaauccaaacucacuuccucacacugauauggagcgcacucuaccaacugagccaccucccucguggaggagaugagaaaacaaaaaaugucaggccucuaaaccacagcuaaguuguauuuuuuuuuuauaauuaacauaaagaaaacugguuuccacuuacaauuguuacagcaaguggugaggacuugagggaucauuauguauuccuuuuuaaaauaaaaaacccaguaucaaguuuaagacagauauaaacaaagguacagagaaacacagacuaaagacacaauucaguuauuccaagggaguaagacccccucacauuauccugcugggguaacuuacccauagagagguccaucauugccaauagcagaaaccauaauuacauuguuagcuguuaauucccacaccuacaaaauaaccaagcauuuaguuauugagugcuaguagcaauacgacacuguccccaaaccaugguccuucugcaaguaugcccaagaaaggagcccccuccaaggcagugcuaggcccggaggacgggcacaagcuuuuggaagacaacugcaugaaccugggcuggacagugcacagcacacuggcccaguggcuaggucaggaaaacagguuuaaacagaaagguaucaagguaccagggaggccggaauguuccuuuaaaauaccuguucccagauggagagauggcucagugguuaagagcacugacugcucuucuggagguccuaaguucaauucccagcaaccacacgauggcucacaaccaucuguaaugggauccgaugcccucuaaagauagccacaguguacucauagaaauaaaauaaaucuuaaaaaacaaaaaacaaaaaaaaccuguucccaggccucuaacccacuggguuuguaacaugcaaguuucugaaauucaugucacuaaccagcuaaccgucuguuucacaaagcugucauuaccucaguggaaaugaugacuauugaagguauaaaagaacacacacaggagcugucauccaacauucugcccuucacagucacuugaccaaccuugucaacaaacggaugauccaugaagucgggcccaccgaugcuaagguugagaacguccaucuucuuuaggauggcauaguugaaggcauccagaaaccaagauguguaagacaccugguuaaagagaaacaguccucugagggccucugcgagcgugcacagagcugugacagcucugcuuucuaaggacaagcacacucuucaaagcaugggcuuugaaguuccaagcaaagcacgccugagaaugcaaacagcacaccacaaacuaaguccucgaaccugcaccaagaagugggcugugcuggacacugucuccccuccaggggcgacaggcacccgccuaccuuacguaggccuuugaggauuagcccaggccucuaagugcccucauaaaaggacccauucuaagacaccacugagacauugaucauuucuacaguuuacaguaucuaacauccuucauuucuaaaaagaacaaacaggagcaagcgcagucacuucacagaucuaacgccaguguucagcucccucuaguucccuuacacuauguaaauuaaacugcuuuuuggaauacuucuguuguuuuucuuuguucguuuuuuuaaaaauacaagcuaaggcaggcaugguggcugagaauuguaaccccagcauuuaagaggcugcagcagggucagccugggcuacauaaugaguuccagaccagucaggcuacagaguaagagccugucucaaagcuaaagcaaagaccaacaacaaaaccacgaagucauguucacagugagcagaguaguacaguaaggaaguaacuugaaagguccuuuggaguuaaauugcaugcugacauguaaagaaacccuagagacaacauaagcugcuaagaacauucuccccacacagagaggugggagugagccgaaagcugcugccuauugauguguuggaacuccaaaguccaauuuacaaauaggggcuugagagauggugcauuguugugaccacuagggucaauugucaacuugaagaaucuagaaccaacugggagcugggccucuggucaugcucaggggcaguuaucuucacuagguuacuucacaaaggagacuccuuucaacuguguguagggccacaggcagggcucccuggggaaacagagcagagcacuagucugcauucauuguucugcuuggcaacuguggaugcuugugaccagcuaccucagaacuccugccaugcacuuccaguccaugaugaacaaaaccuugaacugugagacaaaaucaacccuuucuccauuaaguugcuucugacagaguauuuuauuacagcaacaggaaaaaaaauuaagugggucaagagcuugcuacacaaaugugaauuugaugcacacauuaguaggaccgagguguaguggugcaugacugacaucucagaacugguggaacaggucucuggagcuuuuuuugccgaauaggcaagcucuagguccccguuguuugaucaugggccuacauguuuggauccaauagccugagccaggccagggucccugcagcucucccuggaacagaguugagcaacccacacaaugacuugacagcucucaacucaugguaccaagcucuuugccuuguaugcuacacugaacuaaaucacaugugaaaaauacugccagccugacaaugucucuguucuuaggaugugcuuaugagggaaguggucagaaagcugcucucuaaagaggcuucuuuggcuuaccccaucccaguagugagccccucucuuuccuuauuucuuuagucucauucuuaaugaggcugcucuccaggaucuaaagggaagccucuuuccuucuaagggcccauaaugcuuagaucuccacuuaccauacuguuucugucuaaugcucuuucuccuaaugaauagcaucuuaugaagggacuguguggcagccccuuucuagaccaacugcugcugcucuucucuuuaguaacaacgagagcgccugucucaaguaacaugguaaagucaggcacaguggugcaugccuuuaaucccagcacucaggaggcugagacagaaggaucucuaugaguucaugauuuugaggcuagccuggucugcauaauaagcuccaggucagacaaagaaagauagugagacccugucucaaaaacaaacaaagugaacaguauuguuuaggcuaauauauggccucuauacacaaacacacauaacugacuacuaugaauuaaacacucuuucucucucucccucccucucucagcagccucuuccuuuucuguuucuagaugaaaugaagaaacaaagcuguaaaccuuagcugcugggauacaaaggucagucaguaccauaguguuuacucuccagcagugggaaugaacugggaagcaaacaugccaugcacacgccaaaacuacauccuggaaauccuagacaaugggcuagaggcucaggcaggccugaugugaaggauaaagacaucaaggaaccacaguagccuugggaaggucuucgggacuggggaaggcugaugagcacagaguucggggagggacgggcagaaggcaggacuggacgagacacugagugaggcacauguuacaauaacgaaggcugucaccgcagcaugcugucugcaguggcugugcaacgguguuuuacugcaaaccucaccucugacagcucaugcgucucaaggcccuucaaacacauaccugauuguugguaaagacccugaagaugugcagcucugcaucuggagcaaauccuuggcacucccucaugcuggcaaucacaccugcaacgaaugugccauggccuagcccugaagccacacacacacacaaaaaaaaagucccaugaagacagcugaggacagacaacaagguacagcacucaaaaccaaugaccacacacgccugaucuuagaaagaccucagcagcuucugcucuaguccucccccaccccucaccccccccccccgcccccauacucccaacaccacugcuccugucucuuuugugguuaacuccacagguaacccuucucagcagguaccaccuucucucccagccucuacuuccccacaucaucugcgacaucugugagcuucuaaggaccugggcuugucugugcaaucagaggcuagcucacaagcacugaccugcagaccaagagccuuguccuaucugacugggaccuaccaucauccaggguccgcucauugguccaguugguucucuccuucacauucuuaaaaugcggaugcuucucacugagcccaguaucaaaaacagcaacucugacauuagcaccuuaucccaaaaagagaaggcaacaaucacauugggagaaauaaucuuucuugauuucuacucauaaagcaccauuccuuugagggagccacagcaaaguucaaaguucaaaccccacauccugcauuccauucccaagucccauacgagaugccuaccagucauccucugaccuuagcauacacauucacucauacauuuucucucuuucucucuuccccucguauucauacacacacucauguucacaugcauacauguacucaaguauacacacauacacaggugcaauccuauacauacacaugcacacacacauucuguacacacacaauuuuuuacaaguaaauaaaagucacagaaacagaugcugggcuuaagagguaaauguagggacaguuaacuguacccaguuccacacaugauaggaaggacagauguauauggugacagaccuguggcagggcaaccuagcagaaggucucccugaaugcugucccugucccuggucuacaaaguuccuugucuguagcacauaccuguguaucccaucugccacagcacaucugccugcagugucugggcgaccuggcgaggaauggcucucagcaaucgccgacuugaaugucuuccuguugcaugccagaauccagagcccagggagagacuggcucuuuucaggggacgugaugacugccacuucuggcuccaccggguuucauuacagggcacgaugggguuggcuagaaucaagacagcaugaugaucagaaaccaagagaagcacacaccaugcucagagucaaggucauccuugaaguuguguuucaggacguugcucaaggcaaucacuacuauggggcagacuuaguugccauguuauucccaaaugauucuuaagacuucuguaaccaagaguacauagagaaagacuuacaguaacuucuauagaagccguuuugggguaacacacaucugcagccccagcacuaacaacacugaagcagaauuacaaguguuuacagccuaggcuguacugcaaaaccuugucucaaauaaaccuucugugacaccaaaacacuaaagguaaaaaucacucuccccaguggcccgccucgagaugacagaaaaaaaggaaauggcccaagagcuggcugcugacgucuaagcagcuuuuacauugcuguacucuggagaggagacagcugucuucuccuaccgaacaccucaggacagacuguagcgaggacuuuaaacuaagaacugcccccaaacucagucauuuccuuacuuuccaauuuccccuugcaaaaccuaaaagauccaggaggacaggaggagggucugcggugauagaauacucuaccuagcuuguguauuacugcugagaucugucaaacucaacacuuaaaugaugaauuuuaauaccugaaaacaaacuccuuaauuuuuuuuuaagggugcuggagugguggcgaaaaccuuuaaucucagcacucgggaggcagaggcaggcagaucucugagcucaaggccuguuuggucuacauagugaguucuaggacagccagagcuacacagagaaacccugucuugaaaaaaacaaauaaauaaaguuaaauaaaaguaagauauuacgaugaguuuucauuuuaccacucaaggucuauauuauagugaaaaccaaaucauauuuuuuaaagccuucaugucauuuauuagugggaagcacaugcaacugcuguguaucagcucucuccucacauggcucccagaggcugaacucagacugccaacuuacauggcacgcaccuuuccccacugggccaccuugcuaggccucaaaccaguuuuaagaacaagccuguacucuccuacuccaacaguacugcuucuacagcaagugacucucaggcucgaggcugaaagaagggguccuagaaaagagacugucaaucccaugaugcaacugucugacaguccaacucaaaucuauccacaccgaguuucuucccuagggugacucuagucuugacgucaccagaagggacaauuccagaauaccgaauaacaauauuucaaugaugggaguggucugcucuacuugacguacaaacagaauacagcacucaaagaaaaccaaaacagagagaggcagacugugucauaugaacaaccauugaaaaaacuggggaacaucagcuuggacagaagaaacagguaaaaagaacagcaagcguugcagagaacaaagagaugauguccugguuaggguuacuaugacugugaugaacaccgugggcaaagcagcuuggggagggaagggcuuguuucagcccacacucccaggugacaaucuuaucgcuaagggaaagcagggcaggaacucaaauaaggaagaaaccuggaggcaggagcugaugcagaggucgugagagggugcugcucagccuuaagucugcugcacugcacagaucagcuuuuccaaagacaacacagccucagaggcucugggcuagcacgugaugggcagaacagggagaauacaauguuuguauccuacccaauaaaagaaaccacaggacuggggauguaucucagcuggugguaugccugccucgcacucuuaggcuccaaguuugguugcaagcaccacuuaaacugggugugauggugagggcugauggugagggccuaaaguccccuuacuugaaagggagaagcaaaggaucagaaguucaaggucauccuggacugcauaacaaacucaaagccuaggguacagucaaaacaaaaaacaaaacaaaacaaaacaaccacaaaaagaaggaaggaaggaaaaagaaacaaagcaaacugcuacaguuagccauaugcuaaccugguuuaauaaacagcaaaaaaaaaaaaaaaaaaguucccuuggcggcauuaggcccucuauacuacagaaaacacugcauuaaguuuguaguuuguuacuuaaggacggauucuaccuucaaaggcccaacuggaggcaacacuaggccuaaaaaagugugagccagacucugucucacacccacaggccugccgaugcccacagauuacaaagguagaccauaacgcccaccucugcucacggucugggagcucagagagaaacaaagcacaggccaggaaaaauauacguugcaagagagcuguaaaaaugaaagccugcacucggagaggaaccucaaaggcaaggccuacagaggggggugggggaguggcaggccucuguaacccuagcucguguaaagcugaggccagagacuaucucaguggcagcccagccuguagagcaggacuugguccuuucucuuuucagacuuuccagacuacccaucaaggucuaguaaacucaaaguugggagagucccaaguggacagacagaaaccagcucccacagacauaaaggucaccaccacgcuacagaccuuuauagaguuccucccaagacagcaugaagcugcuuuucucaaaacugcuguccaccagacauggcagugcaugcuugcaaucccagcacuugggagguagaggaaggagcacauuggaggccaggaguucaaggccaaccagucuuagcuucagagugaaucugaaggccaagcuagagcaaacccagucucagaaaacaaaacacagaaacugccugucaagacaacauucuccacuagagagcugugaaaaaggccucagguguucccaagucccucuuagcggcucuguagugaaaggcaagcaguggcuugugcuggccauacucacauucagcaaacuugagggaacgaaagacuuuccgcuggggugucacccgcuugauguuggggugaucuucaagugugagcagccccgccuucugcuucucuuuuaucugaaucaccucaaaaucacuaggguagucacuggauggguuguuccgagguauuauucuccaguuuuccacuucacugcuuuucagagcacuugaaauaaaugaguuucuagcuuuggcugugaaguauccguugaaagccacaauauauucugaaaucaaugcccacaguaaaaguaaguacuuauauacauaacagaguauaccuacucugaaccuccauugagaaaagaacaaugcaccccagagcucauggcaaaguaagagcaagaagagagaugaguaugaacgaccacagguggcaacaugcagagauucacacgaaucucaaaucacacaaaauaugcacuucaaaggcagagaccugugcuuuuguuguuguuuuuuguuugcuuuugaguaaguguaggucuggugagaugguuuaguaauuaagaucauggacuguuuuugcagggaaccugauuucaguuuccagcacccaugucaggcaguucacagucaccaauaacucuauaaucaaaacauauuuuagagagccgggcgugguggcgcacaccuuuaaucccagcacucgggaggcagaggcaggcagauuucugaguucgaggccagccuggucuacaaagugaguuccaggacagccagggcugcacagagaaacccugucucggaaaaaaacaaaaacaaaaacaaaaacauauuuuagaaaacauaaacggggggggggguggggguuggagagauggcgcagggguuaagagugccugcugcucgggagaagacccacagagcagcuuagcaccaccuacacucuaguuccucaggauucaaacccucucugcaagugccaagcacucaugugggucacacgaguggcaaaacaugcaagacauuuguaaacugaaagaauaaauaaaguaaaauaagauaaacccuccacauuuacuaaaacugacuccaguaaagaaaugacguuucccaauagggaaaggaacucagagaacuaaggcuguuuauucuacagaagugaagacaaagcuccggucagguccaggucgcagacuuccugcucugcccuucugccugaggcgugcgugaccuccaaagugucagcugagcgccugcauccgccccucccagcuacagugcugcuggcaguucuaguccagggcaaacaccuucagcaaagguuagcgucuacaugauguguacauuugaaaugaaccacggaggugaacggaagccaguauuuauauuaguuugaaaacagugagaugggaggcccaacacugaagacaagucauuaccguacuccaccacaguugaagagaauuccaccuucaaagucaggugggagcagcuggggcacggggccuuuuccaaagcucucguccccagccugucgcccaggugccguuucccacagagcaaaaccaccagcacaagaagccaggugcugacgagcuucaugguccucagugaauauggucagaaaauugcauaaauucaaaucgcacgaggcucuuccuugaucagaaguggguuucuguucuggcuaaaagcugcagccuuacugaucagccauccuacagacuuguccaacauaaagaaaaccucagucccauggucacccacgguuuggcccaaagagaggcuuucauuucuuucuccgcuucuucuccaucuuggacaggggcuucucucauugaggccgaguccacugaguccuaaacuccauuugcgccacagacccaaaucuagcaggaugcccaauccaccgcucuguagcggaccugaaacaaaaacagcacacagggacaucaguagcauccugacccagccagcuaugacaguuucagcugcauuuaaauggaaggaucagacaccgcaguacagacagacaacucuguauauuuaaauggaaggaucagaccacaguacagacagacagacagacaacucuguguacauuuccuuacuccucacugcuuucagggaaacaucccuacagcuguuaggagugaagggaaaaacuaggagagaagugaagagacuaaagauggacgagagcuagaaaggaagagcaaaagccagaugucaugucccacccuucacgccuuccccagacuguguccccugucaucugcagcucucuaucucccaggguaucucuaaucagcauccacaauuauucaauggaaaguguagucuacaggucuuuacuuucugcuguaaaugauaccuaaggaaaaccgauuuuaauagguucuguaagagauacuacuuucugccaauuuuauaaaaacagcacagauauuuucugcagccauuacauguauuuuaccugaagcaucaaacuuaaacuguuuaaucuguuauaaaaucagauuagcuuuuuacugaaaguggaacagaggucaguuugugaggcaagcuauaucuaaagaaaguguugaguguaagauuucucucucucucaaaguaacuaaaguagaaaggaacggcugcucuucacaagaguggcagugggggccgaagugccacagggugaccagcucacccucauaccuguggggaacaacccagcuggggugggggcaggugaacacagaacaagugaggcccguguacuguuuaaaaaaaaaaaaaucaaagaaugagccaccaacaaccaagaugagucacuucaacucaauucuucugacagaaacugguacuuagaguaacaaugagguuuugguuucggcagcugcccauauggacuuccaaaccaggaaagggcugaaacagugcagaguaaaggacuuaaggcugccugaacuuuccugugguaccauccucgucuguaaaacacaccaguuaugaaccacagcagagccugaggcggcuggcauguacucacaggagaagcaacuaugucugugucaacagaaagacagugaggcugucaaccacaagaacaaaagaguaaaucaaauauccaagacuucagaaagcccagaggucagcuaacacuacguacacauucugcugaggccagaggcccuaucacggaaaggagucucagaaagcagcccuagagaucacgggucaaagaauauacagccaguugucacugaagugauguaaaagaauauacagccaguagucacugaagugauguaaaaguccuaaugcuagaguaagcuugcacuuuacagaaggggcuggagaggguucucagugguuagagcacuggcugcucuuccagaggaucuggguuccauuuccgacacccacauggcaguucacaagcaccugucacuccauuucuauggcccuccuucuucuggccucccuaagcacugcacauacauaguguagacacauauauaggcaaagcaccuauacacauaaaauugccuuaagagagagacucuuugaccuaguggagauauauauaaugagaauguuagugugcaauaccugugagagcaucuugagaggccugccugcacugagucacuuuagcacuguccuggauaacgcuuccacagguagacagucaguuucuauaggauguacccugugcaggagagaucgcugauguuuacaaacuaggcaggggccgaauucuaaaacaaagaaguggaaaggaaugaaaugaacuuuuugaaaagaaaauacucagcuggacuuugcggcacaugcacaaugccagcagcaccugggaggcagaggcagaagaccucugaaucugaagcuagaggcaucuacagagcaaguucuacacagcuauggucacuacacagagaaccccauagguaaccuacucuucuccaguugguucugggaaauuggacacaaaaaaccaacaccacaggucaugaugccuuuaccauuuuauugagugcuuacugagugagaugagacaccgccaggugcuguagagggggugugugcacgugggggaggcagaaggaucagggacacaguguucuuaugugugaggaagcaaaggagaucaaccacaaaccaacuaccaggccaaauucgggaggaaaaagguguuagagcagaggccaccuaagcugaguuaaagucccuucaggagugacaaguuuaguugcacagaaggcacaauggagggagccauggugcaucuggggaugaggagaauacagacuauacauaaggaccaacagggcauccugugugaggaggacaugggaagacggcauggaggagggaguuccagcagguaccauguuggagcaggucauucuagaaugcagacaucagcaaccaagggaaaugaccauaaagagccagagaccaaggcugcugagcaacuaacugcucaagagcucugcacuguacaucuggagggcaggguccuagacaaacccucgaacagcuugucuuccaguguggggaggcacggaagaaacaaauaaguaaaugcagcuuagcugauggcucgugcugugcuugggaacagaggaaggacgggagcaggacugcugagaggacugccucgucaggcaaggugccacuguggcuguggagaaaggacuuuuaaguggaaaccuaaaggaaguaguuuggaaugagaagaaaagcaaagcagcuggguggcugagcuggacgaagaaagggaagggagagagauaaagaacuggggacaacccagggacagcccuguacaucagagaggaacucacuuuacucugaaagggaggggaaggcacagcugguccccagccuucuagaagcaaugaauacagggaaccgggcuauggaagacccggccggguuaaacaacccagggagagcagaugcucacuuagaccuuauggagaaguagguggcgucagcaaacuuguggugacagaugugggagaaugcaggugaggaguaaaaccccggguaacucugccucuaauggagauggaggcgacuauggaagcuggcucaggggagggacagccacacucacaccaacaugcugugaacuaaguagugaacgucuauaguaaggauguuccccaacacugggaagcagccagggccugucagaaucuugggcuauccaguaucucuucuuuggagaagaugacaaggaauaggagaggccaaaagaaaaggaaaagccaacuuccacaaggagagccuggccacuggacgagucuaacagcuuaguuucuagcgggagagggaaauggcucagcagagaaaggcacucacugccaagccugaccaccugaguuccaucccugggaccuacaugguagaaggcacaagcugauuccccauggauuccugcccugaucuccacucaguacucacucauauacacaagguaaauacauuuuuuuacauuuuuuuaaaaugucacugaucccuuccagaaagagguuauccuaagggaucagguggcacuggucugacugcacucuaccaagcccugucuacucccggaccuggcucuccacacccaccagugcuagaaggaaguaaggaaaaaaggaagccacuucggguacaaaagucuccugggauaaaugaacaggcuggaaaugauagaaaacucaaggagaacccgggcgugguggcgcacaucuuuaaucccaacacucaggaggcagaggcaggcagauuucugaguuugaggauagccuggucuacaaagugaguuccaggacagccagggcuacacagagaaacacugucucgaaaaaaaaacaaaagaaaagaaaauucaagugacucugcuguacagagcuagguaaccuguuuauuguccucaagggugaaaguccaagcuuuuagagacacuacaggggcaugccugugguggaaaaugacagccugagguuucuacagguucccaauccugaagaaggcucaaauccuuuuccuuuccggcuucuaauucaccauucaacugucagaagacagugcacagggcaggggugcggaagucaagcauucaccauuaacuccugugcucuugggccugugcguuuagagauccugauccacagacauguccaguacagccuuugaagaacagacugcacuuucaggacuguaacacauauccaccuguaucaacaacucacggugcccaagacacgacuccaaaucagucaacaugagcuacaaaacaugcucgauaguuagcggcaggcaggagagccacaacagacauuaauugcgcagacaggcauauguacacgggcucacgcagagagaaagaaaaccacugacuuguuccccucuuucugaguuaguaugcugaggacaagggggccacggaagacccagggagaaaggagucuagcaugugaggaaaggaagugugugaggagaagccauccaucaaaaaauaaaaugagccauuuaguaguaagcugaaacggagugcuaguacaaacuccagguuuucagauguacacagagagaugcagaaauaaacaagugcacaucugaauucacacaucaucuaccaugaggacacagcagcagugccacgcacugcaccccuaggaaggaguucuaccaugugcccagaugguaguuuucacucuccagggaaagaaguuagguuccuugaagaguaagcucagagcagguugggcuagaggagaugacucuggaacccucuagcagacagugaggcagugcucucucagagaaugggggauaugcugccagaagccaggguggagggacucucccuuagccaaaucucugacaaucuagcuucacaauaucuaaugaguaacagaucacaacucuuugaaaauucaaaaugggaaaacagauuccaacacaaacaaaguggaagcauaaggaaacuucuguuguuuacacagcuucaaaaugcugcccauuaaaauauauauuuacaaaggggaagagugauuuuauuacucuauacaagccaaccagccacaggcaaggggcccagcccacccccucccccagcaggagcacugagaagaacccuauuugugaggcuccuuccaaaacuucacagcagucaaaucacaaggaggcaucagauaaaccccaaggccauugcaugaagugaccuaucagucaccagcuguacagugacacccaguagauagacaugccaguagacagcauugacuaaaaugaaacgggaguguggcugaccauggggaucuacugaugaccgguucccaccccacugccccuuccaucuaagaauauguaaauccuuuacauaauggcacagcacuuccauagaaacuaugcacaggcuccuucuaagagcagcaagagcucuuaaccccucucuaucaacacccccaaauaguuucaaucagcaauuggcugaauaugugaaugugggcugggauauauacuaggggugggggagcaucuaacccccagucuacagagcagucaugcuuucugaaaggcuucaguuaaaaacauucuguucacauuagcuuuagcgcuuucaucauuuauauuauaaacaaacaaaaaacaaguaacuuuuuuccuggaaaaaaagguggagcacccagaauagaacucauacuuaauaauucaacaaaucuaguaaguauucucaugguuuuguuuuguucaaaucucaaauugucaauauguacuaaaaccuuuaaaacuguaccgaaaagauucuucagcaggaagaaaacuuaacacuuacuuagcauuucuugguagcagguaggauucacuaucccuguuacuacccccacugggugagaaaacaggccuaaaggaggaaugcccuugcugccccuacacccugucacugaguggggaagcugucugggaaccccagugucugagugacauucuucagagggacggagccugauguuuuaaaaaugccccuuggaauucaguccaacauguauaaaccugaaagcacacuauuuacauccaaggauguacaguacagcauuguaguggggaagaguuagaaacucuguaagcaugcaauaacaggggacagaaggggaaaugauuaugguuugucugcauuacagaaugccaggcagaaacuuuucgaauaagacugaaucauggucccugacagauguccacauccugacccccagaaccuguggaugugacuguauaccaagacucagcaggauaugagcaccccaagcuggggagggcauccucuacccucuaaucacuauaaugccuccauacagcuaaggggaugguucagaguuaggacaauaaaagccagggugugguuuuuguuagaaagaaaucaaggugccaaggaauuacaggcggcuucuauaaacagagggaacuggaccucucugagagccuucagaaagacccagcugucaauacuggcucugagacucacuuuggacuucugaccucuagaaugauaaaacgguuuaugcuaguaacaggagaaugagcuaaugaaguauuaaagaaaucaguucaugcacagaauggucccagcuuugcagguacacauccccucagugagacagggucuugccuugcuacacagcccuggcuguccuggaucucgcuguguagaccaggauggccucaaacucagcuccaccuccuucuaccuccuaaagcuggcaagcuuugacuuuuaaagucgcauccaugcuacuggagagaugacgcugugauuaggagcacuugcuguucuuguaggacacagguuugagucucagcacccacauggugguucacaaccaacccgaacucagguucaaggggauccaucacucucugcuuaccucuguaagcacaucaugaauaugcauacauuaggcaaaauacagguuaaucuaugaaguuucuguaucuauguacaaggaaaaaccacacuaaaagguaacaaaacagcguaagcgcugcagcaggguggcccccuccucuccacuuuauuacauuucuucacaguuuacaaagagcguuauuguuuuuauaauuagacaaaucacauuguuuaucauuuuaaauaaauccuuuaaaauaaauuuuuaacgaggagguuacauuuucugguaagacagccgcacaaaagaucaacugugagccaggcaugauggcgcacgcuuuuaaacccagcacucaagaggcagaggcaggaggaucucugagaguucaaggccagccuggucuacauagugaguucuagggcaaucaaaguuacauagugagacccugucucaaaaacaaaauaacaacaaaaaucagcaugccagacuuacugauuuugguauacagugaucuuaagcucuuccucucugaguuguucccacacaucugucuacagugaccuuccuagcuacaggagaaccugaagcaccucauggccccguccagaaacuccacagggacgccacucuaccugcagggccucuugagguuuucccuggauccaccaaguagugaucagacuuaacucccaggcauccuugcagaagaccugguuaucuucuauaaaaagcauaccuacuaaagaagaccuuuccacccguggcuucccugagggugacugcacugcucauauggggggacucaagaugagccugacaucaaauacugcaugggaaagacaccugcaccccagggacagaugcaacagguacagugugacagagaggagagugagcgucaaggggcaacuaauaucucuuucaacucugaaauccuuuuuacagugugcacauuguaagagaacaccaccaagauuacacuucugagcauaauuuaaauauaucuaaaguuauuugcuuggauauaauucuuaaaucuaauucaggugagaggaaaugcccauaccgcagccaucuaauuaugcucccaugccccaccucuucaugagcgaguucacugaaguaacuccugugaaggcuguuuaagccaggaaagggcccuauccaauuuaauuaaacguuggcuggaaaacggucucuuuugaaacucaacugcacauuuggcuguauucccaccauuuaacaggcuaacaauuaagcagugccagaagguacucucuuaaaauaaagguguguauggaggccucgaugagccagugauguucaguaugugugaccgagaagcugagguguuuacugucugucccugcagagucugcucuugguuccuagucucugcauaucuaacagguaccagccaaccacagacugggccaaacuucuuacuuuccucauuuuagcugaaauucauuuccuuaugaggggaaaauacugucaagauuaauaggaacauugauuuagugguuaagagcauuuacugguuuuccagagaaccaggguucuauucccaguacccaaagcucuggucuccucagacaagagaugugcagacacaugcaggccagcccuuuauauacacaagagaaguaagucaaacggucaauaggaccgaucagauagcgcuauggguaaaggcacuugcugugcuggccugaugaucugaguuugaccccuugaacccucauaaaggaaagacaagagaaccgacuccacaguuguccucugcccuccacacgugugcaccuauauacaucauacauacguggacuuagaaaacauaucaaaccagacugcaccacuaggaaaaaaauccacucaucggucaccuccuacaauaccuuuggaaagucuagauuccugagcauuucagaucaauggauggguucugaucccaucuauaccacccccaaagcaaucaagaguuguuaauaagaggcuggagacauggcucaguaguuaagaacacuggcugcucuuccagaagacccagguuugaucccuugcacccauguggcagcuuagaacugucuguaacugcaguuccaggggacccaacacccucacauacauauacaggcaggcaaagcaccaaugaacauugaaaugaacauaacucacuuuagggaaaaaaagaaauugcuaaucauauacaacuuucuccucaaaagaaaucacugaagagauuccuuagaggagcugggaagaugauccauggagcacgaggacuugaauuaaguccccaaaacucacacagaaagcugagguagacugccccugggacacaguggccccuuagucucacucaaucagaggcuccagaaucacugagucccugucucaaaaaaaaaaaaaaaaaaaaucagguggagugugaucaaggaagcgcgcgcacacacacacacacacacacacacacacacacacagacuucccuuuugguccuccuaguccaaagauugccgaccaucggagagagaacugagucagagaauaaagcauaugacagcaccaagaaugaacaagaucugaccagaaaacaugcuccuucauucccgaggggcgagggggaggccugccaacaccgcaucacuuuuuagauaguaacagcaaauuguugguuauaagggguguuuagagacugcaggagaguccuaaugagcaaaagugcagguuccaguagccacuucacccuuacacucaaaacaaaaacaaaaaccaaaaaguccacaaaaaauuagcucuguggccaaaugugucacauacugcaagauaagaccuuggcaaaagguauuccacaugaauagggguaacugugggcuauuaaacaacggacuaucauucagccguaaaagaugaaauacugacuuacgcuacaaccauaaaaaaagguacugguuuaugcaacaacauagaugaauucuggaaacaagacaccaaaggccacaugcgacucuugacccacuauucccaaaaagcaaaccuaaggagacagguccaucggugacuaaaauagcagacuaaaaaucgguucuaaccacagcaggguaccgggagucuggggagugguucucaaagcgggcuguggugccgacugaacugcuccgcaagaugacacaaagucacagggcgggaccacuuaauacaagugacccugugauacauaggacacuuuauagaaaucacggucuugcguuuaaaaaauaacgguaagugguguggcgcuguacgucuuuaaucccagcgccaggcagagacgugaggaucaggaguucaaagccagcuugagcuacucagaccuugucuuaaauauuaacuuuuuccccccccgacuaguuuugcagauuuuuaugcuuuucucuguccggcuuuuucauucgccuccaaaccuagggguugcuagcgaggcugaucccagaaugaaaucuucaagugcuccucccgucccuucaaagcgccacucaaaaacaccuacagcaaaugcgaguccgagccgcgaugugcacugagcugcagcucgguuccccggggcucgcgaccgcagggcccugcggaggcgaacggcgcuugcgcaccgcggcgcgcaggcgcaggccaggccgccgcagccgccgccgccgcuccgggccaauuucuggggaagcagcugcgguagccggcggcccccgcgcgggcagcggacggcugagccuagggcgcguccggcucucggccgccgccggcaaacguaccugcguccgccucaggcucggggucggcggacccgggagaacggcggcuccgccgcgaacacgccucgggucuccauucgggggauguuuacucgcaagucucgcgagaccacgccgcu

SEQ ID NO: 4823 - RNA, 2189 nt, Mus musculus
gaaaaggauagaccgcauuuauucccagguuccagaauccuauggauaacccaucauuccggaaacucgcuguggcaaccccauugccugcccacucucugcccugagacuugaaucuugcucuuggccugaugucucccugcugauucgccacacucuccccaaggucuucuguccuucagaugccugaagcccaguaauuagaagacccuugcuggcucaggagaagcugggagcaauaaguugaugucauaaaggacccauuaagccugcauacaguagacuuuagcuaaaggagugcucagagcugaguaguggacuaaccagacuguaggaaagagauggcuuuaccacaaauguaauuaaaguuuugguuuucuggguuucuguuaagaucaccacugauuagggacaggacaaauggagacacccccggccauuaggaacacucccguaucaaagaccaugccucuguuagaaaguucaaagcggguacugggucacaacaccauugaaucccgguccucauuaaguccagguucucguaucaggaagagcaauauucugccaagcgcacaugcugacccuggcuaacagcugccuaggggcugucucagaauaacuagagcaauuacuuuccguuguaaaucucccacuucaaacaaccaaacuuaggaauuuuaucaccgugguucuguagcgauguguguuauauagggaggaccucaguguacagaggacccgugcagucacauacaaaugcuauuucguuugauccaggggacuuaagcaucuguagauuuuguugaucauggggcucccagaacugcuccccucagacaucaagggauaacucuguaguaaccaugugaccacggggcugccagagggaggcuugcugucacuguccacaaacacaucaaaacucaaagcacauaggaggcauggucaguccugagucagggacugugccaagcucacuguggguagagaggagcagaggcugagggcagaggucaucaagacugaggaaccaucaccaauccuccgguucccaaacagggagagguuuuacaucacggaaguaagcaaaaugaaaauggcugaugggggcuagagagguuuaguucagugguuaagggcacuuacugcucuuccagaagaccuaauaagugcaguucccagaacucccucagguagcucacgaccaccuggaacugcagggaucucugacucucuucugcacauguggcagacacucacauagaugaauaaauaccaaaaaaaaauagaccaauaaaaggggucuggagagaugaugacucaguagugaagaacacaaguuauucucauagaggacccagguuugauccccucugcccacaugguagcucauagccaucuguaccucuaguuccaacagcaccugcaugcauguggugcaugcguacaagcucccacagccaaacauacaugcaugcauacauacauacauacauucgugcauacauacaauuagccuaagaaacacaccucagaaggaaagaacugauaaggacuccguuccuucucacucucuaaagccuaccacaccuggccucuguacccccuguacaguugcagcaguuccugcugagccgucccaccauauccacacucucuaaagccuaccacaccuggccucuguacccgcuguacaguugcagcaguuccugcugagccgucccuccauauccacacucucuaaagccuaccacaccuggccucuguacccgccgcuguacaguugcagcaguuccugcugagccgucccuccauauccacacucucuaaagccuaccacaccuggccucuguacccgcuguacaguugcagcaguuccugcugagccgucccaccauauccacacucucuaaagccuaccacaccuggccucuguacccgcuguacaguugcagcaguuccugcugagccgucccuccauauccacacucucuaaagccuaccacaccuggccucuguacccgcuguacaguugcagcaguuccugcugagccgucccuccauauccacaccaccaagugcacagcccauccucagccacucagccagaggacgagggacucgggugcccaguaggcaguaggcacaacggugugcacccuguuguuuuaccaaugacaaccaug

SEQ ID NO: 4824 - RNA, 13225 nt, Mus musculus
guggcgggaccugaaggaaacagugaugcuuuuauuguuacguucugauucacaggaugaguuacaaagguuccgaguuccuccuuccuugguaaaaagccauguccacagugggcaggcagacuagcucagcagagagggucugccuaugagagcuaggaagccuaaaggugccugauucgagucuucugcugcagccacggaucacugugcuccgaguucuagcugaguccugcugagagaacaucacugacuccucaucauggagcaaggacuccgcacuugauagacaagucugaauacugggccacaggaccuuacacagagcggacagugcgucucugcugcuguuuuuguuuccugaaccagaguuucacuauauagcccaugcuggccuugaaccccucagucuccugccuuccucccuaaucaccaugcgugauuaggucucagguggagguacugccgccuaucacaugcacgaagguucucagcaguaagguagccguccccgccgaggcuccuccuccucugucuccaagcaugguagucugcccaugaucugaggacaugaagacacugaucuagaucugagucacaacuuaaaauggcacaucugauguccugggcaaagugcacuugggccuacaggugaugggaugucacuaaagcaacuccauccaagucccagcgugccgcucauucucacuucccaggcacagcgcagcaccacaaggggcaacgccacauccuccacucugcacaagcugccaugacuuccaagcuuccacgugcuggguaugagacccucccaagagguugguuuuauaaaccaacgaaagccacuaaguuucagugugcccccauauugugggauauacguaaaggacccucacgcuaauaaaagcauucccuacaauguacacauucaucacacaggcuaaaaacgagcuaacaucacuucaauaacuaccuuauaccacgcacaaaagcugcccauauuucaaccacuauuccacaaacacgugaugauuuuaucaacaacgcuccuggggagaaauuggauuacauagaaaaguguaugaaagccagcucuaacaagcucugaagggggucagauagaacacggacucagugaggaaccaccacuuagguacauccaaagacaaccuauuaugugucccagccuagcaacaaaacccaccuacagagugggaaagacaaaaguacucaaagaaacaaugucguaggacauggcaagcccacacagcguagagccugaaagucuuucagcacaugaaagggaguagcccaggcguuuacucugggaagggcucccucauaaccucgucuuggcagagucuacuguaaagucuuaucgauaacuucacccagacacacagcacacacaugguucuaagggaccuuagggaaaggcaguguguacacacagacaccccccauggagcuaugcagcaugacacaugucuacuguuaacaccugcacucccaguucacaguuugaaaauaacacuuuucuguugucuuccugaugaacauuaauuuuuuuuucaaggacagguuuaacugcaugucccuggcuggccuggaacucacuauguagcccaggccugucucaagcucccaagugcuggcauuaaaggcgugagcccccacgcccagccugaggaacaucuugaaagccaauacuauaaucagucaccuguaaaaggaaaacaggugacuucucaaaaaaaaaaaaaaaagaaagaaagaaaaagaaaaagaccagcacaagacggacaauacaggagcgagcuggucacgcuccaaguguugaggaagcagcccguucuguccucaggcuucauggccaugcgcccugggccaaccauguggucccugagguuugcucacagacguaacagucggccucaugaaggauggcgaugcacuagggacuugguaggagacgauacacagguggagugaauguguucuuccaaacgccagaaaccguaggugaccguggcuuaaccaagcuucuccccagccuccuggcucaggcuuggcaggauaaggccucuuuccguaaggagcgguugaggagguuugcaccccacacccagagccacucgggcauauacugugcgaagaggaacuacaaaugagagacaaaggagaugugguuagagucccgagccaugagagccgaagaaacaacaggugcagaucaguguggggugcucugggcacccuuagcucucaucaggaagugcagccaaaacugauggaaaggaugcguugaaggaauccucccucaggagugugccuuugaagccccagugccucaugucuguacccugaggacaaucuguucagguugcacuugcuccaagguagccgagcuuaccagccugcaccccagggccuagguaaaaaccagucuggugagcucauugaugugaacauaugcgcggcagcuaagacacugcuuucacagauacggucaaagugucuugccacccauuguccucgaagcugcaucccuaagaggacggcgaggcccuggagcugcuucuguucuguuuuugagaaagaaaaggucucacuccaugggccaggcuggcccuaaguagagauccucccagcucagccuccugacgacugaagagaugcuaggcuaccaaauccagcccaagaugaccaaggccgagccucucugcucacugcucuagguauuaccgacucggaaacagcuccccagacagcuucuuaggccagcugcggcucugagcugcagacaagugugagaagucacugcugaccgacucacacauuuaucuuguggugggaaacugaauuaucuuuauguauaacaucccccaaaguauuuaccuuuguauuauaaucagaaauugcccagugaaauucuaaauucgggcacaucuauuucuacuauagauaauaaaaagcaaauuacuguaaaucauuuaguuacuggccuacugaucaaaaucacaauuuaaaauauuucauaaaucucaaaucuuuucagaugugugugcaugagggcaggggcggggaugcccagcauagugugcguggagacccaaggauaacuugugggaggcaggucucuccuaucacgugggucuuggagagcaaacucagaucaccaggccuggugacaagcacccugaccugcugagccaucuggcuggcucgcaaguacucuuaagaucuuuguucugucugaacaacaaucacaacaaaaaucuuagguucgcuuguaggucuccugagaaaaugaguccgagaaugaaauguguagagacugauuagacaccauggcuaagagcccauggcccugauggcuuucuggacggggcugugcaaggagcauuuccccuucaggccucaccgggaccucugcccugaaaccccuacugagcacccaguauccucacaccccacacacuccaaagcagccuguuuccuguuuuaagggugacaaaggaaauuugagaaguuuugcauuaaucaccccacauaagcaccucacccuguaaccaaaaucacugagaacauggggcauggaugugaggauuugcaacccucccgcccuggugcagcucacggggcucugggcugacggcggugcuaccugaauggaaugggaccaguagccugugguccuuuuugaaaugcccagggucgacacugcaugcugugcauacacucucggcgacggcgccagccacgggcaucugugcaggaagcuggcgggcgcagccccgcugcuggucacguagaaggggaucaggcucugcacaaagauccccuuagaggcauacucguacugcagggcucggcugaagugguccagauaggccuggggggcagaggaggaggacuuaugaccuggaaggaacuugaaagcaaccccaggagcagagaggcuugccugucuccaccuguggggaaagugccaacguaagcaacugggagcugccuacuuuccgaccagcccacggggacaagaaccuuaccuuggacgcagagaaggcagccagcuguggggugggcuugcagcaggaaccagaagacacggugacgauggcgcccuucuuucucuccaccaucccuggcagcacgaugugcaccaucaggcuggcggcugcgauguucacguucacgaugucccagagcguguccucgggcaccuggcugaaauacugaggguagggguagaaugcacccacgucguucaccaggaugccaaugucucugucucucagggcuucucggaugggggcguaaaucucccggccucugcugaagucugccaccaggacaagcgucucuacccuguaggugucggcuaugugcuuggccgcggccugcagcuucuccucuuccuggcugaucaggaugacauugaguccguggcucgcuaacuccuccgcauaggccuucccaaugccaucgguggccccuggaaggcaagccaggagccgugaacacguugaaacaugguauccuuaaagagauccaacccacucccuguugaucucaucagagaagaaugcacaccggaaaaaggcauuaacaccugucagucaaggacaauggugaauccuaacccugcagacccccaggcagggauuagcgagauggcucagcgaguagaggugcuugcugcccagacaaccugaguucaaauccuaggacccacaugguggaagggaggacucccacaaguuguuuccagaccauuccaugugcacaguggcacacagagaccuuuaugugugugcgagugcccacacucagagcccuggaauaagucgcuauaggaaucuguuuccagacuugcaccuggcuugcucagguguccggguuugcuuucuaggucacagagauaaaucaccaugcaauucaaacugagaacacugacugucucagaggaaaauuucaaaacacagaucagggccuggcgugguggcgcacgccuuuauucccagcacucgggaggcagaggcaggcagauuucugaguucaaggccagccuggucuacaaagugaguucuaggacagccagggcuauacagagaaacccugucucgaaaaaaaacaaaacaaaacaaaaaacaaaaacacaaagcaggaaagacauguagggggcgggaaggaggggcuggggaccaagcuggagaaaugaggaguguacuggcugguuugaugucaacuugacacagcuggaguuaucacagagaaaggagcuucaguuggggaagugccuccaugagauccagcuguaaggcauuuucucaauuagugaucaagggggaaaggccccuugugggugggaccaucucugggcuggguagucuuggguucuauaagagagcaggcugagcaaaccaggggcggcaagccagucaagaacaucccuccauggccucugcaucagcuccugcuuccugaccugcuugaguuccaguccugacuuccuuuggugaugaacagcaguguggaaguguaagcugaauaaauccuuuccuccccaacuugcuucuuggucaugauguuugugcaggaauagaaacccugacuaagacaaggaggaugccagucugagggcagggcucccugaagugaggugagagagcacagaacgaggccuccccaggaugcagaagacuccaguuaaguucuguagcucccuguuggaagcauugacuuaacgcacaccccagacagaaaggccaccaagcugcaguuaccacugaugaccgcccaucuuccauacugcuugaucaggucgggccugcuccccaggcgagggaugaagugcagccugaccaggcuguagaagucacagaugacggugaugcucuuucgggcuguguaccaggcucccaccaaggccaaggcuuccauguagcaauugcaagaccuggcgauuucccuguacaagagguagaagcugucaacagcagccauggcgaccugcagggacaggaagagagagagaaagagaugcucuuuguggacggagcaaaaccagaaggagcagacauccucagcaggacggaggacccuggccuucacagcucugcauucacauaaccauucccgagagcagccggccugagacugggaaggcaugaccccacuguguaacaccgguggcuuaggaaguucuugccuuccaaggagaugaugccagagaacuacugagcaacgggauuccucuaagacucuugauucugugcuaccggcggccuaaacaaagauaaacucgggugccuacuucagagcucuaggagacacaacuaucacuggguagcagccugggauguauguauguguucagcuccuggcauuauucaaccagcaaguacaguggaccuacgaccucaaaaguaacuaauaaacagucacagcacguggccuuggccccaagaaacaugcauauuaaauaaaaggggcacccccacccccaccgccaaugaggagcugguaaucuuucaggacaacacagcaagcacccucccuuauuaguuugguuuguuugguauuuuccuuccuggccucuagguucgagaaagucccacgcaugucuucuaaguguauacacagcaaacaggcacuaaaggguggacgugucacacauauagugacagguguuacacauccaagaaacaggcaggcauuuaacaacuaaaaagcaacccugccuggguaccuuagccuacgagcaggggugacccuggagaggugggcagaggccaggcauggucccgacggcaucacuaagggcugagcuccauccugggccacagcagaugaggcgcuguagucagaugagccuaaaggcucacacacacauagugagccaggugagaugacacacgggaaacuggauuucaaaccccucccagaaagaaaacaugaguguuguggggaugacuucuggaaggaaauuccgcuaaagcgagaggaggggaguacagaaaauaacagaggcaaaaugguaggauuuuugggggaggagcgaguccucugugucuaaggcaccuucugcuucuaaccugacacaacucaagcucugucaaguuucccaggagggaaaauguaacaaacuaaccaccaagccggaccagugggaggcacagggaaccgugagaacugacugccagcccggggcaacuaggacuauacagccgguggcagacagcagagacacagcagcaagcugugaggcccagaccacaggggugcuuccccaguaagcuccagauuucuacaguaaacugugaaaggucuucucaaccuggaguagugaugggaacacaucaucucagaaucugggaggcugaccaaggaggaggccaagauugaggccaaaaaagcugggcuguacacauaguaaugccuugucuucaaaaaauaaauauauaaauuaaaaaaaauauauauuaggccccagcugaacucggugauacacgccuuuaaucccagcacugggaggaagagguagguggaucucuucgaggucaaugcuaaccuggucuacauaguaaguuccagaccagucagggcugcauagugaugaacccugucuccccccccccccaaaaaaaaaaaagcaaaagaaaaucaggcuccaugacacaggucugucaucaucccagcuacuggagaggccaaggugggaagauggagguuuaaagccagccuggaacuuaaaugacaaacaucuaagggugcuggagguggaagugugguucaguggcuuguccaacaugagguccuggcuacagaggggaggaagggggaaaagagagaagugagggagggagaggaggcaaagauggggguggaggggagugacugcugaaggugccugacaggggugggggggagggggguggggggaguggaguggggcugcucugcucuaaguccuugucuaccccagucuucucuuaccucccugcugccagcgcugagccuggugcuacagagcuccuccucuucacacugagcuguggaggaaagcccacaacaaacaaacccgagcucagcuggagagacucugaugcaaaacuaagagcaagaaggcuuucaaaacaaagcaaacucuuugcagcaaagcaaggagcgggugucuggggacaguccccuggcuugcaggcacaggggagaggccaugccuuccugguccugacucuucuucuuagggacacaucaucaaaugggaugaaaauccauccaggagaccaggggaucgauggcaaucucuacugacccaacugugccuggagcgccggcugcucacaucgaccccucgcucugucuguggaagggucacccucuuucuguacacugccuuccucaagucuccugcagcacccaacuuccacaccacagcagccagccuguguacuccgggcccagugccugaccaagucuggcuggccugccugacccugggugcccaacacuuucuccugaccuggcagaaauggcagaaaggagagggacuuaagggguuggggagauuacagggcuuggcaggauuccccaccccuccccccaagaugucccccccagacccuucccccaucucuccacucucaugagcuguuuagacagugguucccccaccuagaguguguguugacuuagaggcacuggcagcccugaggcucuggagccuugacuugaagaaacgccaccagucauuucucccagccaggucaaggugaguaaacugacagucacuggccucacacagcaaggugcaaacccaaaccacucaaacagggcaaccaaggcuguccgugacccaaggcaacuugagaaaucaaucgggagcaaccuggcccauaugccuggggacccacaaaaagguaacuggccgucugugagguagggcauuugcaggguuguugagggagggggcaaaaccaggaccugcauggggcacuucuaagagaccaguaagaacccuaggacaaagagagaggguguggagccagccagcccccaucccacaaacagucuugaggcaugacuggacauuuccacguguccuucgauggggacaggaaggugagaggcagagcgagugacaugaccacagucuccacagggucacagucaagggcugugaaugacucugggaggcagcaagguaaggauaaccuucacugaggucuccagaaggacccugccggggcugcgacuucugugugcugagguggcuuuggucucuaaacugcugaacuaugaaguaaugaucacuucugugacuuguuacagaaguauggcagacacaggggcagaugccaggaggaaggaauggacagacagauaacacacugccagucuggaagacacugcaccaggcccucgaccacaacuaucgaguuuauggggaagcaagcccuuugcucuuggacugaagggugagacuaaggcuaggaagggcuaaggccuccuugcccaaggcaccgcagggcacgcaggcaugguacuugucuucuggcucugcuguuccugcugaguccacacugaacaacaaaccccaaguccugcuuagccuucuaagccagcuccuucuugguucaaagccccagccagccucgaggaccagccuccucucuccaagccuaaggacuucaccucaaucaacccaacucuacccucuacugcucucacauaacauuucacuucugacucugcaacuggaacguaggcuuccagaggucaggagcuguguccaaaaccaauuucuccauaauuaaaagguggggaggggggcgggugugguggcacaccuucaaccucaggacucagcaaagcagaagcaagcaggucuccguggguucaagaacagccugucuacaagugagauccugucucaaaaaagaaauuuuuuuuuaaagaaaaagcaacuagaaaauacauucaaagcauauaaaccuacuaugcacaguucaaaggaaaauaaagcaccuacucagugaccagcccaauaaaagcagcauucagugaacuccaggcuucacccuugucuccucuucuauacugaagggcacacccucccaaaagcuggguuugcuuuuguugugguggugguuuuuuuuuuuuuucuuuucuuuuuuuugagacccaggcuggccuugaacucgccaccuuaccucaguauccugaaugcuggcaucacagccaguacccccagcccacuccacuucacaagacugcugaguacugccugucuaagcggcucaugaggaauccccaguguccugagcugaccugcguccuccuuucuggagacuucucuaccagcugaggucugagcugccacguacgacgaugcgacacgcccacauauaauuccuguccacgccaccagcagcccagggugguuuugugccuuucuguacagggccaccacucaaauucuuaaucaugccuugggaacuggugcagacauucaggaagggaugugcugggccacgaggcacucagggcugccacucuaccuugccaauccuucccacagugacaggccugccucaccugccucacaggugggugugcacacugccgccucugcgccaccggcaggaacacccaacacuucacccucaaacaacagguuauaggagugguuaguaaagggccaagacuccuuugaaccacaagugcugcuguuucugaauaucugaaacaccuguucccauguuugcugcuccuccuaucaucaggucuccuuuccugagagggaaaugacaagacuccuggacacaggcucucucuacuaucucucucuagcagcuagcaaggcuggagcuggaggucuuuguuuccaaaucccuuccuguacaggcggggcucaucacguuuuacuucauacugcaaaccccggcagggaaccuccucacaguaucuucuagaaguucuccugauggaagucuguagaccuggauuuuguaaugcuggagacuggcuuucauuucucuucugcaauggcaacacgagccaaaaugcuguguauacaauaucuauggccucaguaaauacaauauugccuuaguaaaucccauuagauacuguuugugccagagcucaaguuuccuucuugaagggaaaagaacuuuguaucagcacucuggcaagccuugcccuugcaaacccugacauuccagggguuccuuacccuccuccaucuauuuuaaucaccgauugaaucgacaaugagauggagaaaaaagaacagcaacauaggaaccggaacccaggacucugacccaagagccaauaccccugagccccaggucuccaccuaggcacagggaauuaaggcaagugcaggccacuccuaggcucucauccaaaauaagugacaguuuuugcuugcauuaaaauuuuacaaagugggcuccuaucagccuaacucacacuagccgaaagaugaaaacugcccaaacguccguccagcaaugaacaaaacguggcccgugcacgacacuguggaauacugagcucugaaaaggaauggggcaugagcgcacacuaugacaugaaaacaugagguugggggacacaaaagaccauucagcauacggucacauguauaaagcguguuugcaauaaggaaauccagagacacagaaaacacaaggggcaagaugagcccaaacugcagcccaugagguggaaucccuuuuugugguuguggaaauuaucuggaaauagggcggugaaaccuaccuaacuacaaaguucugaauuguacauuucaaaauggcuaaaaugauggaucucguuacaugaauuuugccucaauuaaaaaaauaugcacuggggacugguuagauggcucagcagauuguuuuugcugugcaagcuuaaggaccugagcugagguccccagcaguaucuaagaguggguauguaagcagaaccaauuuguaauuucaguauugggaagaaaggagcagacgagaggacccugggggccagucagucagucaaacauaaagaaaacucuugaguucugugagagacguuuucucgaaaaauaagguugcaagugacagacacugacccguagccuccacacccacacauaaauaaacaacacuccccccgccccaacacacacacacacccuccacugauaaaguaacguuggacauggcgcgucuguaauauuuuagcaaugacuagggucacucugaaaaagccaucccacccuugggaaugaaguuacaacaccaccaccuguaaaaagcggcuaacgcuucuccccuacaacgagaauucgaugaggugacgcauaaaaagcauuugcaacagugccuucccgccaccccucaauaaaccggagccacuaggcaggaucaucgcucaggguucgaugcuagcgaccccuauucguacugacccgaguuuaugaagaagcuaagagcgcuguccccgcggcuucacuuuauccccuuccucaaucgcacccggguguacuacacaagaggaaggaaacggacgcaacgacaucccaggaucucagcgaaggcucggcccagagcccuggcagguggucguugagacuccccgugggaacccgaacccgcugcggucaccgcccaggggugcggcugaguccugguagcagaacagggacucccugcuagugucccaucccuccccaguggcgccgggcacggcccagcgacucugcaaaacccaccgggcucugcagaagcugcgcgcuuucuucagcagcgcggccauucugcaucaguccugagacuuagaaccuacuuagaccuagcgaccaggaauaaaggaggauaaagagacaccgacaaaagggccgucccggggcgugucgccugugcgagccuccugccgaggaccaggcccgggacaccugcucagggagcugagcggcugccuagagcgcggaaccagaguuccccgcuacggggcgcggcgggggggagggcguucccgagggucgggguccagggggcguggccagggacggaagcggggcgcgaggggcgugaggggcgcgggcgcaauaccugcagcgagaggcgcggucuccgaagcccgucccgcccgcugcccgcgcggccgccgccccgggacaccaccgcagguccgcuacccacgugauccgcgcacgcgcccg

SEQ ID NO: 4825 - RNA, 13225 nt, Mus musculus
cgggcgcgugcgcggaucacguggguagcggaccugcgguggugucccggggcggcggccgcgcgggcagcgggcgggacgggcuucggagaccgcgccucucgcugcagguauugcgcccgcgccccucacgccccucgcgccccgcuuccgucccuggccacgcccccuggaccccgacccucgggaacgcccucccccccgccgcgccccguagcggggaacucugguuccgcgcucuaggcagccgcucagcucccugagcaggugucccgggccugguccucggcaggaggcucgcacaggcgacacgccccgggacggcccuuuugucggugucucuuuauccuccuuuauuccuggucgcuaggucuaaguagguucuaagucucaggacugaugcagaauggccgcgcugcugaagaaagcgcgcagcuucugcagagcccgguggguuuugcagagucgcugggccgugcccggcgccacuggggagggaugggacacuagcagggagucccuguucugcuaccaggacucagccgcaccccugggcggugaccgcagcggguucggguucccacggggagucucaacgaccaccugccagggcucugggccgagccuucgcugagauccugggaugucguugcguccguuuccuuccucuuguguaguacacccgggugcgauugaggaaggggauaaagugaagccgcggggacagcgcucuuagcuucuucauaaacucgggucaguacgaauaggggucgcuagcaucgaacccugagcgaugauccugccuaguggcuccgguuuauugagggguggcgggaaggcacuguugcaaaugcuuuuuaugcgucaccucaucgaauucucguuguaggggagaagcguuagccgcuuuuuacagguggugguguuguaacuucauucccaagggugggauggcuuuuucagagugacccuagucauugcuaaaauauuacagacgcgccauguccaacguuacuuuaucaguggaggguguguguguguguuggggcggggggaguguuguuuauuuauguguggguguggaggcuacgggucagugucugucacuugcaaccuuauuuuucgagaaaacgucucucacagaacucaagaguuuucuuuauguuugacugacugacuggcccccaggguccucucgucugcuccuuucuucccaauacugaaauuacaaauugguucugcuuacauacccacucuuagauacugcuggggaccucagcucagguccuuaagcuugcacagcaaaaacaaucugcugagccaucuaaccaguccccagugcauauuuuuuuaauugaggcaaaauucauguaacgagauccaucauuuuagccauuuugaaauguacaauucagaacuuuguaguuagguagguuucaccgcccuauuuccagauaauuuccacaaccacaaaaagggauuccaccucaugggcugcaguuugggcucaucuugccccuuguguuuucugugucucuggauuuccuuauugcaaacacgcuuuauacaugugaccguaugcugaauggucuuuugugucccccaaccucauguuuucaugucauagugugcgcucaugccccauuccuuuucagagcucaguauuccacagugucgugcacgggccacguuuuguucauugcuggacggacguuugggcaguuuucaucuuucggcuagugugaguuaggcugauaggagcccacuuuguaaaauuuuaaugcaagcaaaaacugucacuuauuuuggaugagagccuaggaguggccugcacuugccuuaauucccugugccuagguggagaccuggggcucagggguauuggcucuugggucagaguccuggguuccgguuccuauguugcuguucuuuuuucuccaucucauugucgauucaaucggugauuaaaauagauggaggaggguaaggaaccccuggaaugucaggguuugcaagggcaaggcuugccagagugcugauacaaaguucuuuucccuucaagaaggaaacuugagcucuggcacaaacaguaucuaaugggauuuacuaaggcaauauuguauuuacugaggccauagauauuguauacacagcauuuuggcucguguugccauugcagaagagaaaugaaagccagucuccagcauuacaaaauccaggucuacagacuuccaucaggagaacuucuagaagauacugugaggagguucccugccgggguuugcaguaugaaguaaaacgugaugagccccgccuguacaggaagggauuuggaaacaaagaccuccagcuccagccuugcuagcugcuagagagagauaguagagagagccuguguccaggagucuugucauuucccucucaggaaaggagaccugaugauaggaggagcagcaaacaugggaacagguguuucagauauucagaaacagcagcacuugugguucaaaggagucuuggcccuuuacuaaccacuccuauaaccuguuguuugagggugaaguguuggguguuccugccgguggcgcagaggcggcagugugcacacccaccugugaggcaggugaggcaggccugucacugugggaaggauuggcaagguagaguggcagcccugagugccucguggcccagcacaucccuuccugaaugucugcaccaguucccaaggcaugauuaagaauuugagugguggcccuguacagaaaggcacaaaaccacccugggcugcugguggcguggacaggaauuauaugugggcgugucgcaucgucguacguggcagcucagaccucagcugguagagaagucuccagaaaggaggacgcaggucagcucaggacacuggggauuccucaugagccgcuuagacaggcaguacucagcagucuugugaaguggagugggcuggggguacuggcugugaugccagcauucaggauacugagguaagguggcgaguucaaggccagccugggucucaaaaaaaagaaaagaaaaaaaaaaaaaaccaccaccacaacaaaagcaaacccagcuuuugggagggugugcccuucaguauagaagaggagacaagggugaagccuggaguucacugaaugcugcuuuuauugggcuggucacugaguaggugcuuuauuuuccuuugaacugugcauaguagguuuauaugcuuugaauguauuuucuaguugcuuuuucuuuaaaaaaaaauuucuuuuuugagacaggaucucacuuguagacaggcuguucuugaacccacggagaccugcuugcuucugcuuugcugaguccugagguugaaggugugccaccacacccgccccccuccccaccuuuuaauuauggagaaauugguuuuggacacagcuccugaccucuggaagccuacguuccaguugcagagucagaagugaaauguuaugugagagcaguagaggguagaguuggguugauugaggugaaguccuuaggcuuggagagaggaggcugguccucgaggcuggcuggggcuuugaaccaagaaggagcuggcuuagaaggcuaagcaggacuugggguuuguuguucaguguggacucagcaggaacagcagagccagaagacaaguaccaugccugcgugcccugcggugccuugggcaaggaggccuuagcccuuccuagccuuagucucacccuucaguccaagagcaaagggcuugcuuccccauaaacucgauaguuguggucgagggccuggugcagugucuuccagacuggcaguguguuaucugucuguccauuccuuccuccuggcaucugccccugugucugccauacuucuguaacaagucacagaagugaucauuacuucauaguucagcaguuuagagaccaaagccaccucagcacacagaagucgcagccccggcaggguccuucuggagaccucagugaagguuauccuuaccuugcugccucccagagucauucacagcccuugacugugacccuguggagacuguggucaugucacucgcucugccucucaccuuccuguccccaucgaaggacacguggaaauguccagucaugccucaagacuguuugugggaugggggcuggcuggcuccacacccucucucuuuguccuaggguucuuacuggucucuuagaagugccccaugcagguccugguuuugcccccucccucaacaacccugcaaaugcccuaccucacagacggccaguuaccuuuuuguggguccccaggcauaugggccagguugcucccgauugauuucucaaguugccuugggucacggacagccuugguugcccuguuugagugguuuggguuugcaccuugcugugugaggccagugacugucaguuuacucaccuugaccuggcugggagaaaugacugguggcguuucuucaagucaaggcuccagagccucagggcugccagugccucuaagucaacacacacucuaggugggggaaccacugucuaaacagcucaugagaguggagagaugggggaagggucugggggggacaucuuggggggagggguggggaauccugccaagcccuguaaucuccccaaccccuuaagucccucuccuuucugccauuucugccaggucaggagaaaguguugggcacccagggucaggcaggccagccagacuuggucaggcacugggcccggaguacacaggcuggcugcugugguguggaaguugggugcugcaggagacuugaggaaggcaguguacagaaagagggugacccuuccacagacagagcgaggggucgaugugagcagccggcgcuccaggcacaguugggucaguagagauugccaucgauccccuggucuccuggauggauuuucaucccauuugaugaugugucccuaagaagaagagucaggaccaggaaggcauggccucuccccugugccugcaagccaggggacuguccccagacacccgcuccuugcuuugcugcaaagaguuugcuuuguuuugaaagccuucuugcucuuaguuuugcaucagagucucuccagcugagcucggguuuguuuguugugggcuuuccuccacagcucagugugaagaggaggagcucuguagcaccaggcucagcgcuggcagcagggagguaagagaagacugggguagacaaggacuuagagcagagcagccccacuccacuccccccaccccccucccccccaccccugucaggcaccuucagcagucacuccccuccacccccaucuuugccuccucucccucccucacuucucucuuuucccccuuccuccccucuguagccaggaccucauguuggacaagccacugaaccacacuuccaccuccagcacccuuagauguuugucauuuaaguuccaggcuggcuuuaaaccuccaucuucccaccuuggccucuccaguagcugggaugaugacagaccugugucauggagccugauuuucuuuugcuuuuuuuuuuuuggggggggggggagacaggguucaucacuaugcagcccugacuggucuggaacuuacuauguagaccagguuagcauugaccucgaagagauccaccuaccucuuccucccagugcugggauuaaaggcguguaucaccgaguucagcuggggccuaauauauauuuuuuuuaauuuauauauuuauuuuuugaagacaaggcauuacuauguguacagcccagcuuuuuuggccucaaucuuggccuccuccuuggucagccucccagauucugagaugauguguucccaucacuacuccagguugagaagaccuuucacaguuuacuguagaaaucuggagcuuacuggggaagcaccccuguggucugggccucacagcuugcugcugugucucugcugucugccaccggcuguauaguccuaguugccccgggcuggcagucaguucucacgguucccugugccucccacugguccggcuuggugguuaguuuguuacauuuucccuccugggaaacuugacagagcuugaguugugucagguuagaagcagaaggugccuuagacacagaggacucgcuccucccccaaaaauccuaccauuuugccucuguuauuuucuguacuccccuccucucgcuuuagcggaauuuccuuccagaagucauccccacaacacucauguuuucuuucugggagggguuugaaauccaguuucccgugugucaucucaccuggcucacuaugugugugugagccuuuaggcucaucugacuacagcgccucaucugcuguggcccaggauggagcucagcccuuagugaugccgucgggaccaugccuggccucugcccaccucuccagggucaccccugcucguaggcuaagguacccaggcaggguugcuuuuuaguuguuaaaugccugccuguuucuuggauguguaacaccugucacuauaugugugacacguccacccuuuagugccuguuugcuguguauacacuuagaagacaugcgugggacuuucucgaaccuagaggccaggaaggaaaauaccaaacaaaccaaacuaauaagggagggugcuugcuguguuguccugaaagauuaccagcuccucauuggcggugggggugggggugccccuuuuauuuaauaugcauguuucuuggggccaaggccacgugcugugacuguuuauuaguuacuuuugaggucguagguccacuguacuugcugguugaauaaugccaggagcugaacacauacauacaucccaggcugcuacccagugauaguugugucuccuagagcucugaaguaggcacccgaguuuaucuuuguuuaggccgccgguagcacagaaucaagagucuuagaggaaucccguugcucaguaguucucuggcaucaucuccuuggaaggcaagaacuuccuaagccaccgguguuacacaguggggucaugccuucccagucucaggccggcugcucucgggaaugguuaugugaaugcagagcugugaaggccaggguccuccguccugcugaggaugucugcuccuucugguuuugcuccguccacaaagagcaucucuuucucucucucuuccugucccugcaggucgccauggcugcuguugacagcuucuaccucuuguacagggaaaucgccaggucuugcaauugcuacauggaagccuuggccuuggugggagccugguacacagcccgaaagagcaucaccgucaucugugacuucuacagccuggucaggcugcacuucaucccucgccuggggagcaggcccgaccugaucaagcaguauggaagaugggcggucaucagugguaacugcagcuugguggccuuucugucuggggugugcguuaagucaaugcuuccaacagggagcuacagaacuuaacuggagucuucugcauccuggggaggccucguucugugcucucucaccucacuucagggagcccugcccucagacuggcauccuccuugucuuagucaggguuucuauuccugcacaaacaucaugaccaagaagcaaguuggggaggaaaggauuuauucagcuuacacuuccacacugcuguucaucaccaaaggaagucaggacuggaacucaagcaggucaggaagcaggagcugaugcagaggccauggagggauguucuugacuggcuugccgccccugguuugcucagccugcucucuuauagaacccaagacuacccagcccagagauggucccacccacaaggggccuuucccccuugaucacuaauugagaaaaugccuuacagcuggaucucauggaggcacuuccccaacugaagcuccuuucucugugauaacuccagcugugucaaguugacaucaaaccagccaguacacuccucauuucuccagcuugguccccagccccuccuucccgcccccuacaugucuuuccugcuuuguguuuuuguuuuuuguuuuguuuuguuuuuuuucgagacaggguuucucuguauagcccuggcuguccuagaacucacuuuguagaccaggcuggccuugaacucagaaaucugccugccucugccucccgagugcugggaauaaaggcgugcgccaccacgccaggcccugaucuguguuuugaaauuuuccucugagacagucaguguucucaguuugaauugcauggugauuuaucucugugaccuagaaagcaaacccggacaccugagcaagccaggugcaagucuggaaacagauuccuauagcgacuuauuccagggcucugagugugggcacucgcacacacauaaaggucucugugugccacugugcacauggaauggucuggaaacaacuugugggaguccucccuuccaccauguggguccuaggauuugaacucagguugucugggcagcaagcaccucuacucgcugagccaucucgcuaaucccugccugggggucugcaggguuaggauucaccauuguccuugacugacagguguuaaugccuuuuuccggugugcauucuucucugaugagaucaacagggaguggguuggaucucuuuaaggauaccauguuucaacguguucacggcuccuggcuugccuuccaggggccaccgauggcauugggaaggccuaugcggaggaguuagcgagccacggacucaaugucauccugaucagccaggaagaggagaagcugcaggccgcggccaagcacauagccgacaccuacaggguagagacgcuuguccugguggcagacuucagcagaggccgggagauuuacgcccccauccgagaagcccugagagacagagacauuggcauccuggugaacgacgugggugcauucuaccccuacccucaguauuucagccaggugcccgaggacacgcucugggacaucgugaacgugaacaucgcagccgccagccugauggugcacaucgugcugccagggaugguggagagaaagaagggcgccaucgucaccgugucuucugguuccugcugcaagcccaccccacagcuggcugccuucucugcguccaagguaagguucuuguccccgugggcuggucggaaaguaggcagcucccaguugcuuacguuggcacuuuccccacagguggagacaggcaagccucucugcuccugggguugcuuucaaguuccuuccaggucauaaguccuccuccucugccccccaggccuaucuggaccacuucagccgagcccugcaguacgaguaugccucuaaggggaucuuugugcagagccugauccccuucuacgugaccagcagcggggcugcgcccgccagcuuccugcacagaugcccguggcuggcgccgucgccgagaguguaugcacagcaugcagugucgacccugggcauuucaaaaaggaccacaggcuacuggucccauuccauucagguagcaccgccgucagcccagagccccgugagcugcaccagggcgggaggguugcaaauccucacauccaugccccauguucucagugauuuugguuacagggugaggugcuuauguggggugauuaaugcaaaacuucucaaauuuccuuugucacccuuaaaacaggaaacaggcugcuuuggaguguguggggugugaggauacugggugcucaguagggguuucagggcagaggucccggugaggccugaaggggaaaugcuccuugcacagccccguccagaaagccaucagggccaugggcucuuagccauggugucuaaucagucucuacacauuucauucucggacucauuuucucaggagaccuacaagcgaaccuaagauuuuuguugugauuguuguucagacagaacaaagaucuuaagaguacuugcgagccagccagauggcucagcaggucagggugcuugucaccaggccuggugaucugaguuugcucuccaagacccacgugauaggagagaccugccucccacaaguuauccuugggucuccacgcacacuaugcugggcauccccgccccugcccucaugcacacacaucugaaaagauuugagauuuaugaaauauuuuaaauugugauuuugaucaguaggccaguaacuaaaugauuuacaguaauuugcuuuuuauuaucuauaguagaaauagaugugcccgaauuuagaauuucacugggcaauuucugauuauaauacaaagguaaauacuuugggggauguuauacauaaagauaauucaguuucccaccacaagauaaaugugugagucggucagcagugacuucucacacuugucugcagcucagagccgcagcuggccuaagaagcugucuggggagcuguuuccgagucgguaauaccuagagcagugagcagagaggcucggccuuggucaucuugggcuggauuugguagccuagcaucucuucagucgucaggaggcugagcugggaggaucucuacuuagggccagccuggcccauggagugagaccuuuucuuucucaaaaacagaacagaagcagcuccagggccucgccguccucuuagggaugcagcuucgaggacaauggguggcaagacacuuugaccguaucugugaaagcagugucuuagcugccgcgcauauguucacaucaaugagcucaccagacugguuuuuaccuaggcccuggggugcaggcugguaagcucggcuaccuuggagcaagugcaaccugaacagauuguccucaggguacagacaugaggcacuggggcuucaaaggcacacuccugagggaggauuccuucaacgcauccuuuccaucaguuuuggcugcacuuccugaugagagcuaagggugcccagagcaccccacacugaucugcaccuguuguuucuucggcucucauggcucgggacucuaaccacaucuccuuugucucucauuuguaguuccucuucgcacaguauaugcccgaguggcucuggguguggggugcaaaccuccucaaccgcuccuuacggaaagaggccuuauccugccaagccugagccaggaggcuggggagaagcuugguuaagccacggucaccuacgguuucuggcguuuggaagaacacauucacuccaccuguguaucgucuccuaccaagucccuagugcaucgccauccuucaugaggccgacuguuacgucugugagcaaaccucagggaccacaugguuggcccagggcgcauggccaugaagccugaggacagaacgggcugcuuccucaacacuuggagcgugaccagcucgcuccuguauuguccgucuugugcuggucuuuuucuuuuucuuucuuucuuuuuuuuuuuuuuuugagaagucaccuguuuuccuuuuacaggugacugauuauaguauuggcuuucaagauguuccucaggcugggcgugggggcucacgccuuuaaugccagcacuugggagcuugagacaggccugggcuacauagugaguuccaggccagccagggacaugcaguuaaaccuguccuugaaaaaaaaauuaauguucaucaggaagacaacagaaaaguguuauuuucaaacugugaacugggagugcagguguuaacaguagacaugugucaugcugcauagcuccauggggggugucuguguguacacacugccuuucccuaaggucccuuagaaccaugugugugcugugugucugggugaaguuaucgauaagacuuuacaguagacucugccaagacgagguuaugagggagcccuucccagaguaaacgccugggcuacucccuuucaugugcugaaagacuuucaggcucuacgcugugugggcuugccauguccuacgacauuguuucuuugaguacuuuugucuuucccacucuguagguggguuuuguugcuaggcugggacacauaauagguugucuuuggauguaccuaaguggugguuccucacugaguccguguucuaucugacccccuucagagcuuguuagagcuggcuuucauacacuuuucuauguaauccaauuucuccccaggagcguuguugauaaaaucaucacguguuuguggaauagugguugaaauaugggcagcuuuugugcgugguauaagguaguuauugaagugauguuagcucguuuuuagccugugugaugaauguguacauuguagggaaugcuuuuauuagcgugaggguccuuuacguauaucccacaauaugggggcacacugaaacuuaguggcuuucguugguuuauaaaaccaaccucuugggagggucucauacccagcacguggaagcuuggaagucauggcagcuugugcagaguggaggauguggcguugccccuuguggugcugcgcugugccugggaagugagaaugagcggcacgcugggacuuggauggaguugcuuuagugacaucccaucaccuguaggcccaagugcacuuugcccaggacaucagaugugccauuuuaaguugugacucagaucuagaucagugucuucauguccucagaucaugggcagacuaccaugcuuggagacagaggaggaggagccucggcggggacggcuaccuuacugcugagaaccuucgugcaugugauaggcggcaguaccuccaccugagaccuaaucacgcauggugauuagggaggaaggcaggagacugagggguucaaggccagcaugggcuauauagugaaacucugguucaggaaacaaaaacagcagcagagacgcacuguccgcucuguguaagguccuguggcccaguauucagacuugucuaucaagugcggaguccuugcuccaugaugaggagucagugauguucucucagcaggacucagcuagaacucggagcacagugauccguggcugcagcagaagacucgaaucaggcaccuuuaggcuuccuagcucucauaggcagacccucucugcugagcuagucugccugcccacuguggacauggcuuuuuaccaaggaaggaggaacucggaaccuuuguaacucauccugugaaucagaacguaacaauaaaagcaucacuguuuccuucaggucccgccac

SEQ ID NO: 4826 - RNA, 31377 nt, Mus musculus
gggcguggcuuucacgggaguggaguccccgcgcgcgcucuggcucugcaguaaccgcgggccucucuccgaggaccuuagcuugcuguugcgagcggccaccuccccugcccacucucggagcccgcucgacucucguagcggaucagggacgcguucacugguuccggcaguguccucgcggcggccauggccacgaagaucgacaaggaggcgugucgcgcggcguacaacuuagugcgggacgacggcucggcggucaucuggugagcaacgccgcggggccggggaagccaguagugaccugcuucgugccgcucgccgccgccgcucaccuauguuucuuuucuuccuccaacccaaagggugacuuucagauacgacggcgccaccauuguccccggcgaucagggagcagauuaccagcacuucauccagcagugcacagguagggcgacccucaugagaccuuuugaaagagggugggcacccugggcagcgagcugcugggcguccaagcagcagcagaucugggcuggggcuuuguuuguuuguuuguuuugguuuugucuuuguguuuuuggagauaggggcucacuauauauccagggugaccuccaacuggccauccucuugccccaagcgucuaguacugguagggugggugugcacagccaugcaaagcucugaucugagcuuuccaaagucccgaguguaucccucccccacccugcccccaaccccuguggacaucaccaucaagugacccgaggagauuccucccccgguagugucagucggcuucuuccgcucccgcacccugugguccacuggguuuccaggucagaaggggcaguucaaacuccacccucucugauuggucagugaacaauaaacgccgaagccccugggggcugcaagcuaaaggcagaacccagggccccacccuccuuucucccuuccaucuuugucccuaucugcuucuguacaagccuuuaauuugaagaguacagaaacacgcaccaagaauguguauccgauguugcuauaccaggccuggauaaagagaagcugacuugcgaggucccagcggccaguuuccuuuggagcgaauggccacuggcugggguggggcauggagagcugagauugcuccaugguuugguguggaggaaucaagcagaugugugaccuuacuaaaagcaucccagggaacccuaagguuuguguguguuaagcuucccugggacauguggaccaugaaagaacacagggccugaauggccacagcucccguagaacagcucaacaccauugguaaagagaucucuaaaggagcuggugugcagagcagcucagcauauucuggaaacagaggcagggggauggagaauuggaggccagccuaggcugggcaucccccgugccuuccggaaaaagagccuuuaaagagauuggaaguaagagaccccggggccuagugucuccuuagcuuuggaaccuaaugucaaacaaaagcaggccaccuaggagcuaggguguggacuccugggaauggcuguggguuagaaucccucuugggcugcuuuccagcugagugggguggggccaggucccuggggguaggggugggggucacaguuccucaccugaucucuuguagugcugcugugagauugacugaucccaaguguguguaaguguucaggacagugcuggucagucauuggugacaagcagaccaaaaaaaaauuuaaaagccagggucaugugacuuaacugcuuucuuucuucuuuuuuuuuucuuuccucuuuucuuucuucuccccccccccuccgcccccaauacuggguacggaacacagagcauugaauaggcuggccacaugcucuaccacugagguacaucucagccuucuuaaaaagaaagccauuuuaauuugagacaaguucacacuccuugaaccugcgaucuuccugcuucugcuuccuguuuucuuuaauugcuuucuggccucaaacuuggcuguguagcuaagccuggccggaaacuccccgauccuccugccucugccuccaaaaugcuaggaucauaggcuugcaucaccuugcccgguggcauaacuuucuuaauugaaucaucuuuugcauuuaguucgucucaaagggcauucacuuugugcugugugguacuaagauuagugugagauugugugucugcguguaagcauucuccuggcuaaaaugucuccugggaguugcugcuagacucuguauucauugcuuuuguaaauaauucacuuaaaacaacaucgcuguaaagggcgauaccgcggagucagcgcgcaggaucucagcugcuccgacugcagcaaaugcuuccaacgugggacaagugcagacucaacuuucccaaaguuggcgcaccaucaggaggauuguccccagagucucuggggcugggugccgcagguccgcuuccauccucaccgggagcccacccccagcucuccugccucugugacuauuuacuccacuaagcuggagaaggugacagaacuggaggacaagcauccggcugguagauucccagcugaugcuccuguugccgcacauccggccuggaugcugcuugggggacacuuccuuccucuggugggcugugguuuucugcucagaucucccauggcuaacccucuacugggaugggauggcagucgucuggcgucugagcuaaaaaugcucugcaggcugcuuguuggucccugugaauggacugugggaucgaggcugcagcugcagucugcucucucuucccagccaucugguggacauuguacagauggaucugcuugccacgucugcucucugucccucccccgaugaggccuccugagccagggaccccacccacagccuuccuauuuguaaucuuaccuacucccacuguaccugaccugggugucagcgcugcuuccggugggcuggcucauucugaagauugcaaaccaaggcccagagagguuaagugacuuaccugacuccuagggagaacagcgccaggucuggacucuggggcccauagcucuuguccccaaggaagugguuuagggucuucuucuuugugagaugguuugcagacuggaagauuugcuuauugugggguagggagagcccuaauucccugucagcugccuuggcaggccccagaagaaaggcuuuuucucuuauuuccaaguaccucagcgauguauagggucccacccugccuuuccuguggaauuaucucuccucaauaacuacaaaauaacagaaugaguauauaaauauuaaccaaguuacuuuucauuccuguagcuuucauccugagacucucagugggugcuuagccccagcacacagugggucagccuacauccagccugcgauggccuccuguggcacuaaaccuuagccugggucuauuugcaggagcugcuugguccguggggagaacugguugccaugguacugaagggugcaggcugugccaauguucugaguucagauucauguucccgaagcaagaaagcugcccaucuguugacccuucugccacagugcagacagcaggaauguaugcuuagggcauaguauguuccucaaaugucccugaguaggacuagcauuuuauuuggggacagagguccuggggaagcagcguacaugcugagauggcagaaagguaaaggcuggaagguaggggaagcaccugagcugggggcuacagggaccccagagagccacacagagucaggaggcaucauugcucaucccacagagguugaggggccauuugccaaccagaggggaugcacucauccacaugacagcuguagacgcggggcucauaggucuggcaggggugacaaggcagagacuccagcugucuggagucacauuuuguuuuuguccugggcaggcagcucaagcgucuuugugugugugcacauguaugugugggagcauguguuaugugugugugggaacauguguuaugugcaugugugugugggagcaugugugugcacauguaugugugggagcauguguuaugugugugugggaacauguguuaugugcaugugugugugggagcauguguaugugcauguaugugugaaagcauguguuaugugcauguaugugugggaguauguguaugugcauguaugugugggagcaugugugugugugcauguauguguaggagcauguguauguacacuuauguguguauagugcagaagucaauguugauguguguguguguuuucccaugcaugcacaugccauggugcacaugugggggucaguggacaguuuuugggaguuaguucucuccugccaucuggguuccagggaucaaaugcaggcggucaaucuugggaacagggcacuguuacccaccccccucccccagcuuugccagcuugccaccuuuugagauggcucacuagcauguaacuguauccagcuuuucugagaguacuggucauccagacauggguccucaugcuugugccacaaccccuuuaucaacugggccacccaacugcaaaagguucuucuaggauaguuggagacuccggacaaagaggugaaaaccauucagaaauguguccacccuucacuguguccacccuuguucuguccuuggucauauccauucauucugugcaccucuggcuacuuuguagacuuuacucugagaacucaggugaaaugucacagcaaagacauccuacacucagcauauauuucaugaucucccaggaggauuggccacaugaccauggaccuaauuuuugucuguguucuugaaacauuucucuauaugaauuuucugguucaaaguaggaccauccuauggcuguugggccacccaccuucccuucugagaccauguuccagcuuuacucucuuuuguuuuguuuuguuucuuuuucuuguggcuccuuuaaagggcuauacaauauagugcaacauugucuaacuagguccgcugcugauagacccaaaggcuuugcugggagcaguuuucuuuuggaaagaacccaggcuucugggaaugcauccaguguucuggugucgauuuuagagucugcggggaagagcacagaugaaggauccaaucuuugcucuaaccgaagccuggcugugcugugugaccuugggcaggucugccagagucucuguuucuguaugugugagaugaggaugguugugguugauaaagugacaggauacagaagcgccaccuggcauaaaauagauguucuguguguguacagugccaccauagcugucuugggagcuaccuggcccaggcagguugaaggaaacuggauguaugggguagucccuggagaagggcaugccaagagacugucagcaaugauugguugacagaggugcugggugaaugugauacuccuaagaugcucuggucaguccacaggagaguagccugaagccguuuugauuuaggacauugaucuauaucccaucuuuugugaggguuuggggugaauggcucucuagauggcacgugacccagacguggcuaauucgaucgagccuccccaucaugaugauuagcccaagguaggagccucacaugaucccucaaccugaucaggcuugcuucugggacugggacuuuggacagggcgguugggaaagaguccuuuaaucuuucucugggauuaaacccagagugaaugaaggcuuggagucacaggacccuucugccucugacagagccuguaggcagcacaggcaaaggucaggguuggagaccagugggcaaggcuuauacucuugauccagccaugcuugaaucugucucuguccuuguugacuucccugagcuauuugauuucuuugucuuuccuucugagacagggucuugaaacuguagcccagguuggccuugaacucacuguuuagcucaggcuggccucguagcuuaagcuaaucccccugagugccaugauuaaggucugagccaccacaccugcuggauucugacuuuaccuucaaggguguggaguagcuuggauacuguuugggcuccgcugaugcuuucccuacauucuguugcugaguacauuggcuuugugucagcccuuuggauuuauagcuuggugaaguuuuuucuugccuuugaguuugugaucacuuuugcggugucuauuuuucucaugaguagccagugccccuccccuuagagcagcuucuuuaaucuccacccucaggagcugaugcagccuuggcagccuucccucugaguuuucuggguguuauaacuccccacuaccccccucaccaaacacagacagacacacacacauguacacacagacacucacacaugcauacacacaugcacacacacacacacacagacacacacauguacacauacacaugcacacacagacacagaaugaauacacacacagagacacacacagccacacacacacauguacacacacaaacacacacauacagacacacacacacaugaagacacacacaugcauacacacacagagacacacacagccacacacacauguacucacacagacacacacaugaacacacacacagacacacacaugcauacacacacacacacacacacacacacacacgugugcacacacagacccacaaugcauacacacacacagacacacacagacacacacacaugcauauacacagacagacacacauauauacguacacauacagagacacacacaugcauauauacgcacagacacacaugcauacauacaugcacacacacacaugcauacacacacaggcacacacagacacacaccccagccucucccuuugcacuuuaauuuuccucuuugcuuuuucuuuuucuuuuaaagacauucucacuguugaguccuggauggccuggaacuugcuauacagaccaggcuggccuuaaagucauagcagcccaccugccugugucugcuggggacuaaaggcuugaguugccacugugcccagccuuguuaucuuuuuuucuuuuucuuucuuccuauuuaacuuaccucuucugguguuucuagagacuuuggucuucagaaaaccucucugcccccucccuucacacugcccccccauacugccuccaccccuacugccucuauucccuuaccccuuccccucuccccuuguccccucccccucugccccugccccccuccacucuccccucccuccucuugcuggggcuccuucacuucugucucuuucuucugcccuucuuccugccugucagucugaaagaccccagggcuccgcccuuccugccggccuugucucucauuuacuaaaucuacugaauaaggccuuugggcuggcuggggccucguucuugaccccaugaccugguccuccagccaggggugacugucugaguucacuuugggauccccaccccccaacuccuaacaguauuuuuauggcuuuuguccagaaggccccugugcugggaaugaccuggaccgcucccugcugcccucccccacccccuuuuccucagaucuugugggcagucuuccuccguuuugcuuucuaggaaggcuucucugcucuaguuaaggccuagggaaaacgucccuucuacucugaugucacccuuguccucagggaguuggccauguguaauacguguacauguauguggguguugcacgcaugugugagagagagacugugagagagagagaaaagagacacacacaaacacagacacacacacacacagaaugagagagagagcgagagagagaauccuaugguccugaagagacuucaugguuuugguaugaucuugguagcuaggccuaagcacaccuccccccaacccccaugaguacgccacuccuugacugaccugacucaugucuacuccuguaagugcuggcucuuuggccuucuguuuccauuucaagaaggaaauccaugcugucuggccuccaaucugaacucuguucuaaugugagcugugugacccuggcaagucaccuagcuccucugugccccauugugcucaggcaggucuaaaccagcaggcucagccaccuucuguccacccggccuguuuucuccugggcacuguuuuagcuuagcucaagcugacccugggccccggaccugggugcaggccaggggguuggggcuggggguagacccaggaagcaggaaugaggguguggguugggugaggcaggagggcggagaagcaguacagggaauucaugccagccgcugaggcugguggggaccggaugccauucugcugggacccucgaggaucugguaggaggcuggggcacacggcuaccaguuuaugucuccaguucauugguuaagaggugucuccagacuccagggcugcaucucuggugaaucaagcagucagagauuucauagauaggccaugagcagaggccaggugguuugggggccaguauuccuuggagcggguggcaaacccuaaagccacgcccacacaugccguuuuucccuacuuggaucugagccugccuuuagagcugcuguauuucaugaugcuguacugggagcacuugggaguguauaaacacagcccacuauuaucuaggugguccccagccgugccugaaggcugagccugcacaggaaguuccacuguccccucugaagcaguaacuccgcaaucagugcagagcaaauggccccugucaauagcccugaccacauggcugcguuggccucgugccaggcgucucccugcagucccgugucccagagugccucuccuacagaccuguguguacucuauucucagagguggccagcggccucagagcauccguccccagaggccuguuuccgagagcgaauuuuuauauugccuuuuaauauuuaugucauggaugcacuucggaauuaacuugcaguagaucuggcggcgggggaggggcgauacugaggcuugaacccaggcacucuugcaugcagggacgugcuacccuggagccaaccgucuucuuccucuuuucauuuugccaaguugcccaggaugguuuugaacuucgacuccucccgccucacccucccugguaacuagauugacaggccugccauagugggucccgauuguuucuuauuuauuuuuauugaggcagggucugggcagcccuggcuggccugggacucacugcuccuguaucacuugccaggcucugaugucuccaucuuugcuggucucugcaucuguccucguguacuuacuggcauuugauucugucauuucugcucauccuugccaauaaugagcagguugauaguauuaguaagagcagugguuaaugguggccuuccuauggccuuggcuuuuguccucuucuugccucuuuaaggccagcaguaucugcguaguccuuucucaugacagcuccugguccucacucuccuacuuccuauuucuccauguaggaaucuguaguugccuuuagccaagcuaaagguacucagcucaagcaggcaggucaugacagggugaugggggucccccagucugcguacauuuaagauuucccuguggucuacuuaucaucauggguucccaggguggguucugcguguccagagaccuuguccuggggacuggcugcucuguggcguuaggugggcccuccagcacccagccuaccucaccuuccugccuguugcucugcggucucuguuugcuccuugguugccaugguuaccaccagcguucuugucgguguucuugucuucaucaccgucaucuuaccagcucuuuuccuuccuuuuuaucugcauaaucugucuguguagcauaggcuggccuuaaggucacaauccuccugccucagccaccagaguguugugauugacagguaugagcuguucugaugagcuucuccagccucuuucaaaacuugcuaggugucaggccaauccaagggcuuguuuuugucaccugaaugcaccgaggacagcagacuggguuaacucucuggagacugagaggggacuucuugccauccccuugguagagcagccagccccuccugugugcuguugcucagugagaccuaggaaggaggcccagcccccaccucacggccucauccaggccagcagcuguguauggaugcuuucuucucuccgugcccuuugguuaaaaggucagugugcaaaugcugucagcugcuagguggccccugagcuagcuuucucugcaucuccugcucucucucugggggggggggggguguaagucacacugacagugcccagggggaauggugccucccacaguacugagcugcugacaccgaagacugcgcgcucccgagaccacagaggugacugcucaaggcucuuucugagcgugugccaugcgccagcaccaucugggcacuaggauugauaggaacaagauguagucuuccagacugugucgcuggccccgauggaagagugccuacguagcucucagggaagccuggauucaguccucaucgauguacaaaccagacauaguggggcggguuguaaacugaucacccagucgcuugggagguggaggaaggagagucgggaauucaaggucauccuuggcugugugguuccgaggccagccugggcuacgugagaccucugggccaacuuagccuuuaagacuuggauucaaugggaucucauccauggagccuuccuugaucacagccuccagaaaaagcuuacuuccuuccuucuuugauguucuagucacaccugaguaacagcccuuuggguguuuggugucaucgugcucacaguuggaggguagugaucggguagggacgucggucggucguauuuaguaaucucugaaucacagguuaacugugcgcuuguccggggauugacuuagcagaacugugaagggcaaaucggugcuugccuggcugccgggugauccaaccgucacaccccauacgccacacuggccugaggguaucuggccuagugcuguuucagcagaucaucaacagagauaacugauuagcgcaaacaccugugcuaugucggggaagccuggggcgcucuguaauuugggucuccuggucccccuguucccuggagcuccagagccugccaaaaucaucucccacuuacucuacugcauuuucucauguucuuugacuaggaaagcugggucgccaguggcugaugagaacucagccggaaugguuugggcugaugcuggggugggggaggagcuagcacauuauaugcaaugugaucacagacgcaaaacugugcacgcagaugccggugugcuuagauaacccuggagauucagccuccuggccgcugagaagauaagucacuguggacgagucuucagucugggccugcgggcuuucuuuaugucguucagaaguauugcuguuacuauucagugguucugggauuggauuaagggcccugcucacccucaggcaugauucugagcuacauacaccccaccucugguuuuacuuuucuguuuuucaguaagucccauuagaccgaccacaugggccauccuccugucccugcaguagcuaggguugaagcuccauugguagaauaauuucccagcaugcauauaguaaaccagguagguacaugucauaauccugggauuccggaggcagaggcaggaggaucagaaguucaggaucauaccaggcugcaucuacguuugaaaccaacaugaaacccuguguuaagaaagugagacagauguuugggacaagagggugccggcgcaagcccuggacagccaggggcuguguaaugaagagagaccauuuguuaccuagcccuuuucuugcaauuuccaaucagccugaggcuccgaccuucuggccucauucauucauucauccauccauccauccauccaucuauucauucauucauucauucauucauuuucuugugcuagggauggagucugcagacuauagcaagagccaagggaggaggguguguggcaucagcagugccuacagaugcugucaugaaugugggugugccagccuccuuccucuguauuggaaggagagccucaugcccucuggggccucugccugguccuacaggagccaggaugcagugacuguguccagcugccucugggcuuugacaggaugucaaagugguggguuuuuuuuguuuuuuguuuuuuguuuuuuucuuccucccagcuuccuggagauguagcccccccccccuccucccgcaccuccagccuguaaccccuucucucuagccucucuucccccugcagcccuccccuccagccuggaccccccuucagcccugucccccagccuguccuguccuguccuuguuguaccccauguccucucucccacucccugccugcaacccccuccccuugggaagauggcugcucagcucuuuucuuuggugugggaguguuucuccuuucagagcuuuguuugcacaacuucucugaagcugugaagaaggucaggagcugugugagcuaauccagggcucugggcgugugcccugcuuuuccuuucuccuuucguuguacucugaaguucagcuucagggcagaaauagcaaaaaaaaaaaaaaucauucucuuuuuuucuacuuucuguuggcccacgguuuauuuauccauugccuguggugucccuggcacagggacaugagaacuggacagaugggcgaauugcuuaaaagauuugauuugugguagguaggucaccccugcagugacagcacccggaaggcugaggcaggagcaucguugcauaaguuuaaggccaguuugggcuauguaguaaguuccaggcuagcuagcccuggcuaaagaacaagcuaggcucugaucgaaacguucccagagccccuuccaucagcgccuuuauuuucccucguucaaguuucugcuuacuccacacccagugugugucacgcgugauaaggaagucacugagagcucacucaguguuaagugcuaccuggcagcucuuuggucccugggccugcccugaagcgucaguguggaugcaguguugggagaugggggcggcauuguggugggagggggaggagggagaugagccccaacuuaaggguccacuaagguuuuuaaauuuggguggguaagagcagaacagcacacacgaucagcauagcagggacucuauguugguauuucuuugggggacaucaccgaagcagccugaccuaguggcuuuguagauugcagacaauucugacuuccuuuucuguuaucugucugucuuccccucccccguuuauggucacuccauccuuaguucacacucugccucucaguucccuauugcuguccuugccuggcauccccuugcccggaccccagcuggcucuccucuuuccuccugcuagggacccuccgccaugcuucaucuccuaaguccuucccccuuccuagauuagagggagguggggagagggcacauuuggggauaaagcugaagaguggugguauaggccaucgugaagagaggggacaugagaggaacccaggcagaugcgggagggcccugguggagcaccacucaggcaguggccugagcacucccauuggcuucccacuauuguuuauggggugcucagucgauggaggccuggagcuuugcaaucagcagccuguggugguugucucccugcucccacagcuuccauagagaucagccugcgaagaggcaguagauaagacccagaagggguugggggcgggcauuguaguaaccccguggcucucaugaagagagcucaccguauugaggggaaggcuguuaaaguuccugaauuggaggugaagaguucuguguagucaccccagaccuggcacgcacagggaagguacagaauugugucaaccuuccggcaugggucuggccucaucuuauccuuggugacaucccuccauggggacucaaauagauuugugauucgugccccaguccuugggauaaggcuucccgacgaugacgcauuaggugagcagggaguuagacaagcaagucuggacgcccugacacugcucaaggggccuccuuuucugcuguggcuuuugggggguuuggggggagggugagucugagggauagccuuguuugucaccuugaugguuaugccucugguccugcagagggucauguagaagaccugcagcgggucauguggaaaaggcggaucagacccuucaggaaacuuggccugauuacuuccuuaaaaugaagcggcgugaggcaggaggaaggggugggaccggacuucaaggacuucugcuuuucugugcuggagcccucuugucccauccguuguccccacuagcugcgugucccaucccuacacuggauccccuacauccccaccuugccuuacucuuuccguaguggcucucaagcuuuggcucauucaagucaccccaaaggcauguucaagcuccccuccugcgcugccuccuggaguuuccagacaagcagagugcauguccuucugggucauguguguugaaaggcaagccaggacugugcacuuauugagaacuagacuucagcaagaaagcgacuucuuuugaguacacuguagcugucuucagacacaccagaagagggcaucugauuccauuacagauggcugugagccauguggucgcugggaauugaacucaggaccucuggaagaguagucagugcuuuuaacugcugagccaucucucccagccccccagaaagcagcuucuaacucacucccauaacucucaacccauaggucaggacccuuuugugggucaaaugacccuuucacagagguggccuaagaccaucgaaaaccagauauuuguauuacaguucauaguggcaaaguuauaguuauaaaguagcaacaacaauaauuuuaugguuaagggucaccaaaacaugaggggguugcagcguuagaaaguuugggaugcaccauucuacuuccuugccacccaagucccacuggggacaggguaucacugaggaggauggcagcaggcccaggugccagccuucugaugaguguuccaccuuagcacacgugugcauguacacacgugugcacagguccccucugcucaucggccacucuugcacuccuguucugagaagaggguggcuuagguagugugcucagacagcuuugcgcccucauuuuuggagaaagcggugggaguggacuuccggaaagggcugcccacucgcccugugcugucaggauggcugcaacugccuccagcuucaauguggugguagaaaugccgcacaggccuuguguccacccucagcugacauccuguccagccgggucuccagcguccagcauuuguaaaugcuaucgcuccggauuucugaaaaugugucugucagcgaucuugaacaaacugcugcuagcuagcuaagcacccagccagucagucacuccacaugugguuugccugccucccucccccacgguuguuuaaaugaagaagucagcaugagguucuggaagguucccaaagccuuuaggggugugugugugugugugugugugugugugugugugugugugugugagacuuauuuucugugcaccaaggauacaaguuuuacugggugacugcuagagacucuucaaaggaaaucuaggggcugacaagauggcucaguggguaaaggugauugccacccaagugugacgaccuaaguucaguccccggaaccugcauaaagguagaaaaaggggaucgacuccauuccuccucugaccuccguauacacacccugcaucacuuauaugcucucaaaauaagaaauacaacuaaauaaaaaaauuuuuaaaggacccuguucuuuuauguuuaacccaaaccauauuggaguauacacucaaacauuucagugcugucuggggugaguguuugcaauggaugaggggcagacuuugagagggccauauuuugaaagucccuuguggcacaggaaagcugugaccagcagucagggagggagagcugacggcccuggcaggcucugcacuuggcuggaugaagggugaggucaggggcuccagccacugucccacacaaagucuuuggcaagggcccauaguugcugggccccagacuccaugcugacacagcggagcugggacaucgucaccaugggaacggagacuggugguguuuugugugaaggcugguagggaaguggcugggaugggugccugccuccccugcaggucaaggaugaaauucugucaaacauuucagugcuggguauuggacacagugcauaagacacuguccacagccccaccccauucaugcugggagauacacucagauacugguggugugcaucuacgccagcuacaaggcccaugaccacacaaccuagaaaccuucaucuucaagaguucaaggugagcccaggccacauagcagcacccuggcaacccugagccaugacaguaauuucagauagaaguuucuaucugguaggccaggccaccagggcuuaaaugucuccuccucacggauaaugauagaaguauggagcuaacauuuuggaagccccggggagacagagacaggagaauacuuagggcuuccugacuggccagccuagcauaccugguagguuucaggccagugagagucccugucucaaaaaaacaaaguagauaguacccgaaggguagcacucaggguuguccgcaggccacuacacacaugcgcgugcacuuuuacccacacacagguguacagcacacagaugaccccugagaacacagugacuuaagaacuccauccccacagggcacaugugacaucaugucauguuacucauguaacuaucuaaaucagggaucucagugaauccagagacagaggcagguugcugguugccgggggcugccugagccuggaagcagcugcucuuggguucguguuuccuuuuuggaugaugagaauguucuagaauuaggcuacggcgaugguugcgcaguuguguccuuuaaaacgauaugugugcgugcaugcccaagugugcuuuuuuuuaaccagugacauuuuuauaaguuccuuacugucauaacauuuagauuuugaagaaaagaauuuuaaaauguagaauaucucuacaauccuguugugcgaguacaaagcacuuggacuggcaagagaguucaguggggaagggggcuugccaccaggcccaacacccugaguucaaucccugguaccaacauggugaaaaaagagaauagacuuugcaaaauuguccucugaccucugaacauguaacauggccuucaugaaugucccacugccacuggcugcccaguggauggguaguucuuccccugggggacagcugaaaguguguagaguuggcucgucagaccuuaaggaugcucuaaguggugucuagugguggaggccagagguaucguacaacacccuguauuucauuguauacuggggacacacuuguauccgccuucuuucugggcacaccuguggcucauggccucucccagggacauggugucagggaguccuuaccgagugccauguucucccugucuuggccacagaugauguccggcuguucgccuuugugcgcuucaccaccggcgacgccaugagcaaaagauccaaguuugcccucaucacauggaucggggaggacgugaguggacugcagcgugccaagacggggaccgacaagacgcuggugaaggaggugguccagguaaugugcgcugcugcgugucaccaagggucaccauccaguugcagugggugggggggcugugggguggacucuggagaauauuaacauuguucagggagcuggccagggccagagcucugccaucuugacuguuacaccacagaacauagcagcuggacgucagcuuugcacagccagcagcucacagacaaggugaccagaacggagacuacugccugucccauuguggaggggucccagaaguggccacggggauguaggggagagcaugugaccuuucccaguuccugugguaggguacacaacacggguguguugucacaguuugguaacuuaagcaugacaguaguaaugccaacagacagcaccacagacggugagguuguugguuugcugguuugggugaggggccaccucaagaaaggaaaaucugagccgggcguggcggcgcacgccuuuaaucccagcacucgggaggcagaggcaggcggauuucugaguucgaggccagccuggucuacaaagugaguuccaggacagccaggguuauacaaaaaacaaacaaacaaacaaacaaaaaaaaaccaaacaaaaaaggaaaaucugaauuuauuacagucaggcaaggugagugugcaggaguucccaaagucuagaagccagagcccuucuuuuagcuuauccaaacugcuguucaggugaccgggguagguguggccagcccucuucagucugucuguugcccaggggcaagugacuugugcaaagcgaaaagauggggcaggagagaugguucaguggucaggagcauuggcugcauccccagagagccuugugugcuucccggcacccacauggcagcucgcagcccucugcagcugcagcuccaggggaucugauauccucuucuggacuccacggugagcguuguggacaugguacacagacauauauguaggcagaacacccagaugcauaaaauaaaacaaaaacaaaauuaccuuggcucccauuggcucucugguugacauuuaaaaaaaaauuaaaaauuuaaacaaaggggcuggagagauagcucaguggcuaagagcacuuccaaagagcagugguuaaggcugcucuuccaaagguccugaguucaaaucccacaaccacaugguggcucacaaccaucuguaaugggaucggaugcccucuucugcugugucugaagacagugacaguguauucacauauauauaagaugaauagguuaauuaaaauaaaauuuaaaccaggugucuuagugggguuacuauugcugaaucauuaugaucauacagcaagucggggggcagggaggguugauucggcauauacuugcuuccaugacaccuuuuaucacugccgaugcagagcuguggaggggugcugcuugcuagcuugcuccccauggcuugcucagccugcuuucucauaggacccaaaacgaccagccccagggauggccccacccacagugggcuggacucucccccagugaucacuaguuaaguaaaugcucuccuggcuugccugcagcuggaucuucuuagaggcauuuucuccguuaaggcucccucucaucucugacgacccuagcuugugucaagcuguccugaagcuagccagcagacagggucucucuguuagguugcucuggcuucuuccuggaacucacucuguagaccaggcugaccuggaacucacggagaugccccugucucugccuccugaguccugggauugaagguggaggcugaccguauccaguuucuucuuuuuccuuugaguuccgagggucaagcucagcuccuuucccgugcucuuuacagccugaguugcucgaagccgcuaucuguuggccucuguagaaucccuaggaggaguuccagggcuuacaagccuggcagucggcuuaauuggauuuaaaguagguuuuuauuuaauucuguuucgugugcauguguauugugguguguguguguguguguguguguguguguguguguguacaucgccgagaacacauggauagcauuauaaagccacuucucuccuuccaucuuucuuuggcuuccagggacacauucaaaucaccaggcuugcaccaucagcaccuuugcccacugagccauuggcuguaauccccuccucccccauuauuuuacucuaauauaacuuuguugagauagaguagcccagccugaccuuaaaacuuagggugcuucuccugccucugguuuucgagcgcuaacaagugagccaccagccguggcuagcauucaucuaguugcuuauaacacgcuugugauuuugcccugcugaggcuccaacccagggccucgggcaugcacucugccaccaagcugcagucccugccagggcuuuccgugagccuagcacuggcugugguggccaagcagacccaugaguaggggugacucagggacugcggucucugguguagccuucgcggugggaauucuaguuccuggcuguggauuugcaggcucagagaagguugaacuggccggcucucuccagagcagggugagaacagagggacucauggcuggguccaggcuccaguuggccuccuguccucuccugguucuguuucuuucuggauuuggccacccucugcccagcagaaggaaucuccaggcuuuggugauccaucaaggucaggaccucagaagagaggcccacuagugaucucugugguagccaguucuguaaaagacccccgaccgccaucuugggccaggaguggguguuaugaggucccaguucagagcccugcugggaggugaggugugcugggggucgcucaaaugaggagcugggauuccugggcagguggggguacaugccuguaacccuaacaccugaguguggagguaggaggauuagggauugaggccugccuggaacugggagucagaaaggucuguguuuagagcugagcccuguccacggcugggaaaaccagacagaugcccccuucuccaccaaccaaccacagggcugcagggagcuggacuguucuaaggacagugccccgaguuggggaaugugcugagcagacagcucuccuggccgagguugccaugccacacuguugugcccgggagagcacacccggucuuuguucuggugccucugcaggcuucugaggacaauguaguggacagcaggggagacuacccggugccauggcaagcugccuugugucagaguggaucaggcaggccuugcaaaaugcucuaacucacacgcauauauauauauauguguguguguguauucaugauuauugaguuaaaaauauuauguacauauaaacaauguguguguggggcgugcauauggccgucagagaacaaugucauggggucucauucuuuccugggguuuggggucgaaauccaguuacagguagcugcaagcuccugugccugcugagccaucuuucuugccuaagggagacuguuuugaagaugggguuucaucuagaacauagaggggagccugggaaggcuuuaagccagggagagaggcuggcuuugcucagggagaggccccacauaaaccaagcugcuucaaccagcuggccauucuguggcuagcuauggcuugcugucccucaccagacuccagacccacucgcagcccauggccagccugccugucugggugugaugcuuucgagguaccuagcagccaggcccagcacagaaccaugaaacacccccucugugccagacugaaggugugagaccucccuaugauggcccagguaccccgggcauguucuggggggcuuugcccuuuucuggcaccucuccauucuucugucuucuggugauuugccucuauacggucccuuucagagcaaaccuacaccacacacaguuuguguggcccauggucacggcagccaggcacuauuuggugagagcccaccacagacaugagucuaaugcuggucgugugcagucuuucucguguagaccucagccccccauugguuaggagcucacacagaucaucaugucucugguuccucaccccccugaaucucuguuuccucgucugagcaaugggaugccagucuaacacacggaagcaggggaauaagaaaugagauggccuguagggugagugcgcugcuauagauaccuaguuccuuccuuuugagagggucucauguugcccaggugugucuugaacuuaccauauguagcugaggugaccuugaaccccugaaaucccugccuaaaaccccuaaguauccagaugauaggugugcaccgcugcgcccuguuuauacagcgcugggguggaacccagggcuuuguguauacuaggcaagcacucuaccaacuaagcaagccccuguuuacuuacguauucgauuuuuuguugaauuauggacacauccugguauuugcugagagggaacaucuuugaggcuaaauguugucauuuuaaaacaauccuguuuacugauucuuuggagggaacucccaaacgugcauguggcuaggaacaagaaauucuaugccuuuuuuuuuucucucucuuuuucuggagauuaaaccuacggucuccuacacgaaggguggguguucccuuguguggcuaguuccccagccacaggcagcuuugauuaggcaggaguuaaggauccagccuagauuugaccucuggccugucaauugacccauagguaggggcugcuuggagcucuggguuaaggauucuaagguugaaucuugacagaggucugacgauugauuugugaugucugccauggacaucggcguagagaguggaguacaguuccuacuccuuggcucucacagaacuagauagagucagaggucaggucgggucgggucaggucagggcaggcggagucaaggcuuuggugaguguuuaggagguggaggagccggucccaagcacuuuccccuaugugaaaaggaacaguaugggaucagcugcucagggcuggcucacagcaggaucuugggacaucugucugcuugcauucuguuccugguaccucacgaugugcccgccugugugugcccuugguuuucucccugaguaggaaggugacuugcaccuuuguauccgaaugugucaaccacuuggccugccgauccguuuguuuccuucauccucuuuugaugagucaugccugcuuuaagaaccuggucuuuuugaguaaauuauaccuugcuggucggguuuucagacacugaauagguguaggaggucacagagggggugggagggcuagccaggcacuucuguuucuuucugcucagccuccugcaaggcugccuuuuuuccuggcaagaagggcugcugggugcugauugcuuuuauucagcacucagaggucuuuggcuuaaaauucguggggaauuccacuuggggaaaggcauuugauuguuaccagugggugucucguccacugugccuuagcucaugugugugggagagagucuacacccagcacagaggacauguuccugggugccagaugagcccaaagcaagcacggagccuuaacauggaaccaugcugugauccuguguugguugcccauggauucugguauccauggugggacuuaggcaggaccuggggugacugauguggaucugucuggaggacccuuauccccucccucuccucuuucacaggacuggggagccgcugaaugcugcuuucagggccucugcuccuugucucucagagagagccacagcacuggaauguggccucuugguguauaguauaggcuagugauugccuuagugaguguuaagccagugcagguuugggggcgcaguaaggggcguugcuccucuugucucuggguauagaggaagccaccucuucuccgaaagguuuucuccucuccggcucuccucuagcccagcuuuggauguugccgcuggguagguagauauagccagcaucuuccauguuuacccaggaagcccuggggcugccccucuuugcaaaugaacacuggggaugaggaaagggccccggacauugaacgaacccuaagcuucccugcagucuugaggcagaagggaaagcucccaucacuuacagaccagcugaggaccagucagcacuugcccagugcugggcacacccagcaagcgugcaggcucuuugcaugcuccaaagcccucauuacagccucagcauguggaacuguuucugcuccuguuugcagaggaggaacggaagcucuggagggccaggcugcuggagagcauggggcaacuuagacuaaaccccauucucagccaguuuuagcaagaaaacuggguuuaagccauggagucggggagccuucagaagagagcucgggguuggggauagaucucagggggcccccagcaccacguaagccaggcuuuguagcggacaccucuaaucacagcaccagagagguggaagaucggaaauuuagggucauccuuggcuaccagcagguuuaaagccagccugaguuucaugagaaccugucugaaaaggggaagaaacaauuuaaagucaaggauaagagaauacuuauauguaucuuaaucuagcccugcaaacaggcucauguguguauggguaggugugugugugugugugcuucugugugcacgcucaugugcauguaggggugagugugaugggagguggccuuguugguacagggauacagaugaaaaucuccuugcucuuucugaucuugguguugcuccugggucaggccuuagcuguccgcugaugucgcuugguuucugccccuuuuacuuaccuaccuggaaggcgucuccccuguggcccugggaauucuccaguggugcccuuaggucugaagcugacugcucaguagaaguggaggcggagggcaagggaucccucacauaaaucuugagguugguacuugccuugggguuuccauuacugugauggaacaccauuaucuaaagucaaguugaagccggcggugguggcccucaccuuuaaucccagcacuugggaggcagagguaggcggauuucugaguucaaggccagccuggucuacagagugaguucuaggacagacagagcuacacagagaaacccugucucaaaaaaacaaaaaacaaacaaacaaaaaagucaaguugaaggcuagagagauggcucagcgguuaagagcacugacugcuuuuccagagguucugaguucaauucccggcaaccacaugguggcucacaaccaucuguaauggaauccaaugcccucuucuggugagucugaagacagcuacaguguacucacauaaauuaaauaaauauuuuuuaaaaaaucaaguugaggaggaguggguuuguuugccuuacucuuccacaucguagcucaucacugaaggaagacaggacaggaagugaaacgggacaggaaccuggagccaggagcugguauugagcccauggaggggugcugcugucuggcauguuccucauggcuugcucagcccauuucuuauagaacccaggggcuuguaucauacaugauggguugagcccuccccugucaaacacuaagaaaauguccucugggcgucccuacaguccgaucuuaacuuucucaauugagguucccuccucucagaugacucuagcuugugucaaguugacauaaaacuagccagcauagugccugcccaagccaugcauuuuggaacgguuaguagaauucacacccuagaugggaagcgcauaccacuugugucaggccuuuuguuggggcgggggccuguuugccugccugagcugccucuuccaauuucccagauggggagggacugcccuuggaauagcaggaaagaggacccucagcguugucuccagggcuguccauaggucacuugagaccauaaaugagcuuggauggaaacugguaaacucauuuagaaagauguauagggaagggcuggaucauagguaugggagaugcagaagguuccuggagucagguaggguguggggauagguguuagcuaaagacugggagugacugccauugguccaaccacaugaaguccucaccgugguccaagggguaggaaugauuuccuaggcuuuaccauauuccugcugggggggaugugagucugcacacaccccugacuucagcugggcaguguggucucuuguggggugaggagaacagagccagguucaucagccccgagccaggcucguggcgagcaaggccgcagucugacugauuguugaugagagacaucagcccguagcgaagacccaggcucugucucggaaccacaguauggcuugggcuccaguggccucagaaaugcuagcugccugccuuggucacuuggagggaaaaccauucaacccaagaugagggacucuugauucugccuucuaacuuugagguuccccagaacagcaggaguggaaggucgugaccugggggguggggauggggaggcuggaacgugugaucggcacccccacacugcucucccacaguaauagucccagaggauccgucucuggccucugcaggcagcaacuauaaaaaacgaaucugcagacaaaguugucuucuguggcagcagagaggagagaaugucccguguggcugaccccacguggcuguucugucaacuuuggagacuuggaagcauucgcuucauggcgauuugguuuuaaaugugccucaagguucgagguguuuuuuuuuuuuuuuuaaguuugggacagugaauaugugugcacguacgugguguaucucugguagaguauagacgauuuugccuauuuacauuucuugcucuguaccauucacuagucugaucuccuuuuugagacggagucacauguacuaacuuuguguggggauuugugcacaccacagcagcauguggagucuggacagcgugcaggggcuggccucuccuuucauggggggggggggggggcggggcagggcggggaucugagaucaucaggcuucgagacgagugccuuuaccuucugagccaucuccccacccagucucgaauuucugauccucuucucucugggauuacaggccugcgccaacacgccagguuuaugaagugcuggggcuugaacccagggcucugugcacgcuaggcaugcccuccgccagcugagccacgugcacagccccuguuuguuuguugagacagaguuuugcuauguaacacaaacuggcuucagacuggugggcagucagucuccugcucucugggcuugcaucccacacugccugguuguagugugaccacgggacagcucuugugguuuuagccauagcugcacccagcccuuagaacuucccuuuagauuucuuaguccuuaucuugucuuccuaaacucuuguuccugacccagacuucagguucuucuuuacauugccauauaaggcugucaaacaagcagaggacuuugaacuuccucuuaggcuucuugccccauugacuuccuugcuggggcacccgcgccccucccccgugccgcuggccugggaguugagacacaacucucuauucucuuuccagaccugggguccacugccuuccauggucugggucacaugcauaagcuuagcagugcuggcccuggggcugcugggaagggucuuugaauuuggggcugcauaaggcugucucagcucugcccccagggccuuaucguaaccugguaaaaggcuaauguauugaggguggauucagucagauugugugaggcuugccucucuuggcaaauauuaaccccuccuccauauccugccaugucuugguggccuugcucaugguaucuaggaagccgagaacgugaucuuucuggugcuauggcgacuuugcugauuuugguuuuuauugauguaaaauccauuuaauguaaaaguaagcucuuuaaccaccccucccuaguuccaaagcauuuugcucccuuucuugauaucuacauauaguaguugggggugaggacagugcuggggcuugaacccgcgcccuccugccugcuaagguaagcacugaacugagccacacuccugcucugaggcuguagucccaggucugugaccuugggcaggcauuguggucuucagacucugucuuguuuguaaaagaaaaauaaucuugauugucuuugagaauuuuuaucuuuugguuuuucgagacaggguuucuuguguagcccuggcuguccuggaacucgcucuguagaccaggcuggccucgaaucccagagagccaccugucuuugccuccugagugcugggacuaaaggcauaugccaccaguuccuggugucuuuuggaaucugaaaagcugccauugggcugguguggggcagagugagcugcucuucugaccccugcuggcuugcagucaccuccacgaacugugcaguuuuaccacaaugcgucuuagaugacaucugccguuuccuguuuugucucccaccccuggucaccucuggucugcuuucucuguggauuugccuuuuuuggacauuuccugucagaggaaccagacaguggguggcucuucaugucugucuguuuuugcccauguucagggauuuguucgcccauguugcaccgggcauuagaauuucaucgaugacuaauuaaugcgucaccauuuggaacguccaugcauugagggucugccuuacccucucuucucaucugauggcuagcuaccuggggugcuuggcuguuuggggugaaucacguagcugugaagucugggcaugugugucugugcccgggugauuucauuucucucaggcagagcuuucaguguccagcccuagggucauaguugcaguuuuccauauuuugacacuguagcuuggucucaguaccacagcacaguguguguguguguguguguguguguguguguguguguguguguguagcgauuauggugucauaggccuggggauguugcucagugguagagugcuugcuugccuaagacuagggccugagcuccuucuccuaguacugaugcaggugugggaguacgaugugcaguguugaggagcaugccuguggggugugugugugugugugugugugcgcguguguguaccucuuaccguacaggcuuuuguuggccuuaaauuucuauuaucugaggcuggcuaugaacucccacgccuccugccuccaucucccuaguacuggcuuuacagguagguaugccacccucggcucuuuuauguggauaauuucccaaccuuuggacucgugugcauccugcagcuuucuuugucuucccuugagauuuucuugguuuuuauugugccucauaauccgcauauaaaaugacguaauucucacgguucaguguugccugauaagauaccuccugcuucacauucucacgugggccaggcccugggcucaucugaucaaagccuaaaguccuaagaagugaccacaguagcaguguguuucccaacuagagcugggcgcguuuguggaaugaacgccacuaauucccugcgcaccugccuaaaacuuaacuagguugggaaggcuaggguacccacugguaacucuggccuaauaauggcugaggcggccugugggagccagcuucucccaaacccagguauggcagugacaggggugauaaguguagccaccagccagagccuccuuccuucugugugcucccuccuguaaucuuaugagauagggucucacugcgcaguucgagguggucuucggaucacaguaguuuucucccaccgccuuacccuccugugugcugggauugcagguccuugcuagcggguguagcuccuccuccccuccgccccucuucugggguuaacgcuggccaccucccaucuguuuuccugccucacaccuucacccgcagguuuucccagaugaauuugacaguggaaagggacuugcccaagguaacacagccaagggaagacaguucaggggucgcgcuccaguccagcccguggacuggaggccguggcaucucuacccugcuauccgggcuuuuggcacaggcucuauuggcauuuuuuuccauugcaaucuacuaggagugucuggggugccagggcuuccugcugcguugccugggcaacccuggaccugcccccccaccuccucccucacagagacucugagcucuucuuuguccuuacagaauuuugcaaaggaauuugugaucagcgaccggaaggagcuagaggaagacuucaucaggagcgagcugaagaaggcugggggggccaacuacgacgcucagucagaguagcuacagccccacagcccagagccaucugccugcuccgccaaggaggagacugccgccucacgucaccagcccaccagggaggagaagccaugagaggcaccagcgccaccaguguguccaacccuccccuucccucuccccccuguggccccucucaagcucaccaagcaucauucuuugagacccgcccccccuuuuguuuuaaagaagucauuuuggugccagggucaugcauaccaucugaucccagaagccucucugucacuggcccuggaccuggcauuuaccccugccgucaccguggccugccuggucuaagcuacccuggccuugaguugcugaggccuggucaggugccaccccagcuugaccuggcuguuuccugcuagcccuacgccggccaccaauaccaggagcugugcacaccuuacagccuucaugagcucccaugcgcgcgcaugcuccucagagcccauagauguggccccaggccucaccccuguccuguucagaguggccuugagcugucccucugguagacacugcuuggcaguaacagguuuaggucuggcguggaccgagugugaagugacaaauuugccuuaaaucuugccuggcaguggcucugccacguggucuaaacuacccuuuuggcgaagccuuucugaagccugagaggucugagucuggcugggggggggggggggggggaguucagggucaaccucagggccuccagggugacaaggauggaaagguccccugcaaacagggaggcuggcauaggccucagggcaccuggaaggcagcaacgguuggaaucuuagucugcaaauuccaaagauggcuuuguuugcuuuugaagacagcugaggcgggcuuggcuccucgagagcacucgaagaugguucuuucccucccuccucgcucuuauuacucuggggaaggaugcugcaccgggcugggcugugaggaccaucucuggcauuccgacaguuuacagaaguaaauguguuuuucaagaaaaaugag

SEQ ID NO: 4827 - RNA, 2479 nt, Mus musculus
uguugaauuuucuucuugucuucuuccucuuccuuucuccuuuucucauuucuccauccucucccuucuccuaccugcuucugucucauggacagcacaaaaugagcccugagaaggacagcacuccuacagugucccuggguucucagccuaggauccaagugcaugcaucggauaggugguaacggcuaugggcuccggagucugggcaguggaugggggagagggguuaaccuggcugugaaggcugccuccucucagggccucaagcacagaaaaagcuucccaagugccugcugagcguuccaauggacugaucccuaacucuaaauuauaaauaugcagacuuagagagggucuguggcuaaccuaagaccacacagccagcaggagacagagcugguccaucuggacuuuaggggcuucucccuagggagugccacuuuucugaugagaaaacauuuacaaaacaucugucacggggcuggagagauggcucagaaguuaagaacacuggcugcucuuccaaagguccugaguucaagucccagccauggcucacaaccaucuguaaggggauccagugcccucuucaggugugucugaagagagcaauaguguguguguguguguuaaaaaaacauucugaaaaaacaaaaaccaucuaucaugaccuagaagacgaaggaaaggaaagagacaaauguaaacucuuagacuccugguuauaaggaggaagacagaaagcaagcagacaguuucuugguuuugauuuuucaagacaggauuucucugucuaauagcccuagcuaucccagaacucccucuguaaaccaagcuggccuugaacucguagagauuugccaagcagacaguuucuaggaaauauauauaguggagcugguuagaaagcuuaagauggaaaaucccuuacugcuuaagacugccagacaaccugagcucugucccgcggaggucccggacagaaugagagaaagcugucuucuccgucuucuccccugcacauccacacugugcucgaaugugcacacaggcuaauacauaauguuacucacuuguuuaacuuuauuugagacagugucucuaugucauccuggcuagccuggaaauuucuagguagaccaccagacuggccuugaccucacagaggccugccaaccucugccucuugagugcuaagauuauaagcaagugccaccaugccuagccgaaauuuuaaaacuuauuucaggagggagggaaagaaggcaggagacacaugcucucagaagcgcugugacgaucugggguuuacuuccggggcucguguuccaucaucacaaucauaucacgaccucugggguccgacugcggucccggcaggcugugggugacagcucagugcaccauuccauaacacaccuucuugugcagguguaccacuggccugaccacucuacugcggugcugcagcggcugaacgagcagcggcugcacggccucuucugcgacguggugcugguggucgaagagcagcaagugccagcccaccgcaaccuucuggcugugugcagcgacuacuucaacuccauguucacacugggcaugcgcgaagcuuuccagaaggagguggagcuggugggcaccuccuacguggggcucaaggccgugguagauuuccucuacagcagcgagcuggagcuggacggcagcaacauugacuacauccuggagacggcgcaucugcugcagaucuggaccgugguggauuucugcugugaguaccuggagcaggaggugagcgaggacaacuaucucuaccuacaggagcuggccuccaucuacagucucaagaggcucgaugccuucaucgauagcuucguacugagccacuucagcacgcuguccuucacgccugacuuccugcaguccaucuccgugcagaagcugugugucuaccugagcaguggccagguacagcacaaaugggaauacgaccugcugcagguggcucugcaguggcucacgcagcagccggagcgcgaggugcacacccgccgcguucuggagaacauccgcuucccccucuuccccgaggacauccugcuacagcgggugaagcuggccaugugcucucugcugcccagcgaggccaacggcgagggcuuuguggaggaggccaugcacuaccacaacagccugguggcccagccuguccugcagacgaagcgaacgcugcugcgcuccgaggagugcuugcucuucguggggggcgaggucucugagcggugucuggagcugagcgaugacaccugcuaccuagacaccaagaaugagcagugggugaaggagacaucccugccggcccgccggagccaccacugcgucgcugugcuggggggcuucaucuucauugccgggggcagcuucucgagagacaacggagggaaugccgccuccaaccuucuuuauagguaug

SEQ ID NO: 4828 - RNA, 2479 nt, Mus musculus
cauaccuauaaagaagguuggaggcggcauucccuccguugucucucgagaagcugcccccggcaaugaagaugaagccccccagcacagcgacgcagugguggcuccggcgggccggcagggaugucuccuucacccacugcucauucuuggugucuagguagcaggugucaucgcucagcuccagacaccgcucagagaccucgccccccacgaagagcaagcacuccucggagcgcagcagcguucgcuucgucugcaggacaggcugggccaccaggcuguugugguagugcauggccuccuccacaaagcccucgccguuggccucgcugggcagcagagagcacauggccagcuucacccgcuguagcaggauguccucggggaagagggggaagcggauguucuccagaacgcggcgggugugcaccucgcgcuccggcugcugcgugagccacugcagagccaccugcagcaggucguauucccauuugugcuguaccuggccacugcucagguagacacacagcuucugcacggagauggacugcaggaagucaggcgugaaggacagcgugcugaaguggcucaguacgaagcuaucgaugaaggcaucgagccucuugagacuguagauggaggccagcuccuguagguagagauaguuguccucgcucaccuccugcuccagguacucacagcagaaauccaccacgguccagaucugcagcagaugcgccgucuccaggauguagucaauguugcugccguccagcuccagcucgcugcuguagaggaaaucuaccacggccuugagccccacguaggaggugcccaccagcuccaccuccuucuggaaagcuucgcgcaugcccagugugaacauggaguugaaguagucgcugcacacagccagaagguugcggugggcuggcacuugcugcucuucgaccaccagcaccacgucgcagaagaggccgugcagccgcugcucguucagccgcugcagcaccgcaguagaguggucaggccagugguacaccugcacaagaagguguguuauggaauggugcacugagcugucacccacagccugccgggaccgcagucggaccccagaggucgugauaugauugugaugauggaacacgagccccggaaguaaaccccagaucgucacagcgcuucugagagcaugugucuccugccuucuuucccucccuccugaaauaaguuuuaaaauuucggcuaggcaugguggcacuugcuuauaaucuuagcacucaagaggcagagguuggcaggccucugugaggucaaggccagucugguggucuaccuagaaauuuccaggcuagccaggaugacauagagacacugucucaaauaaaguuaaacaagugaguaacauuauguauuagccugugugcacauucgagcacaguguggaugugcaggggagaagacggagaagacagcuuucucucauucuguccgggaccuccgcgggacagagcucagguugucuggcagucuuaagcaguaagggauuuuccaucuuaagcuuucuaaccagcuccacuauauauauuuccuagaaacugucugcuuggcaaaucucuacgaguucaaggccagcuugguuuacagagggaguucugggauagcuagggcuauuagacagagaaauccugucuugaaaaaucaaaaccaagaaacugucugcuugcuuucugucuuccuccuuauaaccaggagucuaagaguuuacauuugucucuuuccuuuccuucgucuucuaggucaugauagaugguuuuuguuuuuucagaauguuuuuuuaacacacacacacacacuauugcucucuucagacacaccugaagagggcacuggauccccuuacagaugguugugagccauggcugggacuugaacucaggaccuuuggaagagcagccaguguucuuaacuucugagccaucucuccagccccgugacagauguuuuguaaauguuuucucaucagaaaaguggcacucccuagggagaagccccuaaaguccagauggaccagcucugucuccugcuggcuguguggucuuagguuagccacagacccucucuaagucugcauauuuauaauuuagaguuagggaucaguccauuggaacgcucagcaggcacuugggaagcuuuuucugugcuugaggcccugagaggaggcagccuucacagccagguuaaccccucucccccauccacugcccagacuccggagcccauagccguuaccaccuauccgaugcaugcacuuggauccuaggcugagaacccagggacacuguaggagugcuguccuucucagggcucauuuugugcuguccaugagacagaagcagguaggagaagggagaggauggagaaaugagaaaaggagaaaggaagaggaagaagacaagaagaaaauucaaca

SEQ ID NO: 4829 - RNA, 2285 nt, Mus musculus
cagaguucgaggccagccuggucuacagagugaguuccaggacagccagggcuacacagagaaacucugucucggaaaaaaagaagauaaacccaaaaggauagccagucuccggcuggacccagagaucuugguuguuggaauagacauggcaggcuuugcaucuuaucguuuacaaagaauuauaguuuuggggcuggagagauggcucagugguuaagagcacugacugcucuuucaaagguccugaguucaauucccaccaaccacaugguggcucacaaccaucuguaaugugaucgggugccuucuucuggugugucugaagacagcuguaguguacucauauacauaaaauaaauaaaucuuuaaaaaauuacaguuuuaccuuauauuugcuguagguuuuugguucagaacuguguuugaguaaggcagaaacucaguaagagauggcuugcaggaagcucaggcaugcuggcuugccugguccccugcuguuuggcaucacacagcacagccagaugcucuggcacaugccugccacccagccacuggaaaggcugaggucagagaaucuccuaagccacaaagucccaagccagcuugggcaauguggugagacccuguguugccucuacccccagauauacaugauugucugacaccauuuauacuauuucacacucuaagaccccuggguagguaaagcuacuuguucugagcuauaugaucaucccuuccuuguccuuaauuauaagguaaccuggacagauguggaugaggccccagcagauaauugggaugcuguuuuacaccuccagcugcaaaggagucucucucccaugguccaggucccugucugcaagucgagauguacugaccuauguaugacugccuuggcccucaagccaggaggaacuuuccagugcuagaaauaaaaggugccggucaccccuuccucccuccuagagagucacccauuguccuuccugacccuggucucuaaggugugguguugggcuguacccuuagccuacagucucucucccgcagggguagcugcugcugcugcacucugugggggccccugguucccauguuuaagccugcauagugcagggcagccucagaggagaccccgcccugccucugccaaggcggacuuuuaagcguuuuuaugagcuguuuugauaccuuuucauacaguuugcuacucaccauuuuguagggugccugcugggguccccccucccugggucuucacuuaggcucagcgccuugguuugucuagaucguggaugcccugcuguacaugugcaccuugcauggugugacuuugucuuccaucccacccuucuucuaugugaacgaucuaaagcagccggagcgcugaugucccuggagggcagguccugugcuucggaggguugguucuucugccagaguuccugccucagaggagugcagagugggagaguuaccugaagcuggucuauuucccuaacacauguguggcugggguccuagucucuuccuaucuacccauccaguaaggagugccuaacuccacagcuaugaccauggcaucuuguccuuucacucuauaaccucugaccuccaggugggugguaucccuguguguucaaugugacuagaaucgguggccucgggaggggagcugagugccuuaaacugucccucaguugucucaguuaacagcacugaaugaauggggcugggaugaggguucagucaguaacgugcuccccuggaaggcaggaaguccgugggugccauccccauaaacugagcauggugaucucagcacuugggagguggaggcaggaggauuacaaguucaaggucuuccuugacuacacagcagguuugaggccagcccuggcuacaggagaacccuguuuugacuuaguugaugaacuaaugauaaacugauaagugaaagcaucggauaaacauaacaguaugcaccuggguugacccaggaagcgcugguccugagguuugauguuaaagccaucaacagcuggccccagucgaaaucagggacguucuggugagcugaaagcauguggugccuucuggcuccugaugucacgggaaucuguaacuguauaugcuuuuuaauguguagcuuuuguguuuguaauuuuaauuuuacggcauucagaguuuuccugucucgccuccuugguugacaguuugcauguugcuucuguuuugaauuccacuggcacacauuaaaagaacuugccugccagggu

SEQ ID NO: 4830 - RNA, 47204 nt, Mus musculus
gcuuuaaaccaacuuugugaucuuuauugaugggugacaacuuuauacuccuaggaaucaauacacuguguacgugggggacacggcaucagagaggcguggcgggagauuacacagcagacacugggaauugucaguccaucauugugcccacuguucauguguacacagcaugaaugugauuugaaaucuuuucaggguaauaaaguuacaaucacccaccucugcagccugacgucuacccacaugucugacccgcggugucuacgucagcgguuucccucucguaaucguuaaaauguguuuccuauuaggaaccagcaacaaguuuuuuuuguauuuauuuccuuuugaaguaagagcgaucucuaaugacgacuggcucguuuuugucauuuaucaaaaacuacaggguaaaggaggagagugugaugaauuaaaaaaauuauuuuuuuaaggaaagauaaaauucauuuucacaaauuuacaagagcugcuggugcgggacuuauuccacuacgcgaucagacugggacacggugcgagccgccuccuccgcccgggaaccagcgguucuucagaagcggcggcucucgugugcccucacccaggcaacaguccagcuucugaagucagucagcacgagcugcgcugugcgggcccucaggcaccuuccauccaagcccacgggcgcagagggagucucucuacagagccacuagagagguggguagugagugaguugggaacuguaggaagcagcgucaggcacacacgggcacacgggcacgguuacagcagguccacgcggcgguaauauaggagguaggcugugcggucggcaggcgguuucaccaccugguacugguuaauaaccuugaccguuuggucaucgauucguagccagccauuaagcccaaucuggaagacguccguaguguaguggccgccuguagcgcuguugccauggugguagaccacuggaagacagcacagagcaggcaacccaugagaaaaggcucucacccugcugccacaggcccccacucccacgacccccuccacagggagguggccccacucgggccugcaggcuacugacucagguggacacugacacccgguaagaccccucucuccugucagccacaauucagggcaaacaugguccugaaugcuuuccugacaaccaggcucuccuagaacaaucucugugggagagugauccagggcaguguugccuggcacccuagccucuguucacuguguuuuggggggaccagaggcaaacacacucaccugcaaacagccuauagguucucuggcauuuaaaauuuuuauuuuugaugccuggagaaaguaguucugaaaaacaaaauagcaacacuucaacaaagacuucacagagcagcagggcuggcugaacaggguccccugaaacacccccccccacacacacacacacacuuugagggucagacagccacagggcagaggaggcaagcacacacccugcuccuagacuaggagaucaggguaggcagugcugggacagaggagggccagcuccaccuaggagcuucucuuagagcagaucagaucagaucagaucagaucagaucagaucagaucagaucagaucagagcaagacacagcugucuuuugguuucccgguucucuguacucuguacucugugccacacuccggcaucaucuaagauguucacccacaugguggauccaguuccuccaaggugccuucugauuuccacaagaaggcuaagacauaaaagccaacacauaugugcuuugguaugaaugccuacacucccacauacacaacacacacaccuauuuaaacaaccuucauuuauauaaguaccagucucuuagggcucuucaaaacuugcugucagagcuagugagacgccucagcacuggcugcccuugcagggcaccgggcagauaugcagugcuaccgcugcugagccacaggccuguggaacgcagaagccagcacauuucugcacaggcaccgugcugcugugugggcggaugaagacccugccagcaccagcugcucuucugcuuucugcuuuagguaaauuacguuuugcuacuaccugcaccaggcaaaucacuauaauaaaguucauggccagucuaguuuacauagagagcuccgggccugucaguacuucauauagagagccugccuuaaacaaagauaaaacacuugacuaaaauauaaggcaacguagggggagcuggagagagggcucaguaguuuaaagaccacuggccaauuucagaggaccaggguuugauucccaguacccacauggcggcugacagccaccuguaacuccaaccccaggggauccaaugcccucuuugggccucugccagcaucaggcaagcacacugggcaaacuugagcauacaggcaaacggccccuaaagcaaauuuaaaaauaagaaaacuaccuuaaugagcauuuccauauagaauccacaaaugucaauaaaauuaaacaaagagaguccuaacuaaaggucucccuggugacuggguggugacaggcuccugcaccugcggggccugcagugggcacaggccagcauuaccucugcugaucuccaaguccacaggguagucaauguucuugaccagcuucuggcauccaccugucuucucauagacaaagcgcuucagguggagcacgaggacagggggcagcuucuccagagucacucugcggcucaccucaaccugggacagaguagccagggucacaggcugccugccuggcuacagcugcacccuguggggcucccuagcccuagccacaccugcaccccaccccuauggacaccugcaacugagccaucugagcaagcuggcugagguacggcuggaguggguaggcaccagccugucucgucaucucagucacaaaccugucuaguagcuuucuucaaacacacguuucaaguaauccuaaagccacugcccugccacucgcuccccgggcccuuuagugcuuucacggccuccugaagauccuuaagcagcaaugaagauaaagcuuaauggaguguaacucaggagaguguggucuggccugcuggagcccuguuucucucugcccaccgcacuuucccagcuaugacgacucuuaggguuucuuuguugucuccacuaaaugguucuucagucgcucacuccucaaaaccccauuauuuacuugaagagaaagagaauuuaaguaauaagcuaaaagacagaaacccacagacacaggcugaaccagcuagcagcugcccacagccagaucaaggguacccgcaugcccucugcugcaggccuucagccccgcacuucuuacucaggccagcuaccgggcuucugucccuggcuccugguacuuaacaaccaccaggcccgaaucagacaacaugguggagaccuuccuucugcagguccccagaguguggcauggccggccggccagagugggagaccucagagggagccgaggcuggggugucuucacuccucaguacacagcucacaaaagggcauuucugaagacaggucugaacugggaucucuuauuuaaccuuguagccucuacacuccacugaguguuuccagcuuucuaauaccaagaacucuucagaacagcgccacccuaacuagccagcauccaucuugccuuaugaccucaaugccacagucuacaaaggaccugagagaggauggccuccacugcagagcagucgggcaggccacugagagccagacaccagccccucuccaugagcugcaagcccagcuccugacuguccaggaugcauacauucaagacuauugccaucaccacaucaaagagcagcaagcaucagaauagucugucugucugucugucauuggcgaucuaugcuuuugcaacacagaugugcccggaacucccucacauccuaacgccucccucugcuagaaguuggcuggcugcagaucccaggauuagauucugaggaacugagacacagaggcagaagagagacauucccucgggucacaagagccagagacacagcugggaguccgucugguucaacuacugcguccugaaacccugggccuucucaguaaagcaacugugugagaggcggacucaggucggcuucccucagccagcagugaccauaccuccugcuugguuuuggugguguaaccuuggacagacucccuggccaccaagcucuccagcgcauccuggacugugcguaucuugucagacuggauguccaacugcagcgugaaaaacaguugcagaguagcugacucuuuggaacucugcugguagaccacagaccuaaagauugcaauugaaaacaaacaaaaguaagaggccacucucugucacuuucccuuaaaacuaacuaacagagaaggaauaaguacacaagcaaguuuauucaguaucacagaaccagagacaacagaacagccaaaaccgcccugaauuuaaaaauaucuccgccaacuaccagccucugugacuagcaacugagcuguacauuuucccagcuuggcucagacacuucaacuuccaaauucuuugcuuguacaccagagcacagcaugcaccagcuaacaaacugaauggaguagggguggagguguuuaacaaaguaucacagccuguucuagugcaacggggauugcgggaauccccaggggaccgggacuuuuaaugcugcucuccuucuauaaaaccaucaggagggggaaggggagcaggcugaugacaauaaaaccaugucgauggucugggaggagaggcgaccagccuugaggguaaggcgccaccugaccuuguuguuuccuuaguuguuuuucuucaucuuucuuuuucuaacuucuucugaauaaaaaccauaagugccucaucucucauuucaccucauccagggaacacucuaugauucaaucuuguuugugcagccuggugucccaguuuaugagcaaagcagagcuggugggagguggcucugacugucgggacagaugugacacccagcugaaauccuuccugucagggucgaaugccccagccuuccuccggagugccaggcaaugacugacgcccccuggguucccaaaagaaaguugaaaaacaucaaugaaaguaaaccggggcagugguggcacacgccuuugaucccagcacucagacaguucaaggccauccuccgcuacagaaucaguuccaggacaaccagcgagcgcuauauacagagaaaccccgacucauaucaagcggcccaugucaagcaaugggccagagcccugggagcugagcauuagagcaaggggaaagcaggcaaggcagauggcagggaggauccagacacugucacaccugccccaugggaacgugggaaagcacagaccugaugugucccccaaaaaugccagugaugggcgucuggacgaaguccgccugccgggugauggacgucuuauucuugggacccacuugcucccacucguccucgcugcccuugcccgugucuuccagcuccucguccucuaucaagucgcuucugggcccauuggaaacagaguguucuaaaaaggagagggccugcugaggcuacuguuuucaagaacaaacuauccaagcaaguacguccgcacagauucuaugauaagagcuggcuaaacagacucaugagggccagggagaagcucggcgggugaagccacguucuccgggccugacaaugagaauguaacuccugcggugacguggugaagagaacggacuccugauuuguccucugaccugcaccuuaccucagaaaccucucuagcgcgugcgcgcacacacaauuacaauugcacaugggugggugggcgggcagguggacagauggauggacacacacacucagaaaggaccaaaauaacaaaaaaccccacaaagaaaaaagaccccaaaaccaaaacaggugaccaagcagugguggcccacaccucuaauuccagcacuugggaggcagaggcuggcagaucugugaguucaaggccagccaggacuacagaguuccaggacagccagggcuacacagagaaauccugucuugcaaauccacacauauaagaagaucuaguuaugcucuacacugaaagucacaguaggcaacugaagcagccagccucacuggacacucucagacaccaagcucuggaaaugccacgcaggcagggcacugagacgggcuagagcacaaagacuaagcguuccaggccagccagagcuucagagaaagaccuugucucaaaauccagagacguucacauuucacaguugucuuuggacaacuggaaaaaucugaagagacucuguggcuugagagaagaagcuaugcucgaagaggaggccuucagcaggggcaauuaucgccaaccucccaucccuaaggcaaacgagcagagcagucuggagugagcuugcacccacgggggucuucccacucgcuucugucuuucuguaucucagaggucauuugaaugugaaauucucacggaacuccacacuuagcucucggcugguggcacugcuuaggcagcagaggcuggcuggaggagaggacauuacuggcuggggcuuacagccuggcucuaugcucuguccacucucugcucgcuguguguggguaagcguggucaucuagcuugccagugugcccuccgcugugauggacucuacccccccggaagccuaagcccgagcaaagccuuugcaacggaacaggaacuauagaaucucccucuagaguaaaaguugaaacaugugcgugagcuggguacauuucaguuauccaagcccaacuuucucacugcucuacuaggaaaugaacaacagcuggcuuuugauguaugcuaagcacugcugauggacaggagacuucuaacugugcaugccugcacauguacaugcaugcccauguguauguaucgauagcacagacacgugaccuuccuugaagccacuaucaggcaaacagucucacccagaagaaccuacuuucgugcgugggugagaguagcuucuucaggcucagcaucucuucauggaguccauugaggaugaaaccuagauacuccucugcguccuccugccggcccugaggacagacaugggcacauuaauuccaaccagcuggaguaaggccuauagaagccccagcaccuagagcaaacuacaccuuagaugaaugcucuagaccagugaacccaaauccccagaguugccaugagaacucuguagccuauuucuauagcuaaccuccuaggcacagauacugguacacacaagcuggucuuagacaauagcgccacucagcgcugugaaaacguccacaguucuagaaggucccugggugccuuccaccuccacuccacugcaucugcacacugucguuacacuucugguugugcuucuaauccccacucuugggaggcauuccuagcaccccaaaucccaaguagugggaagugaaacuccaaaacaagaaaagcuguaucacaggcauuuaaaaaaaaagcuagugggauggugguggcggcucaggauuuuaaauccuaacacuggggagauagaggcauggcagaucucugagccuggucuacagagugcacaggacagggguacacagagaagcccuaucuuagaagggaggaagggggggggauggagggagggagggagggagggagggagggaaaagaagcgggugaggagaaaggaaaagcuaaaguugugcagcuggugucuuuguguaccuggaugcucacucuauuuuuuuuuaauuuuuuauuagguauuuuccucauuuacauuuccaaugcuaucccaaaagucccccauacccacucacccccacuccccuacccacccacucccccuuuuuggcccuggcauuccccuguacuggggcauauaaaguuugcaaguccaugcucacucuauuuaaagcaauacagcuuccagacuauucauuuaaauggcauucucuuacuauuuuuccacucugaguaagcuuccugucuauaccugcauugcacugcucaugccaaugcauuagacuuggcacuggaagaccagcuggaugcucuagacaaugaccacuggaaggccgccuggcucgcucgccugcccgccugcccgccugccugcccacccgcucaccugcccuuaguuaccugcuagcaggauuuuaggaaaagccaggcuacaauggcugaguugauggacucacugcuguagccugagcaggacuaagauggaggcggagcacuccaggacgaggaggaacccccccccccccacucaagcacauugcagcaacaagggucagacucagaagccaggcucugcccaucagcgguggauucacaggcuggcagagccagugagacuccguccuugggucucaaugcuauuaaauguggguaacuggcacguguuaagucauugagugucuccaccauaaaccucacccaguucucaccccaccaagucacagcucgaggcaugcgccaacagccacuucagggucaucuacaacuugcucuguagcaggcuaggcuuagcuucccagagauccucuugccuuggccccuaugcucuaggacguaggcaugguccccucccccaguucuugggagcaguuuccauagcaaccacagagcaccccagaccuuuucagacaggcucgacuugaugacugucaggagucuguauauguauguggguucaaaggcagccccugggcggauaucucucacgauuuuauccccgagagcugcaagaaaaaaacagaagauucugguaaguaaagagaccacagagaggugaaagcaaauccacccaaacucccaucacacggggaaaacaccuugguuuaaauagacacuuuuuucaguaagaccacacauucaccacacgccacccccucgcuccguguccccagugacaaggcgccuaucccggcgcgagcucugacucaccuuggcgggguuugggaggcacuggcauguuagugaacucauucaugagccgaacacuagauggagaaagagcaaagcagaacucacguuaggagcaggccugggcacgguggcacauuaaccagcagcuagaacagcacccaggagcucuuauguuaaaaucuacacauguuaugggaccauuuccagauggcauuuuaagcugguaaacaguacgggguuuccuacggaaucugaagggcagcaaacucuccaguuauauuccacaucaacuuccauagaaaaucccaacaacaucucccuuuaaaggagaauuccagaggcuggaguucagagacuuguugcucuuacaagggaccaggguucaguucucaauacccacugccagcucacaaguagcuguaauuccagguucaggggguccaaagucuucugaccgccacugcccacacguggcaugugcccuuacauguaugcaggcaaagcacgcauucacaugaacuuaagagcagggcgggggagaugguggagcacucgucuguagcaaaucaagaacugagagcuggcgucagccccgggagcaccugcucggccaaaccgcucguucccaucaccgcagggagagcccccgaccacuggcacgugugcgagcgcuuuacuuacaagcuaucuaucaugggcguugaugugcaaggccgcugcacuuuugaguacagaggaaugaacuucaucaggugauacaucggagggcaagccaccaaugccugcagggucuaaaugucgguaaggaaguguaaaggaaaugaaacagacacagaggaacuuuucuaaaaggcacguaaaaaaaaaaaaaagauaagccaaggacacucagcuacguggauauguaaacacaaagaggaguaaaccacaugagaagacagcugccuuguaaaggccauguaaggauccucucucugucggccggcugcaggacacucaagagccuagcuagcugaacaaaacacucccacuaguuagagcaaagccucuaguucuacgcggccauucuguccuacugucuaccaccacuccaaugagaauagaacaugcccgacucuacccuucauaagccaacagaucaauccucggacagagggcggagaggcuccagaguaccaccgaccaugaggcaggcagagugauggcccagucuccgugcucagagcgcaggccggcagcccuggggacgcugcggcaaucaaacacacccagacgggagagugggcaugguggccaggcgcaggguuggcagccaggaaggauacggcauuaauguagcaccaguuuccuuuauugaucagcccacgggguugcaaugacacuggcuuauguauuaggguuacagucuccaauaacucugcaagagugaagaagcaaaugaagacauuaacauugcagucagaauccaugcacggcguuucugaagugcugagaguccuucagaagagcguguccuccgaaagccuucacuuagcaccgcuuuguuacuaaguuggggugcagggguggggggcaguugucuugaacaucaacauuuacaguuauccucucaguuuacacuaggacgcuccauggccagagacaccgacacaauagcuagcagcagagagcggagguggaagacacuggcauccccaccaaggcugacagcaugcuucaccagcugcuaaguccucuggauaccagcuucaaagggacuguggggcaggagugugccaccgggcucccagaaaacccggcagaccacagugggcgcucaauggccgaguauuaagugacagcagcagcuccugccaaucauggaagugagaucagccauugguccacuaacuccucacuccauucagaaguggguggggcuucucuccugacaccccggaaaccacuuuuuuacagcuuuaagaaagcuguaagcugaggaagcacaguggguggcuugauguggcucccauagaucacuuuaucugagaaacuaaaccauuacaggcuccagagaagcaccagacacagccacugagagcagccccuuagugaaaggugugcagaucuaagacaggaagacgcaugcugacagcucccaccaguccuggagcuguccaguaacacucaacugcauagucauaacucugccaaaaagggacucugacaccuccucuuacagaugagaaaacugaagucacagcacugagccagauacaacugugggucuaccuggugggcucagccguuccuagcacuugcugccaggccugaugaucugaguucacagccccuugugguagaaacacaaccaacuuccacagccugaccucacaagcacacacacuuguacauacacacaaacaugcuugcaagcacagaaggaacaaauaagucuaaggaagaaauguuuuuaaauauuauguaaggcgggacgcccucuuucccccucccacugccuucugccaccuguucuugggcuaaacaaggauccauaguacagcaaugaucacaguaaccuccaaaccuguguguucaaacaaaaacacaccccaaagcaacaccacaggcucuacagcagccaucaacgguguggcaagcuuuuacagaauuagaagcuaggucuuccuaccauggcugaccucuguaagaacagcuaaugcaucccgcgugcacccaagccugcaacuagccccgcuccaggccagcucagacagguaaugaagggcucacugucccggacagcaccacagacuguaaaagagucuggggaguaugcuucaccuacagauauaccaagagaacagcuagaugacuggaggcgcagacaucagaaaauaggcagugggggaaaggugucugucuauccggaguaacauaaaggacagcaggaaguaugaacacugaauggcgacuuacacauagguaucagcgugcugcagucccaauacucccacggucacgcacaaccuucagguucagggugcagacuaaugguaucaauaugaagaagcaagccagagaucuggguaagaagguggaagccaguguacacugcucagugggaugccuggcccaggaguuagagccacaugggcggagaaaauucuguuuuccuagugaaggcaaagccuucuugcgucaguugaaggucggaaggggugggguaccaugauauucacaccugcuuuggcacgggcacugacugggccacauuuuuaaaaaaugagagaccuaugugaugacgcuugccuguaaucccggcacuucggaggcaacggugggcaucaggaguucaugaucacuacacagcaaguuaguuccagggcuacagagagacugcaggcuaaggcgagaaucuccccaaauuuguggguaccugaccuggguacaguaugcagugaaguggcagaaacaaaagacacugcuuuaaagacaagauaggugaaaguaagaccuugcucccuaaaagcugacucugacaccacgagaugccuuuggcaagcaugcacacccacucacacauacgugaaaacacacacaccguaagacuaguggugugggugugcugcaucaguguaaaaaagaacccagcaccacaugugacagagcuaauuccuuuucaaaagggaauuggguaagcggguugcgcuaagcccuagaacaaaccucuguggaccagagugaccucaacagccugggggcucccacaggugacacaggagaaugcaauccaaucugaagccagcucuaaucaacuccuucccaacugggaaaccacauguucaaggcucauuucugcaugguccucuucuagaaccagcagguuccauuuuccaagauagugagccugucucuuagcgccacccaguggucuguucaaaaccugcacgcaagcagaccugggacacagacagugcagcagacaggacagacaacugcugcaagcagugcucaaacugcugccuucugguagaauucucaagugcaggguaacucuuuacaggcagguagagaagagagaccuagguuuuucuuucccuaaaaauuacuccauuguucuuggggcuggagaaacggcucagcaccuuagcgucucuaugcugauacuucaggagaagcuccaugcccugcccuuugcccccagacugcugccucuuggcaagcccugggcagucagcccugagcaccucgcugcucacuuacucccgagaguggugcagacauucuucucccgucagcaguaugccaguuccaugguucucaaguuuccuuccacugauuuccugauucaguuacuccuacuaaaaauggccaauauaggugagcagugguggggcacaccuucagucccagcacucagggggcagaggcaggaggaucucugaauuugaggccagccuggucuacagauugaguuccaggacagccagggcuacacacucgcuaucuugagcuuacuacccacaaagggccaauaugcacugagugacugaaguaaacagcagagugagugucucccauccuucagaccugccugguuaaaacuagugcuccuugugcuguuacgauuuuccggcuggcacagaagccagagaucauccucuagcuuagguugcugccagcaagcuccuaggaucucccugucucugagcccagugacagcgucacaggccagagcuuucuuacagguaugacagagaaucaaacgcagaugcucaggcuugcauaacaagggcucucguguacugagccaucucccaguccugcacccagugcaugguagaagaaauauacccauaucuauuaaauggggcgggugggcgggcgggaggcggagggguggagcaaugcauguagaaucccagccccugggagacuggcaguaaaacuuuacagucugugaaaggcaugcgauacaaagugaaacugaaaagaaaaaugggcuggagagguggcuccgaggugagugcacuuguugcucuucuagaugugggucaauuccuagcacccacauggcgcacaugcaggcaaaacacacauaaaauaaaauaaaauuuuaauuaaaaaaaaaaaggaaaaagguacuggugggguacuguagagaagaaaaccacuuuacuugaacaguaccagcuacuauuccagaagagccggguuaaaucuccagcacccacacaaggguuuacaacagacuacaacucuaguuggagggaauuugaugauuucuucuggcaucuucuggaacaaguguugccuggacauacaugaaggcaaagacccauauacauaaaagucaaaaauaauaaauaacgacccccacagagcacagcggcgaacccugugaucccagcaccucaucaggaggugagagcaggaaaaaaauccacuuugaauacagccugggcuagaagcgaguacaagaccagccuaggcuacaugauaagauguuauaucaaagaccaacauaugaagccuaaaacaauaaaaauaaaaauuucaucaauuuucucauuugaagagaccuuagaacacuaagaauauucagaacaguauuaucacauacagccuaaaacguuaccaucuuuguuuuggcuucuuuuaagacagggucuugcuacugaagccaggcugacuuuaaacugcagcucuuccugccucugccuccggagcucuggaauuacagggcuguguuuccaaugugauuaaacuccucuacuugucaccccaaccaucaagaggauacgccuuaaugucugcagggacgcugagcacuccaggggcccgcugcagcugucucaggagcugggaccugaagaccugcuucugcaccacacauccggcgccugccugacuucugcccuuacucuguggcuaugauucucaaugaaauccaucacugaacccaaagucacuaaaggaaggaagauggggggugaugcauuauuuuuagaguaccuucuucuguagauauagaaagagcguacaccgugagugugagcugagaaggcucacuagaccugauggacacccuagcuacagcacagggcaugugugccguacaugacaacaguaauggcaccgaggaauggacauggaguuugucacaacagucauagcagacaugggucuucccugcuuacagaaaggcacggcacccucucccuccaucuuccuccuuacacacaccguuugacuacuggauaacacugacacauacaaguccuuuacuacuguuugcacaccggucggcuaccaccacuggguaccaacagccggcucccaggcccacucagccuguccuuuaacuguaccugcaaucuuuauggcuacaggauccucugacacuggaacaagcccuucuuugacuuccaucuguuuuucagaggccaggggggaugggacagggggggaacacuuaguuuccacauacgccaugggugaggaggcagagggcuuagaaucaugaaagagacuagcccaggacuuugcaggcuggcuaauggggauggcgccagaggcagagagcgcacuuucggcaggaggugacuggcucuccggcuucgcaggguccaggucugcacccucgucggugugcaguucugccccguuggcagcaguguccucgcccggggauucaaguauuuucccauuagcaacugcgaaguucucaguaguaucggugccaacguagggcugcgucccagcuguccuuagcaggcugucugcagggaggcagggcugcucaaagucagcuucauggcagcccucacacagcccugcaguccuggcaucgccuccuaguguccuggggaacggacugucagggacagggccacugaugaaguccacaggauucugagggcugucacaaguccugggcaugacuggaggaagcacguccaugaacucggcguccuccacagccucgccgcucgugcccacugagguggcauggccguugaccaggguggcuggggaagcacuguccucaccgccaucuuucaaauaacuguaguacccagggggccgcuucuucuucuuuuuccguucccucugaccaaggccgccggcaccacugucguucuccagggucucagccucugcguuagaguugcuuuccagagccaaggccgaggcgggguacuggucaauggagcuguaggucucaucuuuuucaacggcuucagggaucuuuuuagaagucguacaaccaaggauaaauucgggugccuggggguucaaggugcuugaaauacuguagcuaggaguuggcggcagccccucacuagguucgaugacuucaucuacaccaaacucgauccucuggugcuccuguccugcugagaagaaaugaccagucaaugucuauccauccagaguacagggugcaaggugcacaguacccaaaccauugguccucuuugagaggugacacuuuguaucauuuccuaacaggguuauaacagguuuuagccuaaucuguuaaaaaugacauguaaaacaagaccaacuuggguauauaaaaaauagaagucuauccucaucccuggauaucuggguaacuaagaguuuaaaaaacagaggguagaaauuaaauuaaauuuguaauuaaaaauuauugggguguguuguuucaguccuggaguggcugaggcagaauugggaacucaaggucacccuccacuccaagguggcugcuggcagccucauuguacaucccacacacaugcaucuuguggcuuaggucagaggcagacagcacacuugccuggagucacucaugucuucagagguacagggacaggugcuggcucacaccuguaauccugacacacaaagcugaggcauaaaaaguccaaguccuggacggcacagugagaccuugucccuccuugcagaccucauggugcuucaugccuaagcagagggaaugugggcucugaugguacaaccugagacacggguacacugcagaaccaggacccccuaggcaggcugugcacaaucccacucucucggacuccuccacugaacacucggacugaggucuagaugccccccugccucaauagcagcuagcuagugacuacucaauucagacgggggugggggugggggauggcggugguaaagccacuuuugaagccuauaaaaccaaaguuagaacuaaacuuugagggacucugaggcaggaucuaccguguagccagccuagccuguuuuggggccuaggaucacaggcaucaaacacuguaccugccuaggacuuugaacuugaaaauucacacugcgagcucuaguaugugcucuucccaguuagcguuaaccugcuccucccauacaugucacgguggacacuguaucuuagucuacaucuuugcaaguagguuacuagaaucaacuguauccuucaacaacauggaagaccacugaaaugccaugcaucuaaaauuaaugccuuaaacuguaguacaagguggcaacaguuuuuuaagucccuuauuucaagaacagaauuauaacccaaaaauuauguccuaaggauguuuaacccuggagggcuugugaugggaaaugaagguccagcagaaagccaaugacaugcuaacugugggguagaggugccuaagccagugagugacaugcugacugugcgguagaggugccuauagcuggggaagaaagaaaggcaauccuaccccaaacagugacuagcaguaacacagcaguuuugccugugcuugcagcaggucacugacugagcaauuuuuuuucccucacuuuagaauggauuaccaaaaaccaauggcuucuauuacaccuagagucuagauucuaugauacugcacauccaagcacauccacgaugccuggagcugccagccacaaacacuaaugugcuugugcuuggauggcuccccgcugagacacaaaugcuguugugaaaucauuuggguuuacugugcugggcugugaagcuuacaggacugcuuacuccaguagaaagaaaagggccuuucacauccauucuaaaucuuaccagaacaauacucuaggugugacuugauaucacagcacaguacuucaggccaguuucucuuuugugugugugugcgcgcgcgcguguguguguguguguguguguguguacacucacagcauaaagcucagaauuagacccauccuucgggugaaaagagagaccuacauaugugacucugaauagcucagcaccgcauaaggaagacaacacccugggcuugugaaaguaucucugcugggaaaggaggucagggaaaaccaggcagcauagguuagagauggcuccgugguuaacagcacuggcugcucuuccagaggacagacccagguucaauucccugcaaccacaugggaguucacaacuguauggaacuccaggucaagagauuccauugccucauugggcaccagacaaacacacaggauacagauauauacauaaaagguaaaacuuacacacacauacauuaaaaagagaagaaaaggugagggcauuuuaaagcaauauuucucaaagugaguuccaucaagcacgcauaccucuaugguggcuggagaccuucccaagcagggaaggcucagugaguucacauuuacgggggagagcaagugagguaacaguggggaaaaaaaggcaagaagggcuucggguguggcucagagggagucaagggcaagagaagauucaaaaguuagugugaugaaaauaacugucccagcagggugcagugacacccuuuaaucccagcauuaugcacaauucccacagaagcuauucagacagcaggaggacuucaacaguuaacuggauggauagcauggacacacugcuucaaaguucagcaguugcccccccaaaaaaauggugggagguaaggcacggcuguggugcuguggugccgaggucgccugcugugacugcccacgcugggagacagacaagaaggaagcucuuccucaugcacacacauucuaaauagacacuaggccacggcagacauucagauauggagauauggggguggucccgaccauccacgucuggacagucuaaaagggaggcagacucauuaacucgguauggaaggcccuagggcagugguucucaaccucccgaggcugcgacccuucgauacaguuugucaugcuguguuuauccccaaauauacaauuauuuuggugcuacuuccuaacugcaauuuugucacaguuauaaaucauaaugugagcaucuggugugccccugugaaggagccgcucaaccccuaaaggccgugacccacaggcugacaacuacugcucuacggagagaaaacaaaaaacacuacacagauuuuagagacaaggaacccuuaagugguuauaccaauuaacugagcaagcaggcaguaggacccuagacgucuuaccacaggguaaagaaugaccaccgccaguacacacagcgaugcccacacagcgaugccccacgggcccacaccuggagcuagacagcagcagaucaaaggacagcuggcuucugcagcucugcucacuuugcuaacuaugcuaagcuguuacugcccuggcccucaggcucucccgucagcacuaaacugcagacugccaacauacuuacuuuuggagauauucccguagucuuuccaaguucaugcaugaaccugauuuauaauuaacacaggucugacaugcuagauaaucauggaaucuaaucccugguucuauuaaaaaaaaaaaaaaaaaaaaaagauuuucuuuuucuuggaagcaaggaaccuaaaacaauccugacuagaaaugaucacgugggccugcagugacugcauagccaggauaucuuaaacacaccucaguaacaaacacugcugcaccuugauaaacaugacacuuaugcauaaaucggccagggcucaugcuggaggccuaaaugcccaggcaugggucaugaacaccaacugcuauaacaacucccuggacccggcagaguugagcacagccaugugggaugacacacccacaacaccagggccugcugaggagacuagagcaccucucuccugaccacaacuuaccaugcccagagugagcguggcacaaccuugaaagcacaccugccaaucugagugacuuggcaguuguggugguuugaguaugcuuggcccaugggccgaggcacuguggguagguguggccuuguuagaggaacuggcacugugcgggugggcuaugagacccuccucacugcuugcaagacuucuccuguuugccuugagaacaacauagagaauucucagcucccagugccaugcaugcccggaugcugccauguuucccuccaugauaacggacugaaccucugaaccuguaaaccagccccaaauaaauguuugccuucauacuggcugcucuggucauggugucucuccacagcaauggaaacuguaagacaggaguuaagugagcugcaggucagagcagaagcuucaagcucuaaugaaaugcgccuccggcugaacggacacugcagcucugggcacaagccugagccugcuaaccuacaaaggaugggagucaacagggacagaucagggagacagcucagcaagagacuugcugcauaagcccgaugaccucuguccaaucaccaaacccaggcaaaagcagaagaggacauauuccagagagcugaccucugaccuccacacaaaagcacacuccaaaauaaaugaauaaauaaaaauuuguguugagaaaagaugacccaauguuggacauguuugcagguuuccugcccacccaguccaugcaacccggcuuaccaucuggcaguucaucuucagccuguaugcuacacagagucccacuguauggagggagcugcgagagaagucagaaacaaaucuuaacagauuaucaaagcccgacagaagccacugcaccagcucaacccuuccucuaagcucugcagaagcaacuggccaugacaucacguucccaggaagacacagauucgccccaaucugaaccaaacaguguaggaaugcuuucaaucguuuaccacugcuaaauacacugcaacggagacugggauacugccugagugucaggcaggcaggaugaucccaaccccaacacuccaucuguuaacagugggaacugaagagucagcaccacuggcagaagugagccagaguccccaagaaagggcugggcccuuaacugucauuuuacagugcgccaugcagaugaguuaaugguuuaacgucaccuuccuuguaugaagaaaggaagaaaacaacauaggucuggcuacuuugugaaaaccuggcaaauuuuaugaaccucucaaauacuucuuccugcuaauucuauuauuuauuuaggauuugggggugucugagaagugagucagcugacagaaccgagccccaaacaccacccugcugcagcaucugugaaguaguccaggaggcucuagcuggugcccagggcaaucacugucugcugugcccguggccuccuaggcucgugucuccagaugaacucuggcuagccaaugcaacaguucuaacgaggcaagguuacuuccuuccccaaaaauaaagugcuggguucucuccccaggaggugaugacaaacagcaagaaaaaaccaaccauggcuggaaaggagcccaaccacucaggaccuggcagccuaggacuuagcaccuugacacaggcaaacucuuccacaugccaucgcugacagcacacagaagcagugugguacagcaacaucaccacggcugcucaccaaaucccgucucuaggucacaaaagggcaagacacccuuacagagaaugucugcucuguggaugguacuaggggacagacggaagugugcauaaucuggacgccuaaaaaagugucaaucaauccauucacacaagcgucacccuaacacugggaaagaaaucuucugaaucuagaagggaccgccuaggaggaccagcgauggugcccaggccugcugggaagguaaaccaccccaggaaugcacacagcuucccugccaaagcuucacaucagugugguuagaaguagaaacuucccuuguaaugugcagagguggggucucugggaaguagaaaaggugaguaggcagagccuccacucgugaacaagaggaccgagacagagaggauaauccccugggacuauucggucggaggucugaucaacacaagcuaccaacauucccaccaucagacuuuguaaggcagacagcuaagcagcucuucucaaaaccaucagccgaccuccagcaagacuuguuaauggcaccagcaacgagcacagugaggugcugugaugggcagagacagugaacagugcugagcaagggcucccaacacuccugcucccgggaccucaggagggggcuucugagacagcagaauaggacgucaggcuaacgguuuccaucacuggggcaauaugacaauuucauuuaaacuucuuuaaaauuuucauucaucagccacgugugguggcacaugccuuuaaucccagcacucgggagguagaggcaggcgaauuucugaguucaaggccagccuggucuacaaagugaguuccaggacagccagggcuacacagagaaacccugucucgaaauaaauaaauaaauaaauaaauaaauaaauaaauaaauaaauaaggauccuggggacugaagccaagucaugaggcuuggcaggaaggaccuuuacccacugggccaccucuccagccuuacuaucauuguauauugagucuauuuagggcauuuuucuuuagggucuggugagauggcucagcagauaaaaagguuacugaacaaguccagcaaccugaguuuaauuccugcaagugacuccacaaagcaguucuauuuggucucccaucgaaccaggccccauacacacgaggcccaccugcagcugcuuccugagagcugggauaagugugugccugcaccaccaccuccagcacacacuauuaccuacuuuggcugccagauugcuaccaucccagggacccgcccaguaggagaaaaaucaacaagcuguccucuauucccacacauacucagacacguacacacacacaaaugaauguaaaaauacuuaacagggccaggcaaugcuggccuuuaaucccagcaccugggaggcagaggcaggcggauuucugaguucaaggccagccuggucuacagagugaguuccaggacagccagggcuacagagaaacccugucucaaaaaaccaaaaccaaaacaaaaaaaccaaaaccagcuuaacagggcaggugggguugggagggagaaaugacuggaauugggcugagguggaaaucuagugcagugggaaccccauggaaccuggcgaagacuccaugauggggaacauggaucgugaaccggccaucuuauauaaccagacaaggccaggaguggagugaucgggacaccaacccagccauaaaaccuuugaccuacaguuuguccugccugcagacucuggggccagugcuuaacagaauugucauuaaaaagaccaagagacuuugccccacaacugaugggagcagaugcagagccccacagccaaacacugagcagagcuugggaguccuucaggggcaggaggaaagccuggaggagccaaaggggcuggggauacacuaggagaacaaggcccacagaaucaacugacugggccucacggggccucacagaggucacgagucucucagggucugacucuguauauaugcuauggagaguagcuuggucuucuuguaggaauccugacaauggggaaugaggggcugacccugacucuugccuucucuucuuccuggguugccuugaugugaugcuaugugucugaucuuaauguagcuuuguuaugccgcguaagccugauguuccuaggccuguucuuuuggaggguaggcagggggggcaggagauaggucaaggcggacacugcaauugggauguggauaagagagaagaaugugaaacugugacagguaugugaugcacgccugcagccucaguacucgggaaguggagucaggaggauuguugagugugaggccagcuugcaccguagaguacaacuguggaauggcugccuuggcaaaaacaugauuacuuuugcucucugguguguagcauccuucacccaauaaacuacagcuucacugagaauuucccuugugccaacagauacagcaagcaccaugagcagaacuauccaaguggaucacuuucuccaguuaguuauacagcugcucagaauacaaaaggacuggaccgacccagcgucucuaccuggaaccccagcagucaagaggcagaggcaggaauucacuaugaauucaguuugagauacauaguuagguuucaggggcagccugcaccggguaauguuuccagcugccuccucuacucagucagaaggccucaucuuacagggguaccauggucaguucaccucagccuguaacuccucuaacucuagcuccaggggaucugacagcuauggcuucuggggacacugcacacacacacacacaauuaaauuccaggguaaagcugguuguaguggugcacuuuaaucccacuacuugggaggcagagacggugagucucuaugaguucaaggccaaccugaucuacuuaaguucugagucacagcccugaguccuugccauaaaugaaugaaugaaugaauggauggauaaauggugggaaagggaucuaugggaaugugaaacaccaccagggacucccucaggaacccacuucgccaaccaggaagccccuagaaauaagcacacaaauauaguguugccaauuaaccacaaugugugugauggaccaugcugagccguuaaagucagaaaacgggcuggagaggcggcucaauaccgccugcucuuacagagggcccggaguucaguuaccagcauccacaacacggcucgcgagcauccguaaucccagcuccaggguaucuccuguaaccuccauggacaccaggcaugcaagacacauauauaucgagcaaaacacauaaucacuaaagaaaugaacaaauaauaacaaaaacaaagcagcaaugucuuagcacggagaacucagcauccuuuucaggcgagcugcaaagggaugucuggaggcacacacagcacucaacccuuccuguggacagagcgcuacccacccagcagugcagccucagggaaggcaggcgugaagaagaaagcaacaggggcuuggccuguaugugaggguauacuuacuucuuugcugagacuuacaagagccagcgagcgggcccagcacacuccuaggauaaucucuacucguuuugaguuagaacucucaacuaaagugaaagugaaccgucaaucaccucgacaaauauguacgugacaacaauuuuucuuaccucaacagaagagcggggagucacaaaaaacugauugaauucaucagggcugaaaucgccaaagauauacugaaacaauaaaauaagaacacuugauuaccuacaacauacacaugacuuauuuuguaaaagccacauauuuuauguguuugucuuaggaagcaucuauacuagaauuuuccaaauccuuuucaaguaaggagugagggacuacaagcuaagguuccuagggcaggcaguauuuccccaugacaagcaagaaaaugucaucuagccuuuucuguaaauugucaaagaacaaauuugaaaaagcuuauuuugaagcaaaucaaguuuagucccagcuccugccuuuggggaaucuuccugguucccccuuuucgccuccacuuagcuuucugcugagucauguuauuaccuaccuccauuuuauuuuucccugccaaaggauaggacaauucacugggcaaugucagugacccugacuaacaaucucaagagagauguguauuuauuauagacauaaaguagaacgacgggacuccagcuucauauugcugugagugaccuuaacucacaggaucuaguacagaacgggugacucugcuacauggccgccagcuccuaagagcuucaagaagucugccacuaacaaguuaucacuauggaauuuccacagcaugcauacaugcauucauucagccagccagccaggcagccaaguacauauuuauaagacucaggccuggguccugaaaacaagcaaagcugucucuccagcucuacugcagcuuaaaaaaucuagaaguagccggaaggugguggcccacaccuuuaaucccagcacucgggagacagaggcaggcggauuucugaguucgaagccagccuggucuacagagugaguuccaggacagccaagucuacagagaaacccugucucaaaaauaaaauaaaauaaaauaaaauaaaauaaauaaaauaaaaaauucagaaguaacuuccagggaaguuuacaaaccacauccuauaaccaaguaaguagaaaauacucuuuuauuaugcaaaagcgcuguuggcgggaagaguaacaaggagaccacccugaggcuacugagcugugucuacuaaaaccauggcaaacccugaagacaaagcuguccucucccguugugcacacauguccugggccacaagcugacaguggacagaagacaaagcuguccucucccguagugcacacauguccugggccacaagcugacagugggccgccgucacgucacgguggaaacacugagaucccacacaguccagaguuuucucaugaaaugcuuucuaacucagccucuuaccaacugcaacauuagccaauugcucacaguaugagaaagcuuauauuaacaucacucacagaacagugugugagaaggaaacagaagacccacaguaugaauggugaacaccagacuaaacucaaaucacuuauuaaaaacuucaacugguguguuuaguggcagaaucgauguauauagcaaccaggagguuuuaaaaacuaagaaacuaaaugcugacgucuuacuuccacagaauuccaucccauaaauauguuacucaacguauaguuaacauccucaaggagcaggggugugguuaguuguaaagcacacgcgggccugacaucuaugggaaguuucuaaaucccauuaagagaacuauggugacagacagggauggauacagugaagccaaugaaacucagagacaccagagagaccacaccucccucucaagggaagcaacacucagaaagccuuuuggguccucuuagggauaagaacuaacuaacuaacuaacuaacuaacuacuaacaauguaggaaagauaucuauggaugagaauuaaaucagugugacuuguuaaaguuaugggugucucugaccugccugaugugggugcugggagcuaaacccaccagagcagcaaggguucuaaccacugaaccaucucuccagcucagaaauguucacuuacauuucacuuggaaacacacuuucuaauuuguucacauacaauccauuuuuuuuuaaaagaaaugguuaauucagaaagggcuaaaucuuggaaaugugcagucugacugcagaacccaggcucccuccuggagggagaaucaggugacaaucucuccuggacuuuucacuugguuccuuauuuggugucacuugaaaaagucugccagagugcuuuucuugcaaauaauucauaccaggacaugguggccuuugccuuuaauccaggcacugaagaggaagauggguaucagauuaucuaaguucaaggccaccuaagagggccuguuaaagacagacaaacugcugaucaaagagcccacccccgcacacacaugaugcgaaauaaaaaugcacauauuuguucaaaagcucuggacucaugaccuagccgggucugacagagcucugguaguguuguuaguaggguguacuauuuuagaauuuuucuuuuuaaaucauguuuuauucaagaaacugacuaggagcuggaaacauggcucaaugacuaagagaagauacuccugaaguucaauucccuaugucugugugaugucacacaacugucugacugucucuaucacauuacauucuucaggccgccaugggcaccaggcaugcaccuguuacacagacauacaugcaggcaagacagaaacuaaguauaggauggcaguauagcgcuugggaagcagaggcagguggaucucuugaguuugaggucagccugguccacagagugacuuccuguacagccagggauguguagagaccacaucucaaaauucaaaauacaaaagggaaacuguguggguauaaagaacagaauucacaggucaugcguaaauccacugcugcacaggcaccacuguguguguggugaagaccucaguuauauccugcugagaauccaucaaaggacacaguagggccuguuaacuggagcuaugccacaccaaacaucaucuggugacugacaaggagacagcagggcugcuugcaacuccauccugacuccucccuucccacugguuccugugcaucagugaaucccaucaagacgcacacagcacaucccccugccaugagaucuauuuucaugagguauuucagugagccauuacaccaacauauacaacgucuugcuucgguuuuguagcugaagccagcaggcgagguucuaacaucggugcacuggauacgcuaguuccaggcaauccaaugccuucuuauggccuccaaggguacacauguuggcaaaaacacuguguguguguguguguguguguguguguguguguguguguguaaauaaaauaaauaugaaaaaaacacuuagaacuucccgggaugauucauggaccauguuaagcgcagauaucacaugccaucccuuuuaaaggcuuuacagccaugcacaccauugagagaucacucuagagauggcucagcaguugagagcacugguugcuuuuccagacgacuggaggucaacugccagcaaccccaagguggcucacaagcauccguaacuccagucccaggggguucuacuucugauuccugaagagcacgugguccauagacacuugugcaggcaaaauacccacauaauaaguuaacuaaauuaaaaauacugggucguucugaaaaggccuuaccauuaucacagagugcuuccuaucggacacauuuuaacaguuuacauuucuaggaagguaaaaagggaaauuacaauaugcugauaaacugcaaaaggcagagaaagcuccugggaguggaagacaggauuuacaaauuuaagaaaagacagggaagaaagaccaagacaagacauucugcucaaaaaucuucucuucccagggaaggcggagaggugacccaggcucacugcagagugcagaccaguaucacaggacacuugaagacugccaucugugugacacuagggggcacuggagaacagcauuccucagucucuaagcuuccaaaggggcuacugaaacucaacggaggguguguuggcugaccuaaauuaacgcucuuuaccuuuugaaaaggucccugguaauaugagguggcucugaaacaaguaaucagcuaacccuuugcucuuuucaguaguucucaguaucaagggagaugaccaaaccggacaguuacccacugcagugcacagcuaggcaagcagccucucuaccugggaggucagggccaucaugugaggcaacagaggcugugagggagcaaagccucucugcagaggacgagcucacccgccaaagcuccagauuucucaccaacuacaagagcuccugggccugacuaggaguaggaagccauggguaggacuggggaggugggggugggaagaugggggugccuggcauugaugaggcucuaugcugugccccaagcauggcaaacacaaaacaacacaagcaaaacacaagcauaaacaagaaaagagagaaacauggacaugcacacaucacaccaauaccuaccugcucaacacucuaaaccuuaaucgaaaaaaggccagcacugaaaaggggaaguaagccaggcacuguggcacaccuuuaaucccagcacuugagagacagaggcaggcagcaggucucugagucagaggucagucuggucuacagagugaguuccagggcagccagggcuacacagagaaacccugucucaaaacaaacaaauauugggaugggaccuagaaagaugguucaaugguuaagaacacugauucuuccaaaggacccaguucaauucccagcacccauaugacagcucacaucaucuauauuaacuccaaagcuggggcuucugacacccucacacagacauacaugcagucaaagcaacaaugaacauaaaauaaaaaugauuuacaaauuguauuuaaaaagucuacuagaagcugggugugguggcacacgccuuuaaucuuagcagaggcaggaagauuucugaguuagaggccagccucgucuacaaagugaguuccagaacagccagggcuauccagagaaacccugucucaaaaaaaaaaaggucugcuagacagugguggugcacaugcacacucaggaggcagaagguggcucugaguuugaggccauuguagucuacagagggagcucuaggacagcccaaggcuagacaggaaaaaagucucaaaaagaaaaaaggggaagaugcuaaagccuacacuaaccaagaaaccacuuacaauugguagcugcuggggaagaggcagucacuuuccccagagugucugucacuggguccaccaacuacucaaccccgugccuaggcagacuuggucagcacagaacaaguucugugacugguuugcuuguuugugguuuuugucuuaguuuuuuuguugggggguugagggggagagaacaugauguuggauaggcagggagguggagagaaucugggaagagaaaaacaucaaaauagaguguaugaggaaaaaaacaaaaacaaaccauaaaaaagucagagaguaagguaaggccaacugccugcagcuccgcucacaugggacgcacaagcuucccagggugcggggagggggacagugucaccacugucccacacagggcgguaguaauaagccucagacugaguuguacccaaaggaaaugcauuggguugcuacacauuucaaggucgaugcuaacuggcuucaguaacagccacacuagacaaaucacacucuggagagaguggugugauagcuugggggacaccugaaggugacacugcaagccgggaguuucacugaugucacaauucccccaagugaacuggugagacugaggauaacgugagcagauacugaagacucaggacaucaacccucaauggcugucacaaggcaagcuaacugcaggcuggugaauguuacaaagggcaggagcuacuucucugagcugaggguccgggcacaagggaacagucauuagcauuacaagucacucacagaguggcacagaguggcacccagcuuuggaaagugcggguuuugguuuggugucuauuuuguuugcauauuuuauuccaaguacuaaaaucuugucaggcuuucaacaggcuggcugcauauucuugguauuuucauugaaaauuugagcuaaauuguugcuacagacgcaaucucaaaauuagaaaccaugauucauguaacaaaaccccacuguuagcagcuucccaguccugucuacagagcagcaauggaugcucacagagcucucaucacacuagaacugcuaacaaacacaaguggacaaauggagaaguaagucccacguacucucugcuguacaccuugaggcuggccugaagagaagcgggaaaagaaccauguaaauaaauaaauaaauaaauaaauaaauaaauaaauaaaugugggcaggugcagucccgggcagguaccagcagauaauagugccuccaacagugggaaccucugggcaaggaaauuauucuguauuuggaguuauggugggcacacguacuguacaggacuauagcucaacacacugcugucugccaguucauugggauggccggcucuccuugaaauccuuacaccagcccuaggccaagaccucaccaacuaacuacugaugagugcccaucacccccacaguguuaauucugcacaggcaggcacccgcaggugcccccaggucuacaggacuccccacugaauggaauugcuggaucaaaaccaacaaaagucccaauagcugaaggucggcugcccggaaggaagucacagcaacaagccuucaggccaugacugaccuggcuugcuggcuuccccaaagguugguuuuacaccccaaggaucuagagcagcugaugaagaagcacacagcucuucccacuuuaaggaggaggucaauaucgaaccucuccaguggggaggagugggaaaggcucagcaggcaagcgugcuuacugccaagccagacaaucugagcgcaacccuaacuuuuacuuuagcacuggcucuccaaguuguccuuugaccacccagguacaaauaaguaaauguuaaaaaaagaaaaaaggaaagaaaaaguuuuuuacaguauacagaguaacccugucucaaaaacaaaacaacauaaaauaaaguuuuuaggggcuucagaaauggcuuaguaguuaagaucacuggcuauccuaucuuacaggcucaauuccuagcacccacacgugucucacaacacagccaccgauaacuccaucccaggggguuggaugcccucuucugaccuuagagaguaccaugggguguguguguguguguguguguguguguguguguguguguguguguguuaucuuguuuugggaagucuccagagggaguccggugaagcugagggucugaaccuucagaagagacgcaauuggccgucagugcugcuucugcacagaagcgggaagcggggagccccucuuaggcuugcuugcagcacacaggccaggccuguaacaacucccaucagugccugggguggaguccagcccucaucccagcuuugagacacugagcugacugauucugacuugcuuggguucaaucucugacugggguuaaccccagggucugagagaaaccugcgcuacuccacugucagcccugaccgagagagaggagcgagaaaaacuaagcggaaacaggaagguaagaacuacuccucuguguaguuaucuggaccauuuauucaugaauagauggaccaacggagagaaucucugagcccucuugaucauuagcaacgguagauggcuuuuuaaaagccagguauacuggcucauguccuuuaccccagccuuuaccuaaggguaaagccaauggucugccaaguuucaggccagcuugagcuaucugaguuugaggccagccuggaccaauguugugagagccugucauuaauuaaucaaucacaaacaaugccagguguggugucuuacaucuuuaauccucuuugagcuaacccagacuagcuacauagaaaguuacaggauaaucagaacuaugugggggccuugucuaugacaacagcagcaauggggcugaagagcuggcuuggcaaucggaugcagcaugcucuccuggccuucacaagcacaaggcaugcauucagugcacacgcacauagacaggcuaugguuguuugaaagagaauggccccccauagacucauauauuugacuccuugguuccaguggguagaacuguuugaggagaauucggagauguggccuuaggaagaguccuaaggcuucagggacaguugcuguggcuucagccaggccagcaggggaacuggcacgcucacuaaugcacuugugcuugcuggcucuacaggggugcugucuuucccucagcccucaggacuacacuugucaggaacuacaggagaauaugauacaguaacuucaacacgacaugcugccgcucaucaccuggucugaagaaacauuuuugguuuugagaaauauuauuucauugcaauucuuaucaaaagagcaucuuaaaaauagaacuagagaaugaguuccaggauagccagggcuacacagagaaaccgucucgaacccccccccccaaaaaaaaucagguugccccagcaagucugccgggagugguggcgcaugccuuuaaucccagcacuugggaggcagaggcugguggauuucugaguuugaggccagcuuggucuacagcaugaguuccaggacagccaggguuacacagaaaaacccugucucgaaaaacaaaaaaaaaaaaaaaaaaacaaaaaaaaaaaagaaaagaaagaaagagagagagagagagagagagagagagagagagagagaaaaggaaaggaaaggaaaggaaaggaaaggaaaggaaaggaaaggaaaggaaaggaaaggaaagaaaagaaaagaaaagaacaaacuaggaguaaguaguagugcacaucuuuaaucccagcagaagcucgcugugccucguucauacacacaguucugguacagccaagacuacauagagacccucucucaaaaaagaaaaaggagggaagggggaggggagggaaggaacugaauuagggggcaggcauggugguggcacauuugggaugugagaugggacuugggaguuggagaaaagccugaacuaugaccuauguagacagaauccuggggcugaggauguagcccaguagagugcuugcauaacaugcaggaaggaagcccuggguuccauccuuagcaccaugggcagggcaccacugcccacacaaccuuaaucccagcacuacacuacuuaaucccaguggaggaggaucaaaagcucuaggucacucucagguacaguucagagccaccugggcuacaagaaucucuaccucaaacaaacaaaaccaagcaaaacaaaucucaaacagcaacagcagaacagagaaaaugugugcacacacaguggacaacaauccucuagccacaggaagaacaaagcuacgucauuugcagggagguggacgcugcuggagaucacauaaagcagucucaggacgauaaaagccacugcucuccucacucacccauggacccuuucauuacaaacacacauaaugaggacaugaaggcagaggggacacuaaaacgcaagauggggaggaaacagggacaaagaugguauuguccacuugcaagaaaauggcaguauacuaaauauauaggauuuaaugggggcuugagagauggcucaaaguucaagaacacugacugcucuuccagagguccugaguucaauuuccagaaaccacaugauggcucacaaccaucuguaaugggauccucugcacucuucuagugugugucugaagacagcugcaguguacucauaaauaaaaaauaaacaaaucuuuaaaaaaaaaaaaagaaaaugguaguauaauaaaaauaugauuuaaugggggcuggagagauggcucagcgguuaagagcacugacugcucuuccagagguccugaguucaauucccagcaaccacaugguggcucacaacuaacuauaaugguaucugaugcucuauucugucaugcagacauacaugcaaaauagcucuuuuuuuuguugcuuuugcacaggaccuggguucaacuucuacugcccacguggcagcucaugacuucugacugauaauuucgguuccagagacucugaaaaccuccaugggcacgaggcucaugcauacauaugggcaaaaacauccacacacauaaaaauaaaugcaucuaaagaaagaaaaucuucaaagcacacuccugaacccuaaucagcccuucaaggcaguaagcagcccacucaucuaccacguucccuucacuuacucacacuauccacuggggaggccaugagcuuagccauggauucaaacuaagcauccagccacaucuggcgagaauaguuuuuaagauucuaaauggcucugugauuagcagguacagaggcuggggacauaaacccauaacaggcugcagcagcaggagccacucagaaguaaagaggaagcagaagcaucagccugugaaaacccagagacauccugaggaggcgcauccaagaccaggagcuacccaagcucgaccacucccacucaaaguuguguacaacuccagggaauuccaggccagcaguuucaaauucaguuaacagugugagucugagguccuaacuccagagggaccugaagcggccacuagccacugcucugggggacaccuauggcuauaacaaaugaaccccagcaagguaaggggaagaaaacaaaagcuggguaaauguuugcugaaggauauuagucacacauagugacccacaaauaaaacagauaccacacugaagagcuaacauacagaccuucacagggcgagacugcaggcuucuaggggccagucccacccacugcaccuaguggacacuaccaccgagaacaaaccuguguucuuguuggcauucacacccacacaaacuggagacauuaaagacacugucgggccgggcgugguggcgcacuuggaaggcaggugaauuucugaguucaaggccagccuggucuacacagagaaacccugucucuaaaaaccaaaaaaaaagacacugugucagggcauggggguacucgucuaauccuagcacaugaggcagaagcaggugccaucugcggguuucugaacuuugacucuguagaccaggcugggcuggaacucagauccacccaccucugccucgagugcacuaggacuaaaaucgugcacaugcacuaugugacuuugcaucucugugaguuugaggccagccuggucuacacagugaguucuaggacagccagagcugcagaggggagaggaggggaggggaggggaggggaggggaggggaggggagaugcucgaacugauacagaagaccucgguuugcauuuuauuagggugugaaguaaaugugccagucuggaaaggcaagaguuagagggugaggaguguuuuauuuaucuggccacugcagaacauugaugaaaagaaagauaacucuggagaagacagaagaaacauuucagguuaaggggcuguagagauggaucagcaguuaagugcaaucaaugguugcuuuuccagaguaccaggguucaauucccaggacccacaagguggcucacaaccaccucuaacucaguuccaugguaucaccucuucuggccucuacuagcacgguauguaugugauacacagcacagacauacaugcaagcaaaacaaccacacauaaaaaggaaaaauguuuuaaaagaaaaaagaagggcuggugagauggcucaguggguaagagcacccgacugcucuuccgaaggucaggaguucaaaucccagcaaccacaugguggcucauaaccauccguaaugagaucugacucucucuucuggagugucugaggacagcuacaguguacuuacauauaauaaauaaauaaauaaauaaauaaaucuuuuaaaaaaaagaaacauuucaggcuaauuggcagauucuuuucuagccacucaggcagaugaccuacacucucuccaaaccauggaggguuuguccuuuagggcacuauagaagaggaaacaacaagaacuuaacuugagaauugccucuuucauaguauaaagccagagcacagggcuacaguggacuauggaguuggagaaguggcuuagcuguuaagagcacuggcuacuuuuucagaagaaccagcuucaacucccaguauccacacagugguuuacaacuguucacaacuccaguuccagaggauccaaugcccucucuuuuuucugugggcacuaggcauacaugugguacaaaacccauacacauaaaaauaauaagggcuggugagauggcucagcagauaggagcacugacugcucuucugaagguccugaauucaaaucccagcaaccacauggcggcccacaaccaucuguaaugagaucugaugcccucuucuggcgccucugaagacagcuacaguguauuuauguauguuaacaaauaaauccuuuaaaaaauaauaauaauaaauuuuaccgaauuucagaauauuaucuaaacuguuccaaguauggggcacacuauaauccuaaagugugaugccaggauggggaggcgggguaggaggagccugucauuaaaacacacacaagacacagacacacagacagacagacagacagacagacagacagacagacacacacacacacacacacagugugaggcagcuccaguuccuaaccccagugcuugggcaacaaagcacauuccaaauccacugccuuguccagguugccaaguuguccagagaacccgucaccugacucuaaaucaaaccaaaacaaaaaaccgaaaacauacagaugacaaaguaaagaugaaggauccguaaagaaacccuuuauuuuuacaucucccaccuccuuugcaggggaugagcggcucaagauagcaugucuuuguuuuauaaguaaaaaucaaucagcaaggacuggacugcaggacaaaugcacaguaacccuugcaggcaggcagcaggcaggcaggcaggcaggcaggcagcaggcaggcaggcaggcaggcaggcaggcaggcagcaggcaggcaggcaggcaggcaggcaggcaggcaggcaggcagcaggcaggcaggcaggcaggcaggcagcaggcaggcagacagcaggcaggcagcaggcagcaggcagcaggcagcaggcagcaggcaggcagcaggcaggcaggcagcaggcaggcagcaggcaggaccuucuuuaucuucuuuaucuggucucugauucuagcucucauuugaggaucacuauaacaucccucgguggacaucaagcucuggccuauguccucuguaaaaucaacucuaugaaguagaaaacucaaaccagaaggaccuaacccugacuuaucagccucuugaccuagaggccugcugccucuucugugguguguggaacagugauaacaguaugugacagcugacacaggccacacaggaggaccacaguaccaaccagccacugcaaugucccuucaaagucaggugugguauaguauacuccuucuuguccaauguucaccuauccaggaagccuaauuuuggucauaaauaaagagugacagccuuggcacccacccaaaggaaaucauuacuuaaaauaccaaaagauuaugugggagaugucuuuaacgucucaauuuugcugugauccuuaaauuacucuuaaaagaaaaaaaaguuaaccaggcagugguggcgcauacacuuaggaggcagaggcagacugaguuccaaggccagccuggucgacagagugaguuccaggacugccaggguuacacagagaaacccugucucgggaaaaaaagaaagaaaggaagagaagagaaagucaagugugguguggugggcacgccuuuagucccaucacucaggaggcagaaggaucuuugaguuugaggccagccuuaccgauagagcaaauuucaggacagucaggaaagcccuguaugcagaagaagggaggugguaagaaaaaguuuaaauauaucaagauaugggcuaggauuguggcuccgggcacacccuugcuucagggcagaagaaaugauauuuaaauuuuagaaggggcaugguagagugguuagaagcacuggcugcucucuggcaaaggacccaggucccagcacccacaaugguggcucaaagcugucucuaauucaaguuccaaacaaacagaugcagacaaacacucauacacaagagggacuggggguaggggaaagggugguagaaugggcagguaucacaaaaccuggaauuaagcuuccuuuucaaacuggcuugcuuaccccacagcuuugauggguacacuguaacaaaaagauguuacacccugggcuuguggcuacaauugauggaagcuaaagaggucagaagcaaguauuuuaaaguuaaguccugggccaggaaaacagcucagcagggaaaugaaaugcagcugcuguauaagcccagaucuggguucuacuucugaaacucacauacauacuaaguuucaucucuggaacccacacagaaguggaaggagccaggcagugaaggugcaugccuuuaaucccagcgcuccagaggcaggugaaucuggagaagagccuggucuccacugugaguuccaggacaggacuaccagagcuacagaaaaaaaccuacagugaaagcgaccacuaacccuccaguccuccagcucccacccaggcacccagacaccucccaccaggaggagauacccuccgaggguuuacaucugagauaagcugccuaacacaggcaagaugcaagagacagaaagaaagcaauucuagaaagcuucuugacagcugcuggaaucccaaucaauccauaagcuaaugguccugagcccguucagaugacagugauggagucgaggcggacacccucugccccagcaaggacaccagcgugcgugugagaguucaaugcugcagccacagacgcucaugcaaaggugacuccggcuuucuaauggagucuauucaauguucuuuggcagccuagugacaagguccaugucuugcaaaauguaauccauauauuacuucagccucacucuguguauuucauaagaucaauuuugcagaguauacaccucuaaucacagcguucaggcgacggagacaugacugcugcccguuccuggccagcagcugugacacagcaagaccucagucuuccaaauucugucucugugaacacagagcuguaccaaauaugucccgccagccacaagaccaaccaaggccucagggcgcacucgucaucaggcagcuucucucagccacagcccggucacccaccgacacuggccuauagcauggcuacugcugcaugcucaguacuuuucugagucuaauucuuguggagcacuuggaugccaacugauacacacaaugcucugagcuguagccucggagucacacaaaucagcacggugccacacuacugugaucucagcacuggggaagucggaggaggagguuccuaagucaucccuggcuagggggcaacuuugaagguagccuuagcuacacuuaaagucauacauacacacacacacacacacacacacacacacacagacaaacacacacacacacacacacacacacacacacacacacacacacagacacagacaaacacaauaauuuggguugccgggguuugagauaagguuucucuuuguagcccuggcugccuccgcuuccugagugcuaggauuaaaagauggacaccuuggggcuggggagauggcucagugguuaagagcacugacugcucuuccagaaguccugaaguucaauucccagcaaccacaugguggcucacaaccaucugcaaugggaucugaugcucucuucuggugugucugaagacagcuacaguguacucauacauaaaauaaaagcuuuaaaaaaaacaaaaacaaaaacaaaaaaacaggccaguugugguggcgcacaccuuuaaauaccagcacuuggaaggcagaggcaggcggauuucugaguucaaggccagccuggucuacagagugaguuccaggacagcaaggguuaaacagagaaacccuaucucaaaaaaaaaaaaaaaaaaaaaaaagauggacaccauuacccaacaaaguuuuaaaagaacauuuugaagccaggccaggggauuuagggggaggguaaauuuuuuuuucuuuuuaaagaacaucuagagcuaagcucaccagccaaggcacuaaggcagagaagcacccaaauguccuccgguccccacaaacacaugggcacgcaccuacacacaggagcaaccccuccccaugggcuccuuccugcacauacucucugcucuccuguaaacaugaaaaagaaguuccagggagagguucuuuuccccaauugucccagcagacggccugcccugcccccagggaagaauaacuguugagaggggcagacaagaguggacagcuucucacuuccuaggucuucagaugaaaaacagcaucaggcccagcauuuccuacaccaacaaaauaaccaggucgugaacagcuaucauuuaaaagccacacucauuuacuaugaaucacacauuuuuugauuuuugaaacaaauaaacuugccauguggacuaccuuuuuguuccaauuuauguuuuuuuuuccccuucagacagaauuuugccauauagccuaggcuggcucagauuuccaaccaugcucagccucccgugugcggggauaacagaugugcaccaccaagguuaguccaaggcuuacuuuucuuuuucuuucuuucaacuuuaugaauaugcguguuuugucugcauuauguguggguaucaugugcauucugugccccaaaaugccaugaaaaggugccagauauccugggccuggaguuacagacaagguugugagcuacccuuugggaucauacccaaguccucugcaagagcagcaaguguuccacagaaccaucucuugagccccuggauuaacagcucuuaauccagccugcccagacaggauggucacacaaggccuuuugggagaucacuugcagacagaaaaacugcaguccaagcacaugcaagucuuagaaaugaauagugcccugcugaaguggcacuaaaagacaaaugacacuaauccaacaucccauggccagcaaauuccacugcagccgugucugcucugcagcaguggcuccucaugugugccagucaacugcaaugcacuagccuaaccacaaauucaaaagcaagcucugcuaaccacuucccauaaacauuuacuuugguuaauuaucaaugacaagugccucccagccccaucuagugcauccugaaaaccugauccaucgcucagaaaugcucacacaacucugaucugcaaaacuaccaagacuugauguaccucagccaagagaagaggacagcuuuuccccacuuuugacaauuuagucugcaugaggccaaauuaugacaucuuucuccuuuuaauuuuccuguguacaccacuauucaaaucaugcuaccuccacauaacagaaauugggacaccuguucuagugguagcccuagagaagacuccagaaucaugucuguccacuaacuguuggugcugaguucccaacaaggagagcugagagaaaggagggcaaguccagagacacaauaagccuucagaggacucccagcuccgggacucagcaguuauagucucagcacugaccgaaguguuugcuguuguuacgcacaaaaaaauaucuucaaauaccccauagccacuucaaaacuguuaguucaguugcacaagcuguguaagauucugauguaguagcucaagagacuaggaagugugagauugccugcagccccuacaguuagguccacaggcuacauaaugaaacauuguuucaaaaaaggaaaaguaucuuuaagaauuaccccaaucuagcuaucaguaacaaaggcaguuccaaaacaguguaacacucugccacagagcuagaaacuguauccagggaacucccagcauguaaaaugugggggucuauguuaaggauaacaaaaaccaauagcacucuacccaaccuggcuacagaaucuacacuguggacccaaggccagcuuuucaacuauaaggaaagcugguagcuucaaauuaaucugcucagcucacagagccaguucugacgcaggaaugccagauucacuuccaccucaggugagagcuccuucucuaaacugguuuagcugguggacaggaacgcccuaaacucagagucuuuccaaguucacagucgcccucaauucacaaaacaggagucaaacaaacccaaaacauggaaaugaaagaguuaacuuguaaccucugaaaguccacugaaaauugacccuuaacuguaaaccugugacaguuacuucaacaaagcccuagaggacauuuaggcuccucccuaaaaccugagaggcugaggcaggaaaacucaagucuaaagcacaccugggcuacauuguaacccugucuccaaaaacaaaucaaaacaaaaaccacccacuucgaacaucauggaggcuagcccuagguaaccugcuaguaucugacugaaugaacuaauuguuaaaauacuuaggacucaaaacagacucaaaacagugaacuccuguuucuccuccuccuccccuucccccucccuccuuccaucucccccuuuuucuccgugaaggggagagaacugcaccgugcucuguacuuagggaugaccuuggauuccugauccugccuccaccucccgcaugcaggggguaccggugugcuccaccuuacacagcuauuucacucgucuuuucaaaauaaaacaggacuaaaacuaccaucaccucuucucccuucuaccacuagcugacccaaggcacugcuaacauuuguuugguuucuccggucaggcuccaugcaaugccaggacaauggaccccaaggaaaucacucaccaccacuuccaccaacuggauauuguugcuggugcuugagaaagugaauucugcuuaagcaugcuuucuuugccccaaaaucauacacacacacacacacagagaauugacauuacagcucaguucagaaugagcaguacagacuaauuccaaaaauaaaacaagguagucaacuagagguuuuugguguuuuucgagacaggguuucucuguguagcccuggcuguucuagaacucacucuguagaccaggcuggccucaaauucagagaucugcuugccucugccucccuagugcugggacuacagguguuuuugaauugagcaaggcuaugaagggcugauggcuccaagguuuaagauaguugcucuugcagaaaacugggguuccauuucuaccaggacucagaggcuaagaaccauucuaauuccaguuccaggagauccaacacccucuucucgcuucaaugggcaccaggaacauacauauaugcaagcaaagcauucauucacauaaaauaaaauaaaauaaaaaugccuaaauagaaccagauguggugguggugaauauuccgaaucgccagggccucuggugacagagguaggcaguugccuuaaucgcaagccaaccacagcugcauaaugaagaccugucuaaaacuuaaaaaaaaaaaaaaaccacuugucaaaauauuauucaacaaauacgaaucgucugccuauugaaaaaaaaaaaagcacaccaaauacaaaagcauuuacagaugaggggaaaggucaaacaggcaaaguucagauuugaucuaugaaacaccacauacuuaagagaacggaaguuucuccuaggaucuaaccuuuuauuaaaaacaguuucgagguuuaaaucccauauugcaacaguuacuaaaaccuuucaaaagcacaugguggcucuugccugcaacgcaccaggcugagauagggaaaaaaaaaaacuuaaguuagaggcgaucguggaccaagagaaagaucaaauaaaaagacgaucguucuucaaagguggccucaccagaccgaccucaccugccuuguacauacauccaccuaccauccucaaaaaggcaauuuuacuucuuaguuucccgagagucgcagcccggagaagcggcaccacgugcugacuucucacucguccuaagugcaucuuaggagaggggcugcaggagcagcuccgggcacagaaaacacagcaggcaauccggccugccgggccccgacccagcccgggcucggacaccgugcaaaaggugucagucucgggcaaaccggaguaugccgccccggcgcuucccgguuuucuuugcaauagaauucccgaggccaggggccagguccccggcggcgcugggccagagcgucgcccgggacucggcggcugcgggccgggcacgcggaggccuucccugcggccucgggcguucucggggcggcucggacacucucggggcggcucgggcgcucucggggagauucgggcggccuccgaagccggggaagcgcggcacugaggggcgcggcgcgggccuaggccggcagcgugccggcgccucccccaccgcucgcccgccgcgcaccucgcgaucgucgccccgaggccgucccguggcccagaccucccagcccagacacggcccgcgcuaccuguggguuguggagggccauggcggcccgucucaaugagguucggugcugcuccggcuucucacgccgcgucucccgucgccgccaucuucucgccgcacagacacacucgcagcggccgccgcgccugcgcacugacugcgccgcgggagagccaggcggcguucugcgccugcgcgcgacaggugggcgugcgccccgggccggcgacccuucuguccccagcgcgccgagggcggcugcuccaggcgagggcgugaggauggagcuggccaggcacccuggggcugcaagguggaguuccggagugguuacugcgcuggguccgccugagcuccgcccugggaucuccgcuggagaucuccaaggaucccuuacccuauggagcgcgcucuucugaccguucguucauucauucauuccuucacucuucauucucuucacuagcuuguuuuaccuggcauuggggaaaaaaagauuuuuuuuuucuuuguaaaacauaaaaguaaacguugaaggagcuagugagaugacucagcggguaacggagcccugccuccuguacccuugaggaccaaaug

SEQ ID NO: 4831 - RNA, 9162 nt, Mus musculus
cuggccuguguuucuaggucacuuuguauucugggaaaugaggcugccucuuggaaaaugucuguuuagcuaagagauuuauuuugggaguguagucuccagaccuuugaagggccuccgagggccacggauacagccauuugcagagugccuguccuggcugcagcucccuuuguggugagcugccggcaggaucgucuggguguggcucagacaccagagccgaggucaagaggcccgagcuggccccaggcaggggaauuacccguucggauuucuuuccccacugaaccucaguuuccuugccucaucugcugcucaaacaaacucccauugugugggcaucaggaucccggagaagagcaguguguauguaguugagccucccagccucucugcaacucuccuggcccaguggaccagaacagagcuacagaaccugcauuugaacacacucccagggagcaugggaugcuggagguuguaggcugcugcagaagggccuuggaacucaaggacaguccuugagaguuugggguccuggagauggugacaguggguucagcaguuggugaccuuugucuaugcaguugcuaugacacaagucaugugcagcccugaaccuugcuuggagaaacacagcugccaucgcucuucacugucccaagcugugagaccauggcucugcuguccucgagggacugugggcaaguuguuuagcuccuaacccucuaucucccaucugagagggauaguuaaugaucagugaucuccuugaccuugugggcuuaugaugucagagugagugacaagcugggcacacuuucagugccaccuuugcccguggcacggcacauugagcaguggguacgggcugcccugggucccacagcugccagaugucagggcugaccaguaaaccucucagcucauaggggucguugugaaaugacccagaauuaaugucgagcccacaugagcggagaguggacacccucuacauguggcaggagagguaggggaaggaugcgugucugucugucugucagucgucagagaugugagcaucaccagacaugagaggugagagcggccugccacgcauccaggaaaugugggcgucaugguaucuggaauuccucaagggggggaaaugaaggacacagccacguccucuuggcuucuggagaaggcucgccucucauggggugaaugugcaaccccaggggacguggagaauacuaggaagcuucuccuggcacuugccccagcggaaaccgaugccuugcuucuggaaaugccagucccuagacaggacgagcauaucugaggaacagaagcagcgacuggccaguugccagucagcacgcaguaagccguuuguguccacucauagaccgugccuccgagaagugguuucugggaauucugaaacugaguaauggugucaccagugucuucaccggccuuaggaacacgugugggucugucgcuucuuacuuaaccuuuugcagcacagacuuuuuugggaauuggaacuugugcguccuucuucaagggaggaaaaugaagaugcuucuccaugacaacagggugccuagccaugcugccaugcucaggaucggaaccagacccugccagucaccgccagccugacaggccucucugcccaggaccacuugggaauaaggaucccguuggcaccaucuguugacugaagaagacaagaugugucaucauggcguuaaagaccuggcuuuugguguuugagccucgagugugggaggcuggaguggcugccgaguuuuccagccuuuggaaaccauucuaauggcccagagggcagggcaaauuuuccugagaccacacagugcugauuucucccuagauggagagagcacccauagaccaaagaaagaauuccauccagguccagccuggugagccaguagguauauguauaguccugugggugacucacaggccaccaggaagacccauggaugguauuuagguagcuauaccagugaagauuuccccuggaguggcucaggauuauacaggaagaaaucccacccagucaauuaacucuaaccucaagaagcagggggucucuaaggaucgugggagccccguccguuuugcuggaauguccacaggcuagauuacgugagggucucauguaaugaucgaagcggcucugacugaagagagccauggucaaucaaaccuguaggcaauggccacacaccuucucauggaguaucacgguuuuggaggacggaugucaagcagccugaagcaggcucucccaggagugccucgguuacagcucugggagguagcacuccaggauguggccaugcagucacacaucucuggggacggugggguacauagcugacucugcucuucaaugcagaaagaggucaagcaacagagccagugcccuggaagguacuagucuccccaggccacgcccgggccuuggcuccuggccuacuaaugccagcagugguccagggaagggagucuuauguuccagcucugagcccuucccuguuacaggacacugauguccgugggccacggugauaaaccugguaaucugcuaccccaacauccuuaacuuaaucccaucugccaagccccuucugccuucacaggucuggggauuaggcugcggucaucucuggggaccauuguuaugcugaccccgcccucaccgugacuggcuucaguuggcguccacagaucucaaguggcuuuggcaaagugacugacccugugugcccagcuugcuggccugagaaaugggaaugacggccaccacccgcgucgcugggucaaauaggauaauaggccacagcggggacugagauccugccagggccggaaugcgcucaugcugggcaggagauggguccucccuaugccaaccagcucagcuccagggugugcaccugagaccuucaggaaggaggugaagacacacgugcaucaucugcagcugguccgcgguagagcagagauggagaccaugaucugggggugcaguuccagggcagggcacuuggcuauuauuugcgaggcuucggguuccaucuccagcacacaggggaaaaggguggaauccacagucuaagccacaaggcugaccccgcccaaggaaagcaugguggacguggucagggaguuagcucggcagcucucagccuuagauggacaucagacacccugguccugggcugcgaccacacuggaugguccugcuccuaggugaaaaguaacggauauguguccugcccaucuucugucccaugagccuuggacuugacucugaagcgguucacccggcaccggccugguaugcacuagacagcugagagcauccgccuguguccacgaugcccagagucacugcauaccagccaccuuagccugcuuuccccuccugggacaugaugggacacuucuaccucggggcucugcacagucuccucccacugccuagaaugcugcaacuggaaugucucugucccuagucuguccucugcugcucuggagcagccucuuccagccagccgccagccgccagccaccucaugaccuaguuuuauuuuccucacagaucucccuuguauguuuguuuguguuuguuagcucccuugacuccauggaagcagggucuucauuagguccccacuaaguucccugagguucagacacacagugugacugcucugaaagguauuugugggugacagaugagugacagagcacauccucugagggucauuccagagcugaggucgcgugggcuguuuccuggggucagcgugaucuguagcaccagaccccgggucccgggucugacacacagccuccugucccugcagacuuccagcauuuguaaggccgcugugcacgcaggugucaucguugacgagguugguggcuaugcagaugugaugcccguggacaaaaagaagagcuacgugggcucccucaggaacggggugcagucggagagguagggcuggcccucgggcccggcagcuccuuacuuuucaaagcugguuaauucaucgucacuaccggguccuggccaagccuucgguccucucucuguccguucuuuggcuuuccagguuuuccuuuucuuugucuuuguggaaaauguaggaauauuagauauuccuggaucuuagcaucuaucugcuguccaucaccugggaaaacagcugugcauuuuuuguuguuuuuuuuuuuuuggcauguaggcuucuaccucucauuccucgugugugcauguguguauaugucuacaccuguguaugcauacauguguguauaugcacacagauguaugcaugcauacguguauaugagugugcaugugugugcacauguguauaugucuaugcauaugcauguauacauguguguauauugcacacacgugcaggcauacauauguguacaugcacacauaugugugcguauacguguguauuaugagugugugugugugugugugcgugcaugugugcauuuauuccauaagacauagggaaccaaguucuacugccccaacagcucugaaagcugcacacaugcuauagaaaugcucucuggcaguguagucuuaaaagcuguauggggaauucaggacccuguagacuuuuuugaucuccaccugcccccugugauuuggacgccugucaccucagccugguggcuagucucccuaagcuguuuuuaucucugugaauugagcacagcaggaccaagggacugugacacccacuccucccuguagcugcaucuguguuugguauuucugccagcuuccccggccucaugggaugggagacaagucauugagacagggccugguggugacaggcaggaaguaagggccuugcugacagcucugggguugcucuuaugcaaucacagggcuaacuuccugccccugcugugucugcuggcuguaguuuggagcaguguccagugcauguggcuccaggcacuuuaccacuaucuagggccauucacacuuugaggccugagccacagugauaagcucccuucuugugggacauuggcacauacuccagguguacucucagauuccccagcugaccucugaggcuuuagcaugacuuucuagaauguuuuucaggauagccuuugguccgggccucuaggcuaauuuuguucgugugacccuauucuguggaaauggauugcaaagacccauuucccaugugguuuccuccugaggacauacacuucagagaaggcucugcuuccucuacccucuagcuuugcugagggauugucaggacaccuuccuaaugcagauagaguugagauccuggcucauacugauacacccuggcugccguggccuuucauucucaugauucuggagaccgcagagguaugagcuugugaggcaguggacacugcuuucuuguguucucugacaucugaggucugucucgcuccugcgcuaugugaugggccuagugaauccuguaagucucaggagcuuccuaagccuuguaaggcucauuucucgcccccccccccccgcccccaggagggaaaguugugauugggaaucaaaagcuacagcaaagcggcuccuaugaaguggaugaugggguccagcaacccuggcugcucucuccaguuguuccaaacccugaaaaauggguccuuuuuacaggaguagguagcuucauuucuagagucaccugaauuggcuuucaaaggaacaugaagcccucacacauguucccuucuccugacacagugggacucuuuaguccauacccacuccuguggccuccuccacacgggaggcccucauguucccagucacuggauccaucaaguagugcgaagcuggaccccuguccugugguguaggccuggccaccugguaggacagacagaagcgagacccaggcgagagagcaggucacuuuugucaaaguauaagaagcuugggcccuucuuggccacaaggcuccagcagacauauuugggcauggcagacauguuugucuuccuccagcauccuugaugcuugaagugacgugacugggaggucuugguagccugucccagugaguugcaggaacugguuucagauccaguaacugcugagacccuagagggguuagagguggucccaauggucauuaaguuauaggacauucuguggccaguguuuuccaaauagcacuuuauuucuaauuaaaauaauuuuuauuuaucuuuacauuguguguguguguguguguguguguguguguguguguguguguguguguacucauguuccacagcaacauguaaaggucagagggcaacuugcaggagucgguucucuccuccacaugugggucccggggauggaacucagaugguuaggcuuggcagcaagccccuuuaucugaugagccaucccacuggcccccguuauuuucauuuuguucauuugagauaaggucgcauguaaaccaagauggccucugacucacuguggagcugaggauguccuugaacuucuaaucuucccgccccgacuucccaaguucuaagguuauuaggcccaugguaccacuccuugcuuggcaaacagcauuuuaaguccugagugguagggggugcuacccaugcuagcugaugugacagcuuugauuucacaauggucuucuuggggaaggagguuuccuggaaguugugaaagguggguguggggcgugagucuccaggacagccuguucucucccagucuuguggcuuacaugggcugggcagcauccucacagagagcaggcaccagcauagaugucugccaggcucaggcucuuccuaaagcagggcaacggggcauucccagucaccugcccugcacaguaaaguaucggcaggggguguguucagacaggcuuuugccuggcuguggaauuguuuagucaacaguaugagcaacucugaccugggcugaggaagggcauggguaacagagauaaucucuacccuaagggucaacagacacaccgggagcgcuacaggccccagcagcuccaguagccucuguaaaaaguguggagguguuugcugcauuugacuuuaagcccagggcuucagaugucucucaggagcgagugcuugggcaaaccuggauuaucaaaagugcaaaaugaggcucagagaaagaaagggagacaaauggggucugcuugggggucguuuugguuugguuugguuuuggguuuauuuuccuuuucguuuucccugaggcaggagcucauuauugcaucuuaaaaagcucaggcuagcccagagcuugugaucccccugccucaggcucucaagugcagacucugacagucuuugucaguacuggggugagacuugguccagcacauacacaucugucuagggggagagcugcaugugugcauagggacaauaacagcacaaucccccauccucucuucucccucccucccucccucccucccucccuccuucccuuccucguucccuuccuacucugacuugaacccagggucucaccacucuagaccagcacucucauuccggauccacaucuccaaccccucuuuuuuacauuguaauuuugggaccauuucuuccuuaguaucacgggcugaaccugaauacacuuuguagcccagauagggcuuggaccaaggauccuccaaccucagccucccgaguagcugggaagagaggccugcacagcagacccaacuucagcaucucuuagcaauuagaaggcaacccuuuccuuuccaaggccagagucagggaccucugugucccaggacuccaugacuccggcugccaacccauggaggcacagguugugcugcaccagaaguagcuguccuauugcucacuccaggcagugcuagaagguuccaaauggcaagagcucuuccucccagaugcuagcacugcugggcugcccugccugcccuguagaggucugguuccaaggcucucugcagagacccaggccagcuaugcucuggccuucaagaaggcaucccugccucucuccucuuuuguccuucguaggauucaagaggcuuuaaaaagagguaguaaaaacaauguguguguguguccuuggaauauguguguguucauggaguguauguguaucuauggaguguauguauguauguauguauguauguauguauaucacagaauuuguuuguccauggaacauguuuguauguguaccauggaguguaugugugccacaguguguguguguguguguguguguguguguguguguguguguguguaccacaguguguauguccaugcaguguguauaccauagaguguguguguguccuuggaguuguguauguguguguacugugguaugugugugugugucuugucagaggacagauguagggagucaguucuuuccuuccaccuucuugagacaggaucugcugagcagaguacuccagacuagcuggucaugagaauuccugucucuuccaucuagcuguggggauccgggaauacagaugacuuccagcacauuggccucuuacuuaaguuccagggaucaaccccagcuucucaggcugugcagcuagcucucccaccugcugagccaccucccgggcccugauaguaauaauauauauauuuauguuuuagacagggucucacuguaauagcuuuggcugaccuagaacucccugcacagaccaagcuggccucauaaucagaaaucugccugccucugcuuccuaggagcuaagauuaaaaggguacaccaccaugcccaguccgcgcuuguuuuugagaggggacugcacugguggcagggacgggcacuauagauguuucaccauacugccuggguuaguggcucacgguacucuccagcacaugcugauugcuuaccgugauggcgucauauccggcugcuuccuuccccauccauuuuucugaacuaaucagaugaggaacaucuuggugcaaucccacacacuccuaggaggucccucagguaacuuccuuuuagugaauggccccagcuauaccaugcccacuucaagucugcacccgucu

SEQ ID NO: 4832 - RNA, 20898 nt, Mus musculus
ccuggacccaggagucccaucuccgguccagggcgcugccucgggcucccaaacgcccucuggcucaguugcuuccacccccgcgccucuauccuucaucuccguaguucucccuccuccaccuggcaccgacauccuuaaaaagagaaucggagucgccacaaacuucaucuauguauggugcggcgggaagccuuaucgagugcucucgaacggcaacgcggcguggcccucgcggcgccccguaggcacugauuucucuuccgggccacccuucccgggggaucuccguuuaguagucuugccguagaugcugcugccucuccuccaagaaccgccgaguucuuggaagcccggucuuggaugaaaucgccagagccuccccgcgauccgccucccggaagccccgggcggcgcgaccggaaggacgcaggcgcagcgucuugaccucggccugguccaguuccggggucguucggcucggcugugccaguucggcgucgggcucccgcuucugcuggggcugcugccucucgcccaccggcccggccggcccgagcagcgcggaaccgagccggauccggguccacccggcccggccaugagcgcugccgcaugaugcgucgccgcccgcgccguugcagccgccggccaccaggagccucagcacugggcgaccccgcccgggccucgggugagugcggggagagcggcggccgcgaccccgggcggcuccccgccgccuccgcgcugcgguccccucgggggcucuccagucuccucugcggaccccgcaggaucgagccccauuugcaccugcagccuuuugccugaccuugggcgcuccagagcuaacgucaggguggcugucauaaagugcugucaccggucugcgagcugucaaguuuuuuuauggucaugcuucgucgcaggucugucuucccaaggccucuguugucucucuuuagcgggacucuucuguucuuugccggucucccuucucuuccccccugccccuggccaugguguuaggaggguaguuacccggaagggcaucugggauaaucgggucagcuuucagggcaauaagguucaacucuauugagcugucauuauuucuagaacuaagucccuucuagcuauuaaauaggcacauuuuauuagcucgugaacagccaguuuauuguggcaauuaaauuggaguagucauaguugcagcagucugcacuguagcggcuuucacugguguguguggcgcuguccaaauccaagcuacagucugcuuugcaaucaguccccuuagugagggaguacacuuguguuuauuuuacugccuugggagagaggucauuuauauuucuugguaaaucugcccagcacaccacucugaucuuuccaaaguuguuuauaacuuucacuuaauucaugcuacauuuagaaacaacaacaaaaaaagauaccuugugauacuugccccugcagaagugguuaaagagaaagguucuuggagguauuuuacaaaaugggcuaaugggaguguuaauuucauuuuuugaacguugcacaaaauagacagguuggggguguugaaacuguguuguguacucuguggaguuacugguaaggaguuacuggcuucugggcugagagugggaaaaagugaagagauaauuucacucagaauuuguucaacagcacuugacucuugagugucugggcgcuuggucgguugauauacuuaaaaauaaaacucuaagcuggauguaaugggugcacaccuuuaaucccagcauuugggaggcagagacaggaggauuucugaguucaaggccagccuguucuacagagugaguuccaggacagugagggcaacacagagaaaccaugucucaaaacaacaacaacaaacaaacaaauuagaacucuguggcuuugcugcucaucaugccuuaaaaucaagcccuuuuuaagaauggaagagaaggcagguauagccccagcauccaagagguagaggugagaggauugaaaguucggaccuaccccaagcaaagcaaaacaagaugggaaaggacccaagcuaauggggugguccucaguucagaaguguaugugaagugaaaggacaggcaagauuguguacucucauugaaauuauuacuuucucacuugagugucagugauauaagacaguaugauugcucuuucuucaccugcggaaaggagacgaagucagucccuacaaaagggaccucuugggugcauuggaagugguuuuucaucaccccagagcuuccuagcuucgguaccugccgagcagugacacguaaugauuuacuagaggcagcuuuugaggaauauuucuucaaaguaauguuuugauuauugaaguaacauaugugcugggcggugguggcacaugccuuuaauuccaacaccugggaggccgaggcaggcagaucucuaaguucaaggccagccuggucuacagagugagugccaggacagccagggcuacacagaagagaaacccugucuuggaaaacaaaaaacaaaacaaaacaaaacccguaacaugcuuuaagaauuaauuaauuaauuuauaaaugcguguguguauguaccugccccaugugggccagaagagaccauuggauaccauggaacuggagcuacaggugguugugagcugagaaauucaggugcucuggaaaaaauggcacguguuuuuagccacugagccaucucuccagcuuguauacacuuuuuacagaaugcucaaagcauaagaacagaacagaauguguacaaucaaaacugucagucaaguucauauucccuaaacugagcuccaaggcaggugauaccuugaacacuucaguuggaccagcugagaguuuaaguccucugugagcauugcugagaugcaaaguuuaggaggaacaaccucacuguccacacugcaaauuggggugggguaaagccaccagcuuggucaugguucacaggaaggauucagagcccacugaaagggauggcaguuaguugguuuauuacaaaaaaaggcugcaauuaaauuuggccaggggagaacggaagucagggacaucucaaauaccagcuucugccauccuaacauugcugugugacaguguguauggaguauugccagcucaggcauccucugaugcagaggugugauugguuagcagugcaguaggaggccuuucuuccaugcagguggauucugugaugcagagccucccagcucaugcacuguuagucuuuucaacucuuccugcuugaagauggaagucuuugcuuugccauugacuaaucacuguccccucuaaguuguggaggacauaaagaucagugaauguggugguuuguauaugcuugguccagggaguggcacuacuaggagauguggcuucguugaaugaagggugucacugugggguagguuuugagaucuuucuccuagucauauaggagcuagucucccguuugccuucugaacaagaugaacccucagcuccucccgcaccaugccugccugggugcugccaugcucccgccuugauaauagacugacccucugaaccuguaagccagccccaguuaaauguuguccuucuaagagcugccuuggucaugguaucuguucacagcaaugggaagcuaacgaagacagugagagagcugugucaguuccaguccccuucagucuaaaagccucugaugcagguagaccgugguagucuaugucuguaguccugacuccagaggauaaaacagaaucgcuugggcccagaaguuugaggcuggccugagcagcacaguaggucuucaucuggcuucuucgaucuccacacugcaaaccuuucuugucuugcugcucugagcccugcuuacugcugaguuccuuucuuguacacauuucguagaauucugcuacuucuugaaugaaauccagacuguguacugugucuuauuggcacagcaccugaucauuuaaaacauucuguauccaaucagucuugaagauagugggugccuaaaaauuggugaaugaauucuugugcgaggcagagagauugaaaaugaauuuugauuggaagaagcagaagccaggaggagcuuaccaaaugaguaccuuguggggagagguggaaggacugagccuggaccagaaugggggagaggaaaacagcgcugagagauuuggggaacugagcugugguuuugaacaauaacucuagauacuggaaucuugcucugggcuccuuguuaccccuggggaaagaauucagaugaaacacagcauagugugggacacucucgagggugagaguggacaguggcccaggggaccaucauggagggaaaugcagggugacagugacuggagagcccgucuugcuggcccacagguuuaggcaagcuucacgcuaugcugcuggagugucuguggcagacagcuuuccugagagauaccuuccugugcaggugauugacaggcccgcaggauuaaucccgaaggauuguacugcaugcuaguggggugggcugcuuagguaaauagaggcacugagucuauaggaggcugguuggaggcaagcugagugcacagucccaggaucuguaugggcagggcagggcagggcagggcagacagagauauggucggauuuaagaugguccuggaggucaagacucagaacuuaaucacaacuuagaugugggggcuggaggaagaggcccgagaagcugacccuggugacgagguggugguguggugcuuauuaaaauggagagggugagauuuaacagugagguucugcuccuaccuuccagccguggaguuugcuaguagccaguuaaccagacagugaugucaccaguguggguauuuacuagguugaguucuccaucccaacauccccaagaagacacuugagagaacacagagggagagaagucaggccccauccugggugcuccuggacuggagcccugugggcaaguguggcuguugaagggaaagcccaguggaaugcuccacccccauggugacucuccucccagugaugugccccaccccugaggugacuccucuccuagccuccugcuucugugccuguguucuccaccuucgaccuuuguggccuggugcuccaacugcuguucucuugugacuacguauuuaaaagacacuucuagaaagguuaauagggcugcuuacugccugcagugugcagccuugcagauguguugacacuuggcuguagguggcuguaucuauguuuucuucaagguuaauaguuuuuagucuuaguaauuagaggaggaaauaauagguuugugugcagaggggaucagcacggugugggaggccagccccacaccaggggcugugggcacacgagagggaagcacuuuccacaagcacuguucuaggucacacauugagaugugucucccuuugaaguuguccccacccugacucaggugcccuucuugccugguuggugaccugcccaggaagcuuguuagaggcauaggucuacuugaccacagggaggagucugcugcccugaugaugccccucugaaugcccaggauccccaccuugucuuaaggagaggacuccuuaaguuguucccucacucuggaucagcugcugggucuccuugggaccugggcaguccaaguucucagugacccggguuuuaagcguuugccucucccaccuggacucuguuuugcaacucuaggcuaagucuuuucuuuaauacccacucuucugucaccagcucuuugcuagccugccaccuccuuccugagcccuggcagguccuuuggauggagaggccagcccuuuacagugagugcuuucugagcacgguagguucucuacauuccgcucuuccucguccuggacuccacagcugucccuauccucccugucccugucuucccagugccucuucaagagugagcugcuuuagccccuccucacccuacaucucucagacccuucuuccaguacccaaaggcuguuguauugggacuugcuuauuugagaaagggucucuuugcagccaguacuaugagaccugaaacuuacaauguagacuagauugguuuugaacuuggagagauccuguuucuguuucuggguucuggaauuaaggcaugcacugccaccuccaacguacauuuuggcaaguucccagcauccuguggcuauaugccaccaucugggucugagggaggacugugacacuacccacccuccaggcugugcagccacugaccuguugaguuagcugggcuuucugcuuggcucgggcugugacagcaguccaguguggagccuuuucucccucucugcacacuuagcacuguuucuaagcugcggcauggggacagacagucucucacucacuuuuuggaggaugcgugguuacuucugccccugagcauugaggaccgcacugugcaggcuccgugcagggaucugugaggcugcugccuuagaucacuggaagcugugaaugugagguuuccucagggugaggcaagccuuccacccuccuacaguugccuuuuuccuuguccucucucucccuguggcuucauucccugagccugcacacgcgggcucccuuccuuuagaaguagcacuguugugauccuguacugcuuugauggccagaagacgaauccaaagcaaggacaagagcaaagggccucugggauaagccuuaucucuugcucaauccaguggcuuaggcggcuuacuuggcaucuggucuuuuugggcgaaauguggcaugguccuagcgccgugcggugggugcagagaagcucuucuguaagguagggagaucaagagugccuuccgugcucccgcuagugugaaaggaggggauccuggggagauuaaaaaucaaagcuuccucuuucccucuagcuucagcugccucucucuuggcagcagugcaaaguuugcuuuuuucuugccuagcauguaugaggcccuaaaaaagaguuguaaccuucuuagcagucaguggcccaggcucuuagcaguuuacugaaagugccaggacaaaguccccggugccugugagcuuugucugugguggccgacugcuccaauccuccugguuccuuccccgcccugaaaugcucacauucucagucaguccucuggggucugugugcacuuaccugucucugcucuccccacacugcuaugcuguggccucucacucuaagucagagcacuugcucuugguuggcugcuugguagcuuuuuggguguguccugccgacaccccauggucagugagcccauggcaucuccucagcagccagcaguucccaugucccagaggccagcgagcccugcccauccucacugccuugcuacucuucccaagacugcacaguggucccccgggccccacucuuccugcacucugcucaucuuugcuugggugacagucuucccugccaacuucucccugccuugaugucuguuugguaccucuugaaaauaccuguccccuaugugaguuuuggugccugagcagggcacuugaggacugaguaggacccaggccuguccuccgucacaguucccucucguguguugugcccuucccacuucaugucugucagguuaccacauggccagucaucuuuccugaccacacugguucccagccagaggcccuuugcucuugguuuggaaucagucaauccacacauuguuugggaucugugcagaugaagcucuggucuugagccuuccaucucugggguuuuuuaaagaggcuagcacuuggcuggccagccccagguggugaggugcgucucugucugcugcagaggucugcuuuguuucuguauguagggcacugguuuuaugugauuacagcaucccugcggucagcucagugugaggccaggggcccaaguggucagucaggguacaggguuagaugucacaccgcugguccuuaguggaacccaucacaaaagauacugaucuugaguuccuucugcugugugcccaugaccacagagguggcagucacagucagguagauggaagggagccuuggcucgugaacgcaugucugcugaagcuuuucccuccagcgcugccccagucccugcaguccucuucaccucuaauggcgccccgcaggggcccaggaagcacacacuuacuaacacauccuaaugaguuuccuuuuaggcauagucucacuauguagcccaggcugaccucaaacuuguccuccugucuuggccuccugaguacuggggauacagccaggugucaccacagugggcuucuuagugaacuugguaaguucauguacgaaugccacucagccaugguuggcuguaguagugugugcccugauccuagcuguuauggcuuaauaguuugaguccaugaguuggaggccacccuggacaaccuauugaaccuuaucucaaagucauaaauaauaaaaucaauaauuuuguuuccaggguugacaauuugcuagugacgagaacucugaagcucagugauuuuguuguuguggacagucccaagugcagagccccagugcugcuguaggccgugugugugugugugugugugugugugugugugugugugugcacgugauccgggguucaucagccuccacgccauacgcugcucugucacacagcacguaaccugucaucggguuucuuaucuugcaggccacaucacacaggacagcaugcggcuuacaguccugaaaaaaaggcacaagugcucccaugaugcuuaaaagcaacuuguaagguaaguguguauguagcuggcgugugugacagggucgcacucuagcucagacugaccauccucugugucacagccuccugagugcugggcuugugggcaccagccaccagagcggcucauuaggaugcagcuguggggugugggacagguaagguguguguggucaagcccagaggcagcugcaggccgaggccucccuuucuaccugucgacuuggcuugccucugcccaggaaggagucugcugauugacuccucagccuuuggccaguagcauaggccacacaagaagagaagaggaaggcuguagauguggcugucaccagggcagauggagagcguguaaugucccgggggucuguguuuacucccagugaggacaaugggcuuuacucugugcagaguacaggcucaggagcagguaaccugcacucacuugauggacguggaagauucugucaccucacagacaccaguugugauggcuguucccaguugucagcuugacuguaucuggaaugaacuacaauccggaacuggagggcacaccugugauccugaucuugaggcgggaaaauaaaggcuuuugaucuugaaacauaguggccaugauaagcuuaggcccaggcaaggugauacacaccuuuaaucccaggagacagaggcaagcagaucucugaguucaaggccagccugggacagagcaagucccaaguaaagaacagguuagguccaggccuggugguacacaccuuuaaucugggccacaccuucugcuggagcccugcauaagaaccguggaggaagcaaggcuucuccuccgccugcuugcacuuacuugccagcacaucuguuggaagcuacuucuucaggaacccggcucauacagaagagcauugagacacccagccucacgggacugagcugcuaaccagauucuuggaguucccguuugcaucugcccguuguuagguuaguugaacugcagacuguaagucauuacaauagcuucucuuacuauauagagaccuuccauguguucugugacucuagagaacccugacuaauacgccaguguucucagggcuccuccagguguggaccagcagacacuagugcuugcugugggacaugccuucugugggucgugcggcucagcaucacauccugggugcuggcaugugcucuuuguguauggagugguuuccgcacucucuccuuuccuguugcacuaaugcagugacucgggguggggcacacuccagacagcuacgguccucugucuucagugacugccuucuuucagauuugggacaagccuggaagcacgugcuugucacccuagcacuugguggguagaggcuggagggucaggaguucaaggacagccugagcuacaugggaucuuguaaaaagaagaggcagugauagcuuugauaccugggucuugggcuguuucccuccucucuggccauggacuuugcagaugcacugcuccaggaugugcguguccaagaguacccgccauggcucugguuagguaugccauucccauaucaguaccccaguauggaggagcagggcauuccaugcucuagcagcccucauggaaccugagccagaaagugcagcagagcuggcaccacucaguaguggcugugacccaucugacuugcauguccugucaccuggagagagcucagacuguuaagguggaguuccaacccaaaaccucucaucccuccgugucagccaggcuguuucucacagugcacaucuuguaaaggaagccaagaaacagagggcucuggccuguagaccccccuggcugggggccuugauguucccugggcccuguuacaauuuuccuaaagaacugggaguuagcuaagugugguggugcaugcuauuaguucuagugcuuuggaggcagaaguaggcagaucuuugugggacugaggccaggaugguccacagaaccagcuccaggucagcaagggcuacacugugcaauuguguuuuagaaagaaaaaaggaggggaaagauacugggaaucauaggagacugccuaaccagggcgcagggguucugucacguccgccuuuaaguggacagcccuugcuguuugcaguuguccugucucagaggggacacaucuccagcauguugauguccggcagggagcaaguaugauaggagguggguggaggcuggcugguggacagacagggcucagauguagcagagccaccagccucuuguuggcccuucagaaccaggcucagccaauggucccugaggcucugagaccccagucaccauguccaggagggaggagcuaugcacacgguguuugcagacaagagaagcaagggccuauguggcuuacaggggccugcgugggaaagcugcacauggaacgugaaagccgggucgagcaaacgucccucuucuccuguccuccauuacacguugcacucaacaucaucaccaaguucuuuugcucugcuucuucucuggcucuggaaacaaugacaugccugccuuucuguccuggucugugcugugucaaagcuccucacccuccaaauggggacucccaugggcaaguauguuccacugcaguuaagaagaaauauuguagcugggcgugguggcgcacgccuuuaaucccagcacucaggaggcagaggcaggcggauuucugaguuugaggccagccuggucuacagagugaguuccagaacagccaggguuacgcagagaaacccugucucgaaaaaccaaaaagaagaaggaggaggaggaggaggaggaggaaggaagaaggaagaagacgaagacaagucuuugucgaggaggaggagaagaagaagaaggagaagaagaagaagagaagaggaggaggaagagaaggagaagaagaagaagaagaagaagaaaggaggaggaggaggaaagaaagaagaaaagaggaaaagaggaggaggaagaggaggaagagaaggagaagaagaaggaaggaagaaggaagaaagaagaaauguuguguccagacuuuaaaagccuguugcuuccuggagccucacccacaccccucccucaccuugcccacugcaacgcugcucuggauggucaguuugcccuggugccugucaguguuuccucuccacauaacaaggccgagacacagcuggacucugccucccucccucccucccugugcuuguccugagaguugccacccuuagcaaacacgcuaagagaaggacaagcccggcaggcccagcgccgcaggcagagcagcuccuacuaaggagccuggcucuugaguuucuccgaccucugucuucuuagcagugaaagaccacaggaaggaugggaaaagccuggaaauaaaaauggauucauaaacagagagacuuuacgaagguuaaaaaugcuaugcuggaacugccauaugaucgcagagucuagaggcaaagagggugcucuccacagaagcaggcacacaccugcauuaaccuggggacaggguggggggaggucauccuggugagccccuaaaagagggaagacaauguucuuugaccaugcuuucuucucuaugccuuggugacaacuguguugaggggguggagagcccugucuagagcacaaacgggucagaucacugggaacagcagugugcuaggauacagcucaugccuuucauuaucucuuugugguaggugacagcuuugcaugcagaggcaaaccccacagcauggggacccacugggucucccacagcaggacagugguguggugaggagagcagagacagagcaaaccccacagcauggggacccacugggucuccuacagcaggacaguggugaggagagcagacagagcaaaccccacagcauggggacccacugggucuccuacagcaggacaguggugaggagagcagagacagagcaaaccccacagcauggggacccacugggucucccacagcaggacagugguguggugaggagagcagagacagagcaaaccccacagcauggggacccacugggucuccuacagcaggacaguggugaggagagcagacagagcaaaccccacagcauggggacccauugggucucccacagcaggacaguggugaggagagcagagacagagcaaaccccacagcauggggacccacugggucucccacagcaggacagugguguggugaggagagcagagacagagcaaaccccacagcauggggacccacugggucucccacagcaggacaguggugaggagagcagacagagcaaaccccacagcauggggacccacugggucuccuacagcaggacaguggugaggagagcagacagagcaaaccccacagcauggggacccacugggucucccacagcaggacagugguguggugaggagagcagagacagagcaaaccccacagcauggggacccacugggucucccacagcaggacagugguguggugaggagagcagagacagagcaaaccccacagcauggggacccacugggucucccacagcaggacaguggugaggagagcagagacagagcaaaccccacagcauggggacccacugggucucccacagcaggacagugguguggagagcagagacagagcccuuggcuaguuuggugcuuagguucuuuucugcucggugucuuugaccugacuuaacacaugcggcuccucauguuaaauuuuguguguguguauguguauacauaugugguuuugcccaggaaccucacuguucucaccaccucugcaggguguuucagggaaucaugcagccgucgggacacaggcuccgggacaucgagcaccauccucuccugacugacaaugacaauuacgacucagcauccucuucguccuccgagacugacauggcagacagggugugguucauccgagauggcuguggcauggucugugcugucaugacguggcuucucgucgucuaugcagacuucguggugaccuuugucaugcugcugccuuccaaagacuucugguacuccguggugaacggaguccucuucaacugcuuggcggugcucgcgcuguccucccaccugagaaccaugcucacugacccgguggguacccagucucuccagcuuagagccuucgcauguccugaugcugugaaggagcagcacacaugaagagugugcugggcucaucucuggagcagguucccauuggguugugaguagaggcagaccuguacuucagcucuucaguuccugagguggugaaggcggauuuagagcuuccagaucagggauagcugcuucucagaaauuugagacacccuuuuuguggcuaccccagauccaggggagauggccagggcuuucuucuggcaagggcaaccaaggccacaugagagcagucccuccaggcagccagugcuggcguaugaggcugugugcugauucuaagaaaguucucagcuucuuuacagcacuaacuaggacccuggcaugaguuccugguccgugcauacugugcugugucugcagguaagggcugcagcgcuaggaagguagaaacugcugcuguaagcuuauguugccuucuaagauggaggcaaggcugcccggccucaggcugccucccugcuguguuagacuccacaguguaaccuuugcuuucucuccugacucaugguagccuuggcuagccuagacaagggaccaaagcugugccccaggcagaccucauccaauguugcacugucugccagugaccuggucgccucugaccauacuaacuccuuccucagacucaggacgcucaggcuucaggggccuuuuguuugacuaaaacagucucaguguguagcccaggcuggccucaaacucagccauccuccuacaucugccuccccagagcugggauuaugggcauauuuuuuagaucuuuuguugugggugggagaguugagacaggguaguccauuguagcccuagcuagccuggaacucacuagauaaaucaggcuggccuccugccucucgaguguuagaauuugagccuuguuuuguuuuucugccuccuuuucacccaaucugaacucaaucugugugcacagggugcuguccccaaaggcaacgccacgaaggaguacauggagagcuugcagcugaagccaggcgaggugaucuacaagugccccaaguguugcugcaucaagccggaacgugcccaccacugcagguauggccucugcccucagcagagcccaggcaguuccuguagucccaugggaguuuuccgauagugcaggagacgagcuggacaacaguuagaggaagcgacaggugucugcuugguuuccuggccuggcacaugcauuuuguagccugagaaucaagccucugugcuugcugccccucgugugugacaggaucugcagacuaaaugcaggcuccuguaggcacacuuucugacugacacuaguuaaugagaaagaggagcaacaguuuagcccacaaacaggugccuuuugaaugucagccucuccuggccuuugcuaccgucuaccauugcccugcugagccaggauggauuucagacaggcugcuguuccuugaggugugggugaccugggauccuuguccauucuggaaaucucuugggcugaguccucgugugugcacaaagauggagugugaccuccccgugagguuaucuuccuccugacggguuggacuuccgggaggagcaaaugaagaugugcagcccauucaaggcuccacagggaggagaaacgacacggugggccuugucaccuguggcugcggagaaagugugggaagaugcuuucuucccagcgaggcccgagguggcauagaguaaagcagcggccuugggcuugggguggcaguggagagugacuggcuguccagaguccuucugaggggucgucucagcucugcaagugcaggagucacugcagugugcauuugaagugucugcuguggcagggagccuacuucucagauccauugcacgugagcuaggaauggcuuggaagcucucggguuggcaggugcacugggggacaugcacagguccacagugguggaguuauggagucuggccgggccaaguccucacuggaugcagucagugauggaaacuguuucagaaugcagcuggcaggaaagcuaggcaagaccagggaagaacagguaggaaaagauacagugcaugcgugcacuccuaacacugaggaggccgaggcaggagaauugucaugaguuugaugccagccuaugcugcauagagacuugucauagguguugugcagagauguucccagccugucccgccuuggaugccauuggugucacugguguccccagaacacaagguucugaagaguguacucuccuuugcaguauuugcaagagaugcauucgaaagauggaccaucacugcccgugggugaacaacugcgucggggagaagaaucagagguucuucgugcuuuucaccgugagugcaugcgcuucuuggagacugcgcugaacuggagguucugagaauugaaccugcuggaguugggggacguauuuaaccacagcuaaugccugugcuggcacaugcagagcacaguccagggcgaccaugccacuuguauuacaucaccuguuggcuguacguuugccugucccucugucaccauugucauacacagggccucccucacacagagcucauuuccccucuacuuauuugccagguggcuguugggcuugcuccacuggggucugaucagcugcugcugcuaccuauaguucacuccuccagccagcucugccuguugggggugggaggugugugugagcuccgccagccucugcuucuaggcugacagcuuguugggaacgacuaacccgucucccuccuucuagauguacauagcucugucuucgguucaugcucugauucucugugggcuucaguucaucuccugcguccgagggcaguggacagguaacuaggacucuaugacaauccugagaguacugcaguguggggaagccaacggagagcuggguuccuggaugggagggagccuuacuccaauaaccugagguuggcuuguuuuguuuuuagguuuguuuguuuguuuguuuuuguuuuuuuuuaaacagggucucacuuuguagucuagguuggcuuugaacucagggaugauucuucucccucaguuucccaaguguuggguuaacacguauauaagccacugugccaguaaagaauuaacauuucuuaagaucagaauguggcagcuucaucccugccagccugcucauuugcugacgccucccucccucaguccauggcuaacuugugauaaaucacuucagcuacuugcagacuuuugacacagaggcaggcaggguugucauuguggccacgcgccuugcguuugcuuucuggcuagcgugguugauccccguucacagcugccuugguguggccugaugggguauccagacagguggagucuauacaggcacuaguuggcagcuacagagaggcaagaggggcugaacuuguuuuguuguuguuguuguuguuuuuuauuacauauuuuccucaauuacauuuucaaugcuaucccaaaagucccccauacccucccccccccacuccccuacccauccauucccacuuuuuggcccuggcguuccccuguacuggggcauauaaaguuugccuguccaaugggcugcucuuuccagugauggccaacuaggccaucuuuugauacauaugcagcuagagucaagagcuccgggguacuaguuaguucauaauguuguugcaccuacaggguugcagaucucuuuagcuccuuggauauuuucucuagcuccuccauugggggcccuaugauccauccaauagcugacugugagcauccacuuauguguuugcuaggucccggccuagucucacaagagacagcuauaucaggguccuuucagcaaaugcuugcuaguguaugcaaugggggcugaacuugugugacagugccucuaguguagaaugucccauguagccacacaguguguagccacaggagugcucuuucaggacauucgcauacaucaggggacccaugcacacagcugcucagauggcugaagcaggaggcucacaaguucaaagcuagccaaacaacuuagugagacccuaucaaagcaaagagagggcugggguauacagcagaagaagguagcugcuugccugccauuguaaagcucuggguauagggguauaguccccagugcgguaagggacuugaggggaggggagauugccagcuggcagggauggggaggcugugugccaggcagggcuguguaccaacuucuucagcaggaggaacucacuccuaggaacugugugcggucccugcagaguagggcgguugcacacugagugccucccucccgucuguccgcagagugcagcgacuucucuccucccauaacuguaauccuguuggucuuccugugccuugagggccuccuguucuucaccuucaccgcagucauguucggcacccagauccacucgauaugcaaugaugaaacagugaguuguccugugucuucagggggcggcaggggcacugucagcggcagcagcccauguggacuugugguaccucagaccuugggcccacaggccuguguaugcugcucucuccauuggggcagcauaguuccugggcccaggauugguuuaaguugguaaaguaggcaggcuccuggucagaacucagugggucucagaaccgugaagguguacccacucuugcaggccuggaguaggcguugccuaacugcagaugaguagggacgcagcgucgguccccguccccccccccaagaggccacugggccacaagagccaugccagguuggcguggaggcugacccaugcggaugguggccccccccucccccugggccacaggcugacuguuugcagcacacauguguagccgugugcagccacagugcagcacgccguguguagccgagugcagccacaggcugacuguggaucucuucucauugcugcucuggcuucuucugcucccaggagaucgagaggcugaagagcgagaagcccacgugggagcgcaggcugcggugggaaggaaugaagucugucuucgggggcccucccucccuccucuggaugaaccccuucguuggcuuccgacucaggcggcugcagaugaggaccaggaaaggaggccccgaguucucugucugagccuucagggugggaaugucugcagacauccgugcucaguggccugcgugcacagcagccuugugggcagauggagcgggccagcugacggggccaugagcggcuucauggaccacaggccacaggcacuugucauuucucuuguguacugccaggagaagcaugcagucccgggaggccaucgucucaccauccugacccuugggaugucgcgugggcacccacggguggaguugcuucucagucaugaagaaagccagcacagcagcgcugggaguccugcuggcccauccccagcgcacccccuuacccgaaagaagggguuccacagagacucugccuuggaggccucugacacccagcacugaacagugaaagcagcuuccagaacacucccugcugccccggaacgggcauccuuugacccuuccagcaagucugugugugcucauccuugugugucuguguggugugugugugugugugugugugagcaugugucagagucagcagugucguugaggcacguaugugguagacaagcugucuuucagacuccaguguuucagggaagugggacgcacugcuggcccuugcuggccuacuaugaauguauccuacaguguccagauccaaagaacaggcaugccugugcaugggcccggccuccugcuuuuauuucacugaaaauuuaguguuugagggcguggagcugagguuuuguuguuccagccaaacugcaacugcaacagucucucaacagggagagugguagcccaugcugaggcccagcgcuuuggggcaggggccaugaggagcucagcgugagaagccaccuagggccccuuggggcaggugcugcagggugagacagccuggugccugagcugucagaguggugauaugugacuauuucucuacccauggcaccgcagucaguggagccuuggugcgggcuuagaaucccgucaguacacaaacagcuccccucaggggauuugccuuaaccgcugguuguugcuuugcugcugggugagagcagucugacagagucuggggacuuccugagagucuucucccaugcagacaccaguguuucccuucugggaccagcugccuuucugucccugggacaccaugacuguucuuucggugucaguugcuugugcccugcccucaucugggcuccugugcuacugaggugacccccagggaccugagccgagcccucaugcagcgagcaaucucuggggcccaagucccugcagagggacaucgaggccucagauugucucugcguuccuuugcacacgugucugggcauguaggcucuggcggucucacccuccaguguggagucugugcggugaacccaagcugaguauacuugacuuuucaauuccucagugugauuuuauaugaaauaaaguaacccguccacaguucucacccuccugcagcccucuucuuccugggugaccugccuugcuuuuccaggagcuguugugugccugugaggggaccuaggcaucuggguacaacuccuagugucaccuggguagaugaugcccuaagaccccuuaacuuucccuuaauuaacuagggaauuuuuaaaaugugcuuuaaaauaaaacuggcucuaagcacacgag

SEQ ID NO: 4833 - RNA, 2679 nt, Mus musculus
gauagugggugccuaaaaauuggugaaugaauucuugugcgaggcagagagauugaaaaugaauuuugauuggaagaagcagaagccaggaggagcuuaccaaaugaguaccuuguggggagagguggaaggacugagccuggaccagaaugggggagaggaaaacagcgcugagagauuuggggaacugagcugugguuuugaacaauaacucuagauacuggaaucuugcucugggcuccuuguuaccccuggggaaagaauucagaugaaacacagcauagugugggacacucucgagggugagaguggacaguggcccaggggaccaucauggagggaaaugcagggugacagugacuggagagcccgucuugcuggcccacagguuuaggcaagcuucacgcuaugcugcuggagugucuguggcagacagcuuuccugagagauaccuuccugugcaggugauugacaggcccgcaggauuaaucccgaaggauuguacugcaugcuaguggggugggcugcuuagguaaauagaggcacugagucuauaggaggcugguuggaggcaagcugagugcacagucccaggaucuguaugggcagggcagggcagggcagggcagacagagauauggucggauuuaagaugguccuggaggucaagacucagaacuuaaucacaacuuagaugugggggcuggaggaagaggcccgagaagcugacccuggugacgagguggugguguggugcuuauuaaaauggagagggugagauuuaacagugagguucugcuccuaccuuccagccguggaguuugcuaguagccaguuaaccagacagugaugucaccaguguggguauuuacuagguugaguucuccaucccaacauccccaagaagacacuugagagaacacagagggagagaagucaggccccauccugggugcuccuggacuggagcccugugggcaaguguggcuguugaagggaaagcccaguggaaugcuccacccccauggugacucuccucccagugaugugccccaccccugaggugacuccucuccuagccuccugcuucugugccuguguucuccaccuucgaccuuuguggccuggugcuccaacugcuguucucuugugacuacguauuuaaaagacacuucuagaaagguuaauagggcugcuuacugccugcagugugcagccuugcagauguguugacacuuggcuguagguggcuguaucuauguuuucuucaagguuaauaguuuuuagucuuaguaauuagaggaggaaauaauagguuugugugcagaggggaucagcacggugugggaggccagccccacaccaggggcugugggcacacgagagggaagcacuuuccacaagcacuguucuaggucacacauugagaugugucucccuuugaaguuguccccacccugacucaggugcccuucuugccugguuggugaccugcccaggaagcuuguuagaggcauaggucuacuugaccacagggaggagucugcugcccugaugaugccccucugaaugcccaggauccccaccuugucuuaaggagaggacuccuuaaguuguucccucacucuggaucagcugcugggucuccuugggaccugggcaguccaaguucucagugacccggguuuuaagcguuugccucucccaccuggacucuguuuugcaacucuaggcuaagucuuuucuuuaauacccacucuucugucaccagcucuuugcuagccugccaccuccuuccugagcccuggcagguccuuuggauggagaggccagcccuuuacagugagugcuuucugagcacgguagguucucuacauuccgcucuuccucguccuggacuccacagcugucccuauccucccugucccugucuucccagugccucuucaagagugagcugcuuuagccccuccucacccuacaucucucagacccuucuuccaguacccaaaggcuguuguauugggacuugcuuauuugagaaagggucucuuugcagccaguacuaugagaccugaaacuuacaauguagacuagauugguuuugaacuuggagagauccuguuucuguuucuggguucuggaauuaaggcaugcacugccaccuccaacguacauuuuggcaaguucccagcauccuguggcuauaugccaccaucugggucugagggaggacugugacacuacccacccuccaggcugugcagccacugaccuguugaguuagcugggcuuucugcuuggcucgggcugugacagcaguccaguguggagccuuuucucccucucugcacacuuagcacuguuucuaagcugcggcauggggacagacagucucucacucacuuuuuggaggaugcgugguuacuucugccccugagcauugaggaccgcacugugcaggcuccgugcagggaucugugaggcugcugccuuagaucacuggaagcugugaaugugagguuuccucagggugaggcaagccuuccacccuccuacaguugccuuuuuccuuguccucucucucccuguggcuucauucccugagccugcacacgcgggcucccuuccuuuagaaguagcacuguugugauccuguacugcuuugauggccagaag

SEQ ID NO: 4834 - RNA, 2543 nt, Mus musculus
acagaagcaaagcuagugacuuuauuaaguauggagacagucacagaggagaaggauaauacagucucaugaugggugugugggcuuuuuccaggaagucguacuuagcugucuucacaauggccgcacauagcaaccuacagccuguuaagucacauucuucaaaagaugcaguuuauaagcuuucaagaguaaucaaagcuuaacauuuuguaaaggaggauggccuugaacuucugaucuucccaccuucacuuuccaagcguugaaacuacaagcaugaguuaucaugaccacuaccaagguuauucaguacaggggauggaaccccaggcuucaugguaagucugaggcuaacccgggcuauaugagauccugccucaaaauaacuaauuacauaaguuaauguuaaguaaaauacaugagcugguaacuuaaaaaaauuuuuuuaauuuuauguauaugaguguuuugcacacauguauguauguauguauguaugaaugugcagcaugcgccuccaaggucagaggagggcaucauguccccuggaacuguagcucagauaguugugagcuauugugugaguauugggaaccauacauggguccucugcaaaagcagcaagugcuauuaauuacagagccaccucuccagccaucuccaagucaagcuuauauuuuauucuuguguguguguguaugugugugugugugcauuuguaugucugccuggguacuccaaggccagagguccucaagggaugggggauuuuucaagacagggucucuugcugaguaaggugcuuuuauuauuuagcuaagcuagauccgcacaaacaaucugaccgugagugugcacaauuuauuuccuguuuuuaacauccuguuuguguugucuugaggaaaacacacugucucuggaggcaauacugccuuuaucaaucuugcugguuucuuaacucucagcgagcaagaaaggucagggugagggcuuuuuucuguucccaggguccuugaagucccugucuuucuauucugccucaauuccauucagguccgccucagugaacugcuaagcucaucgggguuaccuacaagugcauggcuauuuagagguguauggguaacugaggcauugccaacacugagaaguccacccuagcaugggaaaacaugcucaugacacagccugcaaggcuccagaaagucuccucuaaccagcaacaguguacuccuuacaugauccacaagaccucccgggucuuauggguguccugagccccgcuuuccauccugaggaaauagcuaccuagggcaggccaaacaagaggcaccugaaagguugguaccauagugaguauauggaugcacaagacguaaccacaaaaggggcuacagagccugcgagucugcuuagaggugguccuuccagaaaaccuagguuugguuucuuagcacccauaagccaacucaaaacugcuuacgccaguuccaggguaucuaaaugcccuccucgagcaugcacgugguacacagauauauauaugcgggcagaacacccacagacauaagaauuaaagaaagaauuaaauaagauuaaaaagauguaaccauaauuuuucaaacccaaaagaugcuuuuuuuuuuuucaagauggcauuacuauauagucuagaguggucucgaacuccgaauccuccugccucagccuccugagugcugggacuuaggcgugcacuuccaugccuaaacuuaaaagcuguaauuuuggagcaguuaaucuaaugcacccuuauuuccaaaaaucuggcucgaauagcaguuucugggcgcggggacaggaaacccagcgaagauggcgugcguaccccaaugggcuagaucccggagcugucauuauagcccuuuuuaguaucacagcacaccuugcguuugccaguuuaacuaccaaacacuucucugcccuggacaaauugugcuaagucugucaggggacucaagaggcaggggacgggugaagguuauaaaaacacucguuucuaccuccgcaaaacucuggccggucaucaggaaggggucgcagcgacgcuccagcgaccugggcauggaggugugcaagccuggacccaggagucccaucuccgguccagggcgcugccucgggcucccaaacgcccucuggcucaguugcuuccacccccgcgccucuauccuucaucuccguaguucucccuccuccaccuggcaccgacauccuuaaaaagagaaucggagucgccacaaacuucaucuauguauggugcggcgggaagccuuaucgagugcucucgaacggcaacgcggcguggcccucgcggcgccccguaggcacugauuucucuuccgggccacccuucccgggggaucuccguuuaguagucuugccguagaugcugcugccucuccuccaagaaccgccgaguucuuggaagcccggucuuggaugaaaucgccagagccuccccgcgauccgccucccggaagccccgggcggcgcgaccg

SEQ ID NO: 4835 - RNA, 93016 nt, Mus musculus
acgccgggccgccguggaggcuccagcccuuccuuggucaauuaccucacuguggaucugcuccggccgagguggccgaaccugcccgggcgcuggacggaaaggcagccuuugaucaucucggagaaggaaaaggaaaaaacacaaacugguuucuacccacggugcuccggggaucgcucuucugcuuuuauuuuauuguuuuggacauuuuugagcgccguggcuuggacgcugguuuuguuucauugcugggcuugauuuuuuuuuuuuuuuccccucauuuccuucuucgucccucucuggccacuauggaauucuaaccugagccauguucggacugaagccgccucucuauuacuuaccagguaagcgagucgugcgccagguccucgggucccaagaccagggcgcguaggggcgcacaggggcgcgcugcucggcugcccgcucagugcgcgcugccgcguggggcgcccggcccggugcgcgucucgcuccuuuugucugcgcggagccggcggcgcugcgccccgggcgggaucgcgcgggugugaaguuacuuucccgcgggcggcgaccugggggccccggccccgccgcccccucccgauucccuggaagguuuuguugugcgaggccgggaggggccguggccgcagugcgcgcggcuuccuguuuccugcgccucggugcgcgcugacagccgcugccaugcaacuuucaguuucgggggccaccgcgggagagauggggagccccgccacccuuaagaugcuugcgcgcgggcgcgagggaagcuagagagcccggagcgagcaggcaggcgugggaacccggcccuccugguggcuucccccucggguacccccucggguccgacugcacgugaccgcaggucgagagggcugagcugcguguggccgcuucuucuaagaaugcuggguuuuuuuaaucuucuuuuuuuuuucucuaagcccuggcacacaguuucuauugaaguugaggcgucuguggggugcagaaauguuggggugcugaaggagcagaggggcggccuucgugcaugacauggucugcucuuuucugcagaugauuugggaauaguuuugcuaggaaacguaggaaacgugcacguggcuggguguuggguuaacauugccuccccccguccccacuuguguguuguguggauccuguggcucuugccagaucuccaccaaccuggaguccagagaaggagaugugggccaagaaccugccugggcaggacucagcuacagggagcuggcccuagucguccugaccuagggcacacguuguaacugaguuaauguagcagagaugaaaggucgcaaggaaaagcggguggaggaggcaguuccgacugcaggacggcuguagguggcucugggcguuccuuugcggaugcuucuauguccagcccuaccugguggcaagccuguucuguuccugggguguccaguccuugcuguuguuuauauugagacagggucucacgauuuagcucuggcuggccuggaacacguagauuccccugccucagccucaccuccaccaaagugccggaugaaaggugugugugccacagggucuggccccaggcuguuuuuauuggaagauuuucuccacgcaccucccucucuuccagggccugaaauagcaauugucaaaccucuagcugggcucuccccuuccuccguguucaguucauuucgguacuuccuuccauuuggucuagcuaaaauuagagcccggaauccccagcuuccagcaggguuaucucugcaggagggcaggugcccucugcagcucugccggcuccccaugggaaggugugugugguagccucuucacagaagugugcagacugauucugccagugcuuccuguuagccuugacaaggagagcaaagauagguacuuucuuuuuguauucccaagcgccucucuggggccuuggagcuagcuggugguaugagaggaaccucuguaguuaaguacugggcggcucacaagcacagguguuugaaaucugcaccccacgccaccugacauccaagggccggcugguauauuagcuugucaggugacccauucuuuauuuacacagggagccucagaccgagaaggaggaagugucagacuggggaguucaaagcaauuaaaagaaucagccuuggcugggauuaggcccuaggcaggcaggcgggugucagcaaggugaauccugcuuguccugauccuucagggagggaaggacuuggcucuccuccccagggaggagggcucagauaaauuagccacagguugaaggguuuucuccuacugaaguuuauuuuuugacggucccugccaagguuuuccauccugugaguuuaggguagaauuggagcucaggugcaccuugagcuguagguagguaguuuggggacucucccauacaccccaugggguggguacugauaucucacccugcuggccaaucugcccaagaggcccagucguugcccauucuggaagugucagggcugggcucugcugucagccacuucaagaggggauuuccaggccugagaacagugggugucugguuggcuguggucaguagcuuuaguugagagucaagugucuugacccuuagagggaccuggacucugaguuguagguuugucccaagacucuggauucuguccucaagaucuggucccaucaagguggcuguaaccaaccaccaggggacaggguccagaaucuauccaccagcuacugugggggagagggaggguggccacguucagguuggcccuauuuucggucuucucuugccacacuggacaaugggucugaaguccaacccaguguguucccagccucaaccucggcagguaaggaaaguucccagaaguccuucgguuuuccugucucuugacuuggauccacugugcuguccuccuaagauucaaagucuccugguauuaagucucuguuggcaugaggugcaccugugcucgcauggagucccugaagguucucugaccacauagguugagcagugcucauguagcccagacuaaacugaccaggccgaccagaugcugcucuacuauugggggggggggggaaugaacugugauuuguuuugauuuuugagagucucauguagucuggauuagccuggaacuugcugugugacccagguuggccucaaauucccuaugcaccuuccuccaccccaccccaccccaccccaccgcuagguguuaugguauagagucaaucuccacacagggguagccaucaagcuugugaagguuuuaaucaggugugguuacaaggaugaaaucuuuugcagaaauucacagaacuuaguggucuaggcgggacuugaacuugggccagucuggcugacuuuauaguaagaagugacuugcugacuagagggucaaucagcuccucgugcaaagagaagaagaugcaggaucuggggcugugccccccccccaucuuccugacggugacagaugguagucuuucucugggguccccuaucuggcuuuccucugugugcacagcuuacuggauaccccugucccugaacgccacaggacuuugugaucccugcaggcggagacugacugucuccuuuuugcuuggccugcugccagaccaauaacgacagucguaaaaauaaaaaggauaauaaaauaaggaggaggaggcuguggccacuucacauaaggcuuguuccaugccagacuugcuaauucgccggacgaugcugggaggucaggcgagggcugucccacuugacugcagaggaaacugaggcacaagggaggccgaggucacuggaguggcaaaaggcacagcaagagccucagcugggcccuaaccccugaccccggggcagucuggcuccagagucucugcuuaauaaauauuuguugaccggucagggagagauggcggcugguauuggcaguggugcccuccuggggccccuuaucuuguuccugacuguuggcugacccugcccuggccccaagaugaacucuugaugaccucaccucccucuggauucccaguccguagccaggaaggaugcucugagaccugccaugaagggacuggggucugagagcaccauggcuaguggcgguacuuagcuuuauaucuguugggacaucuucugugcccaaaccugccccuugaggucauagugagucauucagagauagaggaccaggcugacccgacgccuuuaugccuuucugagcagcuuacccugugcuagcuuagucuaugcauagagucaggauaguggaaggauaaagguccccagagauugcucuccagaguguuccaaccuguguacaaggcuagguguggacugugcccagcauggguuggggguguguguguacaagccagccagccagccagggcagccucccuugccaguuuacaccuacaccugggacuugugggauccuaaagaaacccuagagaccugcucuugggucaggcugagccugggaaggagguuuggccauuuucgaagugacaagaguccuuacuuacagcucagacacaguggugggcuacauggggcucacaacuagcaccuucagggcggucacuaauuucagacaccccugagaacuggggaaggacugcuacguuuggaucugggaaagccaggggcccuuuugucucagugaggucagggccuggucuggcucucaccucugcucagugagacggucauuaggauuccacccuggcuuccgugcaucugcaaugccaugggugggaaucgauugucccuuguuccaacuccuuaucuucgugacucuuccugcucugggagcaaauggucuggaggacacuugcaucugccuggagggggaggagaauggaggcuguauuuccucccuagaguaaggugggcagugggagggccuagccagacagacugucccuggcagagccagccuggggccagagggucucugccucuguagcauuuacucccaagaccuguguucucugucugccuuccccauggggugaagugccaggguccagugagcucuauuuauauguuuaccucggcauuuugcagccaaggacaccugccaggaaggcucucaggccagcgccuuccacuuuccuggggacugacucugggggaggucggugcugccccagucgacucguuaggaagggccgugcaggguguccuuuuuugccacacugggguuugaacccagagccuugaacuugccaggcaagugcucuaccaagucacacgccacccaccucccaguccuucuuucauucuuuagcuuugagacaaaaaggcuugcuaaguagcugugggugggcuugaacuuacucugcaccucaggauggccugagcuuuguaauuuacagucagcugcuccaggccucguagccguguguguguguguguguguguguguguguguguguguguguguguguaucuagagaugguucacagggccucaaacaugcuagacaaacacuacacuccagacccugaaguggcugaccuuucuucagagaaauggaugguagaacuuagcuuuuuaggggcgauccccagaggacgggcgacuaagugcuugggaacuuuucccuuauugguggucuaugcacugaaguggacucgccaggggccaggccgcaggcgggaagaggggagucgagugugagggaauaauuuagauaucguggucuuucuucuuuuuuuuaagagccccauauagauuuaagguccuuuuguuaauuuaggaacauaaaaccgugaugugcagcuugguuugcucguaaaauuacaaaguguggcauauuuagauccccgaaggcaugggguaaaagggaaggaaugggugagaauuuuuuuuaauaugucuuuggggagauucauuuuucuggccuuccccccucaacagugccaggcccucuacagcuccacagggccccaucgaugccuuccgaguugggugggacucagcuggaaauggggguguuuggcaagcagccaggcccagauccugcccccaguccccaggccugcugccccuggauucccuugucucguuggaucaugcucgcucugccuuccucccgucccccgcccgcagcgaggccggaagugcccucugaccaguccuggcccacugcccagccagccuuuggcuaccggcuuaauggucuguacggucaggaagucaccggacccuuggucguggaggaggacaggcugccgagcccuccucgucuauggggaccaguguugccuggcucuccucccugacaggcagugugggcuggguccaugggcuccuggcccgggucagccucugcugggccacucugaguggcccacuguugcuucucaccaggagcaugugugccuggccuaguuccacgcucugugagguggaacauggauugaauaucagggugacaagcgucuggggcuuuccuguucuguagacaaggggaagguucaguuugagucagggagcagaggcugugucuaggaggagacccccagucccuuccccuuggugguauuuuuauagcaaggcucccgagccugugaaccguccaaaaaacaaaacaaaacaaaaaacucagcagggcucuuguagaagucaaggguuccaaugggggcaggguuggggggggggguggaguuuuuuuguagcagccugaugauaugcggccugugucucauucuguggcuugggagcagcuggggaaccggaccuuguccuuauggcccaggcugggcucuacagaaggaggcagggcagguacugggccagacuuuugaggcuaugacaucugugggagugguaagggacuuugaggccaguagggcguugggacuacucuugggaaugucaucacaccucugaugucagugagcuggguucugugagcugagggggacccagaguugugggguuuguuuuucuuuguguuuguggacgugugcaugcuacugcacacacguggaggucagaggaccacuugugggugucggcucucaccuuccaccaugugggauugaacccaggcugucaggcuuggcagcaggcaccuuagccacugagccaguuugccagccucaccuaaaauuuuuuguuuuuguuguuguuuaguguguuuguuuguuuguuuguuuuuugguuuuucgagacaggguuucucuuuauagcccuggcuguccuggaacucacuuaguagaccaggcuuggccucgaacucagaaaucugccugccucugccucccgaaugcugggauuaaaggcgugugccaccacgcccggcuuguuguuuaguuuuuguuuaccuauauuuauuugcuuuugguuucucgagacaggguuucucugugccccugauuguccuagaacucgcucuguagaccaggcuggccuugaacucaagagaucugccugccucugccucugccucugccuccugagggcuaagauuaaaggcgugggccaucauuuccuaguugacccgaaauuuuggagcugucaacuagcccaggugcauggaaguacagaggagaaaucccagaggauugccuuguccagaggcaccuguaguuucgagagaucuauggggguguagagagccaggauucggcacuggguggcuagagccccccucacucccccaaaaaagagaagauguuagcguagugggaucggaagguccugaggcaccagggaugguauggcugucggggaguggggggaaauagguaugcagccggacagcuggagaguagcgcaugcguacuggggccgauaaguauggcgcaggacaggugaagagcagcgcaugcguacugaggccaucccuaccguagauccucuggcugcugggugacccauguagaggagaccaccauggcucuggguggcugcucuguggagcggagccaugccaguuggagaccguccguggggcuaugagguccacucauggcugucuugccuggugaccuuguuucugcaccuuugggaacuggagggugguagagugguaguaggggguuagagggugucugagggucugcagcuuguucgaggucaguccgcugcagcgcugccuaagcacagagccuagugggagucagggcugaguaccugcuaccuucuuggauguguuacucugggcagguuacuuaaccucucuguuuccuuguguguuucccauguguacucggggccagccgugccaccauguaagguuguuuguccugagcauuggugagugcacaugcaggaaccaaggaugaaaugcucuggaauggaaggaagucugcauucuccuuggaguauguaugaguucucaacuguggcuucaggccggugucagagcagaggcccgccccagguuggugcuggaaggaaggcauuacuuauggacuccugcaggaugccaaggagcccaggcucucaaaauggucaccagugacaaguccuagauacgauaauaguucacucuggagacccauacuggccuguggcccacaccagcagaucucaagucuucugggauagaaaguuuuucuggcuggaucguccccagggagaagguuauaggguacuagauucuucuaaaagcuuuugccucuugcccccccugaaggcuccagccucacccagcagcaauggagccccaggcagacggcaccucaucuccgaccaggccuccuuugaacuggcccccaacgccgcccacccccuugucacucuggcuuguaauucauucaggauuagcucccaggccucucgugggccuaacuucuguugucuuggaaaccgugucaaccguuugcugguuucugugauuaucugacaagagaagggggggugcagcagggacaugaaagagcguaaggggagacagcaugggucuuaauggagcucucugcggaggccugggaggcacggaggggaugaggugcccucaggccuacagcugugugccaggggcucccggugggggcucucaccacuuccugccacucuggggagcugagagaaucacccccucaccucaccucaccuuuauuuccucuaucucagauccucugaggcccagagacaaggugcuauucucuucucccaccucucugcugggaaaguucccuugugggcuucuccagacacagcaacacugggaggcugggggaggcggguaccaccacuugagaggaagcugaguguguagaccauaagcccaccccaggaugcugggaacuggacgccagauggggucaggauggcaccagugugccauugugggcuggccuagggccuucugugccugacauugcagccacaacuaaaagaugagaggggcacuugucuugugaagggcccucuucucccccucccccguccccccauuggcucuggcuacaggcgacgacagucucaguggucccagaugaagcacccucuuccaugggguucucaguguggucugggauuccucacagccucugaugucauggcaggggcugugguggcuuaugcagagaagaggccccaugacccccugccucccagggccuggccucagauaucagggccucuuccacgccacacucaguccguuagcagagagggaggagccccaccaggcugggcucagcuggaaggaauccaucccuugauagggugggaaccacgcugaagagaagauaggauggagauguggaagcugccaguugggaggauagucagccugucucuugcaagcucuucggaaagccagguaggaggccugaccucugggacugggacuagacucuguccucuagggagccugccuuugggguuuccagacagucuagguugugggccuagagcagucuuggaucucaguguggaagcuggaaaguccugccuugaggguuuacagugggccuguguagcugccccuugaagguggugugagggucugcacacaagagcccagcucuggucacaggaagagcagccccucccuggagugaggggccgguuagaugccuuuggggggagccgcuaaugagccacaucugauuuuuuaugaaccucccugguaaauuauuaauuugggccagaaaugaaaguguggaaucggauaagcucaugaauauucauggccgaaucgagcacggguugaucaguggcuggagcggccagccaggcuccugacccagauacagggcagagcucugggagccuccccucccccugcucggguuguagguggggcuggugacucacaacucacacacaguagugucucacgcuggaaugacaggagcagaagucugaggccccugccgcuagucagagccaugccuccccauuucuagaugaggguccccucagaggaagaccuuugggucugggaaacugauguuagggccacugggcccuccuaccuaaguguauucugcuaggcuacuguaguagccaguuggcaucucaggcugcuccaaccagaccgcuuccucuuaccuugccuggcaacucugcccaaaggccaggucuagggagggcugcuuggcucugaccugcuaccugguuacaccucugugcagacuguuuuccucaccaggccucaaggcucagcccuguuagaugcugcuucuccccaggcccaggucugugaaagugggacucuuggaggacuccaugaauucagaaaccagaucugguuuuuuguuguuguucuuuugugguuuuuguuuuguuguuguuguuguuguuguuguuguuuguuauuuuuguuugucugguuugguuuuuuuucaagacaggguuucucuguguagcccuggcuguccuggaacucacucuguagaccaggcuggccucaaacucagaaauccaccugccucugccucgcaagugcugggauuaaaggcgugcgccaccacacccagcagaaaccagaucuauuuugucgaauucuuuuugacacuuauuuugugcugggggugggaugggguggguuuccagccaccaggcaccugugaaggucaaaggacaacuugcaggaguguguccucaccuuucacaguaugggucucuggggucucugggucccugcauugaaacuuggaccgucaggcucgacaugaaccuuucucugcggaaccaucugcuccccuggcccaagaguucggcuuuuguuuuuguauuuguuuauuagacaggguguuauuuuugcaaccuaggcugcccucaaauuuuccauccuccugccucagccuccugacuacugagaucacaggccugcauccccaacuccuggguagcagacuaggaucuggaucugcagauccccuguuggaagggcuugggcaaguuguuugcuaaacuucuuguuugcuaaacugcugucuccuacuuaggauguggaaagcugguuuguuuguuuaaagcccugaaggagaccucguguaguggcacaggacugugaucucaggaugugggaagcugaggcaggaauuauuucugugauggcuguccggcugagcuggggaguacucacagccucacaggcuggcgccuguuauccagccuguuguggccccgggcaccucagggccaccuuagacuguguggcuuucuauuccucucgguacaggcuuugccccucccuaggccugggcaggcucccuguggguagaaccaaggaguuucccccuaaaccucagguggggagggagccugcagaagagagggaggugucuggugguccacugugagcuguggccuggaguucacaggccaagcuggccucugaccuagaaaaccuguccggagaggcagcucccaggccagaugggguuaaaggucaguucuggggccucuucagggccagggagcucugaaggucuuggucauuggucagugugacuggcaaggacuguggccuugggaauauccuccgggcccagaguauggggagaacugccuccagaaccucaccuuuggccuucccuuggccuugccgaugacuguggccggcauccaccugcccugcagggucaagggcaacagaagggauuuuauuggaagcacagaaaccagcaaguccacucguuggcuuuuuauccagagucagaagccuuugacucaaggcucugucaccuccaggaugccagggugcagagggggcagccagccagcagguuggaccggugcggugagccgagugggcaggaugcuaagcaaacagccaccaggcagcagugucccuggccuggcuggaaagagacauuugugcuuggcagcugccagccaguucucgacaccuggcugugccaggcccaggcagggggaaggagugaaaguuagucauaggucuugccuccuaggcugcaaguucccugggcuggauccugggauguuccugacuccagccuagagcaaaccgggaggccuuccugcaggaggugguaccccaugcagcuaaugaguguggacuggguguuuaaaggggucacauggggacagagagugguuugccucucaggugucacagcugggcugggugcuuagaaggacccuguaucuugcuaaaaaaaaggcuccagggagcugugccuuauguaguaaggacuuacuccugagcccccaccgguaggcacccuucccaggccucgcccuaggagcagagcuagaucugcguuguuaccugagacccagcaccuggcuucauguccgaagcuuuggaagcuugucaugugccacaugugcaugucaugugcuugucaugugcuucuuguuucugaguuggaugguggcugccaagcuggccagcgcaguuagagaucaagaccccagucacuaggaaguauacagaaggcagugcuggucucagcccuggggcaggugcagacacuggagcuaaggguuccuagagcuauuggaaccuuaaggagacucugcugagccugagcgccuggguguguguguguguguguguguguguguguguguguguguguguaaggguuccuagagcuauugggaccuuaaggagacugugcugagccugagcgccugguguguguguguguguguauguguguguguguguguguguguguguguguguguguguguguguauaaggguuccuagagcuauugggaccuuaaggagacucugcugagccugagcgccugguguguguguguguguguguguguguguguguguguguuccuagagcuauugggaccuuaaggagacucugcugaaccugagcgccuggugugcgugugcgugugcguguguguguguguguguguguaaguaaggguuccuagagcuauugggaccuuaaggagacucugcugagccugagcaccugguggguguguguguguguguguguguguguguguguguguguguguaaguaaggguuccuagagcuauugggaccuuaaggagacucugcugagccugaggcugguguguauguguguguguguguguguguguguguguguguguacacauaccaggaaccugacaguaaacacuggagggauuugcagggacagaucagagguuacagagccuggcagguccucccugcaggggcaggucacugucaguggaacauguugagagccuggggacaccguggagguacccguccacaaaaugaggaaauaagguugggugugggcaggaacccccaagggagauaguuucuuuaaggaagggguaggcccacuguugugagugggucggcuuugccucuuccagguggccccucccccuccucuccagaguagguuugaggcaacagagcuggaaagagacccccagcagggguuccccagugcaguagccccuccgcaaugccauaggauaggugcuaauaaggucccaaagggggacccacgggucaguggaacauucugggugggaaaaaaaauacaggaugaagaccuaaggcaucccaggagaggagggugggauaacagccuagaaguggggagguggggguagggguguuaccugugugggcuggggguguggggaagauguuuauacuuaugggggacuuggauuguagauggcgacuggagggguggcuucuguggauucauucaucuaaccuuagccucacacugaagaagaaagugugcagagacugagcuguccgggacagguuguacaaccagucagucagugguagggcaggguuuaaauugugcuggucagauugcagaugccuuuucuagccucucagcuuucuuacccccacuacugcaggguccugaccccaaaugcaugggcucuccgaaucccuuuuuucacgcauggcccagagcuccaucuccguggugggacacaaguccaccgagauacugacuccucucuuggcucccaugagcccacguauggcaggcaggccuuguguggacaggguucauuucuucgaguugugggccuuagaggcugguucucagggucauuaaaagaugccauguucugucugagccucguuguccccguagcacaguggagccucauaccagcugggcgugaugauggcuuaacucaggcacucagagauaggugaaucucugaguucaaggccagcauggucuacagagugaguuccagaacagccaaggguacacagagaaacccugucuggaaaaacaauacaaacuuugugaauucugggguguucgauggcuguguucagcacaggcccaagaccagagcagguggcccagagguagcagcuucugucccccaggagacaagguuucacuguguagcccuggcuguccuggaccuuguauguagaucaggcuggccucaaacucacagagauccagcugccucugcuccugaguaccaggaauaaagacaccuggcagguugugcacuuuuuuuuuuuuuuaagauuuuauuuuauuauuauaucuaaguacacacuguuacacuguagcugucuucagacacaccagaagagggcaucagaucacauuacagaugguugugggccaccauaugguuucuggggauugaacucaugaccuuuggaagagcagucagugcucuuaaucacugagccaucucuccagccccagguugugcacuucuuguccguaagggucuguguguuucugggauggaaauuugggagaaauuauuccugucagaauuccacccauagaaaagagaccacaguagggacaguggguguuagagccacuguguucucaucucacaguagggcaggcccagcaccaagcagaaacaggaccuccauggucucagccucccuugagcauagucuggaagagaccaucccaccuugguagcacgggaaggcccugccucccucugcccgcugugacaggcaggccccaagcugaguuguucuuggaggauguccagcuggucagagagcuggccuggcugcacuccuuugagagaggaagcuaucaagggccggccaugggaguuguaaggauaaauggcucucccuagcaggcagccagaacgccucucuccuggcuaaggaagaaccaggccugugaagggcccagugcccacuauucagcuauagcccagagauggaaaaccacuugcccggggggucacacagcacuuggaggccggaguacaaccaggaaugcuccuggcagcagcugugcauguuagcagcucagacauccuuacugccccugucacaacccugcugugcuuauccuggaagccacagccacccaacccaugagcugucucuugucucuccucgacuggacaaggcccaggggucaagucgcaggcguggcuguggccuagagaggaggcccaaguuacacaccccucuccggacuacugcgcugaugcuaaagggugccuuugaacagugcauacccaggcagcugcccucuuauggcuuggcuuggauuggaaggguucgcuccacccccaaccccuaaccccaccccccaccccaccucagaccccuuggugagccccgccccccaacaccaccguagagcucccagggguggcucagcugccgccagggugagcgggagcguccugaguuguggucccccacccccgcaguuccuugugucugcucuugcucugcccaccccagugcuccugcgggugcaguaagcuuggccugagcccccagcaggccgcgguccccuuacccugccagccaguugcuggucuuaaagguuaauccccacucuguagcuggaucccagccccucccgccgcagcccuuuccgccccaguuaauuaaauccgcucggcuauugucagaagagaaacucggguguuuauugcgccuccagaaugucaaaggcucgcacgguuugaagacaugcuggcagggaauagcccgagcauaugucuacgaggccgggggcagccaggccacugccaccuccgcgaccugcggcugcugcugcuccggcugccgcuaacugccucccagacaggcacuugacagggccucauguaccaggagagcccuggcugagcccccggggagaucagcucagcucauaaauauccuggucccugagacugcuucaccaagaggaauuuaaaacgcagaggaaggaaauaaacacagacccuccuccugcaccacaggguggggagccccuuagaagacccugagggggcggcuuccccaucucucucuuucuccccucccccguauccuuguguguguucacguuuuauuauuauugggcagaagcacauggcuaauugugauuuucccccccucguggaguggggcgugagauggaugcguucauuuuauagggauuuuuuuguuguucuccccccuaauaauaacgcuuuaaagauguuugacauguguaacuaacagcugguuucccguuguggaaacuggccuuuuauuucgaagcagguugaacugucauuagugguauaauuaggugacugucagcguagagcagaaagcugcuuaauuguagagacggcguugcgagggcucccgucuuuucauggcuauauuuguuuuagcuguuugaauuuucauuguauuuuggcauuugguauguugccuccguuuuguugggguuuucuucucuuccuguuuuuagugcgucugacagcuguguucaugagcgccugguccugaggacagccggauccacgcaggcggcaguaccagagccaggacgcugguccuguacucccgggcccagguuggagccaggaacaaggccaagugaaggccggccacuggcacagaccugaccuccccaaaaggccaccugaggauuuuaucccucggcacaggguguuggaaggcagcauuacagugugaguugcuaauauguagugaggcuggggguugcuggguggccccccagcuccugcugugcccgccauugugcagggucuuugauggaaccagaguuugaaaacaaccuggcucuaugaaaucuacagugcugucuuuacaacguaaaagcuggguuuaccucugucaccuuuugccuggcccugagccgagcuagcuacaggugcaguuugcuccccagugcuaccuugggacuccuucucagaucugggugcugugugggucuagggaacuguauugggucuuggauguuaaacauguacugagagguacuuugugggguacuaugcagagucuggggugcugugcagagucugggguucuguguagggucugggguucugugcagggucuggggugcugugcagggucuggggugcugugcagggucuggggugcugugcagggugugucugcucuguguuaggaaggauguaggaaguaucugucugaccccugcuggacgguugcacacuuucccugggagccaaggugccuugcgguggguggcaucugucacugagaggcaugccacaggaaucacagcugcccuaauguuccucaggccuuucccugaccacaggaggucccaggugaaggaccucaaugucacccugccugggguaucacagacaggaaguaagguucugcaggccaggugacccaccuccaacaccccugcacugaguuccuucugugguggggaaacuugggguccaagucgugaagauauuuguggugaggaggaauaggggugagaggggggacaaauguagacugaauccuuguggagaaguaggguguagauuggggcuuaugaugacaaaaguuacagggcggcaggggaggggggauucaggucagccagagcagaacacaggccugacagggagaaucucuuguccccaaacccaguuagccgcagagacaucugacaccccauaauccuuugugcuacaccuaacaaagcuggggauuuauuuuauuucauuuauuuuaugguuuuucgagacaggguuucucugcauagcccuggcuguccuggaacucacuuuguagacgaggcuggccucgaacucagaaaaccgccugccucugccuccugagugcugggauuaaaggugugcgucaccacacccggcaaagaguugggaauuuuugaguaccugcuguauacccccauggaggcugagucgcccuccgcccacccauguguccauuacacaggggagggagggagccccagagagagacccaggcacuggcaggaccuaagcauaggacagaggcuaagggucacuguuucccaggaauaguucugcacagauggucaaccucugccugacuugagaacuagauuucuuccuacccguagccagaggauucagggagaagccaagguugaugaaggccagaacucagguuauugacgccucuggcuccuugcaucuccaguggggcucuccaggcuggucuacaacacgucagcuguugcuaguggauuacuaccugggcugaccuccacccugccugugaacaggaugguuugguguugugcaguccgggggugcugcacagagucugggggugcugugcuagaucuagggguaguggguggggccuggauucugugcggggucuggaugcugugccuaggucugggcugcuauguugggucugcaggugcugugcugggucugaggaugcugugcggcaucugggccccaggaugcuacagcuguguguccaccucucucgcgcuuuuccucagcucaguagccuggcaguggaggcugaggccuuuguucucuagaaucagaggcagugaugggccuaugguucuugguaaggcugccuucucccagccugucccuggucaacaggcugcuggggucgguggaggcgucucuaccauggaauccuagucucaccugggaaguggccccagggucgcugcuggcuaggccucuccggaguuuuauggcaaacagauagaugacagauggacagcuuuguugcuuuagugcaggauggaaaguuagaccgucuccccagugauaggcuucucuggaacccauauggaccgguuuuucucuggccacacccuucgcuccagugcgacaggugcgugcgugcauggucacuguuaccagcuuucaucugcaaagagcagaguccaagaagggcugacugccuugugcauggcaaucauagaggugggauucagaccugggccugccccucccuaagccucaggccucuugguccacuaggugaaaugaauucccaacuccgucucucucuaagacggagcugggaauucucuggggacucucuccugcuccgcugugcuagccaugaugugacugugugguccccgcagccccuguacacacagcuucuugcucauucagaccuccccacauccagagccccacacccaacacucucacccuuguccuugucacccugacccaucauguuccuguccauguuuucuugcaacaccuuggagcuccugagaccaggaguggggugucucccagcggagcaauaaacucucuccaaaaugcuuccagcucauggguucuccucugcugcuugucuccagcgugguacaggugcccgcacaguggcacacagcgggugcgugaacagcaggagccaaucaguuggaugaucagccuuuggacauagugaguacauuccauaagucaguuggauggagggaguaagucaguagggaaaccaagguuuaggguucuaccuguguugggcaucccuucccuggacagacaacucugugagagaaaucccaauagcgucagcuuggggccacggcuucagggugccacaguggguagggccagggcaaggaaauagugaaguccucucucgaagagcaguccaccagagggcccucccagagggcggggcuucugcccagagcaaggaaaaggcuccgggagacggacccacccacuucuauugaagccuagcuggggccagcucugggguccugccagacacagcagugcuuuguauccaggcuccuacuacagccaccagggugggggcgcuuuguauuguaaauuuccauggagaauuaugucuuaauguaugguaauccucggaccugggggcugugcuguccuuacgccugugggagucuagaccgccccuggaggagggcuggagagcgcaagugacgugugggggucaaaggggcguguccuggagacccagggauucccugaguugagcuuuggggacccucugaagcagguugucuggccuagcuuccugcuuauuggccagcccuccaaggaaccugacucugguuuuagaccagaacuggccuuggggcucucugcguaucagguacuggcuccugauccuuccgugcugggagaacacaugacuucuuggcucagcuuaggcucggagugagcgacgcugugccccugcccuaugggggagcggggguggaugcuagggugggugucggggcuguggagagauccagugauccggcguucaguggcuuuuugcucagucucuagagaaagggggacagcccgggagcuccccugggaagaacaagccaugugaucagaugacagguaccaaggcccuggggcuggggcuuggcuucugucccaagcuguggauuuuccugcucuugaaugguucuuuggauauuuauuggagucaaguugcuguaggggagcaaagaagcagaggaggcugugggcuggucggauaguccaaucucccaaguugagcgacugcugcggguaggaugcugauagggugagugagcucagcaggggaagagcaggcacuggacaugggaaccaugaggagaggggagaaagccacaacugcuaccaccgcagaaagggaagaguacuuuggggccccucccccucccccucccccuggcggucuccugcaguuuaaccuugcucugccuucugcccccucuccucccuccuccuccuccuccccucucucuucuuccuccucucuccugccccccuccucuccuuccugucguccucuuccccuucccuucccccugcccucuccccuucccucuccuuccccuucccuucucccugcccucuccccuucccucuccuuccccucccccuccccccuuuagccccaccccugcccccuuccccuccuuucugccucucucccuccuggcuuauuccccugcuuccuaucuccuuuuccuucuuccugcucccuccugugcacugcccgcccccuccccccacccccuuaaguagcaucuguuucagaagccaggaauuggccucuacacacacuuuagccaucuuccccaucccucccaggaaggcugaaucccccgcugcagaagugagggggccuggcaggguguguauguguguaagacacacacaccccagcauucugcaccaagacugccugcaccuuaguccuggacuaacugccucuaggacugaggagggcaccccugccauguucccacagguacgugguggccugugcaggaagcccuccuguuaucuucuggucccucccugaaggaccagacccauugcuagaggggcaggcgauuuuuggagaaggggguggugguauuaggugaucagacccacggcuagccaaugagcucagcucugccaccaagcugcccuuuuguuguguauuuugagauugagucucccuggaguuucccagauuggccuuugaaccuacuaugguccucuugcuucagccucccaagcagccugagccaccacaaccucauacuuggagggagggaccagugugggggagguacccuaaguuccugaaacauaggcaaguugacugccaggagauagggaggccaaauugccaagccggggaagguggugauagaugcuaagcugagacaggaugagaacuguucaccccuaacaggccugagccccguagcaauggucgagaagggcuggagaagagcuucccagaguguggagagauccagcaagccuuccaugggagcuccaccaggcuggggaggagacaggggacaggggacuuguugcucuuggcuacauauugaaggacaggcaccagggacacuggugccuggaucuuucugagccuagggcaaaugagacugauuucuugccuaguucuccugccugcuuuucauuaccucggccuucuagagcaggaaggauggaguccugcccccuccccagccgucagcccccagagaggugcccagcguguauagaaacacaagcccccugggcuguguuucccauaggaagguggggcuggccuggaacucugcauuuuccaaguccccaagaggauuauaggaagcagauccugcaacaugggcugucuaggguggagaugccaggcuuuccccgggggccucugcucucacucuagcuguggcagcaagagaggcgagaacacucggugcccccccaccccccagccaacaggagccuggugucaucucaccuagcgcucugaaccuggcaagugugugcagaugcauuuagcacccgugcaggcuuugaaaacauucccccucuuccccaggguggcagcacccccugauuaaugugucucugcaagaaggagcuugccagcauuccacaugaccuuggcucccagcgccucugccuucagggugggucucagcugccgagguuggcugggguucagaggucagggagacccccccuagccuuugaacagcgaguucagagucagaggugggguucugggauucucuugggggcccagacaguaccaggaggacccaggcuaagggcauuucccugcguagcuggcguguaggguagucuuugcucucucugcacgggucucugcagacugacaccugggccagcguaccccaaguccaggccucugugcugauggaaacagagucuguucacaguucaggguaucugggacggggauggccugucucacaccacacccuuuucucuuaaugccuucuccuucccuggaucccgucugcacagccagccccacaguuggucgacugcugccuugucacuuagcuguucugagccagcgaccgggaggccccgcaaacuguggcauuugcugagcguaaaaauucaauuaauuccagaaggcagauuaaauauaagugaguuuuaauaauuugcuguaaagucggagauuacugugggcacgaagagaggaacacacgugugugugccugagcaggcuggcacagccccagggacccagcuggggauaggcugggguagcuuccuggagccuugcuuccccccaccucgcccccagaacacugcccuguccucgaggggaccccauccucugagaugcuuaccugaauucuccaacugagauuugggaggacagcagaccaagaguagcccagccuucaggaacugagacugagagcccuguguaucucacugugagcaggacccugcuccucaguggcuuccacccccagacucaccucucucugccagugacuacucaguguguucuuaggucagggucuagcaugcuuuugcuuuuauaccuuuuuaauuuuaauuuuaauuuucuuucaauaauuuauuuauuuuuaauucccuuuacaucccgaucgagcccccaccucuccucccagucucucccauuauccccuccccccucuucucagagaaggggaagcccccuuggguaucacucccccacgggaugccaaagucccagcaggaccaguuacaucaucuccugcugaggcccaaccaggaaguccagguaggggaagggaagccaacauccaauggcagguaagagagucagagacagccccaggcugauccacuugaagaccaagcugcacaucugcuacaaacagggggccuugcgccagccaacuuuauuuuauuuugagacggggucucucguagcuuaggcuggccuuagaagucacuguguggcugaggaugaccuugaaccccugauccuccugacuuccccucccaagugcagggauuacaggcugugcugcugugcacuguugauuccaugcugggauugauccuagccuagggcuucauacaggcuaggucaaccgagccacagcccccaacccagucguagcuuuuuagaaagucauacacgagagaauguagguggcugcugaccagaagacccugggccuaaacacacacacacacacacacacacacacacacacacacacacaagcgcuaaugugaacucgcacaugcaaacucguccgcagacacccaccuuaucacaccccucccucccugauagccaaaacgccagcuaucuaccccacccccaccccccagccugugccgggucccgaagccuccagagcucuucuuuuguccaccucccaacucaaaaaacaaaagcugagaccuggccccccuccugguagagccaucaaagugaagaagccugacccagaaaaggcaguugguagaggggugucuggggccuccuuggcuucccugguggcggcugggggggagggggcgucggagggagcaacagcuuuuauguagggacagugauaacccacuaaguacaaaccaccauuucaaagcggcuucaucaccgccacaucccacugcgaugucuauagauuccuuugucaccuucaauuggcccuaauuacggagccagaggcugcccgaucagcuucacucuugucaugaaauccugagggcacgcacggggacagcgacacaggcuugccagcugcacagcccgcagaccggccuugggucuuugugugugucccuguguguguacccgugcucgcguguuuggaggccuguccuccccuguccugugugcuuuggcuggcuggaucuccuggauuuagggguggggggggcagggggcggguuggagccccccucccauacacacacacacacacacaccccauaggccucccagcugagaacuggcuagcggggcugugcauaugguaagcaggcugggcugcuggcuaggcagcccgaacaccugcaaagaugaaaggcccagccaagcgccgcacacccgggccuucccuccacgccgccuguaauacccuaauuaugcuguguuuguuucaguaauuuacacucucuggguacugguccaucaauaauggauguauuaccugucuggggaagguuuggaagauccgggaagcggagggugggggaggcaguggccuccccagcagccuuuucucucccaagcuccuuccuacaaggugauguguuuggaggcccagcaaggcugguucuccauacgacuuucccguccucccucuccuuaccccccuucccguuuuaugccuuuuuaauauuuaaagcugucguugggcugagccauaaaauucuuucaaaucgaauuuuauucuccaaucucaaguucuggcuucacucuggcgggaagaguuaguugguugaggggggggguggcagcgguagggcguggggguaggggaggggaaugcuguuguguccaagugucugguguccugagaguccccugagugauccaucuucugucuccagcacuuacgggaucaauggugugugugugugggggggggggugaugguggcagggguugugcuugaaccugaugucacuugugagagccaucccagauagcccagggaaggguggucacuuaaaaucccaaguacauauccagccagagggucugccugaaugugugucugcgcaccaugugcgugccugguacccauggaggucagaaaaggacaucaaguccugcggaaguggagucacaguugguugucagcuaccgaguaggugcugggaaucaaaccccaguccuggaagcguaacagauccuccaagccaucuuuuaaaagugagagcagacagagccgccugaguuuugaugcuugcagcuucuaccuggcuugucuggggaggggcuggcaggaccuaggaagaguguacuaggccucuagacaccaaucucucucuggguccuagaggccucucucucccuguuggucucuaggguauucaaggucaggccuguccagguggcucugagccauuugagccugagggccucugcccgcccuuuagucuuguuggugacuugaauaagguaauaauucuguuuggggguuggagccugcugcuuguagaugugguccauacuucauggagaagaauggcuuccacuguugcauauggccccuccagacuucucuugcaucuugcaggauuguugcugguuacaggugggugguuaucuucuugcuguccacaacccuuccauugucauuaccgucuguggguccuuccugggcuuuuuuuguaaagcugacuucaaugucaguucugcuacccugggggucagggagacagacuucagcugugacccaggcguugcucacgugugcuuuggggugcucugccagccugccuggguucucuuccugccucugccacucacuggcuguguggcaagggacucaaccucucugugacucgcucgccuaccuguaaaauggggacaagaggauaagccgcaccucagugggaggugggaacugccauggaauaacacagauggugcugccauugacaguaaauuucugucuggguguggugaugccugcugccugucccucucagcacuggguagauggagacuggaugagcaggagcuccaggcuagccugggcuacuucaguccacauccuuuaaaaaaaaaauugaauuuucuaucaguuaucuuugauaccucaggagugucuccauucacagaucaggccccugggccugcugggauaaauuuagggguucgaaucuggugucuggggugaacagcuuaacuuccagcucccuucucggaggcuaggcacccacaggcagguuugucugggugcuucaaggaggaggaguugggcucagccugaccucugguucuuauucuacacacggccuuucucuuucaguucuuggguucagauggccugggucacuguuaaugauucuccuucacacaaagucacacacucaggucccagggguggggucuuuaccaccuaaguugucaguucucccccacaacuccccccacccccaauauuggcuccuacaggggcuccaggaucauucccugcccuccugggagcagggccaguccagcugucuggcagccacgccuccuggccaagagugcagccgggcuuggugggcucccaggccccgccccucccacccccucgccccucccacccccucgccucgcucugagcuuugcgcauggaaaguuuaacuugcuucuugauagccagcccccugcucacgccugggcuccggggaucccuguugucaccucaucucucccuugcucccggcccauagacccuguccucugagggcugugcucaagggcagcuuccgguagcuuccauuugauuuuaaauaauuccagagaucagaaagagaaauguguguccccaucugccaaggggccugacugaaugccucuuuauugcacuaucccauguagaggccgagcugguucaagccuggccuccagcugacucacaugacccguguguuccucuguguguguguguguguguguguguguguguguguguguguguguguguaucugucugucugucugucugucugucugucugccugucuguguucugcagacuggagaaggcaaaagaggacagcucuccucuuaggguggggaugcaugggacacaucaaaccugggauguucuggucugcagaucugacucccaccuugggcaguaucuguagggcccauggagaagaaaaaaaaaaggaauaaaaauuuuuuuaaaucggaugggagaaauaaaggggugaaugucgcugcggagccccaguugcuggcagaugguccugguauuagagaaaugaaaauauauguuguaaauucacuauuugccagugcuaauuucuuaucccaagguagagacuuccccuggcccucuccacacaccaucugcacauucauaaaauguauuacagcggaauugauggggcgacagagugcaggaggcucugggugaucacccuccucaggcaggggaugugggaggaagccccucccacaugcuugcgaccacuccccugcagggccuuguggguggguggguuuguggucucccaucuucagcucggcuucaacgauggaugcagccuggaccaagcauggcuucucuuacugaugugguuuauagagcagaggccugaggggggcuuguuaggcacagcccuggccugcgguuccugugggggucaguguaagacugaguucgaggccugauguugccccuuccugggccuuuccugcucauccuaggccuuccuggacugaaccucaagccugugugguucuagccuugcaggccacgguugacaacugcuccccuguggcaaaccccuggaagucccuucggaggccggagacuguucucagcagugacagguuccagggcugaguacauucuccaucuggcuccuugcauuugagaguuuuugccaagacagagcugggcuucuaggagcaguguguccccucugggacauuaguugggagagcagccuuggggccucuuggaaccauggauaugagcagagccaauguccuacugaggcuucuccauuccccuugccugcuccguccuuaccuuagaggcggugccccaccccaguccuugaggcugcuaauugucaaugugugaauagcuuuuaugaccagcuagagccccacaucuggucaguuugcuguaucaguaauugagccugugcaaccgggccagcucccuaggggaagugauuaaggcuguccucugucacgaaugagccagcagaacccaggaccuucacuauuucucaggauugauggccccaucugugaccuuugcuggaucaagaaggaucacugaaaacauucuguuuccggaguuuucaagcugcaaacguccccuguggacaggagcagcagccugaaagcugccaucccguuaugaacagggcaugccuuccuggaagaggaggcagccagccccucacucccugguacccucagggugagugcuccacagcugggggaggagcuaguuugcagaaggcugggugcaggugggugggcccagguacuucuuuccugucaucuugccucacccauccagaugccccuggcucagacuguugacagcgaugcuucccagcuucucucucaggcucucaagugugcacuguagaaacccagaacagcauccagguuccugagggggcaguccuaaugguuuucaggugaagcagggcuauugaguugcaaacuggcauagcugagggaggcagaaagcagagggcuaaggccucuagguacuagugugaguggguggggccuggcggagcuggaaugcugaguggguggggccugguggaacugggaugcugaguggguggggccugguggaacugggacucugaguggguagaaacuggcgaugcugaguggguagggccuguggagcuggaaugcugaguggguggggccugguggagcugggauucugaguggguguggcuugguggagcuggaugcuaaguggguguggccugguggaacugggacucugaguggguggagccugauggagcugagacucuugaguagguagggccugguagagcugggaugcccacuggguggaacgcuauggauccagggaugcugaguagguggggccugguggagcugggaugcugaguggguggggcuuucuggaaaggcaggauucuuggcauucacuaguuucucaagggaaugcuacuuaugagugugcugcgcgcgcgcgcgcguguguguguguguguguguguguguacaugcacauauguauauguguguguccaggaccuggccuccaaggagcccgaaucccaaaggauaccccucuccuucccugcucgagugaccaugaguaucgcucuccuggcguguugucccugguguuggcagagacucagcucaaggaagcacagacuuggagcccuaguggcagaguuauggguguauuucugugguguugaagcuuuucaaagugcuggagauuugucuggaccaaaaaggaaaaagucuuucuucucuguggcuuacuuuuuaccuacccagggcuacaaggacaggacggucuagaucugcagugcccccuagccacaaucuguugagccuccucgcugaacgacugaggcauggcagcggcugggucaccaucaagccucaggugaccgguaccuacgaaggcuccucagcucagcacacauggccucugcacauccagcccauagccccucugcuuaggaggcagcuuccagaaugggagggguagagauggcaaggcuggggggcucuuuguugguuuguuuucauguuuccacuugggagcuugucauugucacuucaaugucuuccgugugcaaugaaggugugaagaccccagauccgcaucuuuggacaagcuggggaccugcucugggcaucacacagaaagaugaccaaccacagcaccccacauacagauuauuuaagaggacaggguuggaggaagccagcucugagggauguccuuuaaucaccagugguuacaccaucuuuucuaggucucuucucccacuggucaggcagcccagggagauuuagauguccuucgacacccccccccccaaucuucuagacuugcaaagaagccaggaucccuaucucuagucccuuugaagauccgguuuuuuucuucuuuauuugauuuauugagacagggugucucuguguagcccuggcugucccggaacuaacucuguagcccaggcuggacuccaacuuagagaaccgccugccucugccuccuccuaggugguaggauuagaggugugugccaccgggggcccagccccuucagagacuuggaaacugagcuccgagaccacgagaaaccugcugcggauggcagaaugaccagacagggagcuuagaccugccuuggguguccugaucuuggugguugcgucgucauggugacuguuaccuaucugaacagaccuguucucaccgggugcccugacaggaguucccugucuagcagcucgcuuggaggcacaggcucagagauacccugcccugcucuuaguaaccuagaucugcuaggagguuggcuuagccguugagguccacccucugagugagcgcggccgcccucagccucagucuccaaauccgagaaaggaccgcagugacaugcagacuaaacgugaaugauguaacuucccaggauugccaaggugggauccuccuuguaccagccggccuugaagacaauuaaccagcaccuuuccuucuugcccucccauccgccccuagagccgcccauccaagcagggguggcggcugccuguagucuuagcagcuguuucucaguuucuucagccaggauugagcagacccggcgacaccaggcucuccacagaguccuucaggccagaugccuugcuuuuccuucccaagaggccugaugucaucuugggaacagccagaaaggggcaggagucagggaggaguuauuuccacugcugccccucccucacccgcuucccccccuccccagcccugccccugacauggcccuggaaccucccacagccucuccucccacuugcuccccccacccccgcccccacccccaggcccugcccugggccagcacagucugugugaaugucuaaucuccaauuuuauucugcugggcuacagcccauuugcauaauccacacaggcacccugguuuuaauugcccacaacucugcagaaagaucaugugguuaagugguaaaucauaauuagauaaauaauugguuuggccacagcaagcugcuucuguuucaccugccaucugccggacccgguuucucuucuggccggaacaaugcgcuucugaugacagagcacacugcugcucccuugugggggcggagggggcugagcggaggggcuuggaaaccgagccuggaaaagugcccgauugcuggggucucuuuccccaagccaggcaagccccacacuugccauucgcccuguguggguaggggcgggggagaguucuggaucugcuguagaaagggaggcuugggucugagcagagcggggccgggacuggcuugcuuggaccugggaucaccuguguagggccgaccugggggccucauuccuuggggcucugagggaguuggugggcagagcuggagcaggcaggccucccugccuaccauggucagcuugcccaucugguguuugcuggaaacuccuuucucuccacacuguaggcccauaugugagccaagucucugggggaauugggaugcugggcugguuggucgccuggcugggucuuccugggggccgccggcuauucgggcuggucuucugcuggucuucagccccccuggauaccauggcugcuuccaguugccuuuccuuuaugcguccucacagacaugagcgccugcacucaccagugccuucccugugcuggccagcacuucugcucacucucaggccugugcuucugccugggggcugaguauggauggaugaauaccaagauccucgccuccaggccuugauucuagggcugucccgacugaguuugccugcacagcggcucaggaagcuaccccucuccccagacuccagguuugucuucucaacuccguggaggacagucuggaugcucaggaccacacacacugaaacucugagcccugugggaaugagggccaccacugcacacagcugaagcccauuggcuccccagccauacacuguguccuccugaagcccacaguugcuucuggggugccucaggaugggcuccauaugucuaaacuauggaacugcuagauaaauucuguguuuuuccagcaugcaggcacccacccauucuuuaucuuuuuuuucucucucucucucucuuuucuuuucuucuuuuggcuagaacucauaaagaucuaccugccucugccauuagagggcugaggcuaaaggaggcgugagagugccaccgcugccagcucccucuuccuuuucuauucaucauccacuuuccuuccuuccgugugccagucacccuuuucccaucuuucuuccaucugucugcucauccauccauuuugccuaucucuccaucaacccaucugcccauccauccauccauccagucaucuauccauucaauuauucauccagcuauccagccauccaacuauccaucuacccauccauccaucugccuuucucuccaucaacccaucugugcaucuauccaucuauccauuuauccauccauccauccauccauccauccauccauccauccaucugccuaucucuccaucaauccauccauccauccauccaucugccuaucucuccaucaauccauccauccacccauccauccaucagccuaucucuccaucaauccacccacccacccaucaaucuaucaucuauuauccaucuauccauccaucuaaccacucacccauccgccaauccaucauucaaccaccuaccuguccaucaaucuauccacuuacucacccauccauuuauuccccugcccaccuaaccauccaugugcacacucauccauuuuuuucucacccuucuauccaucuuccuuccuucugucaucgcccacucuucuguccuuccuuccguguuccucccauaucucuucucccaucccucugcucacccaccugaaauugggcuuugagcagcuuuggccucagcccucugugcugacuugugaagugaggcccuaaagcaguuuaccgagaauggagaagaaacugggcuuuaccguguucuagacucggcuuuucaaaugucuauacuggggauccgggggccagacucuccgaggcuguguucugggcucuucagacguuccgccuguuucuccguaagcacaugugaaugucaggacucagucaccucuuuccuuggcgcacaggcuguggccauagcuggauccagauguccguucugcccggcaccacugaccacauguggcuauugaaaauugagauuaagugaaccuaacaauucugugucuuagucgcaccggccacauuccaggugcucaguggccacuuggggcugggauggcuuuucuaugacagguuuuucuggauuuacucagagguauucuuaaauaaacagauggauccccucagcuauaacuggguucaggcuagaucuuucuggauucuccccuaacuggaugccggagggaggacugagccuggacucguguuuaguuguugucugucuguggugccauguggcuucggucuagccacuuggugugucugacucaucgaggggcaugguggcagcugggucccauugcuuguaggacugacugucuguguucuucccggcuuggggacuuugcuguggaaccacagacguaagagcagcuggugcagucugagauacugcugcugacaaggcuacuggagagcaguguuuccauuuuuuuuucuuggccugggguuuuucucgcuccugugcuaggcagaccccuuauagggacccugcagccuucugccccacuugugauaugauaugcucuguuagacagggcagcucgguggaccaucuaguccucagaccucccuggcccuugcuggaucagugucaguuucuaaggugagccguccucguagugccugccacgggagacgugcaucaaaccagcuuucaccuuucgggaacagucccgcuugauucauagaggcuuaggagaaccagcucuucccacagccacgugggcgacagcuagcccuaucgccaccgcaagagucccaacuaaggccaggaugugucccuaaguggguauggaagagugcucggggcuggggcugcuuccugugccuggguggcucggcugaauguaccauguauguucaugccagcgggcucugagacacuggucacuguguucauucugucaucucggucacucaguggcaggguggugauaggugauaggugccagacaccaccaaggcuaccaccaccccuccccuaagccaugguaccucugggcccaccccuuccaugccucuuaauuauuuuccuuggcuguugugaauuaaaucucccaauaaccgcaggagacaucuuuggguacggccugcucacaucuccggcacccacagaagucguuaaacgaauaacguuaacuuucuccagggauccaauucucucugaauguaauucuccucucaguuacugggagccgcuuaggaaaaaaaaauauaaaagaauaagcagaaguuccuaaggcuuccucagauccuguugggagggaggagagucgcuugaaauuaacuuuuaagagaggaucacagccgcucagugguggcgcacgccuuuaaucccagcacuugggaggcagaggcaggcggauuucugaguucgaggccagccuggucuacagagugaguuccaggacagccagggauacacaaagaaacccugucucgaagaaaaaaagagagagagaggaucacaccacagcuugaugguagaagaagcuggugucugggugguucugauggggaugagugcgcgugcccaggguccugggaaggggguguguguggggggugacuugugauguuggcucucagaucuacccuggauccccaugccagggguacugauagaagcagguaggacagugacucagcuuugauguggaggcuuggccacuggguucuugcugguggaacuggaggguugcugguacacagcagccauggaggugaccuguagaccgcuugucuguguucugcagggguguggcugugagccacuuugucuuaucugccauuguaggccccagcuauucaguucuccugcuggguguuccucuuguuucuccugcuccucuuccuccuccugguccuucugugucucuugauccuccuccucuuccuccucccuccuccucuuccuccucccuccuccucccucuugcuccucccucaccuuuugucuuccucuuccccccuccuccucucugucucuccaucugcucccacccagacaucaccuggggcacaggugaggcugucaccccaacugugagcagacaaggcucuuaaugugccuccuuucucugacaguacagugaccacuguucccguuacagaggcuugcuaaggucccccaucgucagguccuggagcugugaccugggacucuggucugugacuccugagggguuucaggucauccauaaaugugucuuccuguagcucuguguagcuggccagggacccaucuccuccucuaggccaccccacacuacacagcacccuggaguagagcccggucucacggugccacuuugguuuauuaaugggagcacuuggagggaggcagcgugcagcacgggggacuuucccaaggucaugagcaguuuguuggaugagccaggaauagaacuccuuagcugggcuguguuaacccugagcucaaauugccagccagccaggcaggucagcacagagggcgggaguggaguggggcucagcuucugaaacaggggaggcagcagaaccuagaggaggaggcccugugcucucuguagcccugucaaucccaggagaggagggcguggugaucuaugguggauugcagggagcacacagccuccuucuuagcugaugcugugugggcuggaaagagacagccaagccuuguucagaacccagugaucucaagaugggaggggcuagaggacagccuuugcccuacacacacacacacacacacacacacacacacacacacacacacacgacaccccgaugcuacgucaccagugcggucauuucugaaccaggcucucccgaguacuccauggcugccuguaccccuucuccaccacuuugcuuuugggacgccccuggguagcuaacgaggugugcauaucaaggugaaagcugcugacuugcccugggucucugaacccaguaggaauaggaagugaagggguagaggugucugcuugggcuuccaaccuggaagccucccuggaggaggugagcuuuuuggucugaggcugcagaguggggagagcuguucaagguggagaguuggaagggccaagcaaggcuccaggcuaagcagagcuggaagugagagggaggcugggggcccggggagguuggaaauacagcgucuaaauaccaaauacguggccuugaggguagagaugcagggggugcagccucuggggaaccacagagugggccaagaggaaaugccacuuguaaaaguaggaggugcugcuguuggagucuaagggauggaggcagcaggagagggaaguccccuuugucaccaagucccuggggagccugagaaaggaaggauacaagugcaguggucccucuagggcagcuuucagcgaggcuggacaccagcagccagccuggugucugcuccaugccacaggaagagaagagaugcuuuugggccggacccggaugcggcaccagacuguggugcaacugaaggcccaucuggggaaaaugcagagcuuauaaggauggggggggggguggcggaaacugaggcagggaugcugcugaggccugcugccccucaccggaacaccauuucuucacugugaaauggcucaugucgaacgaaccuucccuccuugguuaucucagccugugacacuaaauggcagggacaggaacaugagaacaagggcugaaggauccuugcagcugccuggagcuggcaaaggcaagaucugaccuuggggaccccagaauguccucuccaggcacuggggacacagggguuugugacccugugcagguguuucuauccuggaguuuacaagccacagaggccucugggaucugcugguuucugugacaggcugggacucuagugacaggcagugggaaaaccaagacaagaaugagaggcugggaaacaaggcagguauuuggccagcuggggaggccacgccuaugaucccauuccccgggaagcugggccgggaggguugagaguucgaggcuaccugggcuacagugaaaagccuuauuuccaaaaggacuaaaggcaaaaacguaaggcacgguaguguucggcuuuaaccccagcacuugaggggcagaggcaggugaguaugaguuugaggccagccugguccacagagugcuagcauagccagagcuauacagagaacccccccaccccaccccaccccccgucucaaaacacacacacacacacacacacacacacacacgguuggggguggagagggagagagaggggcaggggagaguaacuguaauguucucugggugaaacaccaacccccacguucugcagccaugacacugccugagucucagguaccacagaggcccagaaggcucucagcagucagggaaacauggcccguuauggaccuucaacccauaucagugugcaaaagguuaggggugccuccagucugggagguuugcaggccaagggggcuugccuggagccggagccgguccagcuuuuaaaucuguagggagagucacaaaacuccaacacccauuuguguggaauccuuagggucuguguggguacauguggaguuccugggggacacccccuagaucucucuguccuagaguauguggccuggacugggacuuggugaggccguccucccucuuauccagacgauugcccagacagagagacagcugugggaaggaggcagagucgcuccugcagugcucuggcucugugaguggacugguuaagaagucggaagguucacugcccuccuguuacccuauaagaaaggggugcaggauuggggccucccacgcaccuggcuccccugccugccccauccugggcugcucugccccaucccccaaccccuacccaggucacagcugucugcuuugcagcagguggcaagagcgccuggagguccuguguggagacagguguacauuccaaugucaccacccccaggugcucaggaguuccaggccccaggcuggggaagaccagaggucugcagcuuuuuuuugggggggggggggagggaggccucagcaggagggauggggcuuggugaccuuucuagccugagggcugagagccacgagguaaugcagcugcagugucuuuaaguccucagagcacagagucugggaaaguuccuuggggcaaggcucaguggcaucugaccguuuccugugaccacgcguccguccaaagugcccacaggcgagggugcugcuggaaggggaguuuccaaggucugcugggguccccuggaaaacacccacccuccccuagccugcagcuuccauguuaaagcgcaaaguacuuccagcacuuuggcgugggggaggggagagugucaagcuuaguagucauuucaacuacauagaaaauuccaagccaguuuuggaugcagaagacccuguauaaaaauaccaaauguugggggugggggaugggguggcucccuggguugugguguuugccacuaagccucgggucuggaguucaggcagcagaacucacaggguagauagagagcgaacuuugagaguuguucccucuaugauauauguguacacacauacaugcacaagauaaaauuuuguuaaaaaaaaauucaguguucacaccugucauuccaggugaggcagagaggucuugaauucuaagcuagccugggcuauauagagugauuuccaggccagccugggcuauggaguaaagggacuaucucaaagagaaaaaaaaagcaaacaaacaaacuugugcgguccaguggcauuuagcacguacacaguguugugcaaccacgcgccugucguccuugaaccagaacagacccgucacccaggaaacugcccccacaagagcagccacuccuccccccaggagcugcuaaugcaucugcugucugccucugugaucugcccauucuggacauugcauauuugggacucacgugacagccuugggguauggccucugcccuuccccaccauguuuuuccaucuuguuauggucaagcuugcuugcuuguucuuucuugcuuccuuuccuuuccuuuccuuuccuuuccuuuccuuuccuuuccuuuccuuuccuuuccuuuccuuuccuuccccuccccucucucccucucucucuccccucuccccccucccccucucucuucccucuccccccucccucuccccucucuccccucccucucucuccccccucccucucuuccuuuuuuucauuuguuuuugagacaggguuucacuuuuuagcccuggcugucuuggaacucacucuggagaccaggcuggccuugaacuuggagauuugccugccucugucuccagagugcugggacuaaaggcacgguaccacaauuaacaccuggcuucuuucucuuuuuugaaacaggauuucucccuacugagugugguagguagugugggccuuuaaucccagcacccugcauuccaggacagccauggcuaccuagagaaaccaggucuuagaaaaacaaaaccaaaaaagacaaguuucucuuuguguugcauccugcuccagccucccggaugcuaggauuagagguaugagcagccauuucuucuuaggaccagacaguacuccacugaauggacauaccacgcucuuaaaacucauucccuggggcuggauagauggcucagcgguuaaaagcacugacugcucuucugaagguccugaguucaaaucccagcaaccccaugguggcucacaaccaucuguaaugagaucuggugcccucuucuuguguguuggaagauagcuacaguguacuuauguguaauaauaaauaaaucuuaaaaaaagaaaaaaaacaaacaaaccucauuccccagcaagguaucaggaccuuuugacaucugucuaauuaauugaacaucugugagggaugcuuguaucgucuguucuuugucccugaauuuaucuaccguauaauacauaucgggacccuguaauuuuuuuuucauggcuuaauaguccaccauagcuugguuuugugguuauucacaggugggcuggacuggcaaucuggagagguguuuggaagagaccagccaggccgagagaccugaagcauagaaggggcugucugugcucucuuuuccaaguugcuggucugaugguuguaccauuaggaagagaggggaguccuugcuaucccaggcugccuaggaucaaggggcgggccucccagugacaucauucacaaaaaucauuuucuuccuauuuuuaaaauuuuuuuucuucuuuuuuuccuuuuugagacacgguuucucuguauaguccuggcugucuuggaacucacucuguagaccaggcuggccuggaacucagaaauccgccugccucugccucccgggugggagcgccaccacugcccggccuaaaaauccucuccucuccucuccucuccucuccucuccccuccccuccccuccccuccccuccccucccccucuccucuuuuuucuuuuuguuauucccuguccucagggugaacggaaggaauuucgugacucagcugauaguccuaauccucgggcuugguccuuucuagguuccuguucucaggcaggugggaggugucuguacaucagcucuagaaaccugggcaccagccacacacauacaccguugaccucuccuacaagcaagaacugggacucggggagcuguauucaaggcuugcucuugagaguugagaacugacuguguagcacgugcuaggauaguccagccucggcacugcugagguaaaacacacagcuuguguuuaaaucaucccugaacagcacggggucgugugggaaaggucugagugugggcugguaggugggaaaccacaaagacacgaacuguuccguggcuggcuggaagcacgguaggagggaugagggaguguccaagggucccaggccucaagaccaagcugggacacaggcccaggagaagccaguucugacaggaacagaagcuaggaagaagggcagcuuguucacugaaaauccgguuuuguguaggugaagaaaaugggggcucccacugauggcuggucaccgcucuuggacacagacucacccacccuugugcugugugcccuugaagucagggccccucccccccucccgcugccugggugcuggcucucucucucucucucucucucucucucucucucucucucucucucucucucucucuuuccacucaggccugccagguagucaggacagucaggacuagaugcgauucuggcuguucggcgcuuucauaaaagccugcuaaaauaagaccacucagggacagggccuccuggcucuccgucacaaauguugacaguggagaaaacguggccagguuccucucaaauauaaaaauagggaguaggcauggaagggaauggaaaccuggcaccccccacggggauggcacugaggugcaggacaagggccuuuuggggggacagcuccugagugggguaggguagggaggcggcgggggguguugucuccuccauggcucgccacugugugaugaggguguaaaguugccagaccaggcugggcaagcagagagaagaggcuguaauggaguugggggugaugguaacuggggacuucugaggcuuggacuguggacagcuguagggcucuccccaggaauucacaagccaagaacuuggaccugagcagggccaggccacugagagcaguuggugacagaaauguagugccagcagucucaaaccaccuccugggagucucuguccucuggaaggaggguccaagcaacccccuuccaccccuuccuccccugccaggcccuggcccagccauauaaaguuuaaagguuuuaaaugcaaauauuucucuuuuauagaugccagcugucuccagagagugcgauuucuccuugcucaacuucaugguccaauuagccucucauaucugaguccuagagagcuggggggggggggguggcugggcucugagccgguggcuuaguaagcuguugucagggguggcuugcgguagacuggguggagggggugcuuuguagggggaggggccuugagccagcaaggauaggaagcugcucccagcugucugcucgggcggggugggcggggcggggcgggguggggagaagguuaggggcugggucacuggguggaggggcuggccaggguuagguacagauuuugaggcuccggguggagaugcaggaacaggggcaguugguggccaggacauucuucuccuguuuagaaacauaaaggcaggcagccugcgcacacuggcucccuucuucuccccucaagugcccucuucccgcccgccuuccagccgugggccacggcguccccauucaccggggcucggaggcgcucacaaagcgaggcaauuagaauugaaaaucuaugcaaaacagcuguuaacugguuguaaaagagugcagcugugugcggggcgcgggugggagccggcgcugaaagcgcaggaaguggcgccgaggcccaggguuaagaggaaaacuccccaaugggccgaggggauccgccaggucuuagccccuuccugcugccugggugaccucaguccccaacagccagccgucagacccgcauguuagauggaaaggaguccacuuuagaaggucaccggcugccuuccguuccccgcugucccgcaucauguccugggucagcaagccugaguuacaggcaguuagagccugcuugccagccccccagcccugggcagucacugcugugagacaagggucuccccccccccccccagaacagggugucauucccauacacccuagaacaguuuagucaggguaaaugcgccuucccaggcccacuuuugucugaaccgguaagaccagccuggaaaggugaguuccagaggcagagaugggaaagccuucuaagagcauagaucugagcaggguuuugaaggauggcugcugauguggaagagggaagagaaagaaaguggagccggguuugagggcuugccagcugcuguggagagccuggcucagguggucaggauggauggagucugggcagacccucuuucucugcuucucagccccccuuccaccagggugguuuucuggguaccaagaguucauccagagacuuagcaaaagcaaaaaugcuagaaacccaaggccaguggcgcccccccccccuucugcaggguuuccuacugcugcagaggaagagccugaacucagagacaccaccucccugccuggauaacuaggguaacaaacuccgcugaaggucuccuaguugggggugugugggggguguggauugucggaauacugccagguguaaguaagcaaccguaggucaggcuuguguuccaguuucagaaccuugaggcagguucauugacacuuggaaguggugcucaccaccugccuggccagaccuggagggcacuggaugacaagagcccagcaagucuuugcugggaaaguuucuuugugauggcuaagucugguccaugcugcagucuagggcuccaguguauggaggugcagcugccgggggacaaagcagucgccucuggugagggcagcggacuggucaaaacuggaaaccacaucaucuuaugucuuccugcccagccccaggaggaaaagacugggaggcacuugaccuccagggcucacuucagacgggguucaggugggaacacgaccuuggugaaggaggcucuaagccugcagccugcucucucaccucccuaacucuggcugccucacaugcccgccugugggccucugguaucugcccuguggccuuucugagcuguggcucuguaauuuucaguuuuguuucuggggagggcccgggcgguggggggggggacuugauguguguccaguggaugcugcccauaccuguccugguucuggcagacccugcagguccagaaaccccuccugccugggguuuugaguucaucgguuucugagguccagggcuuuuacagaggaaaccaggcuuagcugggcugggcugagggaaauccugcuuccuauucuagguggcccagcguggcagaacccuagcaaggaaaguugggugcuccuguguccuagacgggcaagcauccugagcuaagagguucugcucaccuuccaggaccgucccuagcacuugauguuucaaauccucuuucagccaacuucccuaaacaaauggaacugagggaaaggacccagagagcaaaggcuuguauagcuugcugguggggugggagccagcagcugcgaggaggagggggaggagaaaaaggaggagggggcggcaacuagagggagguuagcuuuuagccucggagucgggaauuagcaguccauccauacaggguacaucucguuaacaaggggccagccacauggcggcuagagagcaauucccacccuuaaacucaaaggcccugcucaggauuacugauuuccuggggcaggguguagggacagugaggaccauccaucuccuggugacugccagccuuuucuggccugagugcacauagcuggcucacugcugucccccuguggccaucgugggugucugucacccucuugcuaccuuggacagucuggggcuggauggagaccagacuccugguuugagaagcugggggaggaugccuggcucaccugcaggcuugcaaccuugacuacuuucugggcagguaccucauuugaaaccccgguuggggguacgguuucagcggagcugccuuguauugggguggggugggggagagcagccagcuucuuaaaaaaaaaaaaaaaagcaaaacaggugguagcucauaguggucacccacaaauuuauaggauggccugccuaguucucaccaaacaggugacugaacuuggccuucuagauacccuagggagaaaggugcgacaagauuuggaggaagagccugguguuguuaccuggggaaccuggcccgcaggcagcgcggccaggugcgagcugcucauuuacauguuguccccuccccacccccccaagccaguaauccaggugggaaagggguuggaccagcccgggagguuuuucauuuuguuuuuacggcucgaggccaguuguuucuccugacaccucccuguccccccuccccccucccgcgugcgauucccgacggguaaaggcgccucuccccgcccccacuccuggggagcccggcgcauccuccuggucuccagcgucguaaacuugcggaggccacgcugccccgggcgacgcgaacuaacgcguggaccaaaggccgcgcagcgcguguguggggccagggacccgguggccgcagguaggagcagcaacuccgcccucccucgcccgcccguuucccuugucguuuguggucggccaggggcuugugcaagacuggcccggcgugcgcccccgccccgcggcaucggcggcuucugcuggcgcgggccccgagcgcugcccgccgccggcgucaucgggaacagauggacggggggugcuggcgcccgcgcucgcucccggcgcugucccggcuggcgcgggagggaggaaggcgggggaggcagcgcgcgccugcggagcacugcgcgggcaugucccggggcagguuuggggcuggcaccgcgguggaaaguugagacccgcagcggcgcugagguuccccccccaacccccccggugcgguggccuccgggcuugaaagucugaaaguggaggaucauuaagagagcuguguagaaaggccgggcgggggagaccccgggaccucgcgacgaccuugccaccucgauggcugcucucugcgcgcuggguccggccgaggguccccggcugccuggcucgcgcuguaaccucgcgcuucccggguggcgggaaggggguguuucuagggaucggucgcguugugggcggggacgcuggggcccacagucccucuccgcgccgccugugggugccgaggaauuucaggacgcucccugagucauccccgugaagugccugggugagguagggugggugggggugccaagagugggaaggcggugcgcuggggccgguggcgcgguggguugugccaguuucuggaggcggcggccucgccucugaccgcaaccccagcuacuuaaugaugccccuggcgcagcggcgccuccguggacuucucgaacaugggcucuuuaaagaacuagagcccccgccguuuggccuucucaaaaauuccuuaaagcgagauggagacuuugcaaaacuuugggacagaggcucguggcccgagcucuuaacauuaaguccuuuaaaguugugguaauagaucaggcaucuuggagaucgagagaggccaacggccuauauugugugguccccuccacucagcacaaggaaaggccuaucccuccccucucuuaguggguggccaggugccaggcacuguuccaggcgcuuggggaggcggcuaugaggcucggauauggcaggcguguuguaagccacuccucccuacucuuggagaugaguggcccgcgaggccucugagagaucccccuggacuguccggacagccagggucgccaggagcgcggggggcggcaccuacccggcggguugugaccgcgcugggugcuccgggcggucugucggugcgcgcgcgugcgcuugcggcugaaacccgacaccucccgccggcugaggucagggcgccgggagcgagccggggccggggagugggcggcguugcgcuuggguguguccucagcggcgacagcagcagguguuucuuggcccaggccccggaagcuccaccuccccgagcggcggagccgccgccgcacagccccgggugagauaagcaguucagacaaacccgggcgacgguggcuccggcaugugucaggagcgguggagcagcggggcccuggcaugaaaggugagcgcgcgggugggggaugguggcggggguucccucguucuuccucuccccaaguuugugggcucgggaggggcgccaacggccggugccaggucccgcgggugugagggacgagaagcgcggggcgcgcggccgaccugaagccacacucgcggcugcgcgcgcgcgcgcugggcucagccggcucugcugccgcggaagugcgcggggaagugcgcgggggcggcuccggggcucgggguuguagcaaaacuuuggauggggcgggggcgcccaggcaggugguuggaugggggggggggugcuuuaccugggguggcaguccaaggggccuccgaaccccccgcccagcccuucccgcuccgccuggaugcgccuccccgccccccgcggccgcgcugacggcgaguggcccgcccgaguggagccgauucaauuauauugcagcaccagagacaccucgucgcccgccgccucuccggcaggcuaauuaaauucccuucuuggaggcggagcgggagcugggcugcccuccccgcugcccgccucuccgagcgccgggagguggcgggggccgaauaggacugcgaggagcaggcuuggggccgcaggucugggcaucggagccgggagcgagcaaggggcgcccccgcgcaccugccacccguggugggggugccagcucgaguugggucgguuuggugcaaaccagccuuugucuuccaugcauuuaaagcacucuaaacccuuacuagaccccugcggugccuuaucugucgcgguuggggcccacacagguugggguuugaaaacaagcgagaccaccaaauggaaggggggaaaaaaacaaaccaaaauacaagauccuuuuguaaagaggaccggaacaaaaggcgcagccucgcucuaggagggagcaucgggccuaagccgauucccagcacugggggacaaagaggcaggaggucuuggcuggccgcuuggcagugucucagucugagacugguuuacccccucuucccgaggaagacaaggccccccuggcgagcagccuucccugggcguccguguuacuuaagcuuggcuacuuaaguguugcuuagccuguguuuacagccgcccccacccgcaggcggggaaccugaggcgcaggcugugucugacucagccacucagucgccccgccacaggugaggggggccggggcacaggcuccgacuggcagcgugugucaucugcuaugcugggugucacgccccaccggguggaccggaacaggguugcuggcagccucccucgauggggcucgcugugccgaagccgcuugcucaacacuucucacagccaccgggucacgccugaccaccuccuggggugugugugugugugugugugugugugugugugugugugugugcgccuugauggcuugguacaagguuggcuuuugucgccugguuuggcagcuggagcggaggaggcuuggggggagggggcgcuggugagcagccagccagagacccggggucagccacgccuucggaaaggaggugggaggccuguccuggcuuugggcucuguugugccugccuuagggcagguuccgaaccgggaaggcagagaggccagaucaggcccugaccuguugggggcagcuaguaggauucugaccaguuacgguugaaaaggggguguauauaguuaguuaacauuuuaaaauuacuaggaaucaggccuugucaggcccccauuaagcuaaccuuggggcuggccuggggcgauucugaugccuccagguagguuuuuaaugggguggggguggugggaagcuuccaaaacagccugacccuuuggaagccucugguugcucuuggcuaagcugucccucuggcaggcaggcaggcggccucuggcugugaguaacuuaacuucccugucucuggaggaaguuggaagcugcagaucucaaagggcugugcgguuugcagaaaggcagccaccucagggcccugcgccucuagccagaggaagggggaggagaggucugcaccacuuugugguggacccugggccugcaccuucccagccaggcccucgcccaagcccgccagaguccuuccccagcuggccuugacccuucaggcaggugugguccauuuccccggcuaugaaggaggucuagccucagcucccugcugcuggucuccuccucuuccuagagacgcaaugaguaauagccagcugccgcuuuuuccccccuugcccccaggaacccgcaggggcuuguggagugagccagcagggccgguuuuuccuggcuccaucugcagccuuggaaugcccagccuggguuacuccaaagccuggugggguuggauaggagccuucugggggggggggcacguuaauuacccguguuguggcaacagccacaaacccucuaugaggcccaacccccaccccuuucccucucucccucuccugggaucuuagggcaagagagcauguuuaaccugcagagaacuacguuugaggugacauuucagccccguggcugugcggcagaccugccgagucacuuuaauuucugcccccauggagucucagaucuccgaguccuggccaaaugcagcccgccaguacugcuggcuucacuucccacuauggccuuucucuccacccccccccccccacaaggcacacaggccacagccuaggaggugacguuucugaguguuccugucaaugagaauuuaucgagugccuccugaacccggccucgcacucacugcugggagguguacagacagaugaaacgagagagcauccaacgugcugccaaugugcgcuccggaggccuuuuaaucuggccucugcagagcaucuccccaccagcuccuuacacucccucaugcucuccaccccagccagauaaagcuacuugagcagucccuuucuggcaaaguccguguccuuguacagguugcccugggucuggugggcuccaggcacacccgcucuucuccccucggugccugucucucugugcccaccuuuuagaggccaggagagugacagcuagccucagggagacuaggccugaagggauaacuguaguaacagggacaucuugaggacaccagagucuguucucagucaccaugaaaaaugggggaaaaggguuuggcuguuagggauucugaggaaagagucaucauuaacuggaguacgggauguguggaaaaaggggggguguauucugguuucugaggaucaucauugacuacaguuuaggaaaaaagcaccugguauccaugucaugccuccauucagaugaacccccaucucugggaugggaccuagcaucuguauuguuauuuacuguuuuguugggguuuuguuuguuuguuuuuuaaaauuuauuuugcccaguguagugguauaggcuucuuaauuccagcagucaggaggcagaggcagaggcagguggaucucuugaguuccaagauagcuggggcuacagaaagaaaaaaaaggggggggggucggugaugcuagagagauggcucagugguuaagagcacugacugcucuuccagagguccugaguucaauucccagcaaccacaugggggcucacaagaucugaugcccucuucuggugugccugaagacagcuacauacaguguacucauauacauagaauaaauaauucuuaaaaaagaagcugagcagugguggcacacgccuuuaaucccagcacuugggagacagaggcaggcggauuucugaguuugaggucagccuggucuacagagugaguuccaggacagccagagcuacacagagaaacccugucucgaaaaaacaaaaaagaaagaaaaaaagaaaaaaaggauuuguauuuauguguaugugugaaugccuucauguuuguaucauguguguacggugcccacagaggucagaagaggccauuggauuccccugaaacuggaaauguagaugguucggagccaccaugaacgcccugcccauccagucauucucccugagagcuggaagugcuuggaacugcugagcuaucuccagccugguuauggguuuuuuguuuuuguuuuuguuuugagacauucuugcucuguuguucuagucaagccugaaaaacuuuauagauagacuggccugaucucaaacucucccggucuuugccagcaagggcugggguuaaaggugcgcugcuguuagaaaggcaugcaucacaccuggaguaacagacaacuuuuugugaggcgcucagcguuguagccuggacugaucuugaucugugucgucuugugauaaggucuucuauccaacggcuggccucgaguaucugagggugaccucggucuucugguucuccugccuagacuccuaagagcugggacaacagcaugagccaacaccuuuaugcagcagagaagagagcagugccuucuacuugcuaggcagugauuguaccggcuagucuugaacuauuuuuggcuuuguguuuuuggcuuguuuguuuuggguuggguggguuuuuuuuuguuguuguugguuuuuuuuuuuuguuguuguuguugguuuguuuuuucuucucccauuaagacggacuucucuaaguagcuaugguugucuggaacucucucuguagaccaggcugcccuugaacucacagacaucugccugccucccaagugcugggaucuaaggcgugcaucagcacagccgcacagccgggcuggucuugaacucuugaucagucccacccuuggcuuuggggcuucugcacuguuuuacacccuugguccucguacuggaaccuccucccccuagggauaaugacuggguuugugcuggccuaaguaugggccagaacccuucgcuguugcucuguggcucauuccuuaaguuauucuuagugggaguuuuggaggugcugggucagagggguggggagagauggagcuggcuacagauggcugugagauggacgcucggagguccugcuuugagagaaguucaaauaguaaugugugugccccagacagugggcugaggccaacagugauagaagggcuaacacauccggguguuuguguguguguguguguguguguguguguguguguguguguguguguguguguacguguguguacuggcugcucugcaucucccagccaguguguuuacagccuggguugugggccucaguggcggccucugaccuagggcagguggcaagcgcaugagugucugaagggggucccugguacccacaagcuccguaaagggugauggugucccuguaauuuauuucaacacagagccagguccucauggugagcagcaaggggacucuuuuccagguauaaauuagccugccguguggaguuacucagcuguucuggagggucaccuggcuggggucgccaaaaccaacucagacgccucuguacaccuucccucccccaaccucccgcucccuuggaaaccgugggcuuacacuugggagccacuccagcaugcacuggccccuugucucugccccucugcacucacaccaccggugggccugcggcugcaagcagccauaaaagggaucgaucuguacggcuuuuggucagagcuguauugauguuggacagguuaagccgucccaaaggaaaauccaugugucgagcucacaaacaggcucacgaggggcgggggaggggcaggcuggggcugcaggugcugcuuucaacuaauccugggcuugucccuuuuacggggauggggguggggggagaaaagagggggguguuggggggucaggcccugacaguaucuugccauacauauuuggggcaggugacuuccuaggaucucccagggcaagcggagcaccccggauccaggcaguuucuggccagauggggauaaccugagucuuugcauacagaugggcucuggccucucccaccaggcuuccugcuuguggucagacauuggacccauggggcaguaugccaggcuuggagaaaagccagacaccaaguuauuuucuguccugacuucagaucucuccccaagggacagguugcugguguggaaugaagggccuguguaaacagaguggaucuuucccagucgcugcuggugugugccugucuuuuguuuuugacagauuucuuuuuugcacucagcgcacgguguuuuucucauuugugugagagcagggggggcccccaugguagcaggugcaucuccaggugcggaaaccucagggcaaacaguuaggcuaaccccuuugccccugucuucugccaccuguuugguggcaaaguauggcuuccucacgccaccauggcugagaauaugguccuagcauccaccuuccagucccauguagccacuagccucugugcugcucuccugaaugucccugaugauccccgaccuccccuggguuggggaggcguaugcuguaauuguuuuccauccaggugacccuuccucagcuucuuauuucccugagugugucuggugagcagauauauauauguguguguguguguauacacacacacacacacacacacacacguacauauacauacauauauaugagucaguagccaugccuuaguccuggagccucagacagaccuugucauuuaggcaccggguguggcccuuaacuaaagaacagcuaagguuucacuaguugcucguaagccuccaaguucaaggugcugugcagaagucccugacuucugaugucucaacuuacucuuugaacuuuaugacagaaagcagugcacgcuggguagaaagcacacuucagcuuuucucucugugugugugugugugugugugagagagagagagagagagagagagagagagagagagaguguguguguguguguguguguguguguguguguagugugggcguggaaacuccagcuuugggaguugggguggaugucacagaccucuuaucuaucacuggcccuuugggguuuuaauuuuucuuuaaagaguuauuuauuuucauuuuauacguacaaguacuuugccaccaugcauauaugugugccaugagccuguggcggccucugaggcuagaagaaaguguugaauucccuagacuagaggguugugagccaccaacuaggugcuggcaacccgauccagguccucugcgagaauaauaacucuuaaccacggagccauuuccccagccccacccccuuuauucauugcuaugaucuguagcccaggcuagacaaccauagccaacugacugggaagcaguggugaccuugaacuuugaacaucaacuaauucauuaugaauugaggccuuucucuagggugcuacucuuuggggugccccucuguccuggugccaggcagcagcaauguccacaguuaccugcugguugcaagggaacuuugccagucacaaccauguugaguugguuggguugugaaugcucuuuuuuuuuuuuuuuuaagcccuggcuguccuggaacuugaugagacuggccuugaacccacacaagagauccaccugccucugucucugcugcugagguuaaaggugucugccaccaugcucugcuguuucuagccagaacccaugaaguaggcuggagaauugugggaaaugaacugaggcauucugggagguugacuggaaguuugauggccuuuguacuguauacaucgagccuucuaccagcauggcuguugucaagugugacuccuuuguuggccagaauggagaagggcauauggaggugugagcccuuuaagucuuaaagacagguuaagcaacccugagcugagaccacccuaaccgcuccaaaaucauaaccgguuguaaacaccgaugucgcuucagaguagaaaacucuauaccgcggaacuguuucgucccucaaauuauuaaaauuaccaugcagggccgggguuauggcugagaaauuguuacugaucugguaugugggaggcccuggggucacuucaggcuugggacuggagaaaccaugcuuacugcucuccgagggggcaaaaguaaaguucccaaaacccaugguggggccucuccuugccccaccccagcccccagggugaguuagggagccagugcccucccuauucuggcugccucaggcaccugugcauguccacacauauaaauaaacaguaaguacauucacuugaggccaugugucuuccuguguagaaagcagcuuugggucuugaauguagaccugaguuucuuccccagaacaccaagguagcuuaccgugaccgugcagcuauuccaacuuugaaaggucacuccccaagcugcuguucccaugcauuucaagucaggauuauugcagccugcagugccacagaaaggcauggugggacgggugccaccugcuccucugcuggcucucaccugcccccuggguggagauguggauggggggaacuugguccugugcuuagccagccuuggcuaugaggauugucugcccacaggggagucugcgcuaggccggcucccagggccuucguuaggucugcugcaguguagggagggucaagucuggguuguacucugagccugcuuggcuagagguucccaguuggaauccugcagaauguggguaugcuugaguugccagggugacuuggguauaggugguuggucacucaggggcaccuaacacaugcacccuggagacggugacauguuugcccagguuuguagcuguguguggaggaaguuuuucucugauggaggaggccaucauggccuaagggucccccacccccaccccccgguugagaauuuuauggugucugggcuuggcauguuggguuuugaaggugguagaccagucugauauugaggcacgguacuagagcuuucuuucccucaaucccugagcgacuuuguccccaugcaugguacuagggaggggcauuaguuaggaguggcugcucaaaguaacuuuguugcacaagucauuuuacauccaagccccaaggacccagcugccacuuuaaacaucugggggaguggagcuuuguguguaggcaagcaggcuguuccugccauacauccuaguccccaaaggggucuuuuuacauuuuucugucacguuccuuuacuuguguguacgucacugugggcaugugaaagucgggggacaaccuguaggaaguugggucuccuucagacccaaacuguuggccuugguggucaggaccuuuucugcgggcccuggggacaagccacuugccugcuuauacucugggccaaauccugaaucggauuugaguggcgggcgaguucgcuacaaucugagagggacccuccuggaugggcccuacuuccucuugagucagcaacguggagccugagagucccagcgggacccaguguuucagcucccguggacugcgagcacugagcaggcuacuugugaggccagagcuggggagcguggccaccugagaccuagaggccagcacugggaccccugacuuggggaucgguggguuuuguaacucagcagcuuggaagaaucucaaccgaaauuccauacuaaggugauccuucugggucucacucaaacaacuuaaacgugacuuuaggccagagacacucagcccacuauguccugcgcagccagaagaaacagagcgugguugucucuucucccacgcuuggcaccuggaaccugagggugacccucaaaaguggccagccuguguuggagcugucacuggcugggaccaaggggcuuguaucaaaccgugguuuccauuagggcaaggcuagaggaaaacagccuggccuugcuguccccagcccuccuuccggaaucuaccugugaccuccuccuauagcaccugcugauaaugcugguauguggcuggugugugcccuggggagagguuuguguuguaacacuucuguccccacuucccaaguagcccccugggucugcugagcccccagccaaaacaggaaaugggaguggagggccugucuugguggagccugagaaucccuggggaacugggcggcacaugugcauugcugccuuccaggugaccacucagggccuggccucgaccugcuggccccuggccugcaucccauggagacucggaggcacguaaccucaguccuggacagcuugaguguuuguuuuuggggacuuggggaggaggccagcggccggugcucaaagggcucuuugugaccgaugaagcccaaaggugccaugggccacucggggcucacugggguguacagacacugcugcugggugauguugccugccucugucauccugucguccucggcccuccguaucaggcauggugacaguggugcgcggugggcuccccaggagcugacucaguggacauuacagagaugacagacucugagccuagaugagguguggcucuugccagccuuggucacccucuggguaaaacacccgaaccggacuggguaauggcagagucucuauguccgggaggcagguugggccagacugagcagucaggcugaggcgaggacacccugaggucccuagucccuguccccguccccaguguuaguaagcagcugacaaaggagcccagggaagggaaggaucuugccugucucaccugccugucacugugguugguguguggggucugcugaugugaagggugccaugccuguguguaacguuaugguuauagaagcccugugcacaccucuggcuccaagccagucccaccuccugcugcugucaggaucaccauuggggauggugccgggcucuggacugucaacccucggcggugcugaccacuggcuucccgaccucagggacccuuuccuccgguggguuuugccgagcuggugugggguggcuguguagccuccuucgucugcccacgccaggcuucucacgaagcgaagcacagcgcagcagccacuuagaauaaucgcgucaaaugucgcugccaucuguugccaggcuccaucccugcugccgccugggaaccucugagacuccugcucuguugcuuuguaccuagucaggugacuuccuaggaggccugucuaacaucuacagccacagagccucauggcucuuuccuccuuuccuccccugcucccucccucccuccguccuccgccaugccuaagugagugcuuuacuguugagcucauccucagccgccuuuuuacuauuuuuuuuauuuuauuuauuacuauaugugaaguacacuguggcugucuucagacacaccagaagagggcggcagaucucauuacagaugguugugagccaccaugugguugcugggauuugaacucuggaccucuggaagagcagucagcgcucuuaaccgcugagccaucucuccagccccaugacuacuuguuuuuaagaugaguuuucaccaagucuaggucggcauuaaacccgugguaccccugccucugcacccugaguucgggcgccaucccucacuguuaccccuuucuuugcaccuuuucgauccaccacgugugggucuccugucaguacucccauuuuuuuuuuucagaacacugagacagcagggccuuugacagccuagggguggacagugaaaggcuuggaguuaccaaaagguccccauucucugcccucccauggcugcagggaaccccagaggcugcuuauacauccauggcauucaugcugugggcagccccuccuguccuuguccacagugcagagguggguaaccucucccaucucccucccucauucugccuggcugccucauuccuccccugacccacagaucagagccccugucauacccaggccacccccacucgccugcugcuuucuccgcuuucacggucuugggucaggagucaccaucugcucugcucugcucugcucucccgcucugucgccucgugcagggguuccugggggaacugaccuugggagcagcggcagaggggcaggauuuagcggccugcgggguacacucaccguugaacaucagcaggccucccugcccccgccccggagaagcugccucacaugggugcgcucagaacaagccggcggcggcggcggcacacauaauaaugaauuuauuaugaagccguccaggcucuggggaucacgugggcaccccacacuacugcagccgccaggucccugcagcagggugaccccagccuuguuagagcugcaaaagcaucacccucuggggcgcggggaucacgggggugggggugggggcguggagcccgggccgacccagucucugucuguucacaaacauuucagugugcgguaaugaaaaaugacgaaggggcagauagagcauccagguccacacugccugagagccuugcucugcugggcacagcuucccuggguguaauuaccccagggugaggggcugcuggcggaggagggagggacggauuggugcuugaaccgggccuucagaaaauucaucucagcuauuagcugguaauuacagagcagaaggagcaagccugaggucuggugccgggaggagcugggaugaaagggacgguaauuacggccucaacgggagggaggcugggcugauuaauaacuccugauguacugcaggagggaaguggcacugagacccccuccaccccaucccccaccccgugaaccccuucugggucaacugugcaggaccagagcgaggugaguugaggaguaucaucugccuggugcucuggggucuccuuccuuggcacugaugauauuccugggcauguuaggacccuaagugggggaaucgggcaggaugcaccaaggcagccaggcuguccccagcuauuuuguggagauaguagcuucugacagaaacccgagcucuggacucugggucuagagaggggagagcugcggccggccagcuugagagugaacguuuggucgaggcagcaggaaggagccuguguagagugcccaagaguccacuuagauuuaggcugacuuucucaccgagcugcucgccuggagaacauggacugcauggacugcaggcagccccgggccucauccaucacaggcccuugcuccacagagcuuauucccaacuguuuaggauaaugaauucgcaggagccaguccuauagaugacgacggcugggaacagagaaguuaauaaauacccccuaaugaggacagggagagcaggcaucccgugcccaccucucuccuuuccgcugcccccccccugccugccacaccugagccucuacggacaccgguaccugccuacugaggugguuucuucucgggaugccaggcacagaauagacacuauaccuaguggcccuaggcccugugagugaagaggacucuucagcuccccccaaaauuuggcaguguguccuccucuuugguacccggggccaguuccccaccccuccccccaccagccccaugugcgcaugugugaggaacagugcuaauuuuagacucccccuaaugaagccgcucauuuggaauucuauuuuaagggagcugacaucagagcagcuucccaggcugggaacauacugauaucuccagaaccuaggcuuggggucccccacccccaaggguagggggccaagggcagccaugcccugggcaugagacugcuggaggcccuagggguggaucgguccccugcucucugacaguuggaguccuguuugggcuacccacaggagcauggugauagcaugugguacagggagguccuacccaucacaaauccuguuaucugccauccugccaagucugguggguccagcauauccgcuuacacccauuggcaucuugaagugcccccuccccaguggcacgguccucuccucagauuugggggaugggccuacagcuguaccgcgagcugcugcggcucccagcaucuccaucugccaugcugcccaccuggugcaggugguugggugagacacugaaccuucaacccucccgcuggaucugaggcagcuugcuucacacaggacauagcucuucccccagaguggucccggcccugcucccaacccacccuugugcugagccuacccacucauaucuguggaaugaguccaaggacaccaucccuugugauggcuccugagauggcuuugcacugucagcggcagaggcugggggucaaauauguuggcagaguguuucuuggcuucugauggguugaggugaaccacucauuccagauucugugcaauaugcaauauauuaaacugccccaagcuugguguagggaguagaauagcgucuccuagugccuggagucucuguggguccacgacagaaaaggcuuagcuggucugguccagcucagauugcugcuccagggacuggaaggcaagaagggguucccacccccaccuccccaagcugaaaacaauguauuuguuggaagugaguugucagaaccauuuacacacaggccuuucucugugucuugcaggaaugagugacaagacuugggggacauguuuuaaaucaccggagucguguaguucugagugaugaggcguagcaggguucaggcugagugcggggaugugagaacauuaccacucagcugugauagcaggccagccucggcacaccuggccucaguuucaccaucugcacuccuugagauccaaggaugacugagaugcuggccacaaagaagggggugguguagacagugccuuaguggcuuggcuauguuccgaaccuuccugauccugcgacccuuuacuacaguuccucaugcuguggugacuuccaguccuaaagagucaaagauaucggggcccacagguugagaaccccaguagcuuagagagccacccugauuggaucuuaggagcuguccccaggaugucauggcuaccugauccccauuacaaagagggccugguauggacacaggucagccuccaggcucagcagccugcugcccccgggacaugacccaugcaccacaggaccuggccaccacuggaagccagccagccugcuugcucugggcaucuuuguagcccuugcuggugugcccggccucagugaccucuuucuugcgcgcuuacuuugggggcacccacguggaggaagcgggggugagcggaagugagagauuguucugcggugcggucucugugaaggcgggccucuuucccagaugaugggaagcaguaccaggauggugccuggaaaagcugaaggagcgagagugggagguggcucccgaaacccuuucccucugagggaaagaccagugcauccaggcuacaacgugguuucaaaggcagauuucauucuuccgugucuucaggcccugggaccuagggaaggacuucaccagggccugcagugagcuguagccuuggccaccaucuccuaccaccugggggagauuggauaugagcagagugaggaagagacuggccccggccugagagagaguuaguuaggcacuggguaugcguugaucccacagacaggccucaguuuccuucuccguacaauggggcaguugucgagccggccucuugacgcuguugaagaugucaaugguuucguacccgugcccgucagccgcugcuuguguugucuucucaguuguuccagcccgugccuugucucucuggggucugguggggcucugcauauggugugucgggguaucccauaggccuggcucuggggagccaguccagcauucagcuucaaccggggugccuuuagacccgaggggccagcaggacuauggggauggguccgcugucugcaucgcuggcugugcuccgcucucgcagccccuuggcucucgcugcaugccgcugcagugcccuggcacuggcgcucugcucucugggugacacugguucuucuuuuccuguuucaggcaugagccaugagcccaaguccccuuccauagggaugcuuuccacggcgaccaggaccaccgccaccgucaacccccucacccccucgccacucaauggcgcccuggugcccaccgguagcccggccaccagcaguacgcugucggcccaggccgcuccauccuccagcuuugcugccgcacugcgcaagcucgccaaacaggcagaggagcccagagguaagaggcaccaggccacucgcucaugggaugcccccugcccacugugcaucucucuggcugcuguggccacaggagacagcugucugcagcuugugguacugcaccugcaucuccccucccccaccacauccaggcagagcuagcccggguguagccgucaaguguagcugucaucauaccucaggcccugaccccugacaucugaccccagcucugcacccugcuucacugugccuuccucugugccugccucugccuuccucagcuucaguggcuacuguagaugcuuauugguggacaaguggacuugccauuggggacgccagugggaccagagauuggccuucugaagccucccaagcugaggacaucauguugcuuugggcaaaggcuggcucuuucugaauucgguccuguugacaaaagguucucuuagguccccuuuggaucuggcuuuggacacgucuuguguccugugaugaccgugcgggucaggaaugaguggcacagaugggucgguuuaugucugaacuugggagcucuucagauucuggcaacuccuggacuugcugcucagagaggcagguggccaaaguauggaaacuuugucucaaaggcccugggguccuacagagccaucacuuacacuuaggcuugcagagaguccgcucuggauaagugggcggggauuuccugauaucccacaguucucugcccugguggcuggcagaggugagggugugacugggaugggcccugaggguaccagaggagaaaaaguaguccgucugcccaguggaagacagcugcugccaaaggaccacaccugagccagcccaccuugguuggcugcuggccagguuccggugacccugaggaagaaguuagucugcccaccuaugccauccugggcucucccauuguccugcaaaauccuggggccaacuggucgggccgaguaccagaggcugcggugaauggaaacacggucgauucugaacaacaggugcauuauccaccgcgccugucgcuucuuggcugugaccugggcaucugaugcccaggaacuuugugccacaccgggacaaggagauggggcuggccgugccgcuggccgaggcuucucuccgccagccugucuccugagucuuccccaugugcagauggggacuuggggcuugcgaugcuuagugucuguggauacaggguagcuuggggacccugggacauccugacacugguguccagcugggccugggcccucgucugcuaccuuacuggaaacugggugucuuggcagcgcagcgaaguuaaggcccaccccgcuagucuucagguucucgucugugucgccaggacugguagugauucucugucaccucgguuuggaccugguguugcugaggugacauguuguacggauacuaaagcuacugcgcggaggggucguguugugagaccagggucccgggagcgcauccuccuguccccugagaggacuuggacaguuggaacuaggaauuucaagcacguggccccggaaggagggagcugcuuucuuguucagcgagcaccaguguggugcaggggcuuggcuguggagagcuguggagagcuggauuggccuccccggcuguggguugccaguuccagaauacuucauuccacaagccauaucuuaaguuggggggagggggagggcuguuuauuuguuuuuguuuuuuuguuuuuuuucugagaggguuucucuguguagcccuggcuguccuggauuucacuucguagaccaggcuggccucaccaucagagaucugccugccucuugcucccccaucccccguccccccccucagucccgggauuaaaggcgugugccacuaccacccggguucaauauuuucuugagaucaggugucuugcagcccagguuagccugggacuguguguagcugagggugaccuucaauuucugguuacugggugauggacguacccaacucacagagugccggggagcaaacccagggccuugcgcgugcaugcaagugccaccccugagccggauaagccauucccacucagcuuugauuacacaugcagcuuuuagcacacauccucucuagcaauccagaacauguuuuguaucccccgcaggguuacccuuuucuggccuccccccccccccccaugauucccugucuuguugcuccauccuuugaccccacugugcaagccaugcuagucacauggggaggcaggugggacaggcacccucucugggcccagcaccuaccugguaucuagcuguggcucuucauucccugacucuccagucugucugugucccaggcaauuccaggcucauguucuuaggcccccacaggacaggcaucugagcugccgcgccugagagcccgugguggcucucagcccaccccagcagguaagaaggcucuggagugaaggugggguguccuccagaacugcugcugucaccccgcaggggccucgcucuguguccccuccgucccugaggcucugccccgugcccacccuuccuggaaacaguuguauuuuuagcuaucugacugggcucgccuaggcuucugcugccgacgucucucuucauggugucucaggggugcaguugaaaaauucaauccagacaacgcaaucagcaugccgccucauuugcucugcccccuccccgccagagaaaggcagagggggagggaagagaagcuagccccucccaagaccucugugggccccacaggggauaucccaggcugugggccccaucccaugugguagucguaguuaaggcaaggccaagguuuugccagaagacgcugggauucaccgggccaggcccaguacacauccuggcacuuuuaaucacuugcugugcccugguguguuggcuuaacagucugagccucagcuuuugcccagggccagcaggccaccacuggcagucuguugaucuagugauagcauacagaacggaacacagaucacguaauuaagugcggcccccauaacugccuucccaagugcugucgcuggggcuuccccaauuguccccaccgccauuuucuaauccuguugucccuguuuaugccccaccccaccccaacucccuaaacuuggcaacacccagggucagccauuguggguccccacugcuguggucccagccuggccaagccuagguagcugcuuggcccacuguggccugccaguggugcagugggugggcuuccaaggaggauggagggcgggggggagcacccugacuucuacccugguuucuggaaggagcauugggcuguggauccagcccagcccccaggcuggaccccugggucuguccugcccuggcuucuuaaguuacuacuauuacuguggacucugaauaauguccccagggugcucagcuguccugaagcugccuccauccacguguggcuggcaacauuguagcuccagucuuuguagaggcuaggauccagucuuuccuccaaguagcgcugccccuccccccagaggcccuuaagccucuuuaagauuccaucuuucccugugcugggagcccagcuuggcggguguugagcacuccuaccagcccugucuaucaugcugcccugguggggggugggggggacggggguguuucugucuuucugugacauuagcccagcugccuugaaggcaagggucccccagauugcucagugggcuuaguuaaguuacuuugaguaaagggguacugggagcuucugggaucuuacacccagagccacgucucaagccaccaccagccuggccccaucugagguucucagagcagagaggcucuuuggccucugugagagcaagcuguaagaguccccgccacagcccccaccugugcgagaugaagcugggugcugcugccaggcagggcccaagcuguguggcaaucugcucaucucccacggggcccuggugccgucugccgaggggggugggggugcgacgguagcccacaugucccuggcugaucgguagaagacccacacagcaccagagcuguguguacccucaguuccaguacacccggggccuugggcccccuguuucccaggaagcacaugggggaagagccgccuuauaccuggcuauucgccacuuugucaccuguggggacaaggguagcuuagagcuuuuaagcuucugauuagacaucccuagugcucugaacuuuccggaaaucuuugccaccugccggcccuguaaccaaggggcgucaaguuaccaugggugguggaugaaacccacccagccccugagaggcagaggcuggggaccaucccucuggguuugaguccaagcagccccccccccccccccgccugcaugucugcuacagggugggcugggugcaggcugaaacacacccuggguucaucuccuuggaaaucugccucuuucaaagaaaacaaccaaacaaauggccugccugccugccugccugccugccugucagucuacagcuggcaagguggaggcaucuucgcggggugucuggagccccaucugccugugucucaggugugagcagcggggcuagcuauuguggaggagagagaccaggauggggagggagaaccacccagaguccagagccacagcuggcccugaggugacaggaggugagcaggguguauggacaucaggaugaugguccuuccuucuccaccccucuuaccaccucuccuuccuuccucuuucuaucccccaucccacgcccacccccacacaaucuucauaguguccuaacacggcaguggcagugggacagagcucagcuccaagggauccucacuggcuccugccagccucaguucucaggacuggugcugugguuggucacggcacguucuuugcccaacagguguuacuggaaaguuaguuucucucaagucacagccccuuccugacugcugacugggguuuaacggcaccgccaccagccccguucccucgcggauggacacugaggccacccagccuccagaccugugacaugcgugaagacacacuggcagagcaggagaagaguccuguccggcagcauauggccaccccgugguucaguuucacugucuccucaaagcugcauaucauggcggauaccucugcuggaacuuccugcugcacgccuggcuauuugugcuacacucugggggcuccagagcacuucccugccugguguuugucacugugcccuugguccuagguccccuucgcugccaguuccucauggugcccgggcagugguugggauguaguguugguuggguuuauuucuuguuucuuaacacccacccccacaacuaacuggugggagucgcuugagucugcagggacaagagggacagcccugagaugugggaccacuucucccagcagggaugucagauaagaguaccugcugugcagagauccagaccugaguucagaucucuagaaccugugugggggaggcagagguggaaggaccaccccccccccccuugcuaagcuggucacaccagucaagcuccggguucagugagagagucaguaaauacagggagagccguuaaggaaagcaccugaaaucaucuugcgugcucgaacugacaugcacauauucaacugacauauucagggaaaggggccauugcagguguuguucagcaguucauaucugcaccagcuggcuaaggcugcccaagcucuugccuuugggggucuuggcucuuaauaacacggacugccccacagggccuuggccucaucuguggggucagucagcaaaggugaugcaggcaccccucugccucuucaucugcagcccggcccuggcucucugacccauucccaccacucuggcugaauagcuucaguuaauuacagcgauggcggaccugccugcuccggcagcacagcuagagagaaagagagagcacagggcugggagccaggcgccagccucgcuaauuggcagcgccuugugagguauugaucccagggcucucgcuggugagcacuggccucugccuuccaccuccgacgggauuaggcugcuaauuguccauggccagccucauccucucugagccagccccacacuagagccugccugccccauacucgucccuugcugggccaggcuauugcuagcaugggaaggggcagagaggggccagcugagcuggcugccuugggacugcccugucccuuauacagacggcggggggggggguacagaggagcuaggauggucccugaggcaccaucugauuucgcccccugaggagggucauuuggcuaccuaucucagcagggcccagagcccucaaugaugguccagcgccugcagucaccuggauaguuagugugugagacggccacugccguagcuggcgguggucuucuguguguggaaguguuaacuguuuuugcucccgugugaggauagcauguuccuggcccuuguguucgugucugugcagugggugggagcuacuguucacaguagcugucagguagggccaggcaacugucccauggcugaagaauugggggaggugacuugucccccucggugauggucagcaaccuugagguauggauggaguucugguuugggagacaccguucagcagagggggccagggaaugcccagagccuacagaugucacccucucaggcugcugggucucaggggcggaacaggcacggcugcagguuauaaaaguguuccgcagguugaugguggugaucaagcgagaaggggggggggcuggcucugcugagguggcucuguccuuucaucccaggguucagauggcgagggcaggaggauugccaugaguccagaccaggcagggcuccagcuugagauccuaucucaaaagagggggaggggaggaggaguugcuagggagaugauucagucaguaaaaugcuugagggaccugaguuugagcccuagaacauaccuguuugaaggcaggcaugcuaucuuccacucccaaucucaugccaaggaaguauggacacacaaagcccuaggggaccuccaccccccaccccccgccauucugucuagccugacuugagcuccaggcuguggagagagccugucuuagaaacaguaaguagugucccgaggacugcacccaagguuguugucuggccucugccacauguguacccgcacacacagauuuccgcguacacagagaucgauagcguauuagacaugagcaucauaccguggcuccccugggaaggaccgcgcagcacacccgaacagguugcuguuuuaggcaauaggaggauuccuaaaaauaaugugaaagugauugcguuuuugccuggcguggagacaaccugauugucagcucugggccagcuugggcugaaaaguugggccccugccuuucuguccauccauccguccguccccccccccccccaggagcuauguucuacccuuugagguacugucucugagcaaggagguugcaucccacgcugugugcuugacucggcuuuuucuguuccauguguccucucgugaauguggcugagggccuuguuggggcauuccuguauagaauaggcagggcugggacucgguauagcccaaggcugugggcaugauucacaacagaccgcauggacuuucuccgggguguuuaguugacacuuuuggacacauacagugacgggcauugcaggccuaggguguggcuuucuggccccuuggcuuucucaggugcacagagggauacccuccuacugaaucuagggagguauagaaugccacgcccucccuggcuccugaaugguagcucgcucgugccaagguucuuggucaguccccaggucuggcugcaccaaccgguagcuugccuccaucagcucccagaagcuggccucccgagccaucgugucucugagccuagcugcucuccugugcuuucugacuggcaggugcugggcggucaccgugcuggguucacacugcccagccuuggggcuugcugcugcccgcuacccacuugagacuagagaguucucaggcuguaggcaguggguguggugcccauuggagaccugagagauucuucccuaggcuccagccuucagccugauugcugaggucaggcccugguagucaugugaacaagaggugugcuuggcuggaacugcucggggcacugcgcuguacaauuacacaaguuacacaugggccuccgcagucaaagaggccgugccauguguccgcagguagcaugauugucccgggaaagagggggcuauguuagugacagagaccaucccucacuaccaaguucuguuggaaccgacacucccaagaacuaagcugccucacuaccgccaccuaccugccccucuucccuuuugcugcugggggugguuggcaagggaaacacauugcuucuuucuggggucgugaggcuguucuggguauaguagcauucacucaauauggccgauccaccggagguacauugacgugguuuuaaaagagugagugacaucucagauuuuuuaaguguaaaaauagcucuccaccuccacgccugagaggcaguaugacaagggaggccacagaauggcuguggguccgucccugccugcccgcucuugggccucacuccccaugagcauucuggaauggcaagacgcgugggcgcggugggugguggugugacacacacaggacccugagcugcuucguucucuuuccgcaggguccucacugagcagcgagucaucuccaguguccucuccagccaccaaccauagcucuccagcuagcacgcccaaacgagugcccaugggccccaucaucgucccccccgggggucacaguguccccagcacucccccaguggucacuauugcccccacuaaaaccgucaauggagucuggagaagcgagagccgccaggugaguggcgccgcccagaggugugggcgugguggggguaauggggauggaggcgggguauguggggguguuccugcaggcuguuuucuguccacagcucuguugagaacuugaguugggggcgagguugaccucucacccugguccucagacucuucugcuaggugagcuugauacgcacccgguacuggaagaugcuaggauuaaggcaacccuuacaucagacuugugacagaguaccacaaauucaucguugcuugcuuuaggaggccagagccucccuaagccuggggagggagggggucgccaaggcccugccccuuuacacaguggugucuuauuguguccucugguggccuggacggcaaucacuucuuuaggggucuacauacccagaggcaccagguugagacagacaacaaccauagagugccuuggaucuuuggcuagacaauagcugugacugcuuuggaggaguaggggcgggacuguaggcuaacucugauggucccugaugccagccagcaccgggguccuugugucugcagucucuagcuggccauaaccuaacugcaguggaggagccagccccagagcuuccccuguacugcugggccucccggcggccuggcagccuggcgccuagagggggccuugcuaauuaagaaccgcugucagcuguggcuuucccgggauucuccagccccauucccagaggguuuguacugcuaggaaguacuaauuaaaccacagagauggagggggaggggaaggagagcaccucuccccgcuggggcagggcaggauaggcaagagugugaguuucaucugcccuucaggucugauugguguccccaguaaagugcuuggagcauccaucaggcuccugacugaagcgugggggccagccuuggcccauuccuccuguggcugaagucacacuuaacccugggaaaccugucugagcgauccugucaucgaaucucagcucagagcagccuagacccacccuguccuggcuuaagagaagucagagaaguugccaccgccaaccaucuccugucuguggacuccugccagagcgcagcuuugaccucagacaaugagucagcugauaaaaacccccauagagcuucccuucccuggguaaccagcuugccuggugacuggcuuugcuccugagagagaagcuggugggagggucacuuccuguuccugccuugggccccggagcuucugcugacuggagccccuggcccagguccaagacacuucauguauuguccccuuggagaacuaggagguuccaagugccucugccucgugacuccucugcccggagccugucacuauccucagaggauccuuacugccucagaaacauuuaguaacccggagaagggcucugauggcucugcuccagcaguucacgcugugguuaacaagaccugcucgccaccagggagaccgccaccgccaccgccaccgccaccgccaagcacacacacaguggaugaugcucagagcucagcagagaguuuaauccuuuccaggagggcgggggaugcgcucucccuguaguguggccaugagucacuaggggccucuggaggcaacauccacugguuggaagucaaggggguguguggcuccagggugaccaggcaguggaagccgcgugagagaugaaugaagaacagucuggaaacuaacgggcucaucccacuugaccagcuguggagaccucacucuaaucacuggagaaugagaguucucuccuucccagccgcugccuuucauggaugcagcugugucuuggagcagcucugcagacauaucuugucugccacagcugcugccaggagggugcccuggggcagccaccaugccggggcuuuuucuguccuugucacccaggcagcacccugccccacagauggccugguuagccagguucuagucagagaggccacaggccugaggagggcagcagugugcaaaccccccuuccccccacccccccaauuggccugaugaccauuuuuucuuuucucuuuuuuuucucuuuuuucaucuuuggggcuauuuuuuguuuuuuguuuuuugguuuuugguuuuuuuuuuuuuuggagacaggauuucucuguguagccuggcuguccuagaacucacucuguagugcugggauuaaaggcaugugccaccacugcccagccugauggccauuuuucuagucuccuuguuuguccuggugugagugggauaugugcccccaccccacccgcacccugccauacacaccuauacgguacugugugaauguuucuccugaggagggcaggucagaggucaugaacccaugaggaccccacaagggaacagagacagccugcugcugcacccagggaaggaaacagauguugcugcucauuaaaaauucaaucagcagccugucucccucaauuaaucguggcuggcugucuguggggagcaggagggcuugugguagacucugugagaauggaggcggggagguacggugcuaagcuguccucacucugcacacacaggguuaaguggugguacagccacgaccccuccccucggggcuuacauaugcucuggugaugcuagcugcugacccuggggauaaccacaaggagccgguagaauggcuggcaggccuguauccagagacaaucaguguuacuaugcuggcuaccaugagccuuucagucacaccauggguucagccauaucauccagaggaccucgugucccuagugagugccacugucugccuuguguugggcuucuccugcaguagugagggaagggccucaaaguuguaccaggaggcuccuggcccucagucuccccucugcuccguggcucccugacuuugccucucugccuugcccugaggauuccucccuagucacaggugacaggcaugcagggcuguugggucugguuucuccaggcuguguggugcugcugugacuguuuauacagaaaaucaguccgugaggcggggucuccccagcccagcccagcccagcccaacucaacugccgccucucacuuccugccugaagggagccucuccuggggucucaaagccuaaauaugugcaagggucccccacguagguccauaucagcugccagcaguguccacauagcuacgggcacugcuggaaucuagggagcagcucuguccugaggugcagguccccaggguguguguguguccugacucuaugaccacccuguuuugccuauaggaggugggaguuccuacccugcagaugcccucacaugccucaucuugggauucagcagucuggugucuaaggcuucccugacauuguugaguuccuucuagagcugagccagacccuguagaccuugguccagaccugcucauaggaggcuuucucccuaaauaccccuuuuaugcuuucuuugauuaaaaaaaaaaauuagggggaggauguuucuagaauauggcuccccaaaaccuaacucuucuucccgcaggacucuggcucacgaggcagcagcaguggucgggagcgccuauugguggagccaccucucgcccaggaaaaggcugcgggccccgccauccccucccaccuacucagcaccccguaccccuuuggccuuucccccggcucaguuguacaggacucccgcuuccaaccacucaaguaagugccagccuggggucagggaaggcacagggguggcuccagacagaccugagaguuugcacuggcagagguagauagaaugccauuagucucaguggccugaucugcccugagguccuuggccccaucugaccuugugguccagccuuuguugagacagacuuaucagguguccuaaacacauuuaagcccauccucugggucuggggaacagagagccccuccagcaucucuauccacucguggggaccuugagggacaggcagcuucccaucugugcagucugggcuucaugccaggcuguaccucacugagaggcaggaccugagccuggugagggaguguggcacauuaccucugcuccccacuucccccucccacagccuccagcggccugugcaccauguggugccccccagcacggugacugaggacuacuugagaagcuuccggcccuaccacacugcugaagacuuacgcauguccuccuugccuccgcuuggccuggacccagccaccgccgcagccuacuaucaccccagcuaccuggccccacacccauucccccacccggccuucaggugaggcguccccacucacgcugcccugugugcuaaucuguucucagcaaggcagaaccucucggggcgggcguuugccagggcuugggguccaggcacucaagggagcuauauagcuuuccccagcucgacugaguugagucuugauggauggacucaguaccaccugcugaugcuccuugguucccacuucucagcaucugcaccccagcagccaguccccacuaacagugugugguaccuagacagugugauggagacuccggagugagagucaggccaugcccucccucuuccuguagaagcuccuggccucuuaccacagcgggucacaccagaggucucugccugcagccagucugcccucccgcucgcucacccaugguccgggagguccuaggcgcccauguggucuguuccuuguggccccagacaguggacaugcucuuugcaugcagucucugcagggcugagccugagugagcaguggcucgcccagccgagaggcgccggcucaccugccugggucccggccuuucuccugcagugccagggauucaccugagggcuucgcaucugcuaggcaagcuuauccuuuguggcuccugcacacaccaguccugccucucugucuacaggauggaugacuccuauugccugucagccuuaaggucuccguucuaccccauccccaccccuggcucccugccuccacugcauccgucggcgaugcaccugcaucucuccggcguacgguauccuccugagcucucccacucgucccuggcggcgcuacacucggagcggauguccagccucagugcagagagguaagcuguguuuucagcagaggugggguggaggggacuguugagcguuccugagguccucagcggggccuggcuuggugguggcgggaugcgguucuuuguguguagguggcaacucuugcauguggcugcuccacuuugagcuggggcguggacuugcccccccugcacaucccuuuagcacgcugcccuguuuucccucccagguugcaaauggacgaggaacugcggcgggagagagagcgagagcgggaacgggaacgggaggccgaccgggagcgggagaaggagcgggagcgggagcagcgggagaaggagcgggagaaggagcuggagcgcgagcgggagaaggaacgggagcgcgagcuggagcggcagcgggagcagcgggcgagggagaaggagcugcuggcugccaaggccuuagagcccaccaccuuccugccuguggccgagcugcacggacuccgaggucacagcacggaggagcggcccaagcccucggagcagcugaccccaacccgagcagguaccugggcugagcuguguggagggaauggccugugccugccccagcaguaaggaggugccaucccaacgcuggcgagacugggaggaggugugcucugucacccuggguggauccaggaucccaugggugcccccagaacagccaagacgcuagggaggggaguugccaucacugcgguagaaccuugguuggucucugccuuuugccauggugauggugaacaccagagucacgccacugagauacccccaaucugaccuuuuguucugugucagaguucuaaagccaaggcuagccugggacucaaccgucccucaaauucauagcuaugguccugugucagcccccaaaguguugggagcgcaggcaugagcuaucccgaucuugauuuauuucaugaaaauuuuugugguugauguccucaaaaacauguaaguugcucugagccagccacacacaccacaucuccucucuccaaggaugaggcaguguuuccuucaguccugggcuccgagcacgggcaagggcacuggcgcccccgcagugaccguguuuccucccacagagaagcugaaggacgugggcuugcaggcgcccaagcccgugcagcacccucugcacccagugccugccccacaccacacggugcccagccucaucuccagccacggcaucuucucucugccuggaagcagcgccaccaccgcccugcugauccagcgcaccaacgaggaggagaaguggcuggcacggcagcgccgccugcggcaggagaaggaagaccgccagucccagguguccgaguuccggcagcagguccuggagcagcaccuagaccugggccggccccuggugcccacagaggcggagcacaggcccgagagcaccagguggguccuggguggggccucacgugaggcaagugaugcuggugcaaaagucugucuaucuguccuccugcuguuggucccauggccugcuucaucuucuguaccacuccagcccucagcaucuguguugaccuucagaauacagauaagucucucaucccuucuccuccaugcugagaagagcaauaccuggaaguaccccgggugcccaucccuggcccugcacaccucgcacagcuguagagaggccacucugaggccucgcuagucuuaaacauccugugcuggacaugagguucacgccaagcccgaguccucuggcuccucugccguccgcucggucucccacaucagccugguccuuuuugcugucacugcgaugggggcggggucacacaccccauagcuacgaacuguuaaaaugcuuguuggcuuguuggguguguccugugcuuguuuaucccuugcuguucagaaccugaggggagcuaaagaaacccugugcucucccucgccggagugaggggcagccuuggcagcuuuaaguggcgcuucagccagacuggcaagaccagaggagccuagcaguggccccucccccacagaccuuguucuuacaucuguguguuuagggcugaccacccauuugguagcuuaccccguugcuugucccucccucucacaucucuagcucuucccccgcuggcaugucagcuaguguuguugauauccaagucuugucuggguggcagcuucccugucaugccuagauagcacugccuaccugagggauccugguacguuggcuuccggaguguggggguugcgcuguagacggaccagucagggcugggucccuaaaagucaccuccuguccucugucuugaccaauuguggaucucgguaguagucuacugcaaaaagaggcuugcagaugcagcuccugccugggucuggaagaggccguggaccaaguggugaagggcgaggguccugggcagagcuggacaaugauauagagaguggguuaaggaagcuuuuuugcacaucuggugaggcaagcuggaaguccucaggccgagcucuggggcugcugcaguucuggaaggagccacaggggggcagcagcacagccaccaucccgugucugugauaacugcuuccucuccaggaagaaauggcucuccuagcgggaaggcauggugacagccucuccccauaugaagaguucacaccuaccaggcagucuggugugagcccagcaagcuacccugggcauucugggaggcugguaggcagcucugguuccaaaacccacggcuuugguuuguucuuucuaggccaggaacaaaccggcaugagcagggcagccgugaacccccacagcacuuugguggcccuccaccccucaucucacccaagccccagcagcacaccguacccacagcccucuggaacccagugucucugauggacaaugcucuggagacgcggcgggccgagagccacucucugcauagccacccgacugcuuuugagcccagccgccaggccgccgugccacuggugaagguggagcgaguuuauugcucagagaaggcagaggagccccggaagcgugaggccacaccacuggacaaauaccagccaccaccaccaccaccaccaccgcgggaggcaggaagucuggagccucagaccuuuccccacggaccugggccuuuccuuacugaacuugaaaagucaacacagaccaucuugggccagcagcggcccucucuuucccaggcaaccuccuucggggagcucagugggccucugaaaccaggcucuccguacugccaccccacagcgaggggccccgauccagccuacaucuacgaugaguuucuucagcagcgacggaagcuggucagcaaacuggaccuggaggaacgcaggcggcgcgaggcccaggagaaaggucuggccuccugagugggucccaaccuuccugggaauggggguucaucaggacggggagacuccagugccagcugcucgccucucuucucccacuuuuaacuuacagugcaauuuuuaaaaaauugguuucagauagcagguucagacuucuaaaccucacacaggcaaggauagagccccuugccuguccugcauuuugaggcacauuaucccaaaauggggagucacggcccgucugccaagacguuacugcagacauguuauugauaagugauggacagaggcuggucaggugacuuuaaauauaauagugugacguuacacagagaaacagcccagcagggcgucacacaaggguagugacaguugagggcacguccuccaggggauaaggacagcagcugacacugccccugagggagcuugcuugggguuaggcaucuccuuccugucggaggggacagcucccuaagguccuaagaaggucaagagaaccagcaggggcuguagcuagagaagcaggcaccugcugaggguaacugccucaggcuauucuaggccccugaauccauguggccugucuggugucacacccagcuccucuuagcuccgcuucugcagugcuagucaggauagcuuuagggccuggcuggggccuuucuaucaguuuacuuugagaaggaauggggggcucugugguuuuuagcugccuucccacgagggucacagcaggggccauaugcucacaaagccacggucagguaugcucugcucugagccuagggagucucccuacaggcgucuaggcagaugggaaggggcccagcccucugagccaggguccucgcaggugccugcaggcccagcccaggggucucgcucccuugccccccuggugcacguguccacagagcaucccaaguucugagccuggcucagugcacacauuuuuuugcccucaggguacuacuacgaccucgaugacucguacgacgagagugacgaggaggaggucagggcacaccuccgcuguguggcugagcagccgccccucaaacuggacacauccucggagguaaccgggcccuccuugacucuggcaugcccugggcuggcuggguaguugguccccgcuuggggcccaccucuuggcuaccucuguggccgagcucugggucagacugcaaggaccacgggacccucccccuccccccggggggggggggcagugacuacacagugugaagcugacggugguggcuucacacuccguuuguuuucuuucccgaucuagaagcuagaguucuugcaacuuuuuggcuugaccacccaacagcagaaggaggaacugguggcgcagaagcgccggaagcggaggcggaugcucagagagagaagcccgucgccaccugccguucagugcaagcgacagacgccuucccccaggcuggcucuguccacccgcuacagccccgacgagaugaacaacagccccaacuuugaggagaagaggaaguuccugaccuucuucaacuugacgcacaucagugcggagaagaggaaagguauggccuuccuccggccugcacacacagggcagggcgcuccugggcagcaggagcugcagaguuggccucucggcccugucugguaggcuuuugucccuugguguuucugucacacucuacucuggcacauguccuguuuggaugggaagacugaggugccuguacggacagccagugcccgucaggaccccccccuaccauccuccugcacuuggucagagugccugcaggacuuucccugggacugagagggugugcucagccuccgcuugggguugccagugaucucuacccagcacuguuccugcugcuaacaggccuggagagugagcuuguggguggccuggagaugcccagccuacagagcuaaguacaauuugcccaaaaagaugcuuccagaccagucugguacccuagguccagguuagaaaagagacuugggacuggaagacacgguauagaagacaaggugugaccaaggccugccgaggcuaccuugaucggcucaacacccaucuugggcugaggcguugguguucacagccaugccccuguguucuucaugccccuuaagggcacuggccuccucuggaagacucccaggaaaacggugccucccacuuucugguuggucugacaggcuucuuuauaggcgauggcgguuucuuuuuccuuuuuaacaagcgugguggaggucucacuuuucaugcaaggguuacugacggccugacugccagcgcaagccccuggacacgcgccuagcuguuugcaagccugauuuuucaccuggcuuugugucuaaaggacgucguccaucggcaccaaagccacuuaaguuucagaguuggcaggaagagccacugaaccggggaucugcaguguggaacacuugggggucugcacuccuucgugggaaauggcuaugacccuaggcggggagcacguucccuucccuggucucugcccuuguguuggggccaucccuggucuucagaucaggauaccugcugagaaggaagucaccauggaaaccccagguagccgcugcucguggcugaagacuguggcugucuggagcccagcagggacagccggcugcugucaccugcuucuuccugugggcagcgcuggccagccggccguggugcuugcuuuuggugccucuuggugugaagggcuuguaccugccagucaugguggccagaccccgcccuuccuccccucucaaagugcugcuaaccuggggcugcuuuccucgcagacaaagagaggcuuguugaaaugcuccgagccaugaagcagagagcacuguccgcagcagacucagugacaaacucuucgagggacaguccucccgucucccugagugguaagggagggacaccccaccugccagcguccuguagauugggcgacaggguuagagguggcgcucgaagucuacgucucugcugugaacuuuccuggaagugcaggguuggcuucuccccauccuggcugagcugagccucgggaagcagugcaaaccggaaggugggcgugaaggucaggggagggcgcugacugccacggugccgccccuucagcugcaggcuguagccaucacuacccacgaggaugggccugaagcccaccgaaugcccugccugggcucuccagacugucuccagcaccugcuuucucucucugcuucucugcugcucuccgguugaagaaagcugaagccuugcagugcagccucuggcuagcuccuguccucaccugcucucucugauuuggaugaaguuacuccuaccuucucgucgcuuucugcucucucuccccaccuguccccugggaacuuguucaggguuggacuugcugcuaaacaggccacuccuccaacucuuaaccucgugcacaguguuaacaugggguacacacacugggucuuucugcacuuguaagcucuggagauguguaguauuugcaugccugccuguuccacaacucauaaugucccccucauuuucugucucuccaagaaccagccacacagccagcuccucuagagacggaucagccugucggggucccugccuccuugucagaugucccaaagaccacggagaccgggagacuggaacagcuccggccccaggagcucuugagaguccaggagccggcuccucccaguggugagaaggccaggcugagcgaggccccugguggcaagaagagccugagcaugcuccauuaccuccggggcgccgcgcccaaggacauuccugugccguugucucacagcaucaacgggaagagcaagcccugggagccuuucguggccgaagaguuugcacaucaauuccacgaguccgugcugcaguccacacagaaggcucugcagaagcauaaagguaaccaaccggccacaggucccgugucaccugucacaguacugggugacacaggccauuuacacggugaugguaccaguuaacccuuuaaugccugugaaucacuccggaaggggagacccaagccucgaucacuucccaggcuuguagcagggccuaauguaccugcccaagaaccacacacauuugggacagcuagcaaaugacaguucaggaaggccguguccucuuuguaugcacggcccacagcuguggcuuucccaggaucugcaugggcuuacucggagagugguucuuugccaggguacugaacugugugccuaccgcccagggcccagugaauguagguagggacagcggcuucuccugcccugcucacccagguggaauaagugugugugugugugugugugagagagagagaaagagagagagagagagagagacagagacagagacagagacaucccccagcaggggaaauugacuagccaugccagucugugucugagggcuucacauacauugugaaggcugagcucccaguguuugucacaguugacucugcugcugggacccaggaucaaaggugagcgcuagguuggcuaaggcuaaguggaggcaaagacugcauuccugaggcucgcaggccagccagacuaaaccagacaggaaagccagagcggaagccaucagugcugaccucugaccucgccacuaaggggaagcuccaggaagagaagugucagcuuuggccagaggccgucugcucccugcuccuuaggguggaggggcucuuccagguggcgucacugggcagcguucaggugaugccaccagcggagccugaagccccuuccguuggaggccacagucccugucccugccccugcucaggcagcauacugugcuuacaaaguugcugucagucgagccccugccccucaagauccuguuuuccucuccccagggaacucugcuuugcuaucugcagagcagagccacaaagucgacacggcaauccacuacaacauucccgagcugcaguccuccagcaggguccccuugccccagcacaauggacaacaggagccuccaauggggaggaagggcccuccuaugcaggaggcggaccaggacucugaggaggacucugaggaggacagcgaggaggaagcugaggaagccccgaggcgccaguggcaagggauugaggcaaucuuugaagcuuaccaggaacacauagaagguagggguuugcacggauggguaaucgucagauccagucugucuacucuagaggccgucugcucccugcuccuuaggauggaggggcucuuucagguggcaucuaagggacguaucacuggguaaucaaugcuaagacauugauuuuauugcagggcaagccuaugguauauuuuguaccccagcccugagcccugcuauggugggacaugacagaauguugccugguuuccacacauagcugagcucuggccagcccuaaucaccaugcugugaacccacacugaagauucuagguguuuuugucuaagcccgaguugcgcacccacaguccuagagagaggugguggucccccauuuuccgugugcagcucccuggcccaucucagaguacuugggcgcagcacugccuuuggccuaucucuaggcuaccuccuuccucccauaccuuaccuuucucuuucuggcauauuaauuacuaaagccguaaauacugcaugugaguucagggucucacucuguagcccagguccccugguacuugugggcuccuccugagugcugagaucauaggcgugagcuacugaaccuugaaaggcacugggaacuggauaccaagugaagaacuuagagacugcuagagcagaagcaccuauucgaguuugccuuuccucagaaggcaccgucccgucucccacauuuugggauuauuggguuuaccaguucacuguuccuauaccugguuccguccugcagaaacggaguccagucacaucucagacagaaugaauggaaaugcuuuccugggugugccaggacaccucccuggguugucccugucacucugaggacacaucugcuguauggcagcagcaccccuguggcagcucacuuuggcuuguccuuagcagcugugugaauuucaggaucuugucaaacccugcgaggguuuccuguucccuguggcucacucuccauggcugacaaguguagcuuccucgugugguugugcccagccuccccaugugaaucagaacagggacagugcuucuccagucugcguauuucuauccuugucaccugucuugguugugaaacuaggugcagccuaagcuuucuuccuccgucagguuuugucuuccccucuuuccuuuccuacuuuguuugcuccacggcugacgagugucugucagucuacgcggucgugugucguucaccgaagcacucugugguagugccucggugaaucagauucggcgaauuaaggaugcuuuuccugccugcgccacugacaucgcaguuuuucccaguuuuccccacugccuggccgcaucgguguagcaaagaacacgcugcaugguuugaagacacgcugccuccuaagaggaugacacaucgccaccucuugucuuuucagagcaaaaccuggagcggcaggugcugcagacgcagugccggcgguuggaggcgcagaacuacagccucagccugacugcggagcagcugucucacagcauggcggugagucggccaugggcuuuguacaggcacccccagagaggacaggucugcucccgagaaaucagaacucagugccaggcauacucgccaugcuuuagcccccaggggacaggcagaucugggagguugaggucaguuggggucagccugggacgcauaguaagguccuguguuaggaauaaagagauguuaucugaggagaggcccuugugcccgccccagggugggcacaugugcggggccggucggaccugggauucagagccugagcugaggcagcaguacacacugguucucugggagccuguggugccggaagaauguucuagcaaccuccagaggucacucacgcugcuguguguacagaugguucugacgcgcaucuucuccccaggagcuucggagucagaaacagaagauggucucugagcgggagcggcuccaggcggagcuggaccacuugcggaagugccuugccuugcccaccaugcacuggccuaggggcuacuuuaagggauauccgaggugacgguuucccuugcacuaggcugaaccuauaguauagaaauauuaucuauuuuauuaccuugaauauuuaauauuuuucacugggagguuugaagcuuacaaauugagaacgugccaugcaugaaacaaaggguuccaggcuccagagaggagaucaccucgacgccaaugucaccgaggcaccugucucagcuaggacucaguuucucuuucugaggucggcguuauuuccucucuccccccacgucauccuccuccgacacugacguccaccgugcauguggcugagggagagagccagcugguuguuucugguauagcugugccacgagagcccagcuugcuguugcugcggcccugggguuuaaccucuuccugccaggagcgggacuaaugcgccgggaaggcugggugcguacaagcaaagggcuccccaucagucccguccgucugucgccuucccgcaagcgucaucaucgaagccacugcuccugggagcacacaagcuucucccuggaacagcucuuaggaaaagaggcaaacccacacccaaaaguaccuuguuuuccuuggggaagaugcguggagcuguccacagauagccuacccacuggauugcuaccgccgugugugguguuuucauacaaacguacguuuugagagaaaagucaaaggugcuucagccuuguacuguguauauauuaaaaaaaaaguuuuguauguuuuuauuacuuuaauuauuguuauaaaaagccugccauuuuuaauaugugguuuggggaauuuuguuuguuuuuccuguuuggggguuuucuuugguuuuuuuguuuguuuguuucuguuuuucuggauuuaaaaaaaaagaaaaccuugcuuuuaguguuuguacugcugcuggucagaauguuguuaacugcucaguucuaggaagcaggagagcucgcuugugcagugucccacacagcagggcugaggggccuagggcugccugcucuccaaagcagaugacccaugugcggcagggacucggcaaagcugugaggagcugagcuccggagacaggcacagcucuggcagaaagcucaacgcuaagggaucuccuucccaguuucagcacuucagucagggcugaccaacuugaaaagagccuccgacuguccuccaucggacaggggaagaggaggccgagcccacccuuagccaccaggcucaguggcuguacagagcagcuggcugacaucugucccugcuccaccccugccccuacccgcaccccucugguucucagcaaacucagacaaggcagugccaccaggccugucagcaaagcaccuuccucugcccacagccagucagagaaaacgauccaaaggagggcagaggccgcacacccugggccgaguccugcccgacuucccaguuaaaugcugcuugugcccagugcugcuuucccaagcucaccccaccuccaugacuagaagcuucugcaaaucugcuugguaaaugucuccugggaaaggcagaacccauaacuuaaagacacgcacagucccuuccauugucccacaggaguuccucuggcugaguaugccauccagagcaagcgaugcccucccaggucagucuggggcacaagcugagccgcugacuagcaaugccuacagccuuucccaaugcccuugccugcccuggagcuucuagggccaccucuagcaucuggagaccgaauauccccaugcucagaaguaaagugacaaucagaaccagguacaagccaguaaagcggcagaugacugccacucagcccacauacggcauucuucccaucccacagucuuagagccagaugaggcuaacaagaccacaguagcccccuucccagguaccacacugucccuggagaucccuccagccuagcccugcuauagaucugcucuagacugugaaaucagcauguaugugaaaaaucccaguccuugaccaugucucccacuccaccugcaagugauugcugccaucuguccugggugggaugcaccgagcuagucacgggugucggaucagaucuuuuaaaaacacuugucucauguaauugagacccgccaccaucgcagaugagugacaagagagaaggcugucaacacuucgguacauggugaucuuaaaaacacccaccugcaccaucacaccagacuguaccacuagggcauccagaacaagccccacccuaacagugggggcagggaggguacagccaggcucacagcacugagagucucaaccagcuaagcuaaauugcaagcuagaugccuccugccccugcccucagcugcccaggccccagcauggagauggccugcacagcaggcucagcaccucugaggugugcauuagccacuuauagcagcagucuguacucuuucaaguacgcaagcuuugacuucacuacuugcuguagccuguccccacugucuauccagugcuuacuucaacccuagaggcugccuugacccgaggaggcaucucacugguuccguacuugugugugcccuacgccucacugcuggggcccuggacccagacccaggcaggagggccgacgggugccucggucgcucugggggcaguuuagaugcugugaaauuaaacccguucuaaguguacuuguuugaauuaacuguauuguaauauuauuuguugaauguaguaauuagguauuuaugaauauauugcuguaauuucugacaucccgaaaaauaaaaucuuccuaaaucauguuaagacgaaauucaucuuuuuguaucaccacccccacccucacgcucagccucaacuacauacagcuuuccacgggccaagcuugaagacacuugagcugagcuggcccgaacacucgcugugcuuggcgugcaguccuuggguggaagagaaaggcuggcggcuucucuguucaauggaguugaacuugcaguauggcugaccucugacaaagacgggcagcaaccuuaccaguguuccacacucuucccccaaucuccgccacacagggcacacagcaggguuugcacagcagaggccucuggcuagaaguccugcgacugggugcucucggagggcuggagguuugugcggagcuuguacaugugguugagggccugggugaggaaggccccgcugcugcugaucuccaucaaggu

SEQ ID NO: 4836 - RNA, 93016 nt, Mus musculus
accuugauggagaucagcagcagcggggccuuccucacccaggcccucaaccacauguacaagcuccgcacaaaccuccagcccuccgagagcacccagucgcaggacuucuagccagaggccucugcugugcaaacccugcugugugcccuguguggcggagauugggggaagaguguggaacacugguaagguugcugcccgucuuugucagaggucagccauacugcaaguucaacuccauugaacagagaagccgccagccuuucucuuccacccaaggacugcacgccaagcacagcgaguguucgggccagcucagcucaagugucuucaagcuuggcccguggaaagcuguauguaguugaggcugagcgugaggguggggguggugauacaaaaagaugaauuucgucuuaacaugauuuaggaagauuuuauuuuucgggaugucagaaauuacagcaauauauucauaaauaccuaauuacuacauucaacaaauaauauuacaauacaguuaauucaaacaaguacacuuagaacggguuuaauuucacagcaucuaaacugcccccagagcgaccgaggcacccgucggcccuccugccugggucuggguccagggccccagcagugaggcguagggcacacacaaguacggaaccagugagaugccuccucgggucaaggcagccucuaggguugaaguaagcacuggauagacaguggggacaggcuacagcaaguagugaagucaaagcuugcguacuugaaagaguacagacugcugcuauaaguggcuaaugcacaccucagaggugcugagccugcugugcaggccaucuccaugcuggggccugggcagcugagggcaggggcaggaggcaucuagcuugcaauuuagcuuagcugguugagacucucagugcugugagccuggcuguacccucccugcccccacuguuaggguggggcuuguucuggaugcccuagugguacagucuggugugauggugcagguggguguuuuuaagaucaccauguaccgaaguguugacagccuucucucuugucacucaucugcgaugguggcgggucucaauuacaugagacaaguguuuuuaaaagaucugauccgacacccgugacuagcucggugcaucccacccaggacagauggcagcaaucacuugcagguggagugggagacauggucaaggacugggauuuuucacauacaugcugauuucacagucuagagcagaucuauagcagggcuaggcuggagggaucuccagggacagugugguaccugggaagggggcuacuguggucuuguuagccucaucuggcucuaagacugugggaugggaagaaugccguaugugggcugaguggcagucaucugccgcuuuacuggcuuguaccugguucugauugucacuuuacuucugagcauggggauauucggucuccagaugcuagagguggcccuagaagcuccagggcaggcaagggcauugggaaaggcuguaggcauugcuagucagcggcucagcuugugccccagacugaccugggagggcaucgcuugcucuggauggcauacucagccagaggaacuccugugggacaauggaagggacugugcgugucuuuaaguuauggguucugccuuucccaggagacauuuaccaagcagauuugcagaagcuucuagucauggagguggggugagcuugggaaagcagcacugggcacaagcagcauuuaacugggaagucgggcaggacucggcccagggugugcggccucugcccuccuuuggaucguuuucucugacuggcugugggcagaggaaggugcuuugcugacaggccugguggcacugccuugucugaguuugcugagaaccagaggggugcggguaggggcagggguggagcagggacagaugucagccagcugcucuguacagccacugagccugguggcuaagggugggcucggccuccucuuccccuguccgauggaggacagucggaggcucuuuucaaguuggucagcccugacugaagugcugaaacugggaaggagaucccuuagcguugagcuuucugccagagcugugccugucuccggagcucagcuccucacagcuuugccgagucccugccgcacaugggucaucugcuuuggagagcaggcagcccuaggccccucagcccugcugugugggacacugcacaagcgagcucuccugcuuccuagaacugagcaguuaacaacauucugaccagcagcaguacaaacacuaaaagcaagguuuucuuuuuuuuuaaauccagaaaaacagaaacaaacaaacaaaaaaaccaaagaaaacccccaaacaggaaaaacaaacaaaauuccccaaaccacauauuaaaaauggcaggcuuuuuauaacaauaauuaaaguaauaaaaacauacaaaacuuuuuuuuuaauauauacacaguacaaggcugaagcaccuuugacuuuucucucaaaacguacguuuguaugaaaacaccacacacggcgguagcaauccaguggguaggcuaucuguggacagcuccacgcaucuuccccaaggaaaacaagguacuuuuggguguggguuugccucuuuuccuaagagcuguuccagggagaagcuugugugcucccaggagcaguggcuucgaugaugacgcuugcgggaaggcgacagacggacgggacugauggggagcccuuugcuuguacgcacccagccuucccggcgcauuagucccgcuccuggcaggaagagguuaaaccccagggccgcagcaacagcaagcugggcucucguggcacagcuauaccagaaacaaccagcuggcucucucccucagccacaugcacgguggacgucagugucggaggaggaugacguggggggagagaggaaauaacgccgaccucagaaagagaaacugaguccuagcugagacaggugccucggugacauuggcgucgaggugaucuccucucuggagccuggaacccuuuguuucaugcauggcacguucucaauuuguaagcuucaaaccucccagugaaaaauauuaaauauucaagguaauaaaauagauaauauuucuauacuauagguucagccuagugcaagggaaaccgucaccucggauaucccuuaaaguagccccuaggccagugcauggugggcaaggcaaggcacuuccgcaagugguccagcuccgccuggagccgcucccgcucagagaccaucuucuguuucugacuccgaagcuccuggggagaagaugcgcgucagaaccaucuguacacacagcagcgugagugaccucuggagguugcuagaacauucuuccggcaccacaggcucccagagaaccaguguguacugcugccucagcucaggcucugaaucccagguccgaccggccccgcacaugugcccacccuggggcgggcacaagggccucuccucagauaacaucucuuuauuccuaacacaggaccuuacuaugcgucccaggcugaccccaacugaccucaaccucccagaucugccuguccccugggggcuaaagcauggcgaguaugccuggcacugaguucugauuucucgggagcagaccuguccucucugggggugccuguacaaagcccauggccgacucaccgccaugcugugagacagcugcuccgcagucaggcugaggcuguaguucugcgccuccaaccgccggcacugcgucugcagcaccugccgcuccagguuuugcucugaaaagacaagagguggcgaugugucauccucuuaggaggcagcgugucuucaaaccaugcagcguguucuuugcuacaccgaugcggccaggcaguggggaaaacugggaaaaacugcgaugucaguggcgcaggcaggaaaagcauccuuaauucgccgaaucugauucaccgaggcacuaccacagagugcuucggugaacgacacacgaccgcguagacugacagacacucgucagccguggagcaaacaaaguaggaaaggaaagaggggaagacaaaaccugacggaggaagaaagcuuaggcugcaccuaguuucacaaccaagacaggugacaaggauagaaauacgcagacuggagaagcacugucccuguucugauucacauggggaggcugggcacaaccacacgaggaagcuacacuugucagccauggagagugagccacagggaacaggaaacccucgcaggguuugacaagauccugaaauucacacagcugcuaaggacaagccaaagugagcugccacaggggugcugcugccauacagcagauguguccucagagugacagggacaacccagggagguguccuggcacacccaggaaagcauuuccauucauucugucugagaugugacuggacuccguuucugcaggacggaaccagguauaggaacagugaacugguaaacccaauaaucccaaaaugugggagacgggacggugccuucugaggaaaggcaaacucgaauaggugcuucugcucuagcagucucuaaguucuucacuugguauccaguucccagugccuuucaagguucaguagcucacgccuaugaucucagcacucaggaggagcccacaaguaccaggggaccugggcuacagagugagacccugaacucacaugcaguauuuacggcuuuaguaauuaauaugccagaaagagaaagguaagguaugggaggaaggagguagccuagagauaggccaaaggcagugcugcgcccaaguacucugagaugggccagggagcugcacacggaaaaugggggaccaccaccucucucuaggacugugggugcgcaacucgggcuuagacaaaaacaccuagaaucuucaguguggguucacagcauggugauuagggcuggccagagcucagcuauguguggaaaccaggcaacauucugucaugucccaccauagcagggcucagggcugggguacaaaauauaccauaggcuugcccugcaauaaaaucaaugucuuagcauugauuacccagugauacgucccuuagaugccaccugaaagagccccuccauccuaaggagcagggagcagacggccucuagaguagacagacuggaucugacgauuacccauccgugcaaaccccuaccuucuauguguuccugguaagcuucaaagauugccucaaucccuugccacuggcgccucggggcuuccucagcuuccuccucgcuguccuccucagaguccuccucagaguccugguccgccuccugcauaggagggcccuuccuccccauuggaggcuccuguuguccauugugcuggggcaaggggacccugcuggaggacugcagcucgggaauguuguaguggauugccgugucgacuuuguggcucugcucugcagauagcaaagcagaguucccuggggagaggaaaacaggaucuugaggggcaggggcucgacugacagcaacuuuguaagcacaguaugcugccugagcaggggcagggacagggacuguggccuccaacggaaggggcuucaggcuccgcugguggcaucaccugaacgcugcccagugacgccaccuggaagagccccuccacccuaaggagcagggagcagacggccucuggccaaagcugacacuucucuuccuggagcuuccccuuaguggcgaggucagaggucagcacugauggcuuccgcucuggcuuuccugucugguuuagucuggcuggccugcgagccucaggaaugcagucuuugccuccacuuagccuuagccaaccuagcgcucaccuuugauccugggucccagcagcagagucaacugugacaaacacugggagcucagccuucacaauguaugugaagcccucagacacagacuggcauggcuagucaauuuccccugcugggggaugucucugucucugucucugucucucucucucucucucucuuucucucucucucacacacacacacacacacacuuauuccaccugggugagcagggcaggagaagccgcugucccuaccuacauucacugggcccugggcgguaggcacacaguucaguacccuggcaaagaaccacucuccgaguaagcccaugcagauccugggaaagccacagcugugggccgugcauacaaagaggacacggccuuccugaacugucauuugcuagcugucccaaaugugugugguucuugggcagguacauuaggcccugcuacaagccugggaagugaucgaggcuugggucuccccuuccggagugauucacaggcauuaaaggguuaacugguaccaucaccguguaaauggccugugucacccaguacugugacaggugacacgggaccuguggccgguugguuaccuuuaugcuucugcagagccuucuguguggacugcagcacggacucguggaauugaugugcaaacucuucggccacgaaaggcucccagggcuugcucuucccguugaugcugugagacaacggcacaggaauguccuugggcgcggcgccccggagguaauggagcaugcucaggcucuucuugccaccaggggccucgcucagccuggccuucucaccacugggaggagccggcuccuggacucucaagagcuccuggggccggagcuguuccagucucccggucuccguggucuuugggacaucugacaaggaggcagggaccccgacaggcugauccgucucuagaggagcuggcuguguggcugguucuuggagagacagaaaaugagggggacauuaugaguuguggaacaggcaggcaugcaaauacuacacaucuccagagcuuacaagugcagaaagacccaguguguguaccccauguuaacacugugcacgagguuaagaguuggaggaguggccuguuuagcagcaaguccaacccugaacaaguucccaggggacagguggggagagagagcagaaagcgacgagaagguaggaguaacuucauccaaaucagagagagcaggugaggacaggagcuagccagaggcugcacugcaaggcuucagcuuucuucaaccggagagcagcagagaagcagagagagaaagcaggugcuggagacagucuggagagcccaggcagggcauucggugggcuucaggcccauccucguggguagugauggcuacagccugcagcugaaggggcggcaccguggcagucagcgcccuccccugaccuucacgcccaccuuccgguuugcacugcuucccgaggcucagcucagccaggauggggagaagccaacccugcacuuccaggaaaguucacagcagagacguagacuucgagcgccaccucuaacccugucgcccaaucuacaggacgcuggcagguggggugucccucccuuaccacucagggagacgggaggacugucccucgaagaguuugucacugagucugcugcggacagugcucucugcuucauggcucggagcauuucaacaagccucucuuugucugcgaggaaagcagccccagguuagcagcacuuugagaggggaggaagggcggggucuggccaccaugacuggcagguacaagcccuucacaccaagaggcaccaaaagcaagcaccacggccggcuggccagcgcugcccacaggaagaagcaggugacagcagccggcugucccugcugggcuccagacagccacagucuucagccacgagcagcggcuaccugggguuuccauggugacuuccuucucagcagguauccugaucugaagaccagggauggccccaacacaagggcagagaccagggaagggaacgugcuccccgccuagggucauagccauuucccacgaaggagugcagacccccaaguguuccacacugcagauccccgguucaguggcucuuccugccaacucugaaacuuaaguggcuuuggugccgauggacgacguccuuuagacacaaagccaggugaaaaaucaggcuugcaaacagcuaggcgcguguccaggggcuugcgcuggcagucaggccgucaguaacccuugcaugaaaagugagaccuccaccacgcuuguuaaaaaggaaaaagaaaccgccaucgccuauaaagaagccugucagaccaaccagaaagugggaggcaccguuuuccugggagucuuccagaggaggccagugcccuuaaggggcaugaagaacacaggggcauggcugugaacaccaacgccucagcccaagauggguguugagccgaucaagguagccucggcaggccuuggucacaccuugucuucuauaccgugucuuccagucccaagucucuuuucuaaccuggaccuaggguaccagacuggucuggaagcaucuuuuugggcaaauuguacuuagcucuguaggcugggcaucuccaggccacccacaagcucacucuccaggccuguuagcagcaggaacagugcuggguagagaucacuggcaaccccaagcggaggcugagcacacccucucagucccagggaaaguccugcaggcacucugaccaagugcaggaggaugguagggggggguccugacgggcacuggcuguccguacaggcaccucagucuucccauccaaacaggacaugugccagaguagagugugacagaaacaccaagggacaaaagccuaccagacagggccgagaggccaacucugcagcuccugcugcccaggagcgcccugcccugugugugcaggccggaggaaggccauaccuuuccucuucuccgcacugaugugcgucaaguugaagaaggucaggaacuuccucuucuccucaaaguuggggcuguuguucaucucgucggggcuguagcggguggacagagccagccugggggaaggcgucugucgcuugcacugaacggcagguggcgacgggcuucucucucugagcauccgccuccgcuuccggcgcuucugcgccaccaguuccuccuucugcuguuggguggucaagccaaaaaguugcaagaacucuagcuucuagaucgggaaagaaaacaaacggagugugaagccaccaccgucagcuucacacuguguagucacugccccccccccccggggggagggggagggucccgugguccuugcagucugacccagagcucggccacagagguagccaagaggugggccccaagcggggaccaacuacccagccagcccagggcaugccagagucaaggagggcccgguuaccuccgaggauguguccaguuugaggggcggcugcucagccacacagcggaggugugcccugaccuccuccucgucacucucgucguacgagucaucgaggucguaguaguacccugagggcaaaaaaaugugugcacugagccaggcucagaacuugggaugcucuguggacacgugcaccaggggggcaagggagcgagaccccugggcugggccugcaggcaccugcgaggacccuggcucagagggcugggccccuucccaucugccuagacgccuguagggagacucccuaggcucagagcagagcauaccugaccguggcuuugugagcauauggccccugcugugacccucgugggaaggcagcuaaaaaccacagagccccccauuccuucucaaaguaaacugauagaaaggccccagccaggcccuaaagcuauccugacuagcacugcagaagcggagcuaagaggagcugggugugacaccagacaggccacauggauucaggggccuagaauagccugaggcaguuacccucagcaggugccugcuucucuagcuacagccccugcugguucucuugaccuucuuaggaccuuagggagcuguccccuccgacaggaaggagaugccuaaccccaagcaagcucccucaggggcagugucagcugcuguccuuauccccuggaggacgugcccucaacugucacuacccuugugugacgcccugcugggcuguuucucuguguaacgucacacuauuauauuuaaagucaccugaccagccucuguccaucacuuaucaauaacaugucugcaguaacgucuuggcagacgggccgugacuccccauuuugggauaaugugccucaaaaugcaggacaggcaaggggcucuauccuugccugugugagguuuagaagucugaaccugcuaucugaaaccaauuuuuuaaaaauugcacuguaaguuaaaagugggagaagagaggcgagcagcuggcacuggagucuccccguccugaugaacccccauucccaggaagguugggacccacucaggaggccagaccuuucuccugggccucgcgccgccugcguuccuccagguccaguuugcugaccagcuuccgucgcugcugaagaaacucaucguagauguaggcuggaucggggccccucgcugugggguggcaguacggagagccugguuucagaggcccacugagcuccccgaaggagguugccugggaaagagagggccgcugcuggcccaagauggucuguguugacuuuucaaguucaguaaggaaaggcccagguccguggggaaaggucugaggcuccagacuuccugccucccgcgguggugguggugguggugguggcugguauuuguccagugguguggccucacgcuuccggggcuccucugccuucucugagcaauaaacucgcuccaccuucaccaguggcacggcggccuggcggcugggcucaaaagcagucggguggcuaugcagagaguggcucucggcccgccgcgucuccagagcauuguccaucagagacacuggguuccagagggcuguggguacggugugcugcuggggcuugggugagaugagggguggagggccaccaaagugcuguggggguucacggcugcccugcucaugccgguuuguuccuggccuagaaagaacaaaccaaagccguggguuuuggaaccagagcugccuaccagccucccagaaugcccaggguagcuugcugggcucacaccagacugccugguaggugugaacucuucauauggggagaggcugucaccaugccuucccgcuaggagagccauuucuuccuggagaggaagcaguuaucacagacacgggaugguggcugugcugcugccccccuguggcuccuuccagaacugcagcagccccagagcucggccugaggacuuccagcuugccucaccagaugugcaaaaaagcuuccuuaacccacucucuauaucauuguccagcucugcccaggacccucgcccuucaccacuugguccacggccucuuccagacccaggcaggagcugcaucugcaagccucuuuuugcaguagacuacuaccgagauccacaauuggucaagacagaggacaggaggugacuuuuagggacccagcccugacugguccgucuacagcgcaacccccacacuccggaagccaacguaccaggaucccucagguaggcagugcuaucuaggcaugacagggaagcugccacccagacaagacuuggauaucaacaacacuagcugacaugccagcgggggaagagcuagagaugugagagggagggacaagcaacgggguaagcuaccaaauggguggucagcccuaaacacacagauguaagaacaaggucugugggggaggggccacugcuaggcuccucuggucuugccagucuggcugaagcgccacuuaaagcugccaaggcugccccucacuccggcgagggagagcacaggguuucuuuagcuccccucagguucugaacagcaagggauaaacaagcacaggacacacccaacaagccaacaagcauuuuaacaguucguagcuauggggugugugaccccgcccccaucgcagugacagcaaaaaggaccaggcugaugugggagaccgagcggacggcagaggagccagaggacucgggcuuggcgugaaccucauguccagcacaggauguuuaagacuagcgaggccucagaguggccucucuacagcugugcgaggugugcagggccagggaugggcacccgggguacuuccagguauugcucuucucagcauggaggagaagggaugagagacuuaucuguauucugaaggucaacacagaugcugagggcuggagugguacagaagaugaagcaggccaugggaccaacagcaggaggacagauagacagacuuuugcaccagcaucacuugccucacgugaggccccacccaggacccaccuggugcucucgggccugugcuccgccucugugggcaccaggggccggcccaggucuaggugcugcuccaggaccugcugccggaacucggacaccugggacuggcggucuuccuucuccugccgcaggcggcgcugccgugccagccacuucuccuccucguuggugcgcuggaucagcagggcggugguggcgcugcuuccaggcagagagaagaugccguggcuggagaugaggcugggcaccgugugguguggggcaggcacugggugcagagggugcugcacgggcuugggcgccugcaagcccacguccuucagcuucucugugggaggaaacacggucacugcgggggcgccagugcccuugcccgugcucggagcccaggacugaaggaaacacugccucauccuuggagagaggagaugugguguguguggcuggcucagagcaacuuacauguuuuugaggacaucaaccacaaaaauuuucaugaaauaaaucaagaucgggauagcucaugccugcgcucccaacacuuugggggcugacacaggaccauagcuaugaauuugagggacgguugagucccaggcuagccuuggcuuuagaacucugacacagaacaaaaggucagauuggggguaucucaguggcgugacucugguguucaccaucaccauggcaaaaggcagagaccaaccaagguucuaccgcagugauggcaacuccccucccuagcgucuuggcuguucugggggcacccaugggauccuggauccacccagggugacagagcacaccuccucccagucucgccagcguugggauggcaccuccuuacugcuggggcaggcacaggccauucccuccacacagcucagcccagguaccugcucggguuggggucagcugcuccgagggcuugggccgcuccuccgugcugugaccucggaguccgugcagcucggccacaggcaggaagguggugggcucuaaggccuuggcagccagcagcuccuucucccucgcccgcugcucccgcugccgcuccagcucgcgcucccguuccuucucccgcucgcgcuccagcuccuucucccgcuccuucucccgcugcucccgcucccgcuccuucucccgcucccggucggccucccguucccguucccgcucucgcucucucucccgccgcaguuccucguccauuugcaaccugggagggaaaacagggcagcgugcuaaagggaugugcagggggggcaaguccacgccccagcucaaaguggagcagccacaugcaagaguugccaccuacacacaaagaaccgcaucccgccaccaccaagccaggccccgcugaggaccucaggaacgcucaacaguccccuccaccccaccucugcugaaaacacagcuuaccucucugcacugaggcuggacauccgcuccgaguguagcgccgccagggacgagugggagagcucaggaggauaccguacgccggagagaugcaggugcaucgccgacggaugcaguggaggcagggagccagggguggggaugggguagaacggagaccuuaaggcugacaggcaauaggagucauccauccuguagacagagaggcaggacuggugugugcaggagccacaaaggauaagcuugccuagcagaugcgaagcccucaggugaaucccuggcacugcaggagaaaggccgggacccaggcaggugagccggcgccucucggcugggcgagccacugcucacucaggcucagcccugcagagacugcaugcaaagagcauguccacugucuggggccacaaggaacagaccacaugggcgccuaggaccucccggaccaugggugagcgagcgggagggcagacuggcugcaggcagagaccucuggugugacccgcugugguaagaggccaggagcuucuacaggaagagggagggcauggccugacucucacuccggagucuccaucacacugucuagguaccacacacuguuaguggggacuggcugcuggggugcagaugcugagaagugggaaccaaggagcaucagcaggugguacugaguccauccaucaagacucaacucagucgagcuggggaaagcuauauagcucccuugagugccuggaccccaagcccuggcaaacgcccgccccgagagguucugccuugcugagaacagauuagcacacagggcagcgugaguggggacgccucaccugaaggccgggugggggaauggguguggggccagguagcuggggugauaguaggcugcggcgguggcuggguccaggccaagcggaggcaaggaggacaugcguaagucuucagcagugugguagggccggaagcuucucaaguaguccucagucaccgugcuggggggcaccacauggugcacaggccgcuggaggcugugggagggggaaguggggagcagagguaaugugccacacucccucaccaggcucagguccugccucucagugagguacagccuggcaugaagcccagacugcacagaugggaagcugccugucccucaagguccccacgaguggauagagaugcuggaggggcucucuguuccccagacccagaggaugggcuuaaauguguuuaggacaccugauaagucugucucaacaaaggcuggaccacaaggucagauggggccaaggaccucagggcagaucaggccacugagacuaauggcauucuaucuaccucugccagugcaaacucucaggucugucuggagccaccccugugccuucccugaccccaggcuggcacuuacuugagugguuggaagcgggaguccuguacaacugagccgggggaaaggccaaagggguacggggugcugaguaggugggaggggauggcggggcccgcagccuuuuccugggcgagagguggcuccaccaauaggcgcucccgaccacugcugcugccucgugagccagaguccugcgggaagaagaguuagguuuuggggagccauauucuagaaacauccucccccuaauuuuuuuuuuuaaucaaagaaagcauaaaagggguauuuagggagaaagccuccuaugagcaggucuggaccaaggucuacagggucuggcucagcucuagaaggaacucaacaaugucagggaagccuuagacaccagacugcugaaucccaagaugaggcaugugagggcaucugcaggguaggaacucccaccuccuauaggcaaaacaggguggucauagagucaggacacacacacacccuggggaccugcaccucaggacagagcugcucccuagauuccagcagugcccguagcuauguggacacugcuggcagcugauauggaccuacgugggggacccuugcacauauuuaggcuuugagaccccaggagaggcucccuucaggcaggaagugagaggcggcaguugaguugggcugggcugggcugggcuggggagaccccgccucacggacugauuuucuguauaaacagucacagcagcaccacacagccuggagaaaccagacccaacagcccugcaugccugucaccugugacuagggaggaauccucagggcaaggcagagaggcaaagucagggagccacggagcagaggggagacugagggccaggagccuccugguacaacuuugaggcccuucccucacuacugcaggagaagcccaacacaaggcagacaguggcacucacuagggacacgagguccucuggaugauauggcugaacccauggugugacugaaaggcucaugguagccagcauaguaacacugauugucucuggauacaggccugccagccauucuaccggcuccuugugguuauccccagggucagcagcuagcaucaccagagcauauguaagccccgaggggaggggucguggcuguaccaccacuuaacccugugugugcagagugaggacagcuuagcaccguaccuccccgccuccauucucacagagucuaccacaagcccuccugcuccccacagacagccagccacgauuaauugagggagacaggcugcugauugaauuuuuaaugagcagcaacaucuguuuccuucccugggugcagcagcaggcugucucuguucccuugugggguccucauggguucaugaccucugaccugcccuccucaggagaaacauucacacaguaccguauagguguguauggcagggugcggguggggugggggcacauaucccacucacaccaggacaaacaaggagacuagaaaaauggccaucaggcugggcagugguggcacaugccuuuaaucccagcacuacagagugaguucuaggacagccaggcuacacagagaaauccugucuccaaaaaaaaaaaaaaccaaaaaccaaaaaacaaaaaacaaaaaauagccccaaagaugaaaaaagagaaaaaaaagagaaaagaaaaaauggucaucaggccaauuggggggguggggggaagggggguuugcacacugcugcccuccucaggccuguggccucucugacuagaaccuggcuaaccaggccaucuguggggcagggugcugccugggugacaaggacagaaaaagccccggcaugguggcugccccagggcacccuccuggcagcagcuguggcagacaagauaugucugcagagcugcuccaagacacagcugcauccaugaaaggcagcggcugggaaggagagaacucucauucuccagugauuagagugaggucuccacagcuggucaagugggaugagcccguuaguuuccagacuguucuucauucaucucucacgcggcuuccacugccuggucacccuggagccacacacccccuugacuuccaaccaguggauguugccuccagaggccccuagugacucauggccacacuacagggagagcgcaucccccgcccuccuggaaaggauuaaacucucugcugagcucugagcaucauccacugugugugugcuuggcgguggcgguggcgguggcgguggcggucucccugguggcgagcaggucuuguuaaccacagcgugaacugcuggagcagagccaucagagcccuucuccggguuacuaaauguuucugaggcaguaaggauccucugaggauagugacaggcuccgggcagaggagucacgaggcagaggcacuuggaaccuccuaguucuccaaggggacaauacaugaagugucuuggaccugggccaggggcuccagucagcagaagcuccggggcccaaggcaggaacaggaagugacccucccaccagcuucucucucaggagcaaagccagucaccaggcaagcugguuacccagggaagggaagcucuauggggguuuuuaucagcugacucauugucugaggucaaagcugcgcucuggcaggaguccacagacaggagaugguuggcgguggcaacuucucugacuucucuuaagccaggacagggugggucuaggcugcucugagcugagauucgaugacaggaucgcucagacagguuucccaggguuaagugugacuucagccacaggaggaaugggccaaggcuggcccccacgcuucagucaggagccugauggaugcuccaagcacuuuacuggggacaccaaucagaccugaagggcagaugaaacucacacucuugccuauccugcccugccccagcggggagaggugcucuccuuccccucccccuccaucucugugguuuaauuaguacuuccuagcaguacaaacccucugggaauggggcuggagaaucccgggaaagccacagcugacagcgguucuuaauuagcaaggcccccucuaggcgccaggcugccaggccgccgggaggcccagcaguacaggggaagcucuggggcuggcuccuccacugcaguuagguuauggccagcuagagacugcagacacaaggaccccggugcuggcuggcaucagggaccaucagaguuagccuacagucccgccccuacuccuccaaagcagucacagcuauugucuagccaaagauccaaggcacucuaugguuguugucugucucaaccuggugccucuggguauguagaccccuaaagaagugauugccguccaggccaccagaggacacaauaagacaccacuguguaaaggggcagggccuuggcgacccccucccuccccaggcuuagggaggcucuggccuccuaaagcaagcaacgaugaauuugugguacucugucacaagucugauguaaggguugccuuaauccuagcaucuuccaguaccgggugcguaucaagcucaccuagcagaagagucugaggaccagggugagaggucaaccucgcccccaacucaaguucucaacagagcuguggacagaaaacagccugcaggaacacccccacauaccccgccuccauccccauuacccccaccacgcccacaccucugggcggcgccacucaccuggcggcucucgcuucuccagacuccauugacgguuuuagugggggcaauagugaccacugggggagugcuggggacacugugacccccgggggggacgaugauggggcccaugggcacucguuugggcgugcuagcuggagagcuaugguugguggcuggagaggacacuggagaugacucgcugcucagugaggacccugcggaaagagaacgaagcagcucaggguccugugugugucacaccaccacccaccgcgcccacgcgucuugccauuccagaaugcucauggggagugaggcccaagagcgggcaggcagggacggacccacagccauucuguggccucccuugucauacugccucucaggcguggagguggagagcuauuuuuacacuuaaaaaaucugagaugucacucacucuuuuaaaaccacgucaauguaccuccgguggaucggccauauugagugaaugcuacuauacccagaacagccucacgaccccagaaagaagcaauguguuucccuugccaaccacccccagcagcaaaagggaagaggggcagguagguggcgguagugaggcagcuuaguucuugggagugucgguuccaacagaacuugguagugagggauggucucugucacuaacauagcccccucuuucccgggacaaucaugcuaccugcggacacauggcacggccucuuugacugcggaggcccauguguaacuuguguaauuguacagcgcagugccccgagcaguuccagccaagcacaccucuuguucacaugacuaccagggccugaccucagcaaucaggcugaaggcuggagccuagggaagaaucucucaggucuccaaugggcaccacacccacugccuacagccugagaacucucuagucucaaguggguagcgggcagcagcaagccccaaggcugggcagugugaacccagcacggugaccgcccagcaccugccagucagaaagcacaggagagcagcuaggcucagagacacgauggcucgggaggccagcuucugggagcugauggaggcaagcuaccgguuggugcagccagaccuggggacugaccaagaaccuuggcacgagcgagcuaccauucaggagccagggagggcguggcauucuauaccucccuagauucaguaggaggguaucccucugugcaccugagaaagccaaggggccagaaagccacacccuaggccugcaaugcccgucacuguauguguccaaaagugucaacuaaacaccccggagaaaguccaugcggucuguugugaaucaugcccacagccuugggcuauaccgagucccagcccugccuauucuauacaggaaugccccaacaaggcccucagccacauucacgagaggacacauggaacagaaaaagccgagucaagcacacagcgugggaugcaaccuccuugcucagagacaguaccucaaaggguagaacauagcuccuggggggggggggggacggacggauggauggacagaaaggcaggggcccaacuuuucagcccaagcuggcccagagcugacaaucagguugucuccacgccaggcaaaaacgcaaucacuuucacauuauuuuuaggaauccuccuauugccuaaaacagcaaccuguucgggugugcugcgcgguccuucccaggggagccacgguaugaugcucaugucuaauacgcuaucgaucucuguguacgcggaaaucugugugugcggguacacauguggcagaggccagacaacaaccuugggugcaguccucgggacacuacuuacuguuucuaagacaggcucucuccacagccuggagcucaagucaggcuagacagaauggcggggggugggggguggagguccccuagggcuuuguguguccauacuuccuuggcaugagauugggaguggaagauagcaugccugccuucaaacagguauguucuagggcucaaacucaggucccucaagcauuuuacugacugaaucaucucccuagcaacuccuccuccccucccccucuuuugagauaggaucucaagcuggagcccugccuggucuggacucauggcaauccuccugcccucgccaucugaacccugggaugaaaggacagagccaccucagcagagccagccccccccccuucucgcuugaucaccaccaucaaccugcggaacacuuuuauaaccugcagccgugccuguuccgccccugagacccagcagccugagagggugacaucuguaggcucugggcauucccuggcccccucugcugaacggugucucccaaaccagaacuccauccauaccucaagguugcugaccaucaccgagggggacaagucaccucccccaauucuucagccaugggacaguugccuggcccuaccugacagcuacugugaacaguagcucccacccacugcacagacacgaacacaagggccaggaacaugcuauccucacacgggagcaaaaacaguuaacacuuccacacacagaagaccaccgccagcuacggcaguggccgucucacacacuaacuauccaggugacugcaggcgcuggaccaucauugagggcucugggcccugcugagauagguagccaaaugacccuccucagggggcgaaaucagauggugccucagggaccauccuagcuccucuguacccccccccccgccgucuguauaagggacagggcagucccaaggcagccagcucagcuggccccucucugccccuucccaugcuagcaauagccuggcccagcaagggacgaguauggggcaggcaggcucuaguguggggcuggcucagagaggaugaggcuggccauggacaauuagcagccuaaucccgucggagguggaaggcagaggccagugcucaccagcgagagcccugggaucaauaccucacaaggcgcugccaauuagcgaggcuggcgccuggcucccagcccugugcucucucuuucucucuagcugugcugccggagcaggcagguccgccaucgcuguaauuaacugaagcuauucagccagaguggugggaaugggucagagagccagggccgggcugcagaugaagaggcagaggggugccugcaucaccuuugcugacugaccccacagaugaggccaaggcccuguggggcaguccguguuauuaagagccaagacccccaaaggcaagagcuugggcagccuuagccagcuggugcagauaugaacugcugaacaacaccugcaauggccccuuucccugaauaugucaguugaauaugugcaugucaguucgagcacgcaagaugauuucaggugcuuuccuuaacggcucucccuguauuuacugacucucucacugaacccggagcuugacuggugugaccagcuuagcaaggggggggggggugguccuuccaccucugccucccccacacagguucuagagaucugaacucaggucuggaucucugcacagcagguacucuuaucugacaucccugcugggagaaguggucccacaucucagggcugucccucuugucccugcagacucaagcgacucccaccaguuaguuguggggguggguguuaagaaacaagaaauaaacccaaccaacacuacaucccaaccacugcccgggcaccaugaggaacuggcagcgaaggggaccuaggaccaagggcacagugacaaacaccaggcagggaagugcucuggagcccccagaguguagcacaaauagccaggcgugcagcaggaaguuccagcagagguauccgccaugauaugcagcuuugaggagacagugaaacugaaccacgggguggccauaugcugccggacaggacucuucuccugcucugccagugugucuucacgcaugucacaggucuggaggcuggguggccucaguguccauccgcgagggaacggggcugguggcggugccguuaaaccccagucagcagucaggaaggggcugugacuugagagaaacuaacuuuccaguaacaccuguugggcaaagaacgugccgugaccaaccacagcaccaguccugagaacugaggcuggcaggagccagugaggaucccuuggagcugagcucugucccacugccacugccguguuaggacacuaugaagauugugugggggugggcgugggaugggggauagaaagaggaaggaaggagaggugguaagagggguggagaaggaaggaccaucauccugauguccauacacccugcucaccuccugucaccucagggccagcuguggcucuggacucugggugguucucccuccccauccuggucucucuccuccacaauagcuagccccgcugcucacaccugagacacaggcagauggggcuccagacaccccgcgaagaugccuccaccuugccagcuguagacugacaggcaggcaggcaggcaggcaggcaggccauuuguuugguuguuuucuuugaaagaggcagauuuccaaggagaugaacccaggguguguuucagccugcacccagcccacccuguagcagacaugcaggcggggggggggggggggcugcuuggacucaaacccagagggaugguccccagccucugccucucaggggcuggguggguuucauccaccacccaugguaacuugacgccccuugguuacagggccggcagguggcaaagauuuccggaaaguucagagcacuagggaugucuaaucagaagcuuaaaagcucuaagcuacccuuguccccacaggugacaaaguggcgaauagccagguauaaggcggcucuucccccaugugcuuccugggaaacagggggcccaaggccccggguguacuggaacugaggguacacacagcucuggugcugugugggucuucuaccgaucagccagggacaugugggcuaccgucgcacccccaccccccucggcagacggcaccagggccccgugggagaugagcagauugccacacagcuugggcccugccuggcagcagcacccagcuucaucucgcacaggugggggcuguggcggggacucuuacagcuugcucucacagaggccaaagagccucucugcucugagaaccucagauggggccaggcuggugguggcuugagacguggcucuggguguaagaucccagaagcucccaguaccccuuuacucaaaguaacuuaacuaagcccacugagcaaucugggggacccuugccuucaaggcagcugggcuaaugucacagaaagacagaaacacccccgucccccccaccccccaccagggcagcaugauagacagggcugguaggagugcucaacacccgccaagcugggcucccagcacagggaaagauggaaucuuaaagaggcuuaagggccucuggggggaggggcagcgcuacuuggaggaaagacuggauccuagccucuacaaagacuggagcuacaauguugccagccacacguggauggaggcagcuucaggacagcugagcacccuggggacauuauucagaguccacaguaauaguaguaacuuaagaagccagggcaggacagacccagggguccagccugggggcugggcuggauccacagcccaaugcuccuuccagaaaccaggguagaagucagggugcucccccccgcccuccauccuccuuggaagcccacccacugcaccacuggcaggccacagugggccaagcagcuaccuaggcuuggccaggcugggaccacagcaguggggacccacaauggcugacccuggguguugccaaguuuagggaguuggggugggguggggcauaaacagggacaacaggauuagaaaauggcgguggggacaauuggggaagccccagcgacagcacuugggaaggcaguuaugggggccgcacuuaauuacgugaucuguguuccguucuguaugcuaucacuagaucaacagacugccagugguggccugcuggcccugggcaaaagcugaggcucagacuguuaagccaacacaccagggcacagcaagugauuaaaagugccaggauguguacugggccuggcccggugaaucccagcgucuucuggcaaaaccuuggccuugccuuaacuacgacuaccacaugggauggggcccacagccugggauauccccuguggggcccacagaggucuugggaggggcuagcuucucuucccucccccucugccuuucucuggcggggagggggcagagcaaaugaggcggcaugcugauugcguugucuggauugaauuuuucaacugcaccccugagacaccaugaagagagacgucggcagcagaagccuaggcgagcccagucagauagcuaaaaauacaacuguuuccaggaagggugggcacggggcagagccucagggacggaggggacacagagcgaggccccugcggggugacagcagcaguucuggaggacaccccaccuucacuccagagccuucuuaccugcuggggugggcugagagccaccacgggcucucaggcgcggcagcucagaugccuguccugugggggccuaagaacaugagccuggaauugccugggacacagacagacuggagagucagggaaugaagagccacagcuagauaccagguaggugcugggcccagagagggugccugucccaccugccuccccaugugacuagcauggcuugcacaguggggucaaaggauggagcaacaagacagggaaucauggggggggggggggaggccagaaaaggguaacccugcgggggauacaaaacauguucuggauugcuagagaggaugugugcuaaaagcugcauguguaaucaaagcugagugggaauggcuuauccggcucagggguggcacuugcaugcacgcgcaaggcccuggguuugcuccccggcacucugugaguuggguacguccaucacccaguaaccagaaauugaaggucacccucagcuacacacagucccaggcuaaccugggcugcaagacaccugaucucaagaaaauauugaacccgggugguaguggcacacgccuuuaaucccgggacugaggggggggacgggggaugggggagcaagaggcaggcagaucucugauggugaggccagccuggucuacgaagugaaauccaggacagccagggcuacacagagaaacccucucagaaaaaaaacaaaaaaacaaaaacaaauaaacagcccucccccuccccccaacuuaagauauggcuuguggaaugaaguauucuggaacuggcaacccacagccggggaggccaauccagcucuccacagcucuccacagccaagccccugcaccacacuggugcucgcugaacaagaaagcagcucccuccuuccggggccacgugcuugaaauuccuaguuccaacuguccaaguccucucaggggacaggaggaugcgcucccgggacccuggucucacaacacgaccccuccgcgcaguagcuuuaguauccguacaacaugucaccucagcaacaccagguccaaaccgaggugacagagaaucacuaccaguccuggcgacacagacgagaaccugaagacuagcggggugggccuuaacuucgcugcgcugccaagacacccaguuuccaguaagguagcagacgagggcccaggcccagcuggacaccagugucaggaugucccaggguccccaagcuacccuguauccacagacacuaagcaucgcaagccccaaguccccaucugcacauggggaagacucaggagacaggcuggcggagagaagccucggccagcggcacggccagccccaucuccuugucccgguguggcacaaaguuccugggcaucagaugcccaggucacagccaagaagcgacaggcgcgguggauaaugcaccuguuguucagaaucgaccguguuuccauucaccgcagccucugguacucggcccgaccaguuggccccaggauuuugcaggacaaugggagagcccaggauggcauaggugggcagacuaacuucuuccucagggucaccggaaccuggccagcagccaaccaaggugggcuggcucaggugugguccuuuggcagcagcugucuuccacugggcagacggacuacuuuuucuccucugguacccucagggcccaucccagucacacccucaccucugccagccaccagggcagagaacugugggauaucaggaaauccccgcccacuuauccagagcggacucucugcaagccuaaguguaagugauggcucuguaggaccccagggccuuugagacaaaguuuccauacuuuggccaccugccucucugagcagcaaguccaggaguugccagaaucugaagagcucccaaguucagacauaaaccgacccaucugugccacucauuccugacccgcacggucaucacaggacacaagacguguccaaagccagauccaaaggggaccuaagagaaccuuuugucaacaggaccgaauucagaaagagccagccuuugcccaaagcaacaugauguccucagcuugggaggcuucagaaggccaaucucuggucccacuggcguccccaauggcaaguccacuuguccaccaauaagcaucuacaguagccacugaagcugaggaaggcagaggcaggcacagaggaaggcacagugaagcagggugcagagcuggggucagaugucaggggucagggccugagguaugaugacagcuacacuugacggcuacacccgggcuagcucugccuggauguggugggggaggggagaugcaggugcaguaccacaagcugcagacagcugucuccuguggccacagcagccagagagaugcacagugggcagggggcaucccaugagcgaguggccuggugccucuuaccucugggcuccucugccuguuuggcgagcuugcgcagugcggcagcaaagcuggaggauggagcggccugggccgacagcguacugcugguggccgggcuaccggugggcaccagggcgccauugaguggcgagggggugaggggguugacgguggcggugguccuggucgccguggaaagcaucccuauggaaggggacuugggcucauggcucaugccugaaacaggaaaagaagaaccagugucacccagagagcagagcgccagugccagggcacugcagcggcaugcagcgagagccaaggggcugcgagagcggagcacagccagcgaugcagacagcggacccauccccauaguccugcuggccccucgggucuaaaggcaccccgguugaagcugaaugcuggacuggcuccccagagccaggccuaugggauaccccgacacaccauaugcagagccccaccagaccccagagagacaaggcacgggcuggaacaacugagaagacaacacaagcagcggcugacgggcacggguacgaaaccauugacaucuucaacagcgucaagaggccggcucgacaacugccccauuguacggagaaggaaacugaggccugucugugggaucaacgcauacccagugccuaacuaacucucucucaggccggggccagucucuuccucacucugcucauauccaaucucccccaggugguaggagaugguggccaaggcuacagcucacugcaggcccuggugaaguccuucccuaggucccagggccugaagacacggaagaaugaaaucugccuuugaaaccacguuguagccuggaugcacuggucuuucccucagagggaaaggguuucgggagccaccucccacucucgcuccuucagcuuuuccaggcaccauccugguacugcuucccaucaucugggaaagaggcccgccuucacagagaccgcaccgcagaacaaucucucacuuccgcucacccccgcuuccuccacgugggugcccccaaaguaagcgcgcaagaaagaggucacugaggccgggcacaccagcaagggcuacaaagaugcccagagcaagcaggcuggcuggcuuccagugguggccagguccuguggugcaugggucaugucccgggggcagcaggcugcugagccuggaggcugaccuguguccauaccaggcccucuuuguaauggggaucagguagccaugacauccuggggacagcuccuaagauccaaucaggguggcucucuaagcuacugggguucucaaccugugggccccgauaucuuugacucuuuaggacuggaagucaccacagcaugaggaacuguaguaaagggucgcaggaucaggaagguucggaacauagccaagccacuaaggcacugucuacaccacccccuucuuuguggccagcaucucagucauccuuggaucucaaggagugcagauggugaaacugaggccaggugugccgaggcuggccugcuaucacagcugagugguaauguucucacauccccgcacucagccugaacccugcuacgccucaucacucagaacuacacgacuccggugauuuaaaacaugucccccaagucuugucacucauuccugcaagacacagagaaaggccuguguguaaaugguucugacaacucacuuccaacaaauacauuguuuucagcuuggggaggugggggugggaaccccuucuugccuuccagucccuggagcagcaaucugagcuggaccagaccagcuaagccuuuucugucguggacccacagagacuccaggcacuaggagacgcuauucuacucccuacaccaagcuuggggcaguuuaauauauugcauauugcacagaaucuggaaugagugguucaccucaacccaucagaagccaagaaacacucugccaacauauuugacccccagccucugccgcugacagugcaaagccaucucaggagccaucacaagggaugguguccuuggacucauuccacagauaugaguggguaggcucagcacaaggguggguugggagcagggccgggaccacucugggggaagagcuauguccugugugaagcaagcugccucagauccagcgggaggguugaagguucagugucucacccaaccaccugcaccaggugggcagcauggcagauggagaugcugggagccgcagcagcucgcgguacagcuguaggcccaucccccaaaucugaggagaggaccgugccacuggggagggggcacuucaagaugccaauggguguaagcggauaugcuggacccaccagacuuggcaggauggcagauaacaggauuugugauggguaggaccucccuguaccacaugcuaucaccaugcuccuguggguagcccaaacaggacuccaacugucagagagcaggggaccgauccaccccuagggccuccagcagucucaugcccagggcauggcugcccuuggcccccuacccuugggggugggggaccccaagccuagguucuggagauaucaguauguucccagccugggaagcugcucugaugucagcucccuuaaaauagaauuccaaaugagcggcuucauuagggggagucuaaaauuagcacuguuccucacacaugcgcacauggggcugguggggggagggguggggaacuggccccggguaccaaagaggaggacacacugccaaauuuuggggggagcugaagaguccucuucacucacagggccuagggccacuagguauagugucuauucugugccuggcaucccgagaagaaaccaccucaguaggcagguaccgguguccguagaggcucagguguggcaggcagggggggggcagcggaaaggagagaggugggcacgggaugccugcucucccuguccucauuaggggguauuuauuaacuucucuguucccagccgucgucaucuauaggacuggcuccugcgaauucauuauccuaaacaguugggaauaagcucuguggagcaagggccugugauggaugaggcccggggcugccugcaguccaugcaguccauguucuccaggcgagcagcucggugagaaagucagccuaaaucuaaguggacucuugggcacucuacacaggcuccuuccugcugccucgaccaaacguucacucucaagcuggccggccgcagcucuccccucucuagacccagaguccagagcucggguuucugucagaagcuacuaucuccacaaaauagcuggggacagccuggcugccuuggugcauccugcccgauucccccacuuaggguccuaacaugcccaggaauaucaucagugccaaggaaggagaccccagagcaccaggcagaugauacuccucaacucaccucgcucugguccugcacaguugacccagaagggguucacggggugggggaugggguggagggggucucagugccacuucccuccugcaguacaucaggaguuauuaaucagcccagccucccucccguugaggccguaauuaccgucccuuucaucccagcuccucccggcaccagaccucaggcuugcuccuucugcucuguaauuaccagcuaauagcugagaugaauuuucugaaggcccgguucaagcaccaauccgucccucccuccuccgccagcagccccucacccugggguaauuacacccagggaagcugugcccagcagagcaaggcucucaggcaguguggaccuggaugcucuaucugccccuucgucauuuuucauuaccgcacacugaaauguuugugaacagacagagacugggucggcccgggcuccacgcccccacccccacccccgugauccccgcgccccagagggugaugcuuuugcagcucuaacaaggcuggggucacccugcugcagggaccuggcggcugcaguaguguggggugcccacgugauccccagagccuggacggcuucauaauaaauucauuauuaugugugccgccgccgccgccggcuuguucugagcgcacccaugugaggcagcuucuccggggcgggggcagggaggccugcugauguucaacggugaguguaccccgcaggccgcuaaauccugccccucugccgcugcucccaaggucaguucccccaggaaccccugcacgaggcgacagagcgggagagcagagcagagcagagcagauggugacuccugacccaagaccgugaaagcggagaaagcagcaggcgaguggggguggccuggguaugacaggggcucugaucugugggucaggggaggaaugaggcagccaggcagaaugagggagggagaugggagagguuacccaccucugcacuguggacaaggacaggaggggcugcccacagcaugaaugccauggauguauaagcagccucugggguucccugcagccaugggagggcagagaauggggaccuuuugguaacuccaagccuuucacuguccaccccuaggcugucaaaggcccugcugucucaguguucugaaaaaaaaaaaugggaguacugacaggagacccacacgugguggaucgaaaaggugcaaagaaagggguaacagugagggauggcgcccgaacucagggugcagaggcagggguaccacggguuuaaugccgaccuagacuuggugaaaacucaucuuaaaaacaaguagucauggggcuggagagauggcucagcgguuaagagcgcugacugcucuuccagagguccagaguucaaaucccagcaaccacaugguggcucacaaccaucuguaaugagaucugccgcccucuucuggugugucugaagacagccacaguguacuucacauauaguaauaaauaaaauaaaaaaaauaguaaaaaggcggcugaggaugagcucaacaguaaagcacucacuuaggcauggcggaggacggagggagggagggagcaggggaggaaaggaggaaagagccaugaggcucuguggcuguagauguuagacaggccuccuaggaagucaccugacuagguacaaagcaacagagcaggagucucagagguucccaggcggcagcagggauggagccuggcaacagauggcagcgacauuugacgcgauuauucuaaguggcugcugcgcugugcuucgcuucgugagaagccuggcgugggcagacgaaggaggcuacacagccaccccacaccagcucggcaaaacccaccggaggaaagggucccugaggucgggaagccaguggucagcaccgccgaggguugacaguccagagcccggcaccauccccaauggugauccugacagcagcaggaggugggacuggcuuggagccagaggugugcacagggcuucuauaaccauaacguuacacacaggcauggcacccuucacaucagcagaccccacacaccaaccacagugacaggcaggugagacaggcaagauccuucccuucccugggcuccuuugucagcugcuuacuaacacuggggacggggacagggacuagggaccucaggguguccucgccucagccugacugcucagucuggcccaaccugccucccggacauagagacucugccauuacccaguccgguucggguguuuuacccagagggugaccaaggcuggcaagagccacaccucaucuaggcucagagucugucaucucuguaauguccacugagucagcuccuggggagcccaccgcgcaccacugucaccaugccugauacggagggccgaggacgacaggaugacagaggcaggcaacaucacccagcagcagugucuguacaccccagugagccccgaguggcccauggcaccuuugggcuucaucggucacaaagagcccuuugagcaccggccgcuggccuccuccccaaguccccaaaaacaaacacucaagcuguccaggacugagguuacgugccuccgagucuccaugggaugcaggccaggggccagcaggucgaggccaggcccugaguggucaccuggaaggcagcaaugcacaugugccgcccaguuccccagggauucucaggcuccaccaagacaggcccuccacucccauuuccuguuuuggcugggggcucagcagacccagggggcuacuugggaaguggggacagaaguguuacaacacaaaccucuccccagggcacacaccagccacauaccagcauuaucagcaggugcuauaggaggaggucacagguagauuccggaaggagggcuggggacagcaaggccaggcuguuuuccucuagccuugcccuaauggaaaccacgguuugauacaagccccuuggucccagccagugacagcuccaacacaggcuggccacuuuugagggucacccucagguuccaggugccaagcgugggagaagagacaaccacgcucuguuucuucuggcugcgcaggacauagugggcugagugucucuggccuaaagucacguuuaaguuguuugagugagacccagaaggaucaccuuaguauggaauuucgguugagauucuuccaagcugcugaguuacaaaacccaccgauccccaagucaggggucccagugcuggccucuaggucucagguggccacgcuccccagcucuggccucacaaguagccugcucagugcucgcaguccacgggagcugaaacacugggucccgcugggacucucaggcuccacguugcugacucaagaggaaguagggcccauccaggagggucccucucagauuguagcgaacucgcccgccacucaaauccgauucaggauuuggcccagaguauaagcaggcaaguggcuuguccccagggcccgcagaaaagguccugaccaccaaggccaacaguuugggucugaaggagacccaacuuccuacagguugucccccgacuuucacaugcccacagugacguacacacaaguaaaggaacgugacagaaaaauguaaaaagaccccuuuggggacuaggauguauggcaggaacagccugcuugccuacacacaaagcuccacucccccagauguuuaaaguggcagcuggguccuuggggcuuggauguaaaaugacuugugcaacaaaguuacuuugagcagccacuccuaacuaaugccccucccuaguaccaugcauggggacaaagucgcucagggauugagggaaagaaagcucuaguaccgugccucaauaucagacuggucuaccaccuucaaaacccaacaugccaagcccagacaccauaaaauucucaaccggggggugggggugggggacccuuaggccaugauggccuccuccaucagagaaaaacuuccuccacacacagcuacaaaccugggcaaacaugucaccgucuccagggugcauguguuaggugccccugagugaccaaccaccuauacccaagucacccuggcaacucaagcauacccacauucugcaggauuccaacugggaaccucuagccaagcaggcucagaguacaacccagacuugacccucccuacacugcagcagaccuaacgaaggcccugggagccggccuagcgcagacuccccugugggcagacaauccucauagccaaggcuggcuaagcacaggaccaaguuccccccauccacaucuccacccagggggcaggugagagccagcagaggagcagguggcacccgucccaccaugccuuucuguggcacugcaggcugcaauaauccugacuugaaaugcaugggaacagcagcuuggggagugaccuuucaaaguuggaauagcugcacggucacgguaagcuaccuugguguucuggggaagaaacucaggucuacauucaagacccaaagcugcuuucuacacaggaagacacauggccucaagugaauguacuuacuguuuauuuauauguguggacaugcacaggugccugaggcagccagaauagggagggcacuggcucccuaacucacccugggggcugggguggggcaaggagaggccccaccauggguuuugggaacuuuacuuuugcccccucggagagcaguaagcaugguuucuccagucccaagccugaagugaccccagggccucccacauaccagaucaguaacaauuucucagccauaaccccggcccugcaugguaauuuuaauaauuugagggacgaaacaguuccgcgguauagaguuuucuacucugaagcgacaucgguguuuacaaccgguuaugauuuuggagcgguuaggguggucucagcucaggguugcuuaaccugucuuuaagacuuaaagggcucacaccuccauaugcccuucuccauucuggccaacaaaggagucacacuugacaacagccaugcugguagaaggcucgauguauacaguacaaaggccaucaaacuuccagucaaccucccagaaugccucaguucauuucccacaauucuccagccuacuucauggguucuggcuagaaacagcagagcaugguggcagacaccuuuaaccucagcagcagagacagaggcagguggaucucuuguguggguucaaggccagucucaucaaguuccaggacagccagggcuuaaaaaaaaaaaaaaaagagcauucacaacccaaccaacucaacaugguugugacuggcaaaguucccuugcaaccagcagguaacuguggacauugcugcugccuggcaccaggacagaggggcaccccaaagaguagcacccuagagaaaggccucaauucauaaugaauuaguugauguucaaaguucaaggucaccacugcuucccagucaguuggcuaugguugucuagccugggcuacagaucauagcaaugaauaaaggggguggggcuggggaaauggcuccgugguuaagaguuauuauucucgcagaggaccuggaucggguugccagcaccuaguugguggcucacaacccucuagucuagggaauucaacacuuucuucuagccucagaggccgccacaggcucauggcacacauauaugcaugguggcaaaguacuuguacguauaaaaugaaaauaaauaacucuuuaaagaaaaauuaaaaccccaaagggccagugauagauaagaggucugugacauccaccccaacucccaaagcuggaguuuccacgcccacacuacacacacacacacacacacacacacacacacacucucucucucucucucucucucucucucucucucucucacacacacacacacacacacagagagaaaagcugaagugugcuuucuacccagcgugcacugcuuucugucauaaaguucaaagaguaaguugagacaucagaagucagggacuucugcacagcaccuugaacuuggaggcuuacgagcaacuagugaaaccuuagcuguucuuuaguuaagggccacacccggugccuaaaugacaaggucugucugaggcuccaggacuaaggcauggcuacugacucauauauauguauguauauguacguguguguguguguguguguguguguauacacacacacacacauauauauaucugcucaccagacacacucagggaaauaagaagcugaggaagggucaccuggauggaaaacaauuacagcauacgccuccccaacccaggggaggucggggaucaucagggacauucaggagagcagcacagaggcuaguggcuacaugggacuggaagguggaugcuaggaccauauucucagccaugguggcgugaggaagccauacuuugccaccaaacagguggcagaagacaggggcaaagggguuagccuaacuguuugcccugagguuuccgcaccuggagaugcaccugcuaccaugggggcccccccugcucucacacaaaugagaaaaacaccgugcgcugagugcaaaaaagaaaucugucaaaaacaaaagacaggcacacaccagcagcgacugggaaagauccacucuguuuacacaggcccuucauuccacaccagcaaccugucccuuggggagagaucugaagucaggacagaaaauaacuuggugucuggcuuuucuccaagccuggcauacugccccauggguccaaugucugaccacaagcaggaagccuggugggagaggccagagcccaucuguaugcaaagacucagguuauccccaucuggccagaaacugccuggauccggggugcuccgcuugcccugggagauccuaggaagucaccugccccaaauauguauggcaagauacugucagggccugaccccccaacaccccccucuuuucuccccccacccccauccccguaaaagggacaagcccaggauuaguugaaagcagcaccugcagccccagccugccccucccccgccccucgugagccuguuugugagcucgacacauggauuuuccuuugggacggcuuaaccuguccaacaucaauacagcucugaccaaaagccguacagaucgaucccuuuuauggcugcuugcagccgcaggcccaccgguggugugagugcagaggggcagagacaaggggccagugcaugcuggaguggcucccaaguguaagcccacgguuuccaagggagcgggagguugggggagggaagguguacagaggcgucugaguugguuuuggcgaccccagccaggugacccuccagaacagcugaguaacuccacacggcaggcuaauuuauaccuggaaaagaguccccuugcugcucaccaugaggaccuggcucuguguugaaauaaauuacagggacaccaucacccuuuacggagcuuguggguaccagggacccccuucagacacucaugcgcuugccaccugcccuaggucagaggccgccacugaggcccacaacccaggcuguaaacacacuggcugggagaugcagagcagccaguacacacacguacacacacacacacacacacacacacacacacacacacacacacacacacacaaacacccggauguguuagcccuucuaucacuguuggccucagcccacugucuggggcacacacauuacuauuugaacuucucucaaagcaggaccuccgagcguccaucucacagccaucuguagccagcuccaucucuccccaccccucugacccagcaccuccaaaacucccacuaagaauaacuuaaggaaugagccacagagcaacagcgaaggguucuggcccauacuuaggccagcacaaacccagucauuaucccuagggggaggagguuccaguacgaggaccaaggguguaaaacagugcagaagccccaaagccaagggugggacugaucaagaguucaagaccagcccggcugugcggcugugcugaugcacgccuuagaucccagcacuugggaggcaggcagaugucugugaguucaagggcagccuggucuacagagagaguuccagacaaccauagcuacuuagagaaguccgucuuaaugggagaagaaaaaacaaaccaacaacaacaacaaaaaaaaaaaaccaacaacaacaaaaaaaaacccacccaacccaaaacaaacaagccaaaaacacaaagccaaaaauaguucaagacuagccgguacaaucacugccuagcaaguagaaggcacugcucucuucucugcugcauaaagguguuggcucaugcuguugucccagcucuuaggagucuaggcaggagaaccagaagaccgaggucacccucagauacucgaggccagccguuggauagaagaccuuaucacaagacgacacagaucaagaucaguccaggcuacaacgcugagcgccucacaaaaaguugucuguuacuccaggugugaugcaugccuuucuaacagcagcgcaccuuuaaccccagcccuugcuggcaaagaccgggagaguuugagaucaggccagucuaucuauaaaguuuuucaggcuugacuagaacaacagagcaagaaugucucaaaacaaaaacaaaaacaaaaaacccauaaccaggcuggagauagcucagcaguuccaagcacuuccagcucucagggagaaugacuggaugggcagggcguucaugguggcuccgaaccaucuacauuuccaguuucaggggaauccaauggccucuucugaccucugugggcaccguacacacaugauacaaacaugaaggcauucacacauacacauaaauacaaauccuuuuuuucuuuuuuucuuucuuuuuuguuuuuucgagacaggguuucucuguguagcucuggcuguccuggaacucacucuguagaccaggcugaccucaaacucagaaauccgccugccucugucucccaagugcugggauuaaaggcgugugccaccacugcucagcuucuuuuuuaagaauuauuuauucuauguauaugaguacacuguauguagcugucuucaggcacaccagaagagggcaucagaucuugugagcccccaugugguugcugggaauugaacucaggaccucuggaagagcagucagugcucuuaaccacugagccaucucucuagcaucaccgaccccccccccuuuuuuuucuuucuguagccccagcuaucuuggaacucaagagauccaccugccucugccucugccuccugacugcuggaauuaagaagccuauaccacuacacugggcaaaauaaauuuuaaaaaacaaacaaacaaaaccccaacaaaacaguaaauaacaauacagaugcuaggucccaucccagagauggggguucaucugaauggaggcaugacauggauaccaggugcuuuuuuccuaaacuguagucaaugaugauccucagaaaccagaauacacccccccuuuuuccacacaucccguacuccaguuaaugaugacucuuuccucagaaucccuaacagccaaacccuuuucccccauuuuucauggugacugagaacagacucugguguccucaagaugucccuguuacuacaguuaucccuucaggccuagucucccugaggcuagcugucacucuccuggccucuaaaaggugggcacagagagacaggcaccgaggggagaagagcgggugugccuggagcccaccagacccagggcaaccuguacaaggacacggacuuugccagaaagggacugcucaaguagcuuuaucuggcugggguggagagcaugagggaguguaaggagcugguggggagaugcucugcagaggccagauuaaaaggccuccggagcgcacauuggcagcacguuggaugcucucucguuucaucugucuguacaccucccagcagugagugcgaggccggguucaggaggcacucgauaaauucucauugacaggaacacucagaaacgucaccuccuaggcuguggccugugugccuuguggggggggggggguggagagaaaggccauagugggaagugaagccagcaguacuggcgggcugcauuuggccaggacucggagaucugagacuccaugggggcagaaauuaaagugacucggcaggucugccgcacagccacggggcugaaaugucaccucaaacguaguucucugcagguuaaacaugcucucuugcccuaagaucccaggagagggagagagggaaagggguggggguugggccucauagaggguuuguggcuguugccacaacacggguaauuaacgugcccccccccccagaaggcuccuauccaaccccaccaggcuuuggaguaacccaggcugggcauuccaaggcugcagauggagccaggaaaaaccggcccugcuggcucacuccacaagccccugcggguuccugggggcaaggggggaaaaagcggcagcuggcuauuacucauugcgucucuaggaagaggaggagaccagcagcagggagcugaggcuagaccuccuucauagccggggaaauggaccacaccugccugaagggucaaggccagcuggggaaggacucuggcgggcuugggcgagggccuggcugggaaggugcaggcccaggguccaccacaaaguggugcagaccucuccucccccuuccucuggcuagaggcgcagggcccugagguggcugccuuucugcaaaccgcacagcccuuugagaucugcagcuuccaacuuccuccagagacagggaaguuaaguuacucacagccagaggccgccugccugccugccagagggacagcuuagccaagagcaaccagaggcuuccaaagggucaggcuguuuuggaagcuucccaccacccccaccccauuaaaaaccuaccuggaggcaucagaaucgccccaggccagccccaagguuagcuuaaugggggccugacaaggccugauuccuaguaauuuuaaaauguuaacuaacuauauacacccccuuuucaaccguaacuggucagaauccuacuagcugcccccaacaggucagggccugaucuggccucucugccuucccgguucggaaccugcccuaaggcaggcacaacagagcccaaagccaggacaggccucccaccuccuuuccgaaggcguggcugaccccgggucucuggcuggcugcucaccagcgcccccuccccccaagccuccuccgcuccagcugccaaaccaggcgacaaaagccaaccuuguaccaagccaucaaggcgcacacacacacacacacacacacacacacacacacacacacaccccaggagguggucaggcgugacccgguggcugugagaaguguugagcaagcggcuucggcacagcgagccccaucgagggaggcugccagcaacccuguuccgguccacccgguggggcgugacacccagcauagcagaugacacacgcugccagucggagccugugccccggccccccucaccuguggcggggcgacugaguggcugagucagacacagccugcgccucagguuccccgccugcgggugggggcggcuguaaacacaggcuaagcaacacuuaaguagccaagcuuaaguaacacggacgcccagggaaggcugcucgccaggggggccuugucuuccucgggaagaggggguaaaccagucucagacugagacacugccaagcggccagccaagaccuccugccucuuugucccccagugcugggaaucggcuuaggcccgaugcucccuccuagagcgaggcugcgccuuuuguuccgguccucuuuacaaaaggaucuuguauuuugguuuguuuuuuuccccccuuccauuugguggucucgcuuguuuucaaaccccaaccugugugggccccaaccgcgacagauaaggcaccgcaggggucuaguaaggguuuagagugcuuuaaaugcauggaagacaaaggcugguuugcaccaaaccgacccaacucgagcuggcacccccaccacggguggcaggugcgcgggggcgccccuugcucgcucccggcuccgaugcccagaccugcggccccaagccugcuccucgcaguccuauucggcccccgccaccucccggcgcucggagaggcgggcagcggggagggcagcccagcucccgcuccgccuccaagaagggaauuuaauuagccugccggagaggcggcgggcgacgaggugucucuggugcugcaauauaauugaaucggcuccacucgggcgggccacucgccgucagcgcggccgcggggggcggggaggcgcauccaggcggagcgggaagggcugggcgggggguucggaggccccuuggacugccaccccagguaaagcacccccccccccauccaaccaccugccugggcgcccccgccccauccaaaguuuugcuacaaccccgagccccggagccgcccccgcgcacuuccccgcgcacuuccgcggcagcagagccggcugagcccagcgcgcgcgcgcgcagccgcgaguguggcuucaggucggccgcgcgccccgcgcuucucgucccucacacccgcgggaccuggcaccggccguuggcgccccucccgagcccacaaacuuggggagaggaagaacgagggaacccccgccaccaucccccacccgcgcgcucaccuuucaugccagggccccgcugcuccaccgcuccugacacaugccggagccaccgucgcccggguuugucugaacugcuuaucucacccggggcugugcggcggcggcuccgccgcucggggagguggagcuuccggggccugggccaagaaacaccugcugcugucgccgcugaggacacacccaagcgcaacgccgcccacuccccggccccggcucgcucccggcgcccugaccucagccggcgggaggugucggguuucagccgcaagcgcacgcgcgcgcaccgacagaccgcccggagcacccagcgcggucacaacccgccggguaggugccgccccccgcgcuccuggcgacccuggcuguccggacaguccagggggaucucucagaggccucgcgggccacucaucuccaagaguagggaggaguggcuuacaacacgccugccauauccgagccucauagccgccuccccaagcgccuggaacagugccuggcaccuggccacccacuaagagaggggagggauaggccuuuccuugugcugaguggaggggaccacacaauauaggccguuggccucucucgaucuccaagaugccugaucuauuaccacaacuuuaaaggacuuaauguuaagagcucgggccacgagccucugucccaaaguuuugcaaagucuccaucucgcuuuaaggaauuuuugagaaggccaaacggcgggggcucuaguucuuuaaagagcccauguucgagaaguccacggaggcgccgcugcgccaggggcaucauuaaguagcugggguugcggucagaggcgaggccgccgccuccagaaacuggcacaacccaccgcgccaccggccccagcgcaccgccuucccacucuuggcacccccacccacccuaccucacccaggcacuucacggggaugacucagggagcguccugaaauuccucggcacccacaggcggcgcggagagggacugugggccccagcguccccgcccacaacgcgaccgaucccuagaaacacccccuucccgccacccgggaagcgcgagguuacagcgcgagccaggcagccggggacccucggccggacccagcgcgcagagagcagccaucgagguggcaaggucgucgcgaggucccggggucucccccgcccggccuuucuacacagcucucuuaaugauccuccacuuucagacuuucaagcccggaggccaccgcaccggggggguuggggggggaaccucagcgccgcugcgggucucaacuuuccaccgcggugccagccccaaaccugccccgggacaugcccgcgcagugcuccgcaggcgcgcgcugccucccccgccuuccucccucccgcgccagccgggacagcgccgggagcgagcgcgggcgccagcaccccccguccaucuguucccgaugacgccggcggcgggcagcgcucggggcccgcgccagcagaagccgccgaugccgcggggcgggggcgcacgccgggccagucuugcacaagccccuggccgaccacaaacgacaagggaaacgggcgggcgagggagggcggaguugcugcuccuaccugcggccaccgggucccuggccccacacacgcgcugcgcggccuuugguccacgcguuaguucgcgucgcccggggcagcguggccuccgcaaguuuacgacgcuggagaccaggaggaugcgccgggcuccccaggagugggggcggggagaggcgccuuuacccgucgggaaucgcacgcgggaggggggaggggggacagggaggugucaggagaaacaacuggccucgagccguaaaaacaaaaugaaaaaccucccgggcugguccaaccccuuucccaccuggauuacuggcuuggggggguggggaggggacaacauguaaaugagcagcucgcaccuggccgcgcugccugcgggccagguuccccagguaacaacaccaggcucuuccuccaaaucuugucgcaccuuucucccuaggguaucuagaaggccaaguucagucaccuguuuggugagaacuaggcaggccauccuauaaauuugugggugaccacuaugagcuaccaccuguuuugcuuuuuuuuuuuuuuuuaagaagcuggcugcucucccccaccccaccccaauacaaggcagcuccgcugaaaccguacccccaaccgggguuucaaaugagguaccugcccagaaaguagucaagguugcaagccugcaggugagccaggcauccucccccagcuucucaaaccaggagucuggucuccauccagccccagacuguccaagguagcaagagggugacagacacccacgauggccacagggggacagcagugagccagcuaugugcacucaggccagaaaaggcuggcagucaccaggagauggaugguccucacugucccuacacccugccccaggaaaucaguaauccugagcagggccuuugaguuuaagggugggaauugcucucuagccgccauguggcuggccccuuguuaacgagauguacccuguauggauggacugcuaauucccgacuccgaggcuaaaagcuaaccucccucuaguugccgcccccuccuccuuuuucuccucccccuccuccucgcagcugcuggcucccaccccaccagcaagcuauacaagccuuugcucucuggguccuuucccucaguuccauuuguuuagggaaguuggcugaaagaggauuugaaacaucaagugcuagggacgguccuggaaggugagcagaaccucuuagcucaggaugcuugcccgucuaggacacaggagcacccaacuuuccuugcuaggguucugccacgcugggccaccuagaauaggaagcaggauuucccucagcccagcccagcuaagccugguuuccucuguaaaagcccuggaccucagaaaccgaugaacucaaaaccccaggcaggagggguuucuggaccugcagggucugccagaaccaggacagguaugggcagcauccacuggacacacaucaaguccccccccccaccgcccgggcccuccccagaaacaaaacugaaaauuacagagccacagcucagaaaggccacagggcagauaccagaggcccacaggcgggcaugugaggcagccagaguuagggaggugagagagcaggcugcaggcuuagagccuccuucaccaaggucguguucccaccugaaccccgucugaagugagcccuggaggucaagugccucccagucuuuuccuccuggggcugggcaggaagacauaagaugaugugguuuccaguuuugaccaguccgcugcccucaccagaggcgacugcuuugucccccggcagcugcaccuccauacacuggagcccuagacugcagcauggaccagacuuagccaucacaaagaaacuuucccagcaaagacuugcugggcucuugucauccagugcccuccaggucuggccaggcagguggugagcaccacuuccaagugucaaugaaccugccucaagguucugaaacuggaacacaagccugaccuacgguugcuuacuuacaccuggcaguauuccgacaauccacaccccccacacacccccaacuaggagaccuucagcggaguuuguuacccuaguuauccaggcagggagguggugucucugaguucaggcucuuccucugcagcaguaggaaacccugcagaagggggggggggcgccacuggccuuggguuucuagcauuuuugcuuuugcuaagucucuggaugaacucuugguacccagaaaaccacccugguggaaggggggcugagaagcagagaaagagggucugcccagacuccauccauccugaccaccugagccaggcucuccacagcagcuggcaagcccucaaacccggcuccacuuucuuucucuucccucuuccacaucagcagccauccuucaaaacccugcucagaucuaugcucuuagaaggcuuucccaucucugccucuggaacucaccuuuccaggcuggucuuaccgguucagacaaaagugggccugggaaggcgcauuuacccugacuaaacuguucuaggguguaugggaaugacacccuguucuggggggggggggggagacccuugucucacagcagugacugcccagggcuggggggcuggcaagcaggcucuaacugccuguaacucaggcuugcugacccaggacaugaugcgggacagcggggaacggaaggcagccggugaccuucuaaaguggacuccuuuccaucuaacaugcgggucugacggcuggcuguuggggacugaggucacccaggcagcaggaaggggcuaagaccuggcggauccccucggcccauuggggaguuuuccucuuaacccugggccucggcgccacuuccugcgcuuucagcgccggcucccacccgcgccccgcacacagcugcacucuuuuacaaccaguuaacagcuguuuugcauagauuuucaauucuaauugccucgcuuugugagcgccuccgagccccggugaauggggacgccguggcccacggcuggaaggcgggcgggaagagggcacuugaggggagaagaagggagccagugugcgcaggcugccugccuuuauguuucuaaacaggagaagaauguccuggccaccaacugccccuguuccugcaucuccacccggagccucaaaaucuguaccuaacccuggccagccccuccacccagugacccagccccuaaccuucuccccaccccgccccgccccgcccaccccgcccgagcagacagcugggagcagcuuccuauccuugcuggcucaaggccccucccccuacaaagcacccccuccacccagucuaccgcaagccaccccugacaacagcuuacuaagccaccggcucagagcccagccacccccccccccccagcucucuaggacucagauaugagaggcuaauuggaccaugaaguugagcaaggagaaaucgcacucucuggagacagcuggcaucuauaaaagagaaauauuugcauuuaaaaccuuuaaacuuuauauggcugggccagggccuggcaggggaggaagggguggaaggggguugcuuggacccuccuuccagaggacagagacucccaggaggugguuugagacugcuggcacuacauuucugucaccaacugcucucaguggccuggcccugcucagguccaaguucuuggcuugugaauuccuggggagagcccuacagcuguccacaguccaagccucagaaguccccaguuaccaucacccccaacuccauuacagccucuucucucugcuugcccagccuggucuggcaacuuuacacccucaucacacaguggcgagccauggaggagacaacaccccccgccgccucccuacccuaccccacucaggagcuguccccccaaaaggcccuuguccugcaccucagugccauccccguggggggugccagguuuccauucccuuccaugccuacucccuauuuuuauauuugagaggaaccuggccacguuuucuccacugucaacauuugugacggagagccaggaggcccugucccugaguggucuuauuuuagcaggcuuuuaugaaagcgccgaacagccagaaucgcaucuaguccugacuguccugacuaccuggcaggccugaguggaaagagagagagagagagagagagagagagagagagagagagagagagagagagagagagccagcacccaggcagcgggagggggggaggggcccugacuucaagggcacacagcacaagggugggugagucuguguccaagagcggugaccagccaucagugggagcccccauuuucuucaccuacacaaaaccggauuuucagugaacaagcugcccuucuuccuagcuucuguuccugucagaacuggcuucuccugggccugugucccagcuuggucuugaggccugggacccuuggacacucccucaucccuccuaccgugcuuccagccagccacggaacaguucgugucuuugugguuucccaccuaccagcccacacucagaccuuucccacacgaccccgugcuguucagggaugauuuaaacacaagcuguguguuuuaccucagcagugccgaggcuggacuauccuagcacgugcuacacagucaguucucaacucucaagagcaagccuugaauacagcuccccgagucccaguucuugcuuguaggagaggucaacgguguauguguguggcuggugcccagguuucuagagcugauguacagacaccucccaccugccugagaacaggaaccuagaaaggaccaagcccgaggauuaggacuaucagcugagucacgaaauuccuuccguucacccugaggacagggaauaacaaaaagaaaaaagaggagagggggaggggaggggaggggaggggaggggaggggagaggagaggagaggagaggagaggagaggauuuuuaggccgggcagugguggcgcucccacccgggaggcagaggcaggcggauuucugaguuccaggccagccuggucuacagagugaguuccaagacagccaggacuauacagagaaaccgugucucaaaaaggaaaaaaagaagaaaaaaaauuuuaaaaauaggaagaaaaugauuuuugugaaugaugucacugggaggcccgccccuugauccuaggcagccugggauagcaaggacuccccucucuuccuaaugguacaaccaucagaccagcaacuuggaaaagagagcacagacagccccuucuaugcuucaggucucucggccuggcuggucucuuccaaacaccucuccagauugccaguccagcccaccugugaauaaccacaaaaccaagcuaugguggacuauuaagccaugaaaaaaaaauuacagggucccgauauguauuauacgguagauaaauucagggacaaagaacagacgauacaagcaucccucacagauguucaauuaauuagacagaugucaaaagguccugauaccuugcuggggaaugagguuuguuuguuuuuuuucuuuuuuuaagauuuauuuauuauuacacauaaguacacuguagcuaucuuccaacacacaagaagagggcaccagaucucauuacagaugguugugagccaccaugggguugcugggauuugaacucaggaccuucagaagagcagucagugcuuuuaaccgcugagccaucuauccagccccagggaaugaguuuuaagagcgugguauguccauucaguggaguacugucugguccuaagaagaaauggcugcucauaccucuaauccuagcauccgggaggcuggagcaggaugcaacacaaagagaaacuugucuuuuuugguuuuguuuuucuaagaccugguuucucuagguagccauggcuguccuggaaugcagggugcugggauuaaaggcccacacuaccuaccacacucaguagggagaaauccuguuucaaaaaagagaaagaagccagguguuaauugugguaccgugccuuuagucccagcacucuggagacagaggcaggcaaaucuccaaguucaaggccagccuggucuccagagugaguuccaagacagccagggcuaaaaagugaaacccugucucaaaaacaaaugaaaaaaaggaagagagggaggggggagagagagggaggggagagaggggagagggaggggggagagggaagagagagggggaggggggagaggggagagagagagggagagaggggaggggaaggaaaggaaaggaaaggaaaggaaaggaaaggaaaggaaaggaaaggaaaggaaaggaaaggaaaggaagcaagaaagaacaagcaagcaagcuugaccauaacaagauggaaaaacaugguggggaagggcagaggccauaccccaaggcugucacgugagucccaaauaugcaauguccagaaugggcagaucacagaggcagacagcagaugcauuagcagcuccuggggggaggaguggcugcucuugugggggcaguuuccugggugacgggucuguucugguucaaggacgacaggcgcgugguugcacaacacuguguacgugcuaaaugccacuggaccgcacaaguuuguuuguuugcuuuuuuuuucucuuugagauagucccuuuacuccauagcccaggcuggccuggaaaucacucuauauagcccaggcuagcuuagaauucaagaccucucugccucaccuggaaugacaggugugaacacugaauuuuuuuuuaacaaaauuuuaucuugugcauguauguguguacacauauaucauagagggaacaacucucaaaguucgcucucuaucuacccugugaguucugcugccugaacuccagacccgaggcuuaguggcaaacaccacaacccagggagccaccccaucccccacccccaacauuugguauuuuuauacagggucuucugcauccaaaacuggcuuggaauuuucuauguaguugaaaugacuacuaagcuugacacucuccccucccccacgccaaagugcuggaaguacuuugcgcuuuaacauggaagcugcaggcuaggggaggguggguguuuuccaggggaccccagcagaccuuggaaacuccccuuccagcagcacccucgccugugggcacuuuggacggacgcguggucacaggaaacggucagaugccacugagccuugccccaaggaacuuucccagacucugugcucugaggacuuaaagacacugcagcugcauuaccucguggcucucagcccucaggcuagaaaggucaccaagccccaucccuccugcugaggccucccucccccccccccccaaaaaaaagcugcagaccucuggucuuccccagccuggggccuggaacuccugagcaccuggggguggugacauuggaauguacaccugucuccacacaggaccuccaggcgcucuugccaccugcugcaaagcagacagcugugaccuggguagggguugggggauggggcagagcagcccaggauggggcaggcaggggagccaggugcgugggaggccccaauccugcaccccuuucuuauaggguaacaggagggcagugaaccuuccgacuucuuaaccaguccacucacagagccagagcacugcaggagcgacucugccuccuucccacagcugucucucugucugggcaaucgucuggauaagagggaggacggccucaccaagucccaguccaggccacauacucuaggacagagagaucuagggggugucccccaggaacuccacauguacccacacagacccuaaggauuccacacaaauggguguuggaguuuugugacucucccuacagauuuaaaagcuggaccggcuccggcuccaggcaagcccccuuggccugcaaaccucccagacuggaggcaccccuaaccuuuugcacacugauauggguugaagguccauaacgggccauguuucccugacugcugagagccuucugggccucugugguaccugagacucaggcagugucauggcugcagaacguggggguugguguuucacccagagaacauuacaguuacucuccccugccccucucucucccucuccacccccaaccguguguguguguguguguguguguguguguguuuugagacgggggguggggugggguggggggguucucuguauagcucuggcuaugcuagcacucuguggaccaggcuggccucaaacucauacucaccugccucugccccucaagugcugggguuaaagccgaacacuaccgugccuuacguuuuugccuuuaguccuuuuggaaauaaggcuuuucacuguagcccagguagccucgaacucucaacccucccggcccagcuucccggggaaugggaucauaggcguggccuccccagcuggccaaauaccugccuuguuucccagccucucauucuugucuugguuuucccacugccugucacuagagucccagccugucacagaaaccagcagaucccagaggccucuguggcuuguaaacuccaggauagaaacaccugcacagggucacaaaccccuguguccccagugccuggagaggacauucugggguccccaaggucagaucuugccuuugccagcuccaggcagcugcaaggauccuucagcccuuguucucauguuccugucccugccauuuagugucacaggcugagauaaccaaggagggaagguucguucgacaugagccauuucacagugaagaaaugguguuccggugaggggcagcaggccucagcagcaucccugccucaguuuccgccacccccccccccauccuuauaagcucugcauuuuccccagaugggccuucaguugcaccacagucuggugccgcauccggguccggcccaaaagcaucucuucucuuccuguggcauggagcagacaccaggcuggcugcugguguccagccucgcugaaagcugcccuagagggaccacugcacuuguauccuuccuuucucaggcuccccagggacuuggugacaaaggggacuucccucuccugcugccuccaucccuuagacuccaacagcagcaccuccuacuuuuacaaguggcauuuccucuuggcccacucugugguuccccagaggcugcacccccugcaucucuacccucaaggccacguauuugguauuuagacgcuguauuuccaaccuccccgggcccccagccucccucucacuuccagcucugcuuagccuggagccuugcuuggcccuuccaacucuccaccuugaacagcucuccccacucugcagccucagaccaaaaagcucaccuccuccagggaggcuuccagguuggaagcccaagcagacaccucuaccccuucacuuccuauuccuacuggguucagagacccagggcaagucagcagcuuucaccuugauaugcacaccucguuagcuacccaggggcgucccaaaagcaaagugguggagaagggguacaggcagccauggaguacucgggagagccugguucagaaaugaccgcacuggugacguagcaucggggugucguguguguguguguguguguguguguguguguguguguguguguguagggcaaaggcuguccucuagccccucccaucuugagaucacuggguucugaacaaggcuuggcugucucuuuccagcccacacagcaucagcuaagaaggaggcugugugcucccugcaauccaccauagaucaccacgcccuccucuccugggauugacagggcuacagagagcacagggccuccuccucuagguucugcugccuccccuguuucagaagcugagccccacuccacucccgcccucugugcugaccugccuggcuggcuggcaauuugagcucaggguuaacacagcccagcuaaggaguucuauuccuggcucauccaacaaacugcucaugaccuugggaaagucccccgugcugcacgcugccucccuccaagugcucccauuaauaaaccaaaguggcaccgugagaccgggcucuacuccagggugcuguguagugugggguggccuagaggaggagaugggucccuggccagcuacacagagcuacaggaagacacauuuauggaugaccugaaaccccucaggagucacagaccagagucccaggucacagcuccaggaccugacgaugggggaccuuagcaagccucuguaacgggaacaguggucacuguacugucagagaaaggaggcacauuaagagccuugucugcucacaguuggggugacagccucaccugugccccaggugaugucugggugggagcagauggagagacagagaggaggaggggggaagaggaagacaaaaggugagggaggagcaagagggaggaggagggaggaggaagaggaggagggaggaggaagaggaggaggaucaagagacacagaaggaccaggaggaggaagaggagcaggagaaacaagaggaacacccagcaggagaacugaauagcuggggccuacaauggcagauaagacaaaguggcucacagccacaccccugcagaacacagacaagcggucuacaggucaccuccauggcugcuguguaccagcaacccuccaguuccaccagcaagaacccaguggccaagccuccacaucaaagcugagucacuguccuaccugcuucuaucaguaccccuggcauggggauccaggguagaucugagagccaacaucacaagucaccccccacacacacccccuucccaggacccugggcacgcgcacucauccccaucagaaccacccagacaccagcuucuucuaccaucaagcuguggugugauccucucucucucuuuuuuucuucgagacaggguuucuuuguguaucccuggcuguccuggaacucacucuguagaccaggcuggccucgaacucagaaauccgccugccucugccucccaagugcugggauuaaaggcgugcgccaccacugagcggcugugauccucucuuaaaaguuaauuucaagcgacucuccucccucccaacaggaucugaggaagccuuaggaacuucugcuuauucuuuuauauuuuuuuuuccuaagcggcucccaguaacugagaggagaauuacauucagagagaauuggaucccuggagaaaguuaacguuauucguuuaacgacuucugugggugccggagaugugagcaggccguacccaaagaugucuccugcgguuauugggagauuuaauucacaacagccaaggaaaauaauuaagaggcauggaaggggugggcccagagguaccauggcuuaggggagggguggugguagccuugguggugucuggcaccuaucaccuaucaccacccugccacugagugaccgagaugacagaaugaacacagugaccagugucucagagcccgcuggcaugaacauacaugguacauucagccgagccacccaggcacaggaagcagccccagccccgagcacucuuccauacccacuuagggacacauccuggccuuaguugggacucuugcgguggcgauagggcuagcugucgcccacguggcugugggaagagcugguucuccuaagccucuaugaaucaagcgggacuguucccgaaaggugaaagcugguuugaugcacgucucccguggcaggcacuacgaggacggcucaccuuagaaacugacacugauccagcaagggccagggaggucugaggacuagaugguccaccgagcugcccugucuaacagagcauaucauaucacaaguggggcagaaggcugcagggucccuauaaggggucugccuagcacaggagcgagaaaaaccccaggccaagaaaaaaaaauggaaacacugcucuccaguagccuugucagcagcaguaucucagacugcaccagcugcucuuacgucugugguuccacagcaaaguccccaagccgggaagaacacagacagucaguccuacaagcaaugggacccagcugccaccaugccccucgaugagucagacacaccaaguggcuagaccgaagccacauggcaccacagacagacaacaacuaaacacgaguccaggcucaguccucccuccggcauccaguuaggggagaauccagaaagaucuagccugaacccaguuauagcugaggggauccaucuguuuauuuaagaauaccucugaguaaauccagaaaaaccugucauagaaaagccaucccagccccaaguggccacugagcaccuggaauguggccggugcgacuaagacacagaauuguuagguucacuuaaucucaauuuucaauagccacauguggucaguggugccgggcagaacggacaucuggauccagcuauggccacagccugugcgccaaggaaagaggugacugaguccugacauucacaugugcuuacggagaaacaggcggaacgucugaagagcccagaacacagccucggagagucuggcccccggauccccaguauagacauuugaaaagccgagucuagaacacgguaaagcccaguuucuucuccauucucgguaaacugcuuuagggccucacuucacaagucagcacagagggcugaggccaaagcugcucaaagcccaauuucaggugggugagcagagggaugggagaagagauaugggaggaacacggaaggaaggacagaagagugggcgaugacagaaggaaggaagauggauagaagggugagaaaaaaauggaugagugugcacauggaugguuaggugggcaggggaauaaauggaugggugaguaaguggauagauugauggacagguaggugguugaaugauggauuggcggaugggugagugguuagauggauggauagauggauaauagaugauagauugauggguggguggguggauugauggagagauaggcugauggauggauggguggauggauggauugauggagagauaggcagauggauggauggauggauggauugauggagagauaggcagauggauggauggauggauggauggauggauggauggauggauaaauggauagauggauagaugcacagauggguugauggagagaaaggcagauggauggauggguagauggauaguuggauggcuggauagcuggaugaauaauugaauggauagaugacuggauggauggauggaugggcagauggguugauggagagauaggcaaaauggauggaugagcagacagauggaagaaagaugggaaaagggugacuggcacacggaaggaaggaaaguggaugaugaauagaaaaggaagagggagcuggcagcgguggcacucucacgccuccuuuagccucagcccucuaauggcagaggcagguagaucuuuaugaguucuagccaaaagaagaaaagaaaagagagagagagagagaaaaaaaagauaaagaaugggugggugccugcaugcuggaaaaacacagaauuuaucuagcaguuccauaguuuagacauauggagcccauccugaggcaccccagaagcaacugugggcuucaggaggacacaguguauggcuggggagccaaugggcuucagcugugugcagugguggcccucauucccacagggcucagaguuucagugugugugguccugagcauccagacuguccuccacggaguugagaagacaaaccuggagucuggggagagggguagcuuccugagccgcugugcaggcaaacucagucgggacagcccuagaaucaaggccuggaggcgaggaucuugguauucauccauccauacucagcccccaggcagaagcacaggccugagagugagcagaagugcuggccagcacagggaaggcacuggugagugcaggcgcucaugucugugaggacgcauaaaggaaaggcaacuggaagcagccaugguauccaggggggcugaagaccagcagaagaccagcccgaauagccggcggcccccaggaagacccagccaggcgaccaaccagcccagcaucccaauucccccagagacuuggcucacauaugggccuacaguguggagagaaaggaguuuccagcaaacaccagaugggcaagcugaccaugguaggcagggaggccugccugcuccagcucugcccaccaacucccucagagccccaaggaaugaggcccccaggucggcccuacacaggugaucccagguccaagcaagccagucccggccccgcucugcucagacccaagccucccuuucuacagcagauccagaacucucccccgccccuacccacacagggcgaauggcaaguguggggcuugccuggcuuggggaaagagaccccagcaaucgggcacuuuuccaggcucgguuuccaagccccuccgcucagcccccuccgcccccacaagggagcagcagugugcucugucaucagaagcgcauuguuccggccagaagagaaaccggguccggcagauggcaggugaaacagaagcagcuugcuguggccaaaccaauuauuuaucuaauuaugauuuaccacuuaaccacaugaucuuucugcagaguugugggcaauuaaaaccagggugccuguguggauuaugcaaaugggcuguagcccagcagaauaaaauuggagauuagacauucacacagacugugcuggcccagggcagggccugggggugggggcggggguggggggagcaagugggaggagaggcugugggagguuccagggccaugucaggggcagggcuggggagggggggaagcgggugagggaggggcagcaguggaaauaacuccucccugacuccugccccuuucuggcuguucccaagaugacaucaggccucuugggaaggaaaagcaaggcaucuggccugaaggacucuguggagagccuggugucgccgggucugcucaauccuggcugaagaaacugagaaacagcugcuaagacuacaggcagccgccaccccugcuuggaugggcggcucuaggggcggaugggagggcaagaaggaaaggugcugguuaauugucuucaaggccggcugguacaaggaggaucccaccuuggcaauccugggaaguuacaucauucacguuuagucugcaugucacugcgguccuuucucggauuuggagacugaggcugagggcggccgcgcucacucagaggguggaccucaacggcuaagccaaccuccuagcagaucuagguuacuaagagcagggcaggguaucucugagccugugccuccaagcgagcugcuagacagggaacuccugucagggcacccggugagaacaggucuguucagauagguaacagucaccaugacgacgcaaccaccaagaucaggacacccaaggcaggucuaagcucccugucuggucauucugccauccgcagcagguuucucguggucucggagcucaguuuccaagucucugaaggggcugggcccccgguggcacacaccucuaauccuaccaccuaggaggaggcagaggcaggcgguucucuaaguuggaguccagccugggcuacagaguuaguuccgggacagccagggcuacacagagacacccugucucaauaaaucaaauaaagaagaaaaaaaccggaucuucaaagggacuagagauagggauccuggcuucuuugcaagucuagaagauugggggggggggugucgaaggacaucuaaaucucccugggcugccugaccagugggagaagagaccuagaaaagaugguguaaccacuggugauuaaaggacaucccucagagcuggcuuccuccaacccuguccucuuaaauaaucuguauguggggugcugugguuggucaucuuucugugugaugcccagagcagguccccagcuuguccaaagaugcggaucuggggucuucacaccuucauugcacacggaagacauugaagugacaaugacaagcucccaaguggaaacaugaaaacaaaccaacaaagagccccccagccuugccaucucuaccccucccauucuggaagcugccuccuaagcagaggggcuaugggcuggaugugcagaggccaugugugcugagcugaggagccuucguagguaccggucaccugaggcuugauggugacccagccgcugccaugccucagucguucagcgaggaggcucaacagauuguggcuagggggcacugcagaucuagaccguccuguccuuguagcccuggguagguaaaaaguaagccacagagaagaaagacuuuuuccuuuuugguccagacaaaucuccagcacuuugaaaagcuucaacaccacagaaauacacccauaacucugccacuagggcuccaagucugugcuuccuugagcugagucucugccaacaccagggacaacacgccaggagagcgauacucauggucacucgagcagggaaggagagggguauccuuugggauucgggcuccuuggaggccagguccuggacacacacauauacauaugugcauguacacacacacacacacacacacacacgcgcgcgcgcgcgcagcacacucauaaguagcauucccuugagaaacuagugaaugccaagaauccugccuuuccagaaagccccacccacucagcaucccagcuccaccaggccccaccuacucagcaucccuggauccauagcguuccacccagugggcaucccagcucuaccaggcccuaccuacucaagagucucagcuccaucaggcuccacccacucagagucccaguuccaccaggccacacccacuuagcauccagcuccaccaagccacacccacucagaaucccagcuccaccaggccccacccacucagcauuccagcuccacaggcccuacccacucagcaucgccaguuucuacccacucagagucccaguuccaccaggccccacccacucagcaucccaguuccaccaggccccacccacucagcauuccagcuccgccaggccccacccacucacacuaguaccuagaggccuuagcccucugcuuucugccucccucagcuaugccaguuugcaacucaauagcccugcuucaccugaaaaccauuaggacugcccccucaggaaccuggaugcuguucuggguuucuacagugcacacuugagagccugagagagaagcugggaagcaucgcugucaacagucugagccaggggcaucuggaugggugaggcaagaugacaggaaagaaguaccugggcccacccaccugcacccagccuucugcaaacuagcuccucccccagcuguggagcacucacccugaggguaccagggagugaggggcuggcugccuccucuuccaggaaggcaugcccuguucauaacgggauggcagcuuucaggcugcugcuccuguccacaggggacguuugcagcuugaaaacuccggaaacagaauguuuucagugauccuucuugauccagcaaaggucacagauggggccaucaauccugagaaauagugaagguccuggguucugcuggcucauucgugacagaggacagccuuaaucacuuccccuagggagcuggcccgguugcacaggcucaauuacugauacagcaaacugaccagauguggggcucuagcuggucauaaaagcuauucacacauugacaauuagcagccucaaggacugggguggggcaccgccucuaagguaaggacggagcaggcaaggggaauggagaagccucaguaggacauuggcucugcucauauccaugguuccaagaggccccaaggcugcucucccaacuaaugucccagaggggacacacugcuccuagaagcccagcucugucuuggcaaaaacucucaaaugcaaggagccagauggagaauguacucagcccuggaaccugucacugcugagaacagucuccggccuccgaagggacuuccagggguuugccacaggggagcaguugucaaccguggccugcaaggcuagaaccacacaggcuugagguucaguccaggaaggccuaggaugagcaggaaaggcccaggaaggggcaacaucaggccucgaacucagucuuacacugacccccacaggaaccgcaggccagggcugugccuaacaagccccccucaggccucugcucuauaaaccacaucaguaagagaagccaugcuugguccaggcugcauccaucguugaagccgagcugaagaugggagaccacaaacccacccacccacaaggcccugcaggggaguggucgcaagcaugugggaggggcuuccucccacauccccugccugaggagggugaucacccagagccuccugcacucugucgccccaucaauuccgcuguaauacauuuuaugaaugugcagaugguguguggagagggccaggggaagucucuaccuugggauaagaaauuagcacuggcaaauagugaauuuacaacauauauuuucauuucucuaauaccaggaccaucugccagcaacuggggcuccgcagcgacauucaccccuuuauuucucccauccgauuuaaaaaaauuuuuauuccuuuuuuuuuucuucuccaugggcccuacagauacugcccaaggugggagucagaucugcagaccagaacaucccagguuugaugugucccaugcauccccacccuaagaggagagcuguccucuuuugccuucuccagucugcagaacacagacaggcagacagacagacagacagacagacagacagauacacacacacacacacacacacacacacacacacacacacacacacacagaggaacacacgggucaugugagucagcuggaggccaggcuugaaccagcucggccucuacaugggauagugcaauaaagaggcauucagucaggccccuuggcagauggggacacacauuucucuuucugaucucuggaauuauuuaaaaucaaauggaagcuaccggaagcugcccuugagcacagcccucagaggacagggucuaugggccgggagcaagggagagaugaggugacaacagggauccccggagcccaggcgugagcagggggcuggcuaucaagaagcaaguuaaacuuuccaugcgcaaagcucagagcgaggcgagggggugggaggggcgagggggugggaggggcggggccugggagcccaccaagcccggcugcacucuuggccaggaggcguggcugccagacagcuggacuggcccugcucccaggagggcagggaaugauccuggagccccuguaggagccaauauuggggguggggggaguugugggggagaacugacaacuuaggugguaaagaccccaccccugggaccugagugugugacuuugugugaaggagaaucauuaacagugacccaggccaucugaacccaagaacugaaagagaaaggccguguguagaauaagaaccagaggucaggcugagcccaacuccuccuccuugaagcacccagacaaaccugccugugggugccuagccuccgagaagggagcuggaaguuaagcuguucaccccagacaccagauucgaaccccuaaauuuaucccagcaggcccaggggccugaucugugaauggagacacuccugagguaucaaagauaacugauagaaaauucaauuuuuuuuuuaaaggauguggacugaaguagcccaggcuagccuggagcuccugcucauccagucuccaucuacccagugcugagagggacaggcagcaggcaucaccacacccagacagaaauuuacugucaauggcagcaccaucuguguuauuccauggcaguucccaccucccacugaggugcggcuuauccucuuguccccauuuuacagguaggcgagcgagucacagagagguugagucccuugccacacagccagugaguggcagaggcaggaagagaacccaggcaggcuggcagagcaccccaaagcacacgugagcaacgccugggucacagcugaagucugucucccugacccccaggguagcagaacugacauugaagucagcuuuacaaaaaaagcccaggaaggacccacagacgguaaugacaauggaaggguuguggacagcaagaagauaaccacccaccuguaaccagcaacaauccugcaagaugcaagagaagucuggaggggccauaugcaacaguggaagccauucuucuccaugaaguauggaccacaucuacaagcagcaggcuccaacccccaaacagaauuauuaccuuauucaagucaccaacaagacuaaagggcgggcagaggcccucaggcucaaauggcucagagccaccuggacaggccugaccuugaauacccuagagaccaacagggagagagaggccucuaggacccagagagagauuggugucuagaggccuaguacacucuuccuagguccugccagccccuccccagacaagccagguagaagcugcaagcaucaaaacucaggcggcucugucugcucucacuuuuaaaagauggcuuggaggaucuguuacgcuuccaggacugggguuugauucccagcaccuacucgguagcugacaaccaacugugacuccacuuccgcaggacuugauguccuuuucugaccuccauggguaccaggcacgcacauggugcgcagacacacauucaggcagacccucuggcuggauauguacuugggauuuuaagugaccacccuucccugggcuaucugggauggcucucacaagugacaucagguucaagcacaaccccugccaccaucacccccccccccacacacacacaccauugaucccguaagugcuggagacagaagauggaucacucaggggacucucaggacaccagacacuuggacacaacagcauuccccuccccuacccccacgcccuaccgcugccacccccccccucaaccaacuaacucuucccgccagagugaagccagaacuugagauuggagaauaaaauucgauuugaaagaauuuuauggcucagcccaacgacagcuuuaaauauuaaaaaggcauaaaacgggaagggggguaaggagagggaggacgggaaagucguauggagaaccagccuugcugggccuccaaacacaucaccuuguaggaaggagcuugggagagaaaaggcugcuggggaggccacugccucccccacccuccgcuucccggaucuuccaaaccuuccccagacagguaauacauccauuauugauggaccaguacccagagaguguaaauuacugaaacaaacacagcauaauuaggguauuacaggcggcguggagggaaggcccgggugugcggcgcuuggcugggccuuucaucuuugcagguguucgggcugccuagccagcagcccagccugcuuaccauaugcacagccccgcuagccaguucucagcugggaggccuaugggguguguguguguguguguguaugggaggggggcuccaacccgcccccugccccccccaccccuaaauccaggagauccagccagccaaagcacacaggacaggggaggacaggccuccaaacacgcgagcacggguacacacacagggacacacacaaagacccaaggccggucugcgggcugugcagcuggcaagccugugucgcuguccccgugcgugcccucaggauuucaugacaagagugaagcugaucgggcagccucuggcuccguaauuagggccaauugaaggugacaaaggaaucuauagacaucgcagugggauguggcggugaugaagccgcuuugaaauggugguuuguacuuaguggguuaucacugucccuacauaaaagcuguugcucccuccgacgcccccucccccccagccgccaccagggaagccaaggaggccccagacaccccucuaccaacugccuuuucugggucaggcuucuucacuuugauggcucuaccaggaggggggccaggucucagcuuuuguuuuuugaguugggagguggacaaaagaagagcucuggaggcuucgggacccggcacaggcuggggggugggggugggguagauagcuggcguuuuggcuaucagggagggaggggugugauaaggugggugucugcggacgaguuugcaugugcgaguucacauuagcgcuuguguguguguguguguguguguguguguguguguguguguguuuaggcccagggucuucuggucagcagccaccuacauucucucguguaugacuuucuaaaaagcuacgacuggguugggggcuguggcucgguugaccuagccuguaugaagcccuaggcuaggaucaaucccagcauggaaucaacagugcacagcagcacagccuguaaucccugcacuugggaggggaagucaggaggaucagggguucaaggucauccucagccacacagugacuucuaaggccagccuaagcuacgagagaccccgucucaaaauaaaauaaaguuggcuggcgcaaggcccccuguuuguagcagaugugcagcuuggucuucaaguggaucagccuggggcugucucugacucucuuaccugccauuggauguuggcuucccuuccccuaccuggacuuccugguugggccucagcaggagaugauguaacugguccugcugggacuuuggcaucccgugggggagugauacccaagggggcuuccccuucucugagaagaggggggaggggauaaugggagagacugggaggagaggugggggcucgaucgggauguaaagggaauuaaaaauaaauaaauuauugaaagaaaauuaaaauuaaaauuaaaaagguauaaaagcaaaagcaugcuagacccugaccuaagaacacacugaguagucacuggcagagagaggugagucuggggguggaagccacugaggagcaggguccugcucacagugagauacacagggcucucagucucaguuccugaaggcugggcuacucuuggucugcuguccucccaaaucucaguuggagaauucagguaagcaucucagaggaugggguccccucgaggacagggcaguguucugggggcgagguggggggaagcaaggcuccaggaagcuaccccagccuauccccagcugggucccuggggcugugccagccugcucaggcacacacacguguguuccucucuucgugcccacaguaaucuccgacuuuacagcaaauuauuaaaacucacuuauauuuaaucugccuucuggaauuaauugaauuuuuacgcucagcaaaugccacaguuugcggggccucccggucgcuggcucagaacagcuaagugacaaggcagcagucgaccaacuguggggcuggcugugcagacgggauccagggaaggagaaggcauuaagagaaaaggguguggugugagacaggccauccccgucccagauacccugaacugugaacagacucuguuuccaucagcacagaggccuggacuugggguacgcuggcccaggugucagucugcagagacccgugcagagagagcaaagacuacccuacacgccagcuacgcagggaaaugcccuuagccuggguccuccugguacugucugggcccccaagagaaucccagaaccccaccucugacucugaacucgcuguucaaaggcuagggggggucucccugaccucugaaccccagccaaccucggcagcugagacccacccugaaggcagaggcgcugggagccaaggucauguggaaugcuggcaagcuccuucuugcagagacacauuaaucagggggugcugccacccuggggaagagggggaauguuuucaaagccugcacgggugcuaaaugcaucugcacacacuugccagguucagagcgcuaggugagaugacaccaggcuccuguuggcuggggggugggggggcaccgaguguucucgccucucuugcugccacagcuagagugagagcagaggcccccggggaaagccuggcaucuccacccuagacagcccauguugcaggaucugcuuccuauaauccucuuggggacuuggaaaaugcagaguuccaggccagccccaccuuccuaugggaaacacagcccagggggcuuguguuucuauacacgcugggcaccucucugggggcugacggcuggggagggggcaggacuccauccuuccugcucuagaaggccgagguaaugaaaagcaggcaggagaacuaggcaagaaaucagucucauuugcccuaggcucagaaagauccaggcaccagugucccuggugccuguccuucaauauguagccaagagcaacaaguccccuguccccugucuccuccccagccugguggagcucccauggaaggcuugcuggaucucuccacacucugggaagcucuucuccagcccuucucgaccauugcuacggggcucaggccuguuaggggugaacaguucucauccugucucagcuuagcaucuaucaccaccuuccccggcuuggcaauuuggccucccuaucuccuggcagucaacuugccuauguuucaggaacuuaggguaccucccccacacuggucccucccuccaaguaugagguugugguggcucaggcugcuugggaggcugaagcaagaggaccauaguagguucaaaggccaaucugggaaacuccagggagacucaaucucaaaauacacaacaaaagggcagcuugguggcagagcugagcucauuggcuagccgugggucugaucaccuaauaccaccacccccuucuccaaaaaucgccugccccucuagcaaugggucugguccuucagggagggaccagaagauaacaggagggcuuccugcacaggccaccacguaccugugggaacauggcaggggugcccuccucaguccuagaggcaguuaguccaggacuaaggugcaggcagucuuggugcagaaugcuggggugugugugucuuacacacauacacacccugccaggcccccucacuucugcagcgggggauucagccuuccugggagggauggggaagauggcuaaaguguguguagaggccaauuccuggcuucugaaacagaugcuacuuaaggggguggggggagggggcgggcagugcacaggagggagcaggaagaaggaaaaggagauaggaagcaggggaauaagccaggagggagagaggcagaaaggaggggaagggggcagggguggggcuaaaggggggagggggaggggaaggagagggaaggggagagggcagggagaagggaaggggaaggagagggaaggggagagggcagggggaagggaaggggaagaggacgacaggaaggagaggaggggggcaggagagaggaggaagaagagagaggggaggaggaggaggagggaggagagggggcagaaggcagagcaagguuaaacugcaggagaccgccagggggagggggagggggaggggccccaaaguacucuucccuuucugcggugguagcaguuguggcuuucuccccucuccucaugguucccauguccagugccugcucuuccccugcugagcucacucacccuaucagcauccuacccgcagcagucgcucaacuugggagauuggacuauccgaccagcccacagccuccucugcuucuuugcuccccuacagcaacuugacuccaauaaauauccaaagaaccauucaagagcaggaaaauccacagcuugggacagaagccaagccccagccccagggccuugguaccugucaucugaucacauggcuuguucuucccaggggagcucccgggcugucccccuuucucuagagacugagcaaaaagccacugaacgccggaucacuggaucucuccacagccccgacacccacccuagcauccacccccgcucccccauagggcaggggcacagcgucgcucacuccgagccuaagcugagccaagaagucauguguucucccagcacggaaggaucaggagccaguaccugauacgcagagagccccaaggccaguucuggucuaaaaccagagucagguuccuuggagggcuggccaauaagcaggaagcuaggccagacaaccugcuucagaggguccccaaagcucaacucagggaaucccugggucuccaggacacgccccuuugacccccacacgucacuugcgcucuccagcccuccuccaggggcggucuagacucccacaggcguaaggacagcacagcccccagguccgaggauuaccauacauuaagacauaauucuccauggaaauuuacaauacaaagcgcccccacccugguggcuguaguaggagccuggauacaaagcacugcugugucuggcaggaccccagagcuggccccagcuaggcuucaauagaaguggguggguccgucucccggagccuuuuccuugcucugggcagaagccccgcccucugggagggcccucugguggacugcucuucgagagaggacuucacuauuuccuugcccuggcccuacccacuguggcacccugaagccguggccccaagcugacgcuauugggauuucucucacagaguugucuguccagggaagggaugcccaacacagguagaacccuaaaccuugguuucccuacugacuuacucccuccauccaacugacuuauggaauguacucacuauguccaaaggcugaucauccaacugauuggcuccugcuguucacgcacccgcugugugccacugugcgggcaccuguaccacgcuggagacaagcagcagaggagaacccaugagcuggaagcauuuuggagagaguuuauugcuccgcugggagacaccccacuccuggucucaggagcuccaagguguugcaagaaaacauggacaggaacaugaugggucagggugacaaggacaagggugagaguguuggguguggggcucuggauguggggaggucugaaugagcaagaagcuguguguacaggggcugcggggaccacacagucacaucauggcuagcacagcggagcaggagagaguccccagagaauucccagcuccgucuuagagagagacggaguugggaauucauuucaccuaguggaccaagaggccugaggcuuagggaggggcaggcccaggucugaaucccaccucuaugauugccaugcacaaggcagucagcccuucuuggacucugcucuuugcagaugaaagcugguaacagugaccaugcacgcacgcaccugucgcacuggagcgaaggguguggccagagaaaaaccgguccauauggguuccagagaagccuaucacuggggagacggucuaacuuuccauccugcacuaaagcaacaaagcuguccaucugucaucuaucuguuugccauaaaacuccggagaggccuagccagcagcgacccuggggccacuucccaggugagacuaggauuccaugguagagacgccuccaccgaccccagcagccuguugaccagggacaggcugggagaaggcagccuuaccaagaaccauaggcccaucacugccucugauucuagagaacaaaggccucagccuccacugccaggcuacugagcugaggaaaagcgcgagagagguggacacacagcuguagcauccuggggcccagaugccgcacagcauccucagacccagcacagcaccugcagacccaacauagcagcccagaccuaggcacagcauccagaccccgcacagaauccaggccccacccacuaccccuagaucuagcacagcacccccagacucugugcagcacccccggacugcacaacaccaaaccauccuguucacaggcaggguggaggucagcccagguaguaauccacuagcaacagcugacguguuguagaccagccuggagagccccacuggagaugcaaggagccagaggcgucaauaaccugaguucuggccuucaucaaccuuggcuucucccugaauccucuggcuacggguaggaagaaaucuaguucucaagucaggcagagguugaccaucugugcagaacuauuccugggaaacagugacccuuagccucuguccuaugcuuagguccugccagugccugggucucucucuggggcucccucccuccccuguguaauggacacaugggugggcggagggcgacucagccuccauggggguauacagcagguacucaaaaauucccaacucuuugccggguguggugacgcacaccuuuaaucccagcacucaggaggcagaggcaggcgguuuucugaguucgaggccagccucgucuacaaagugaguuccaggacagccagggcuaugcagagaaacccugucucgaaaaaccauaaaauaaaugaaauaaaauaaauccccagcuuuguuagguguagcacaaaggauuauggggugucagaugucucugcggcuaacuggguuuggggacaagagauucucccugucaggccuguguucugcucuggcugaccugaauccccccuccccugccgcccuguaacuuuugucaucauaagccccaaucuacacccuacuucuccacaaggauucagucuacauuuguccccccucucaccccuauuccuccucaccacaaauaucuucacgacuuggaccccaaguuuccccaccacagaaggaacucagugcagggguguuggaggugggucaccuggccugcagaaccuuacuuccugucugugauaccccaggcagggugacauugagguccuucaccugggaccuccuguggucagggaaaggccugaggaacauuagggcagcugugauuccuguggcaugccucucagugacagaugccacccaccgcaaggcaccuuggcucccagggaaagugugcaaccguccagcaggggucagacagauacuuccuacauccuuccuaacacagagcagacacacccugcacagcaccccagacccugcacagcaccccagacccugcacagcaccccagacccugcacagaaccccagacccuacacagaaccccagacucugcacagcaccccagacucugcauaguaccccacaaaguaccucucaguacauguuuaacauccaagacccaauacaguucccuagacccacacagcacccagaucugagaaggagucccaagguagcacuggggagcaaacugcaccuguagcuagcucggcucagggccaggcaaaaggugacagagguaaacccagcuuuuacguuguaaagacagcacuguagauuucauagagccagguuguuuucaaacucugguuccaucaaagacccugcacaauggcgggcacagcaggagcuggggggccacccagcaacccccagccucacuacauauuagcaacucacacuguaaugcugccuuccaacacccugugccgagggauaaaauccucagguggccuuuuggggaggucaggucugugccaguggccggccuucacuuggccuuguuccuggcuccaaccugggcccgggaguacaggaccagcguccuggcucugguacugccgccugcguggauccggcuguccucaggaccaggcgcucaugaacacagcugucagacgcacuaaaaacaggaagagaagaaaaccccaacaaaacggaggcaacauaccaaaugccaaaauacaaugaaaauucaaacagcuaaaacaaauauagccaugaaaagacgggagcccucgcaacgccgucucuacaauuaagcagcuuucugcucuacgcugacagucaccuaauuauaccacuaaugacaguucaaccugcuucgaaauaaaaggccaguuuccacaacgggaaaccagcuguuaguuacacaugucaaacaucuuuaaagcguuauuauuaggggggagaacaacaaaaaaaucccuauaaaaugaacgcauccaucucacgccccacuccacgagggggggaaaaucacaauuagccaugugcuucugcccaauaauaauaaaacgugaacacacacaaggauacgggggaggggagaaagagagagauggggaagccgcccccucagggucuucuaaggggcuccccacccuguggugcaggaggagggucuguguuuauuuccuuccucugcguuuuaaauuccucuuggugaagcagucucagggaccaggauauuuaugagcugagcugaucuccccgggggcucagccagggcucuccugguacaugaggcccugucaagugccugucugggaggcaguuagcggcagccggagcagcagcagccgcaggucgcggagguggcaguggccuggcugcccccggccucguagacauaugcucgggcuauucccugccagcaugucuucaaaccgugcgagccuuugacauucuggaggcgcaauaaacacccgaguuucucuucugacaauagccgagcggauuuaauuaacuggggcggaaagggcugcggcgggaggggcugggauccagcuacagaguggggauuaaccuuuaagaccagcaacuggcuggcaggguaaggggaccgcggccugcugggggcucaggccaagcuuacugcacccgcaggagcacuggggugggcagagcaagagcagacacaaggaacugcgggggugggggaccacaacucaggacgcucccgcucacccuggcggcagcugagccaccccugggagcucuacggugguguuggggggcggggcucaccaaggggucugaggugggguggggggugggguuagggguuggggguggagcgaacccuuccaauccaagccaagccauaagagggcagcugccuggguaugcacuguucaaaggcacccuuuagcaucagcgcaguaguccggagagggguguguaacuugggccuccucucuaggccacagccacgccugcgacuugaccccugggccuuguccagucgaggagagacaagagacagcucauggguuggguggcuguggcuuccaggauaagcacagcaggguugugacaggggcaguaaggaugucugagcugcuaacaugcacagcugcugccaggagcauuccugguuguacuccggccuccaagugcugugugaccccccgggcaagugguuuuccaucucugggcuauagcugaauagugggcacugggcccuucacaggccugguucuuccuuagccaggagagaggcguucuggcugccugcuagggagagccauuuauccuuacaacucccauggccggcccuugauagcuuccucucucaaaggagugcagccaggccagcucucugaccagcuggacauccuccaagaacaacucagcuuggggccugccugucacagcgggcagagggaggcagggccuucccgugcuaccaaggugggauggucucuuccagacuaugcucaagggaggcugagaccauggagguccuguuucugcuuggugcugggccugcccuacugugagaugagaacacaguggcucuaacacccacugucccuacuguggucucuuuucuauggguggaauucugacaggaauaauuucucccaaauuuccaucccagaaacacacagacccuuacggacaagaagugcacaaccuggggcuggagagauggcucagugauuaagagcacugacugcucuuccaaaggucaugaguucaauccccagaaaccauaugguggcccacaaccaucuguaaugugaucugaugcccucuucuggugugucugaagacagcuacaguguaacaguguguacuuagauauaauaauaaaauaaaaucuuaaaaaaaaaaaaaagugcacaaccugccaggugucuuuauuccugguacucaggagcagaggcagcuggaucucugugaguuugaggccagccugaucuacauacaagguccaggacagccagggcuacacagugaaaccuugucuccugggggacagaagcugcuaccucugggccaccugcucuggucuugggccugugcugaacacagccaucgaacaccccagaauucacaaaguuuguauuguuuuuccagacaggguuucucuguguacccuuggcuguucuggaacucacucuguagaccaugcuggccuugaacucagagauucaccuaucucugagugccugaguuaagccaucaucacgcccagcugguaugaggcuccacugugcuacggggacaacgaggcucagacagaacauggcaucuuuuaaugacccugagaaccagccucuaaggcccacaacucgaagaaaugaacccuguccacacaaggccugccugccauacgugggcucaugggagccaagagaggagucaguaucucgguggacuugugucccaccacggagauggagcucugggccaugcgugaaaaaagggauucggagagcccaugcauuuggggucaggacccugcaguaguggggguaagaaagcugagaggcuagaaaaggcaucugcaaucugaccagcacaauuuaaacccugcccuaccacugacugacugguuguacaaccugucccggacagcucagucucugcacacuuucuucuucagugugaggcuaagguuagaugaaugaauccacagaagccaccccuccagucgccaucuacaauccaagucccccauaaguauaaacaucuuccccacacccccagcccacacagguaacaccccuacccccaccuccccacuucuaggcuguuaucccacccuccucuccugggaugccuuaggucuucauccuguauuuuuuuucccacccagaauguuccacugacccgugggucccccuuugggaccuuauuagcaccuauccuauggcauugcggaggggcuacugcacuggggaaccccugcugggggucucuuuccagcucuguugccucaaaccuacucuggagaggagggggaggggccaccuggaagaggcaaagccgacccacucacaacagugggccuaccccuuccuuaaagaaacuaucucccuuggggguuccugcccacacccaaccuuauuuccucauuuuguggacggguaccuccacgguguccccaggcucucaacauguuccacugacagugaccugccccugcagggaggaccugccaggcucuguaaccucugaucugucccugcaaaucccuccaguguuuacugucagguuccugguauguguacacacacacacacacacacacacacacacacacauacacaccagccucaggcucagcagagucuccuuaaggucccaauagcucuaggaacccuuacuuacacacacacacacacacacacacacacacacacacacacacccaccaggugcucaggcucagcagagucuccuuaaggucccaauagcucuaggaacccuuacuuacacacacacacacacacacacgcacacgcacacgcacaccaggcgcucagguucagcagagucuccuuaaggucccaauagcucuaggaacacacacacacacacacacacacacacacacacacaccaggcgcucaggcucagcagagucuccuuaaggucccaauagcucuaggaacccuuauacacacacacacacacacacacacacacacacacacacacacacauacacacacacacacacaccaggcgcucaggcucagcacagucuccuuaaggucccaauagcucuaggaacccuuacacacacacacacacacacacacacacacacacacacacacacccaggcgcucaggcucagcagagucuccuuaagguuccaauagcucuaggaacccuuagcuccagugucugcaccugccccagggcugagaccagcacugccuucuguauacuuccuagugacuggggucuugaucucuaacugcgcuggccagcuuggcagccaccauccaacucagaaacaagaagcacaugacaagcacaugacaugcacauguggcacaugacaagcuuccaaagcuucggacaugaagccaggugcugggucucagguaacaacgcagaucuagcucugcuccuagggcgaggccugggaagggugccuaccggugggggcucaggaguaaguccuuacuacauaaggcacagcucccuggagccuuuuuuuuagcaagauacaggguccuucuaagcacccagcccagcugugacaccugagaggcaaaccacucucuguccccaugugaccccuuuaaacacccaguccacacucauuagcugcaugggguaccaccuccugcaggaaggccucccgguuugcucuaggcuggagucaggaacaucccaggauccagcccagggaacuugcagccuaggaggcaagaccuaugacuaacuuucacuccuucccccugccugggccuggcacagccaggugucgagaacuggcuggcagcugccaagcacaaaugucucuuuccagccaggccagggacacugcugccugguggcuguuugcuuagcauccugcccacucggcucaccgcaccgguccaaccugcuggcuggcugcccccucugcacccuggcauccuggaggugacagagccuugagucaaaggcuucugacucuggauaaaaagccaacgaguggacuugcugguuucugugcuuccaauaaaaucccuucuguugcccuugacccugcagggcagguggaugccggccacagucaucggcaaggccaagggaaggccaaaggugagguucuggaggcaguucuccccauacucugggcccggaggauauucccaaggccacaguccuugccagucacacugaccaaugaccaagaccuucagagcucccuggcccugaagaggccccagaacugaccuuuaaccccaucuggccugggagcugccucuccggacagguuuucuaggucagaggccagcuuggccugugaacuccaggccacagcucacaguggaccaccagacaccucccucucuucugcaggcucccuccccaccugagguuuagggggaaacuccuugguucuacccacagggagccugcccaggccuagggaggggcaaagccuguaccgagaggaauagaaagccacacagucuaagguggcccugaggugcccggggccacaacaggcuggauaacaggcgccagccugugaggcugugaguacuccccagcucagccggacagccaucacagaaauaauuccugccucagcuucccacauccugagaucacaguccugugccacuacacgaggucuccuucagggcuuuaaacaaacaaaccagcuuuccacauccuaaguaggagacagcaguuuagcaaacaagaaguuuagcaaacaacuugcccaagcccuuccaacaggggaucugcagauccagauccuagucugcuacccaggaguuggggaugcaggccugugaucucaguagucaggaggcugaggcaggaggauggaaaauuugagggcagccuagguugcaaaaauaacacccugucuaauaaacaaauacaaaaacaaaagccgaacucuugggccaggggagcagaugguuccgcagagaaagguucaugucgagccugacgguccaaguuucaaugcagggacccagagaccccagagacccauacugugaaaggugaggacacacuccugcaaguuguccuuugaccuucacaggugccugguggcuggaaacccaccccaucccacccccagcacaaaauaagugucaaaaagaauucgacaaaauagaucugguuucugcugggugugguggcgcacgccuuuaaucccagcacuugcgaggcagaggcagguggauuucugaguuugaggccagccuggucuacagagugaguuccaggacagccagggcuacacagagaaacccugucuugaaaaaaaaccaaaccagacaaacaaaaauaacaaacaacaacaacaacaacaacaacaacaaaacaaaaaccacaaaagaacaacaacaaaaaaccagaucugguuucugaauucauggaguccuccaagagucccacuuucacagaccugggccuggggagaagcagcaucuaacagggcugagccuugaggccuggugaggaaaacagucugcacagagguguaaccagguagcaggucagagccaagcagcccucccuagaccuggccuuugggcagaguugccaggcaagguaagaggaagcggucugguuggagcagccugagaugccaacuggcuacuacaguagccuagcagaauacacuuagguaggagggcccaguggcccuaacaucaguuucccagacccaaaggucuuccucugaggggacccucaucuagaaauggggaggcauggcucugacuagcggcaggggccucagacuucugcuccugucauuccagcgugagacacuacugugugugaguugugagucaccagccccaccuacaacccgagcagggggaggggaggcucccagagcucugcccuguaucugggucaggagccuggcuggccgcuccagccacugaucaacccgugcucgauucggccaugaauauucaugagcuuauccgauuccacacuuucauuucuggcccaaauuaauaauuuaccagggagguucauaaaaaaucagauguggcucauuagcggcuccccccaaaggcaucuaaccggccccucacuccagggaggggcugcucuuccugugaccagagcugggcucuugugugcagacccucacaccaccuucaaggggcagcuacacaggcccacuguaaacccucaaggcaggacuuuccagcuuccacacugagauccaagacugcucuaggcccacaaccuagacugucuggaaaccccaaaggcaggcucccuagaggacagagucuagucccagucccagaggucaggccuccuaccuggcuuuccgaagagcuugcaagagacaggcugacuauccucccaacuggcagcuuccacaucuccauccuaucuucucuucagcgugguucccacccuaucaagggauggauuccuuccagcugagcccagccugguggggcuccucccucucugcuaacggacugaguguggcguggaagaggcccugauaucugaggccaggcccugggaggcagggggucauggggccucuucucugcauaagccaccacagccccugccaugacaucagaggcugugaggaaucccagaccacacugagaaccccauggaagagggugcuucaucugggaccacugagacugucgucgccuguagccagagccaauggggggacgggggagggggagaagagggcccuucacaagacaagugccccucucaucuuuuaguuguggcugcaaugucaggcacagaaggcccuaggccagcccacaauggcacacuggugccauccugaccccaucuggcguccaguucccagcauccuggggugggcuuauggucuacacacucagcuuccucucaaguggugguacccgccucccccagccucccaguguugcugugucuggagaagcccacaagggaacuuucccagcagagaggugggagaagagaauagcaccuugucucugggccucagaggaucugagauagaggaaauaaaggugaggugaggugagggggugauucucucagcuccccagaguggcaggaaguggugagagcccccaccgggagccccuggcacacagcuguaggccugagggcaccucauccccuccgugccucccaggccuccgcagagagcuccauuaagacccaugcugucuccccuuacgcucuuucaugucccugcugcacccccccuucucuugucagauaaucacagaaaccagcaaacgguugacacgguuuccaagacaacagaaguuaggcccacgagaggccugggagcuaauccugaaugaauuacaagccagagugacaagggggugggcggcguugggggccaguucaaaggaggccuggucggagaugaggugccgucugccuggggcuccauugcugcugggugaggcuggagccuucagggggggcaagaggcaaaagcuuuuagaagaaucuaguacccuauaaccuucucccuggggacgauccagccagaaaaacuuucuaucccagaagacuugagaucugcuggugugggccacaggccaguaugggucuccagagugaacuauuaucguaucuaggacuugucacuggugaccauuuugagagccugggcuccuuggcauccugcaggaguccauaaguaaugccuuccuuccagcaccaaccuggggcgggccucugcucugacaccggccugaagccacaguugagaacucauacauacuccaaggagaaugcagacuuccuuccauuccagagcauuucauccuugguuccugcaugugcacucaccaaugcucaggacaaacaaccuuacaugguggcacggcuggccccgaguacacaugggaaacacacaaggaaacagagagguuaaguaaccugcccagaguaacacauccaagaagguagcagguacucagcccugacucccacuaggcucugugcuuaggcagcgcugcagcggacugaccucgaacaagcugcagacccucagacacccucuaacccccuacuaccacucuaccacccuccaguucccaaaggugcagaaacaaggucaccaggcaagacagccaugaguggaccucauagccccacggacggucuccaacuggcauggcuccgcuccacagagcagccacccagagccaugguggucuccucuacaugggucacccagcagccagaggaucuacgguagggauggccucaguacgcaugcgcugcucuucaccuguccugcgccauacuuaucggccccaguacgcaugcgcuacucuccagcuguccggcugcauaccuauuuccccccacuccccgacagccauaccaucccuggugccucaggaccuuccgaucccacuacgcuaacaucuucucuuuuuugggggagugaggggggcucuagccacccagugccgaauccuggcucucuacacccccauagaucucucgaaacuacaggugccucuggacaaggcaauccucugggauuucuccucuguacuuccaugcaccugggcuaguugacagcuccaaaauuucgggucaacuaggaaaugauggcccacgccuuuaaucuuagcccucaggaggcagaggcagaggcagaggcaggcagaucucuugaguucaaggccagccuggucuacagagcgaguucuaggacaaucaggggcacagagaaacccugucucgagaaaccaaaagcaaauaaauauagguaaacaaaaacuaaacaacaagccgggcgugguggcacacgccuuuaaucccagcauucgggaggcagaggcaggcagauuucugaguucgaggccaagccuggucuacuaagugaguuccaggacagccagggcuauaaagagaaacccugucucgaaaaaccaaaaaacaaacaaacaaacaaacacacuaaacaacaacaaaaacaaaaaauuuuaggugaggcuggcaaacuggcucaguggcuaaggugccugcugccaagccugacagccuggguucaaucccacaugguggaaggugagagccgacacccacaagugguccucugaccuccacgugugugcaguagcaugcacacguccacaaacacaaagaaaaacaaaccccacaacucugggucccccucagcucacagaacccagcucacugacaucagaggugugaugacauucccaagaguagucccaacgcccuacuggccucaaagucccuuaccacucccacagaugucauagccucaaaagucuggcccaguaccugcccugccuccuucuguagagcccagccugggccauaaggacaagguccgguuccccagcugcucccaagccacagaaugagacacaggccgcauaucaucaggcugcuacaaaaaaacuccacccccccccccaacccugcccccauuggaacccuugacuucuacaagagcccugcugaguuuuuuguuuuguuuuguuuuuuggacgguucacaggcucgggagccuugcuauaaaaauaccaccaaggggaagggacugggggucuccuccuagacacagccucugcucccugacucaaacugaaccuuccccuugucuacagaacaggaaagccccagacgcuugucacccugauauucaauccauguuccaccucacagagcguggaacuaggccaggcacacaugcuccuggugagaagcaacagugggccacucagaguggcccagcagaggcugacccgggccaggagcccauggacccagcccacacugccugucagggaggagagccaggcaacacugguccccauagacgaggagggcucggcagccuguccuccuccacgaccaaggguccggugacuuccugaccguacagaccauuaagccgguagccaaaggcuggcugggcagugggccaggacuggucagagggcacuuccggccucgcugcgggcgggggacgggaggaaggcagagcgagcaugauccaacgagacaagggaauccaggggcagcaggccuggggacugggggcaggaucugggccuggcugcuugccaaacacccccauuuccagcugagucccacccaacucggaaggcaucgauggggcccuguggagcuguagagggccuggcacuguugaggggggaaggccagaaaaaugaaucuccccaaagacauauuaaaaaaaauucucacccauuccuucccuuuuaccccaugccuucggggaucuaaauaugccacacuuuguaauuuuacgagcaaaccaagcugcacaucacgguuuuauguuccuaaauuaacaaaaggaccuuaaaucuauauggggcucuuaaaaaaaagaagaaagaccacgauaucuaaauuauucccucacacucgacuccccucuucccgccugcggccuggccccuggcgaguccacuucagugcauagaccaccaauaagggaaaaguucccaagcacuuagucgcccguccucuggggaucgccccuaaaaagcuaaguucuaccauccauuucucugaagaaaggucagccacuucagggucuggaguguaguguuugucuagcauguuugaggcccugugaaccaucucuagauacacacacacacacacacacacacacacacacacacacacacacacacggcuacgaggccuggagcagcugacuguaaauuacaaagcucaggccauccugaggugcagaguaaguucaagcccacccacagcuacuuagcaagccuuuuugucucaaagcuaaagaaugaaagaaggacugggagguggguggcgugugacuugguagagcacuugccuggcaaguucaaggcucuggguucaaaccccaguguggcaaaaaaggacacccugcacggcccuuccuaacgagucgacuggggcagcaccgaccucccccagagucaguccccaggaaaguggaaggcgcuggccugagagccuuccuggcagguguccuuggcugcaaaaugccgagguaaacauauaaauagagcucacuggacccuggcacuucaccccauggggaaggcagacagagaacacaggucuugggaguaaaugcuacagaggcagagacccucuggccccaggcuggcucugccagggacagucugucuggcuaggcccucccacugcccaccuuacucuagggaggaaauacagccuccauucuccucccccuccaggcagaugcaaguguccuccagaccauuugcucccagagcaggaagagucacgaagauaaggaguuggaacaagggacaaucgauucccacccauggcauugcagaugcacggaagccaggguggaauccuaaugaccgucucacugagcagaggugagagccagaccaggcccugaccucacugagacaaaagggccccuggcuuucccagauccaaacguagcaguccuuccccaguucucaggggugucugaaauuagugaccgcccugaaggugcuaguugugagccccauguagcccaccacugugucugagcuguaaguaaggacucuugucacuucgaaaauggccaaaccuccuucccaggcucagccugacccaagagcaggucucuaggguuucuuuaggaucccacaagucccagguguagguguaaacuggcaagggaggcugcccuggcuggcuggcuggcuuguacacacacacccccaacccaugcugggcacaguccacaccuagccuuguacacagguuggaacacucuggagagcaaucucuggggaccuuuauccuuccacuauccugacucuaugcauagacuaagcuagcacaggguaagcugcucagaaaggcauaaaggcgucgggucagccugguccucuaucucugaaugacucacuaugaccucaaggggcagguuugggcacagaagaugucccaacagauauaaagcuaaguaccgccacuagccauggugcucucagaccccagucccuucauggcaggucucagagcauccuuccuggcuacggacugggaauccagagggaggugaggucaucaagaguucaucuuggggccagggcagggucagccaacagucaggaacaagauaaggggccccaggagggcaccacugccaauaccagccgccaucucucccugaccggucaacaaauauuuauuaagcagagacucuggagccagacugccccggggucagggguuagggcccagcugaggcucuugcugugccuuuugccacuccagugaccucggccucccuugugccucaguuuccucugcagucaagugggacagcccucgccugaccucccagcaucguccggcgaauuagcaagucuggcauggaacaagccuuaugugaaguggccacagccuccuccuccuuauuuuauuauccuuuuuauuuuuacgacugucguuauuggucuggcagcaggccaagcaaaaaggagacagucagucuccgccugcagggaucacaaaguccuguggcguucagggacagggguauccaguaagcugugcacacagaggaaagccagauaggggaccccagagaaagacuaccaucugucaccgucaggaagauggggggggggcacagccccagauccugcaucuucuucucuuugcacgaggagcugauugacccucuagucagcaagucacuucuuacuauaaagucagccagacuggcccaaguucaagucccgccuagaccacuaaguucugugaauuucugcaaaagauuucauccuuguaaccacaccugauuaaaaccuucacaagcuugauggcuaccccuguguggagauugacucuauaccauaacaccuagcgguggggugggguggggugggguggaggaaggugcauagggaauuugaggccaaccugggucacacagcaaguuccaggcuaauccagacuacaugagacucucaaaaaucaaaacaaaucacaguucauucccccccccccccaauaguagagcagcaucuggucggccuggucaguuuagucugggcuacaugagcacugcucaaccuauguggucagagaaccuucagggacuccaugcgagcacaggugcaccucaugccaacagagacuuaauaccaggagacuuugaaucuuaggaggacagcacaguggauccaagucaagagacaggaaaaccgaaggacuucugggaacuuuccuuaccugccgagguugaggcugggaacacacuggguuggacuucagacccauuguccaguguggcaagagaagaccgaaaauagggccaaccugaacguggccacccucccucucccccacaguagcugguggauagauucuggacccuguccccuggugguugguuacagccaccuugaugggaccagaucuugaggacagaauccagagucuugggacaaaccuacaacucagaguccaggucccucuaagggucaagacacuugacucucaacuaaagcuacugaccacagccaaccagacacccacuguucucaggccuggaaauccccucuugaaguggcugacagcagagcccagcccugacacuuccagaaugggcaacgacugggccucuugggcagauuggccagcagggugagauaucaguacccaccccaugggguguaugggagaguccccaaacuaccuaccuacagcucaaggugcaccugagcuccaauucuacccuaaacucacaggauggaaaaccuuggcagggaccgucaaaaaauaaacuucaguaggagaaaacccuucaaccuguggcuaauuuaucugagcccuccucccuggggaggagagccaaguccuucccucccugaaggaucaggacaagcaggauucaccuugcugacacccgccugccugccuagggccuaaucccagccaaggcugauucuuuuaauugcuuugaacuccccagucugacacuuccuccuucucggucugaggcucccuguguaaauaaagaaugggucaccugacaagcuaauauaccagccggcccuuggaugucagguggcguggggugcagauuucaaacaccugugcuugugagccgcccaguacuuaacuacagagguuccucucauaccaccagcuagcuccaaggccccagagaggcgcuugggaauacaaaaagaaaguaccuaucuuugcucuccuugucaaggcuaacaggaagcacuggcagaaucagucugcacacuucugugaagaggcuaccacacacaccuucccauggggagccggcagagcugcagagggcaccugcccuccugcagagauaacccugcuggaagcuggggauuccgggcucuaauuuuagcuagaccaaauggaaggaaguaccgaaaugaacugaacacggaggaaggggagagcccagcuagagguuugacaauugcuauuucaggcccuggaagagagggaggugcguggagaaaaucuuccaauaaaaacagccuggggccagacccuguggcacacacaccuuucauccggcacuuugguggaggugaggcugaggcaggggaaucuacguguuccaggccagccagagcuaaaucgugagacccugucucaauauaaacaacagcaaggacuggacaccccaggaacagaacaggcuugccaccagguagggcuggacauagaagcauccgcaaaggaacgcccagagccaccuacagccguccugcagucggaacugccuccuccacccgcuuuuccuugcgaccuuucaucucugcuacauuaacucaguuacaacgugugcccuaggucaggacgacuagggccagcucccuguagcugaguccugcccaggcagguucuuggcccacaucuccuucucuggacuccagguugguggagaucuggcaagagccacaggauccacacaacacacaaguggggacggggggaggcaauguuaacccaacacccagccacgugcacguuuccuacguuuccuagcaaaacuauucccaaaucaucugcagaaaagagcagaccaugucaugcacgaaggccgccccucugcuccuucagcaccccaacauuucugcaccccacagacgccucaacuucaauagaaacugugugccagggcuuagagaaaaaaaaaagaagauuaaaaaaacccagcauucuuagaagaagcggccacacgcagcucagcccucucgaccugcggucacgugcagucggacccgaggggguacccgagggggaagccaccaggagggccggguucccacgccugccugcucgcuccgggcucucuagcuucccucgcgcccgcgcgcaagcaucuuaaggguggcggggcuccccaucucucccgcgguggcccccgaaacugaaaguugcauggcagcggcugucagcgcgcaccgaggcgcaggaaacaggaagccgcgcgcacugcggccacggccccucccggccucgcacaacaaaaccuuccagggaaucgggagggggcggcggggccggggcccccaggucgccgcccgcgggaaaguaacuucacacccgcgcgaucccgcccggggcgcagcgccgccggcuccgcgcagacaaaaggagcgagacgcgcaccgggccgggcgccccacgcggcagcgcgcacugagcgggcagccgagcagcgcgccccugugcgccccuacgcgcccuggucuugggacccgaggaccuggcgcacgacucgcuuaccugguaaguaauagagaggcggcuucaguccgaacauggcucagguuagaauuccauaguggccagagagggacgaagaaggaaaugaggggaaaaaaaaaaaaaaaucaagcccagcaaugaaacaaaaccagcguccaagccacggcgcucaaaaauguccaaaacaauaaaauaaaagcagaagagcgauccccggagcaccguggguagaaaccaguuuguguuuuuuccuuuuccuucuccgagaugaucaaaggcugccuuuccguccagcgcccgggcagguucggccaccucggccggagcagauccacagugagguaauugaccaaggaagggcuggagccuccacggcggcccggcgu

SEQ ID NO: 4837 - RNA, 11007 nt, Mus musculus
uguaacucgcuggaucaggauucaggaagcguggagcccaaguacuggaaagggcaucgguaggccuuagaggggcggggccggcguacagcuccgccuacagaccaauccgcgaguuuguacuagcugugacuuggaggcugcgaagagagcaacgucucuauagggccgccgcaggacgucuuccguucgaggggcgggccccgcgcgguggcgggaaagaagugccugaggcgcugccucugagucgcggaggggcgguaacgggccugggccgccuacucuucaacauggaugcggccgagguggaguuuuuggccgaaaaggaguuggugacuaucaucccgaacuucagucuggacaagaucuaccugaucggggugagccagggcgguacggggcggcggccugggaucaugcucgggucaccgcuccuuuccaccuggggucugcguuguccuugcagggggaccuggggcccuucaaccccggcuuacccguggacgugccccuguggcuggccauuaaccugaaacagagacagaagugccgccuguuaccuccggaauggauggaugugggugagcauucccgggcccgggugggcgggcuuguacggggagggggcuguagugauggcgcacgccuguagucccagcacucuuuagaggcgguagaggcaggaagaucucugaguuugaagccagcuugguccacagagggaggugcaggacaaacagccaggacuacacagugaaacccugucuggggguggggugguguccuagucaggguuucuauuccugcacaaacaucaugaccaacaagcaaguuggggaggaaacgguuuauuuggcuuacacuuccaucaccaaggaagucaggacuggaacucaagcaggucaggaagcaggagcugaugcagaggccauggagggauguucuugacuggcuugccuccccugguuugcucagccugcucucuuauagaacccaggauuaucagcccagagauggcaccacccacaaggggccuuucccccuugaucacuaauugagaaaaugccuuacagcuggaucucauggaggcauguccucaagggaggcuccuuucucugugauaacuccagcugugucaaguugacacaaaacuagccaguacagguagggauuggggaacagagaugcaaccuuaaacaaguuuuguuuuuguuugucuuuuuuuguuucucuguguagcccuggcuguccuggaacucacucuguagaccaggcuggccucgaacucagaaauccgccugccucugccucccaagugcugggauuaaaggcgugcgccaccacugucuggugacucugauagucuugaaacugggaccccaguuucugugccuugaggggcaucuuuagcaccccugucccccaaagccugaguccauuucccagugucugcuggccaggguuggggagcaggggaacagacuucuauugccuuugcuacauggagaggagcagucaggagugcaggaggccucucuguccugggaucugaggucaacagaaugcugucgugugccaugcggcucugucuucuggaaaugugugguuugcaguuggccuguggucacguggccaucaccuuguuauccuagguuuucucuugcaugaguauucugcaucuacuuacccauccugugaauggguauuuagguuacugcccauuuugaaauauuuuuuuuuauuuuuguacguaaggguguuguauguauguaugcauguacgccacuuggcgcacagugccuucaaaggccagaagaggcucucuggauccccuggaacugggguuacagguagguaguugcugccacaugagugcugggacccaaauccaggcccucugacagagauacaauuacucuuaacggcugagccaucucuccagccccguuucccagucuuaaaagucauuauuguguccgugugucugcacaugugccguguguggcgcaggggugagcagaggacagcguguuaaagagugggguucuggccuuccacagugucuagcuucaucaggcuuggugacagucaccuuuaucuauggagccaucuccccaguccccaggucacgucucauuuuguaccguugugugagccuuucuguagaucgguguuucccuuugguugguugagacggggccucaugcagcccaggcugcugccugcuugcugcguagcugacacagggcuucaccugaugacccuccugccuccacuagcccucuugcugggugacaggugucugcgcucugccuccuggcuugguuuuccuuaggauaaccaacagauaccuccuguuggggaccuguugggcuagaggacagaugauucuuaaguuauaagcggcugccagacaguccugcugaguguugaaagguccgaaucccacagaacugucgaggaggucacauugucccacauccuggccagagguuuggccuugccgguggaggggccucaccuacggagcucuggaccccggcgcugacaggucguggagaauuggcuucaggcaugaguagaaggcaggcagcuaggucagaagaaaguccauagguaguggugacagcucuuccugagacaugucuguaaagcuuugauaugaaugccccccacauuguuuguaugccacauacacaugcuuauuggccacgggcaauaccagcaccuggucaaauuguaagauuaaaaauguuuucucagccgggcgugguggcgcaugccuuuaaucccagcacucgggaagcagaggcaggcggauuucugaguucgaggccagccuggucuauagagugaguuccaggacagccagggcuacacagagaaaccuugucuugaaaacccaaaaaaaaaaaaaaaaaguuuucucauucaggaggggugcacgccuuuaaucccagcacuuuggaggcagaagcagguggcuuucugaguucgagcccaggacagccaagggauacacagagaacccaugucuuacaaaaccaaaccaacccgaccgauuguuuucuuuguuguggugauggugaagcauccugacgucuguguuucagagaaacuggaacagaugcgugaugaggagcggaaggaggagacauucaccccagugcccagcccgcacuacauggagaucacgaagcuccugcugaaucagugaguuagcacagggacagcgcauccccuccgugacccgagucuccuccugcuccccugcccaguccgugguggcuuagacacucaguuucucauacaggugaccuggaggaggugucugcaggguguccaggccgucucuguucucuccuguucuuucucucuccuccuuggguucuaacguuccuggucugucaccugucacuggguuguaguguggccgcugacagucuagcagcagccuuuucucagguacacgagcuucauugaauccagcuuucccugaaaguguacggaucuggcuucccugcgucugucacaggacuggucaaggguguugagugggugcugguccugagccauagcgauagaugugcccuggcaagcucuggguuugagcguucguaucugucccaacucggucuucugguuuauucuccauguagugggcaggcugccuggugcugcccuggcugcagcccuuagccuuucuagcuucagucucuagucagagugcucacagcaggugccccgucccuaucucucacugcucuccuuugcucucagucuguauuuuuaugaucccaguggucugcuguagaacagguuuguuuguuugauauggagucuugcuuuauggccuacacugguccugaacucugggcuuuagugguccucuugcuccaggucuuucuuccuugccuagggucugcagagcuuuguucuggcgugugccacagugcaguuuuggaguccuccaugugcugugccaucgugcccacuguccuagaugggcagggccugucuccagcaagccucacacaggggcgcugaguguaagcagaugcccaggccuaacuuacuuagcauaggcuagacccugcucccucagcugugcggaagcagaacuggcaccaagaccagaaccgugcugcucgcuuagagcagcuggacagugggacugcugucacugcuccuuccgagagcagugcuccucaagugcuccucaaagaugggaggccauucuguccucuaacaauaugcuguaaacauggucaugugggccugaguucccauuuggguaagagaacaauugugacccugugaacuggucauaaaaccgccacacagucagugcccaugggaguccauaggacacagcaaggccugguggggccagagaaggcguguaaggaacgcagaguugagcaggacagcagagugucccaaggagcagagagagagagcugaggugggaggagcgauaaggcacugugacucugugugcuuuggggggguuggggaucaaugugggcacacaaugggccaugggcucuguguuuauggggaggcccagggagcuggcguccgcagagcucugcgggagacuggcaaaguugugggggcagugcugggaaaggggagagccuugaagcgugacugagaaucagacucuugcuccugguggauuaagcaaucucccaagacauugcggguggcaucguacuuuuaaucccagcacugagaugggugggggauagggacagacaggucgcugaguuccaguuuggacuacuuuacgacuugcaggccaccuugggcuauguaguaagacccugucuuuuuuguuuugccugcacaugugagggagucagauucucuagaacuaggagucacgggcaguggacugccauguggguacuggaaaccgaacucaggaccucaggaagaccugccagugcucuuaaccacugagccgucucuccagcccccagacacugucaaaaaccaaaacaaaaccuuacuguguaauuuaucuggccaaggaacacaauuaaaaguuuuuuuaaguuggguagugguggcacaugccuuuaaucccagcacuugaggcagaggcaggcagauuucugaguucgaggccagccuggucuacaaagugaguuccaggacagccagagcuauacagagaaacccugucucgaaaaaccaaaaaauaaaaaaauaaaaaaaggaaaaaaaauuuuuuagccagccagugguggugccagccuuaauccuagcacuugggggcaaaggcaggggaucucugaguuugaggccagucuggucuauaaugcaaguuccaggacguccaaggcuacacagagaaacccugucuggaaaaaauaaaaauaaaaaaauuuuuuuaaagauuuauuuauuuauuauauguaaguacacuguagcugucuucagacacaccagaagagggcaucagaucucauuacggaugguugugagucaccaugugguugcugggauuugaacucuggaccuuuggaagagcagucgggugcucuuacccacugagccaucucaccagcccacaaauaaaauuuuaaaaacauuuuuuuuggcauacauguguuggcaugacaugcacacagaguuccaaggacaacuuucaggaguuggcucucuccuagcacgugccuccagagacuggcuuuagcuugucagguuuagccaccaauaccuucacaugccgagcugccgcacugguccagggacccaguuuuccuuuguucuguaguucacuugcugaagaucuggaggucuuuguuguaagcauaagauccgaaugcuguguucauauucaguucacuacacacacacuaccacagaucugccuacagcuccugagcuggcuggccuuggaggcucuagcucagcccagagugcccagugcugggucgcacgagucugccucugucucaugugagcuccuucaaaggguggcuucacguacauccugaaggaaaguugucacuaccugcucaccuuaagcuuugagacucugcuuuucugcucugugguuuugugucccccacaguggcaguccugucucucagccuuugugagacuagacauaccacuuaaagggcuuugcacggagcuugccugguggugauggauagugagccuaugucacuguuaaaaaccagggagcugcugaucugagccagccuccauaccaacuugagauaaauuacacagcagaggcuguuguuauccugaagggagugucccaacuguccaauuucucaguuuucauuuaaagacauauucuuauuccuuuuuaauuccauguguuugugucugugugguuauguguguguaagugcagugcccaaggaaacaagagcgaauuggaucucuugaagcuggaauuucaggcgguuguuagcugcuccacggagguugcugggaacugauuuagguccuuucaagagcaguaugugcugguaacugcugagcugucucuagccccuccaguguguuauugucuacaagauuuguacuauccugcauguauguccacgugcugggauuauaauuuccacuccuggcuuuuaguacgucacugcucugucauucuguguagccacuggccauggcugcuaagcuuuaccugccgacauccuaacccaaggaaagaacagagccccaggauucucucaagucugugcgaggcucccccgaccccuuucaaacggagucucuauguauccuugaacuucugauucuccuggcuucauccuucugaguucuagggucacagucaugugcucaagcuucguuuacaaagauucguuucugugcauguggcugugaccgacuucacguuccggguccacagaggcuaggaugcauuguaucuugguauaagcagucgggcauugcccgcuggaugcugucaguggaacugguauccucgggaagggcacaaagcacuaacugcuaggcuguccugccccuaugcugcuguuugaagcagccauuucugccuguccccgguaaacuuacugagugccucuauauuucugccucuuuaucuucagugcuucugacaacauccccaaagcagacaccauccggacacugaucaaagaccugugggacacacgcauggccaagcuucgagugucugcugacaguuuugugcggcagcaagaggcacaugccaagguaggcaugguucuccugucccugcccggugccagugggcacugccugccagugugaccgcuucccagggagcugucaggccaugcugccugcucagcaugaaacagggauuugaagcugugcuuugagcaguggcucacugggacuuggggguuuggcucucagagccugccuacacccucaguaccaggagccaacaacucacgguugagcagucuagcuuugccuuaaagccaagacuuccuccgcucacuugcuuuuguguuucagcuggacaaccugaccuugauggagaucagcagcagcggggccuuccucacccaggcccucaaccacauguacaagcuccgcacaaaccuccagcccuccgagagcacccagucgcaggacuucuagccagaggccucugcugugcaaacccugcugugugcccuguguggcggagauugggggaagaguguggaacacugguaagguugcugcccgucuuugucagaggucagccauacugcaaguucaacuccauugaacagagaagccgccagccuuucucuuccacccaaggacugcacgccaagcacagcgaguguucgggccagcucagcucaagugucuucaagcuuggcccguggaaagcuguauguaguugaggcugagcgugaggguggggguggugauacaaaaagaugaauuucgucuuaacaugauuuaggaagauuuuauuuuucgggaugucagaaauuacagcaauauauucauaaauaccuaauuacuacauucaacaaauaauauuacaauacaguuaauucaaacaaguacacuuagaacggguuuaauuucacagcaucuaaacugcccccagagcgaccgaggcacccgucggcccuccugccugggucuggguccagggccccagcagugaggcguagggcacacacaaguacggaaccagugagaugccuccucgggucaaggcagccucuaggguugaaguaagcacuggauagacaguggggacaggcuacagcaaguagugaagucaaagcuugcguacuugaaagaguacagacugcugcuauaaguggcuaaugcacaccucagaggugcugagccugcugugcaggccaucuccaugcuggggccugggcagcugagggcaggggcaggaggcaucuagcuugcaauuuagcuuagcugguugagacucucagugcugugagccuggcuguacccucccugcccccacuguuaggguggggcuuguucuggaugcccuagugguacagucuggugugauggugcagguggguguuuuuaagaucaccauguaccgaaguguugacagccuucucucuugucacucaucugcgaugguggcgggucucaauuacaugagacaaguguuuuuaaaagaucugauccgacacccgugacuagcucggugcaucccacccaggacagauggcagcaaucacuugcagguggagugggagacauggucaaggacugggauuuuucacauacaugcugauuucacagucuagagcagaucuauagcagggcuaggcuggagggaucuccagggacagugugguaccugggaagggggcuacuguggucuuguuagccucaucuggcucuaagacugugggaugggaagaaugccguaugugggcugaguggcagucaucugccgcuuuacuggcuuguaccugguucugauugucacuuuacuucugagcauggggauauucggucuccagaugcuagagguggcccuagaagcuccagggcaggcaagggcauugggaaaggcuguaggcauugcuagucagcggcucagcuugugccccagacugaccugggagggcaucgcuugcucuggauggcauacucagccagaggaacuccugugggacaauggaagggacugugcgugucuuuaaguuauggguucugccuuucccaggagacauuuaccaagcagauuugcagaagcuucuagucauggagguggggugagcuugggaaagcagcacugggcacaagcagcauuuaacugggaagucgggcaggacucggcccagggugugcggccucugcccuccuuuggaucguuuucucugacuggcugugggcagaggaaggugcuuugcugacaggccugguggcacugccuugucugaguuugcugagaaccagaggggugcggguaggggcagggguggagcagggacagaugucagccagcugcucuguacagccacugagccugguggcuaagggugggcucggccuccucuuccccuguccgauggaggacagucggaggcucuuuucaaguuggucagcccugacugaagugcugaaacugggaaggagaucccuuagcguugagcuuucugccagagcugugccugucuccggagcucagcuccucacagcuuugccgagucccugccgcacaugggucaucugcuuuggagagcaggcagcccuaggccccucagcccugcugugugggacacugcacaagcgagcucuccugcuuccuagaacugagcaguuaacaacauucugaccagcagcaguacaaacacuaaaagcaagguuuucuuuuuuuuuaaauccagaaaaacagaaacaaacaaacaaaaaaaccaaagaaaacccccaaacaggaaaaacaaacaaaauuccccaaaccacauauuaaaaauggcaggcuuuuuauaacaauaauuaaaguaauaaaaacauacaaaacuuuuuuuuuaauauauacacaguacaaggcugaagcaccuuugacuuuucucucaaaacguacguuuguaugaaaacaccacacacggcgguagcaauccaguggguaggcuaucuguggacagcuccacgcaucuuccccaaggaaaacaagguacuuuuggguguggguuugccucuuuuccuaagagcuguuccagggagaagcuugugugcucccaggagcaguggcuucgaugaugacgcuugcgggaaggcgacagacggacgggacugauggggagcccuuugcuuguacgcacccagccuucccggcgcauuagucccgcuccuggcaggaagagguuaaaccccagggccgcagcaacagcaagcugggcucucguggcacagcuauaccagaaacaaccagcuggcucucucccucagccacaugcacgguggacgucagugucggaggaggaugacguggggggagagaggaaauaacgccgaccucagaaagagaaacugaguccuagcugagacaggugccucggugacauuggcgucgaggugaucuccucucuggagccuggaacccuuuguuucaugcauggcacguucucaauuuguaagcuucaaaccucccagugaaaaauauuaaauauucaagguaauaaaauagauaauauuucuauacuauagguucagccuagugcaagggaaaccgucaccucggauaucccuuaaaguagccccuaggccagugcauggugggcaaggcaaggcacuuccgcaagugguccagcuccgccuggagccgcucccgcucagagaccaucuucuguuucugacuccgaagcuccuggggagaagaugcgcgucagaaccaucuguacacacagcagcgugagugaccucuggagguugcuagaacauucuuccggcaccacaggcucccagagaaccaguguguacugcugccucagcucaggcucugaaucccagguccgaccggccccgcacaugugccca

SEQ ID NO: 4838 - RNA, 5990 nt, Mus musculus
gggcggggcuucccugauucccgcgaugcuucgcggcuccgucuuggucuuccgguugcgggccccguucuuccggucgcgagcaccccaggguguagagggcggucgcggcggucgccugggcagcgguggcaggugacggccuuggacggcgggugaggguggcacggucgggggcccgaggaccuggagcgccggggccgggagcggugccuccgagacgcccccggacccgggacuugagcggcucggugaccuuggggcgcccgcuuccccgagcgggucuguugucucggguccccgcuccggccugccgggcaccgggcguucccgcugugccaggcccgagggacagcgaccugagcccugacgucacgcuacgguuucugccgccccgggcguugauuuuuuuuuucccgggcucggacguucuuucucggggaucgaaucucagggguugugcuacagugaggcguggggcucgggucgcuggggcgggugacagggucauccaggucgccugcgggacgcaggaacgggaagcgggccagggccugagccugggcggccuccucccgcuugcccuucgcagucucuguacaagucaauuuuuaaaauaaaacucagucgcaggaggugugcuaccgugcuaucuaucuaucuaucuaucuaucuaucuauauaucuaguucuagcaguuucagucauuuuugucuuucuaguuaauuuuuuaagaagccggauuuauagucauuggccaaagccauguauauuacagcccuuggcuugauguaaggaaguucacccugugccuucgcaucaguaauaaaaaccggauccugggggcaugccucuggccuguaaugccggcucuuacgagguagaggaagguaauaguggaagcuuucaggccaguccgugccuuaaaaaguugaugaaaucauuaccaaaaaaaaaaaaaaaaaacauuuaacauuucgggggauaaguugcauuuacuuccuuaauguuuugccgcaaaaagacuuuggcuaaaagguguuugcugucauuguuaagagguauaaggguuuuuuuuugucuuucagaauguuggcuuccagagcgcugagccugauuggcaagagagccauuucuacuucggugugccuucgagcacauggugagcaggacuuucacucccuucccugcccuuuucuuucuccucccuuugguuuuucaugacaggguuucucugcauggcucuggcugccuuggagcgcagagacuuaaccugccucugacucccauguucugggauuaaagaugugcaccgccaugcccggcucaggacuuuuacuuucuuuuucuuuuuuuuuuuuuuuuaaagauuuacuuauuuauuuuauguauaugaguacacacaguagcuguacagaugggugugagcuuucaucugguuguugggaauugaauuuaggaccucugcucgcucuggucaacccugcucgcucugguagaccccgcucauucugguccaaagauuuauuuauuauuauacauaaguacacuguaguugucuucagacacaccagaagagggcaucagaucucauuacgggugguugcugggauuugaacucaggaccucuggaagagcagccagugcucuuaccugcugagccaucucaccagcccccgacuuuuacuuucaaacaggcaaacuaaaugucuuuuugccccuaugucucagguccugugcugggauuuuuuuaacaaagaugccugguagcuuggccuuaccgggauuuuagggagagaugagaauuugaacagggcguuugccugcuugaaggagcauggauaaauccuauuagucugggucuuugcuugcuuuauuuucuucuuacauuuuuuucucucucccuucuuccuucccuccuuccucucagucucacuguguagcucugacuggcuuuggacccacaggguuccagacugugccucgugaaugcugugguuaaaggcaggacaccacaccuguaaaguucugucccucugucuggcgccaugucugucuuuaaucuuuuccugccacaagccucuguaaacgcauaaagcccgcuucuguugccaucccagaagcaugaagcgaagggaggcugcugggcuugagucugagcuguguggauuucaccucagccaugggccagcugcugguguccuaaggcucugcagcagugagagugcuguguccuguugcucuccccggggcaccauaggugcaggcugagacagaaggguguuggguaagggaagucccucuuuuauuauccaacacggaaaagacaugcuccaucuccaagcacagauaucugugacaagaccaguuuuugucugacuuggcugucauuuuuuggcagucuggccaguggacaaggagcugcagucuccuuguuguccucuguggacaucugugcccacaguauuagagcgcuuugggagccugcuggggcacugcugucaguugagguauucauggugugaggugacugagaagagaucugagccuuaacaucugacaacccgggcagcgcuugccuggggugggaacagaagugaucuugugauugcagucuuugcuuuucccccuuuuauuauuauucuguaaauuuuccccaaagguugagguuuacuaagggcaagaagggugacugaggccuggcauaugccuggguagguagggaagguuucugcaacccggucuacuuggaaguaacccugccagcuccccuuacccacagcccuuaggcccaggagcagggaugguugcuugggacuugucuucaugugcaacguggcccucagcagucggcgucuuucuacguaucucaugcuucagguggggacgaugccaguucuugccuaaugaggccacucauucaggugaggucaccucccugcacauuugagugugguccugcacagguggccacagcuacgaggaagccggcugugggcucugcaccucugacccugaccuuuuaaaagaggaggguuuagccuuuguuuuccucugacccauggaagaggcacaaaagcucucaagugcgccuagaaaacaacuuacccacucuugaucuagaauguagugcuuuauggcugcaaugcucugagaccaugagaguuuauggcagucugauagcugagcuguaauucacacgauacauugggucacucaagucacuucucguuauuucaguguaguugcugguaugugccauuaucauaguugauugauucuagaacauucucacccuaauuuacaucuaucucaauagccugcaguccuuuagccuagaggcauaggguugagggcgcgugcgugcguguguguguguguguguguguguguguguguguguguguguguguguguguugguaggaaaguucaguagcugccguucuuuuucugaucauugucuccuaguuuuaggacaguguuuuugugauuguucagucaggucucaagcuugagcuccuccugcuuccgccugccgggugcuuggguucagcgugugcugucagggccaacuuuaugggaugcugaggguuaaggugggagaguaaucccggcgggucuguuggggugggguugagcagaagaauggagacucacugguuuuuugugcaccaaaguaaauacacagaaggaccacacgcagcacugcucaaggcuuugucuauuguguaccaacaugaccuggggaaagcauucugcaaagcuuuguccugcagacagccgggucaaguuagagcuuuagcaacaggaagcccugggggcaccauccagcuuggguucuuguggccugagcuuuuguccuggugaggccacgcucacugugaugguuccauggagcagcuggagccuccccucaggcuggcacucuccacugcucacuuugggcugacuggacuguuuugaguguuuuaagugggaaacaugggaaggaagacagaacuaaccugccgugagucugcuuguugagcacagcagucuucccucagagucucgagggccacccucugcuuccugacacacgugcauuccuccagugggacccaagccuccuguacugcucaguucucacuuagagugugagcccauggggggguacaggugcuuacuuguuuccugacacugccauccagacauguccagaguuagccucagugaccaguaggcacuugguaaguccuuggcugccagggucacggugaccaccaagacucugcaacagucgccuuucccuuuuugaauuuuauguucugaguaugagacccugcgguugggucuccauuuaguccaguugcuugugugacuaacaacccucagcccugguccugccccuggugaccgaggggcugcuuaggucaggcuuccgucuuaaccguugaccgucaccgcccuucugccuagacugccguccacacgggguuucaggccucuccaauguguuguagggaguguugugaagagugaagacuaugcuuuccccacuuacgcugaucggcgugacuaccccuugccugauguggcccaugucacgaugcugucugccagccagaaggcgcugaaggagaaggagaaggccgacuggagcagccuuuccagggaugagaaaguucaguguggguaucagagggggugcacaaacacucaguaguguguggaggcgauugcacugggucagcucucccagcugggcuucuagauacccauuccauacugcuggcuuggccaaacgggagccaugugaccucacagucaugugaccucgugucugagggcugugcucacagcucuucauuuuccccuuccauguaugcuggugugugagugcaggugugugcacaguuguguguucuagccuagccugugcagucccugggauggguuuauucagggaggggcugagcccucuguagguauucuuuaccuugcaucugucucauucaguguaccgcauccaguuuaacgagagcuucgccgagaugaacaggggcaccaaugaauggaagacaguugugggcauggccauguucuucauuggcuucacugcgcucguucugauuugggagaagagcuaugguaaguacagagggugagguaggcccaggacagcuauagcucuuggugcuguuggggucuuauguggccuccaagcccacauagauagagaugcugugaucauggcaacaguuaugagcugcagcgugccuuuguggccagaugguuugcuuuguauagaauaucguguucuguagcuuaauuaagccucauguccacagaggacugcauagugugagcuaggagacccauuggcugcguggcuggcuguucccaagcaucuggagucugggaugucggccuuuuccauaguguuuggacacuguugcgcuugccugcucucugacaugcauccucucugggucagguuguguugcauuccgagcaggcccuccccuccugagugugauugcagacuacuaacaugccagcccucugaguggcaccccuagcugugugcugggccacccugcagacucugccacugacagcuuaauccguaggauuucccugcugaccuuucacaaucgagggagguucugagauaggaguuacagugcccuggauuaaagcccgugugagagagggguugggcagguggcagggcagccuuccucaccaaguuguucuguuccacaguguauggccccaucccucauacuuucgaucgugacuggguggccaugcagaccaagcgaaugcuggacaugaaggccaaccccauucagggcuucuccgccaagugggacuaugacaagaaugaguggaagaagugagagcccgcugccugccggcucccugccucccucacucccucggcaugcuggaagcugccguauccaaugguccaugcuaauaaaagaccaguuuacguggugu

SEQ ID NO: 4839 - RNA, 5990 nt, Mus musculus
acaccacguaaacuggucuuuuauuagcauggaccauuggauacggcagcuuccagcaugccgagggagugagggaggcagggagccggcaggcagcgggcucucacuucuuccacucauucuugucauagucccacuuggcggagaagcccugaaugggguuggccuucauguccagcauucgcuuggucugcauggccacccagucacgaucgaaaguaugagggauggggccauacacuguggaacagaacaacuuggugaggaaggcugcccugccaccugcccaaccccucucucacacgggcuuuaauccagggcacuguaacuccuaucucagaaccucccucgauugugaaaggucagcagggaaauccuacggauuaagcugucaguggcagagucugcaggguggcccagcacacagcuaggggugccacucagagggcuggcauguuaguagucugcaaucacacucaggaggggagggccugcucggaaugcaacacaaccugacccagagaggaugcaugucagagagcaggcaagcgcaacaguguccaaacacuauggaaaaggccgacaucccagacuccagaugcuugggaacagccagccacgcagccaaugggucuccuagcucacacuaugcaguccucuguggacaugaggcuuaauuaagcuacagaacacgauauucuauacaaagcaaaccaucuggccacaaaggcacgcugcagcucauaacuguugccaugaucacagcaucucuaucuaugugggcuuggaggccacauaagaccccaacagcaccaagagcuauagcuguccugggccuaccucacccucuguacuuaccauagcucuucucccaaaucagaacgagcgcagugaagccaaugaagaacauggccaugcccacaacugucuuccauucauuggugccccuguucaucucggcgaagcucucguuaaacuggaugcgguacacugaaugagacagaugcaagguaaagaauaccuacagagggcucagccccucccugaauaaacccaucccagggacugcacaggcuaggcuagaacacacaacugugcacacaccugcacucacacaccagcauacauggaaggggaaaaugaagagcugugagcacagcccucagacacgaggucacaugacugugaggucacauggcucccguuuggccaagccagcaguauggaauggguaucuagaagcccagcugggagagcugacccagugcaaucgccuccacacacuacugaguguuugugcacccccucugauacccacacugaacuuucucaucccuggaaaggcugcuccagucggccuucuccuucuccuucagcgccuucuggcuggcagacagcaucgugacaugggccacaucaggcaagggguagucacgccgaucagcguaaguggggaaagcauagucuucacucuucacaacacucccuacaacacauuggagaggccugaaaccccguguggacggcagucuaggcagaagggcggugacggucaacgguuaagacggaagccugaccuaagcagccccucggucaccaggggcaggaccagggcugaggguuguuagucacacaagcaacuggacuaaauggagacccaaccgcagggucucauacucagaacauaaaauucaaaaagggaaaggcgacuguugcagagucuugguggucaccgugacccuggcagccaaggacuuaccaagugccuacuggucacugaggcuaacucuggacaugucuggauggcagugucaggaaacaaguaagcaccuguacccccccaugggcucacacucuaagugagaacugagcaguacaggaggcuugggucccacuggaggaaugcacgugugucaggaagcagaggguggcccucgagacucugagggaagacugcugugcucaacaagcagacucacggcagguuaguucugucuuccuucccauguuucccacuuaaaacacucaaaacaguccagucagcccaaagugagcaguggagagugccagccugaggggaggcuccagcugcuccauggaaccaucacagugagcguggccucaccaggacaaaagcucaggccacaagaacccaagcuggauggugcccccagggcuuccuguugcuaaagcucuaacuugacccggcugucugcaggacaaagcuuugcagaaugcuuuccccaggucauguugguacacaauagacaaagccuugagcagugcugcgugugguccuucuguguauuuacuuuggugcacaaaaaaccagugagucuccauucuucugcucaaccccaccccaacagacccgccgggauuacucucccaccuuaacccucagcaucccauaaaguuggcccugacagcacacgcugaacccaagcacccggcaggcggaagcaggaggagcucaagcuugagaccugacugaacaaucacaaaaacacuguccuaaaacuaggagacaaugaucagaaaaagaacggcagcuacugaacuuuccuaccaacacacacacacacacacacacacacacacacacacacacacacacacacacgcacgcacgcgcccucaacccuaugccucuaggcuaaaggacugcaggcuauugagauagauguaaauuagggugagaauguucuagaaucaaucaacuaugauaauggcacauaccagcaacuacacugaaauaacgagaagugacuugagugacccaauguaucgugugaauuacagcucagcuaucagacugccauaaacucucauggucucagagcauugcagccauaaagcacuacauucuagaucaagaguggguaaguuguuuucuaggcgcacuugagagcuuuugugccucuuccaugggucagaggaaaacaaaggcuaaacccuccucuuuuaaaaggucagggucagaggugcagagcccacagccggcuuccucguagcuguggccaccugugcaggaccacacucaaaugugcagggaggugaccucaccugaaugaguggccucauuaggcaagaacuggcaucguccccaccugaagcaugagauacguagaaagacgccgacugcugagggccacguugcacaugaagacaagucccaagcaaccaucccugcuccugggccuaagggcuguggguaaggggagcuggcaggguuacuuccaaguagaccggguugcagaaaccuucccuaccuacccaggcauaugccaggccucagucacccuucuugcccuuaguaaaccucaaccuuuggggaaaauuuacagaauaauaauaaaagggggaaaagcaaagacugcaaucacaagaucacuucuguucccaccccaggcaagcgcugcccggguugucagauguuaaggcucagaucucuucucagucaccucacaccaugaauaccucaacugacagcagugccccagcaggcucccaaagcgcucuaauacugugggcacagauguccacagaggacaacaaggagacugcagcuccuuguccacuggccagacugccaaaaaaugacagccaagucagacaaaaacuggucuugucacagauaucugugcuuggagauggagcaugucuuuuccguguuggauaauaaaagagggacuucccuuacccaacacccuucugucucagccugcaccuauggugccccggggagagcaacaggacacagcacucucacugcugcagagccuuaggacaccagcagcuggcccauggcugaggugaaauccacacagcucagacucaagcccagcagccucccuucgcuucaugcuucugggauggcaacagaagcgggcuuuaugcguuuacagaggcuuguggcaggaaaagauuaaagacagacauggcgccagacagagggacagaacuuuacaggugugguguccugccuuuaaccacagcauucacgaggcacagucuggaacccuguggguccaaagccagucagagcuacacagugagacugagaggaaggagggaaggaagaagggagagagaaaaaaauguaagaagaaaauaaagcaagcaaagacccagacuaauaggauuuauccaugcuccuucaagcaggcaaacgcccuguucaaauucucaucucucccuaaaaucccgguaaggccaagcuaccaggcaucuuuguuaaaaaaaucccagcacaggaccugagacauaggggcaaaaagacauuuaguuugccuguuugaaaguaaaagucgggggcuggugagauggcucagcagguaagagcacuggcugcucuuccagagguccugaguucaaaucccagcaaccacccguaaugagaucugaugcccucuucuggugugucugaagacaacuacaguguacuuauguauaauaauaaauaaaucuuuggaccagaaugagcggggucuaccagagcgagcaggguugaccagagcgagcagagguccuaaauucaauucccaacaaccagaugaaagcucacacccaucuguacagcuacuguguguacucauauacauaaaauaaauaaguaaaucuuuaaaaaaaaaaaaaaaagaaaaagaaaguaaaaguccugagccgggcauggcggugcacaucuuuaaucccagaacaugggagucagaggcagguuaagucucugcgcuccaaggcagccagagccaugcagagaaacccugucaugaaaaaccaaagggaggagaaagaaaagggcagggaagggagugaaaguccugcucaccaugugcucgaaggcacaccgaaguagaaauggcucucuugccaaucaggcucagcgcucuggaagccaacauucugaaagacaaaaaaaaacccuuauaccucuuaacaaugacagcaaacaccuuuuagccaaagucuuuuugcggcaaaacauuaaggaaguaaaugcaacuuaucccccgaaauguuaaauguuuuuuuuuuuuuuuuuugguaaugauuucaucaacuuuuuaaggcacggacuggccugaaagcuuccacuauuaccuuccucuaccucguaagagccggcauuacaggccagaggcaugcccccaggauccgguuuuuauuacugaugcgaaggcacagggugaacuuccuuacaucaagccaagggcuguaauauacauggcuuuggccaaugacuauaaauccggcuucuuaaaaaauuaacuagaaagacaaaaaugacugaaacugcuagaacuagauauauagauagauagauagauagauagauagauagcacgguagcacaccuccugcgacugaguuuuauuuuaaaaauugacuuguacagagacugcgaagggcaagcgggaggaggccgcccaggcucaggcccuggcccgcuucccguuccugcgucccgcaggcgaccuggaugacccugucacccgccccagcgacccgagccccacgccucacuguagcacaaccccugagauucgauccccgagaaagaacguccgagcccgggaaaaaaaaaaucaacgcccggggcggcagaaaccguagcgugacgucagggcucaggucgcugucccucgggccuggcacagcgggaacgcccggugcccggcaggccggagcggggacccgagacaacagacccgcucggggaagcgggcgccccaaggucaccgagccgcucaagucccggguccgggggcgucucggaggcaccgcucccggccccggcgcuccagguccucgggcccccgaccgugccacccucacccgccguccaaggccgucaccugccaccgcugcccaggcgaccgccgcgaccgcccucuacacccuggggugcucgcgaccggaagaacggggcccgcaaccggaagaccaagacggagccgcgaagcaucgcgggaaucagggaagccccgccc

SEQ ID NO: 4840 - RNA, 874 nt, Mus musculus
ucuucugcuuuucccaggcugaguccugcugcgugugggccccggggcucugcgggcgagcacacaacacaccccaggcccguuuccaugucccugauugcuuuucccuccccgggguugcuaaacagccuaugaagaaagcccuuucuuuugccuuuuuauuuuaaggaaggaguguggugacaucugucuacggagaggcuccauguccaagagaccagccccugccuagagguaucuguuucgucuccuccucagagggucccaggagagucuagugacgccuuccuucaaggguucaagcaagggaagucuccgaugcuucagugaagagucacccagcacucaccuacugggccugagaaaggagagaagaggagccuaugggaucgggguagaggcgaagcugagcacagagcuguguuguuucagaggccccugccuuggccuuugugacgcauuuccuuagagcaaugguucucaaccuauaggaugccaccccugggggggggcgguugauugacccuuucagagggguugcauagcacauauucugccaaucaggcauuuacaucacgauucauaacacuagcagaauuacaguuaugaaguuagccaugaaaaucauuguaugguugggaggucaccauaacacgaggaacuguacuaaagggaccagaguuaggaagguugaagcccgcugccuuagagucuuaaggaaaggaccuggucggcucucguucuagcucugagugaaaacaaggacauuagcugggugcuguacccugugagccagaggugaagacacugaccuccuccgcagcuuuccucagaacccaggcaacugcacacaggcaacggaacagcaaagcca

SEQ ID NO: 4841 - RNA, 586 nt, Mus musculus
ggggagggcgggcuugcgggggaggcgcgcucgggagccgcagugacggcagaggugcagccgccccgcgcagcccccuccccucccuccccuccugcuccuccuccuccucccggcucggcagcgcagagcagcggcggcagcggcggcggcagcagccacccgauguccgcgcccgacaagcagcagccgccgcacggcgggggcacaggaggaggcggcggcgcgggcggccaggccauggaccccgcggcggcgggccccaccaaggccaagaagaccaacgccggcgugcggcggccggagaagccgcccuacucguacaucgcgcucaucgucauggcuauccagagcucgcccagcaagcgccugacccucagcgagaucuaccaguuucuucaggcgcgcuuccccuucuuccgcggcgccuaccagggcuggaagaacuccgugcgccacaaccugucgcucaacgagugcuucaucaaacugcccaagggccucgggcgacccggcaagggccacuacuggaccaucgauccggcuagcgaguuuauguucgaggagggcucguuccgccggcggc

SEQ ID NO: 4842 - RNA, 1759 nt, Mus musculus
uacuguuggguuucccgucucaagcucugccuggaguuuuugauuucuguguuucuggggagagccgucugcaguuuucuugucauuucugacugguuuuagugucuggaugaccccguaaagugggccgugaagcaaguauguucucaucacucaauuuacuaaaaaaaaguuugugacuuuuuuuuuuuucuccugugcugggauuagaauccucuguugggugugcuggacaagagccccaccacuacgcuacauccacgggcuuuuaccaaguuuugagacagacucucgguaaguuucaggggcuggccuugaacuugugauccuacugccucauccugggauguugggacugugccaccgggcuguucaguggagccgugugggccuggaguguccuggggaggggggggggucacgccuguuugagugccugcuccucaagccuccuucccugcaucccccuccccccucucccacccuuccugcucccacucccaccucucgccugucacuuuagcacaucacaccuucugagcacacuggccacuuucucacgccucuguaaguugagcagugaugucagcacugaccucacggaugucacacagccuggccucccucuuccugcucagucuggcuagcuguccaucaguuuuauuaaucuuaucagagucaccucugggguucccuggaguucucuauuguucucugcaugccuggcuguaggcaaauggcuuccucuuccugccuucccuaagucugaggaauucccugagauugugugugugugugugugugugugugugugugugugugugugauaucugucugucuguguuacauguguggugugugauuugucuguguguguguguguguguaugugguauguguguaaugugucugucugucugucuguauuaugugugucuguguuauguguguggugucuguguguaucucuauguuuaucuaugugugugguauguaugugugauguauggugugugucugugugugcauguguaucuguauguauguguguguggugugugugguaugugguauguguguaugugucucugugugguauguauggugugugccuguguaugucuguguaucuguguguaguguauguguggugugugugugguguguauauguauaucuguguguagagugugugugguguguguguaugcaucugacuguuggggggugcucugugugugaguguguguuuguguguguguguguguguguguguguguguguguguguguguagcugagcugaacaugcaauucaccagcuaauucucagcuuucuguaaacccucagcccagcccguuggauccugcuguggcagcccaguucagccaucacagugaaggcugcaguagauuuugagauauuccauuugccuuucuacaaaggagcuuuccugacgggagcaguccuccagagagagcucacauggucaggucuggacagacugguagccggcgcugaguccgguuccccuucgcucugugcugggacuaagcuggacggaggauccaugacgaccguggacacucagcucagaagcugggcagcccagcauccauccgguggcagcagcuuugcaaacgggacagcaagccugugggcuggccucugucccucacugccgagaggauuuaucaucugucuuuucuuauguugauguuggagccaaaguuuauugguuauaaauguuaaaaacaua

SEQ ID NO: 4843 - RNA, 13546 nt, Mus musculus
uggauuuagaguuucacaaauaacauuuauuggcugcauucacaacagacucgugcggacauucguaccagccccccuucaacuagcagucacgugacagucccuagcucagauuggaccuugggugcagaucuuaucuccuguggaagcagcaagugucgcagauccuccuaagcugagggcgucccuugaggaccaugaugggggcugacauucuugcggaggaucuugacaguagcuaaagacuucagucccagaacaaaugacuagaaaaccaaaaggaaggcaggcucugagagcuguccccaggguugaaagcccucgaugucccccaggcugaacccucacuguccccccaaacugagccuugccugucccugacaugggcuugcuaggagccuccacagcaaggagagugugagugcccccucagucacugggucucccacuacacccaggaacuggagaaguggacugggaucagggcugcaucugugauucccagcugagacccggugagccucugacggucaguacucagucucggggggggggggugcuccauagcacccuuacuccugggaagggucugagcuggacucccugucagcaauuguccgcuagcccacaggggcagccaggcagccaugaugugaagguucauggggcucaccaugucccagaugaacacggggaaugagccagcacugcugacccccccgcccccagcgaggccugugaagccaggggcagcucugggagaagagccuuaugagcacugucaucaugacgucuaggguucaguaagggacagaagacaagucuagggcagggugcuggcggcagguacccuaagguuccgaagagagugaugaguccagacccgccccuccucgaccccacccccaccccagcagcucaccaaauggcuaugauggcccucaggacugccugcagcaggcucaggagauugaagcugauggggaggaggccuaagcggccagcaugcggcucguccuccugaagaccuggcagcucaucuugauaaagggccuggagcugcugccacuugaggaggagauguugguucccacagacccgccagcagccauaccaucugcuugaguccugggggcgaccuagaaguaagaggggcauuguucaggagagggcgggacaccagcuagcccccagagggugacgaucaacaguuccuuuccuuuauuuauuuuuuuuucaguggggaacggggguucaagacaggguuucucuguguacccccugccuguccuggaacuugcucuguagaccaggcuggucucgaacacagaucugccugccucugccucccaagugcugggacuaaaggcgugcgccaccaacaccaaccaucaucagacagugucugagucuuuauucuucaaaguggauagcugggauuuuucagccuucguuugucuguuucucuagaagagagagguccaugaggauggaaccuaauugggcuaccacagcugaguugcgggaacaucacugauuuaagcaccgcuaaaucauggcuggagaaauggcucagugguuaagggcacuggcuguccuuugagaaggccuggauuugacuccuagcacacacacacacacacacacacacagagagagagagagagagagagagagagagagagagagagagagagagagagagagagagagagagagagagagagagagagagaagcgcuaacaacccuauguagaguuuccagggucuacagcucccccuacuggcccccacagggacuacaagcacaaacacugaggaggggcacggcuugagcccgggagucacacacagcuggggcaacacaguaagaucucaucuugaaaacaagacaaauaaauccaauaaaaccucaacugcaaagcacaauuggagaggguggcgagacagcucagaggcugcaagaggaccaggguucgaaccugcacuccagguagcagugcagcuucugugguugggaacgggacuuuuuuuaugcauucaagaacaugucgguuguuggcuacccauuucccaagugcuucuuauccuuucccagaaagccaucaccaccccagauccugcacaaggcauuuucugugcagagccggcacagagcaggaccugauaccagaccagagccuggaaacaucuucaagaccaagcccaggacacuggguacaaaaccauaaguaacguaggaaggagacaccugucccauccaaccaucugagccaugggggaugugagugugugugagugugcugcccagaacguaugugcgcacgacaaaugcacauuguuagccaugaguacaggaaugcauacgugccagguccaugcaugggcaucugcacguaccgugcugcacgcacacgguuaugacugugcugugcaaugcgugugugugugugugugugugugugugugugugugugugugugagauucaagugccgucacaucggaaagacacaccaguucaaaagugaacaguaguggugcacgccuuuaaucccagcacuugggaggcagaggcaggaggauuucugaguucgaggucagccuagucuacaaagugaguucuaggacagccagggcuacacagagaaacccugucucgaaaaaaaaaaaagugaacaccuacagacaccccauacuacaaguaacagaaguccacagccuaaauaaaaccacuucuggugucgucagccccggcuugccacugcuaagacugggggggucugucugggucauuuguaaagagacggcaggcagcuggugaugccugacaaggguaggggauggcugugccaccuguguggccuugucccacccccuucccagggcagaaugaggugacacgugguguggacuuaccuggagugucuuccacauucuccagccucuucaacaccuaaaagaugagaaagugggucaguaugucacuuaaaagaugagaaagugggucaguaggucgucuagugacccauggugugucugucugucagggcguaaucaggacuugagaccucaggggaugggugcuguggcucccgguucagagccgaguucuuugugcuggagacagcuugcuucucagggauagagaaccccagaguggaagccaggagaggaagaggagaccucuuacuaggcccaaacacuaggaagguccacuaggcugcaggaagguuggauguggguaaucccggccuuguggucccaaacuaccacuguggggaugugggugguaccagaggaaggaaacccagagccacagcuggacaccaauacaggacucuggacaggugcaagaggaaugggcacaggucgugugaccuggcugguuuugugugucaacucgacauaggcuggaguuaucacagaaaggaguuugagaaaaaugccuccaugagauccagcuguaaggcauuuucucaauuagugaucaaggggugagggcccauuguggguggugccaucccuggugucucagucaggguuucuuuuuuuuuuuuuuuuuuuuuaaaaaccuggucuuuuuuuuuuuuuuuuuuuuuuuuagauuuauuuauuuauuauagguaaguacuguagcugucuucagacaccccagaagaggacaucagaucucauuacggaugguugugagccaucaugugguugcugggauuugaacucaugaacuucagaagagcagucggcacucuuaaccgcugagccaucucuccagcccucagucaggguuucuauuccugcacaaacaucaugaccaagaagcaguuggggaggaaaggguuuauucagcuuacacuuccacauuguuguucaucaccaaaggaagucaggacuggaacucaagcaggucagaaagcaggagcugaugcagaggccauggagggauguuccuuacuggcuugcuuccccuggcuugcucagccugcucucuuauagaaccaagacuaccagcccagagauggucccacccacaaggggccuuucccccuugaucacuaauugagaaaaugccuuacuguuggaucucauggaggcauuuccucaacugaagcuccuuucucugugauaacuccagcugugucaaguugacacaaaacuagccaauacaccugggcugggagucuuggguucuauaagaaagcaaacugagcaagccaggggaagcaagccaguaaguaacaucccuccguggacucugcaucagcuccugcuuccugcuuccugcuugaguuccaguccugacuuccuuuggugaugaacagcgauguggaaguguaagcugaauaaacccuuuccuucccaacuugcuucuugguuaugauguuugugcaggaauagaaacccugacuaagacaucaugaaagguagaaagagagaggaagggacagcaaggaagaaaagacgcagcacccuggguaccagaugucccucacccauccucacccauccucagagaaugaggcccacacuucccagcagccuccacgagacaugaccuuccacccuugccauggccaucugggaggaggcccuuggacuucuuccccuuuacucagcccugucucaugccccaaucccccuuuuuaccuucuucugugaccucagccccuggggcacccaguagggcaugacagcccugucccugggcaucggaaggcggcccccaaagcaguggcaggagcaccggcaggacuucauggcucuggggauguaacaccgcaucaucuucgagaccuaccggcagacagugggaaagggucgagggggcaccagguaugauggcaugcgccucugguuacaggacucagaaggcaggugggucuucuugaguucgaggccagccuggucuauguagggaggcccugucuuuagguggggggaggcuagagcccagauaucagggugcuccccuugcacacacaaggaccuguguuccaucuccagcaccagcagguguaagggccaggaggauggcucagcugguaggggcaccugcugccuagccuguacgccuguguuccagcccugggacucacagugaagagggagaagugaguccuguaaaaguuccucccacuuccacacaugcccuagucacaccacaggaaagagaaagagagaaagagagaaagagagaaagagagaaagaaagaaagaaagaaagaaagaaagaaagaaagaaagaaagaaagagugagagaaagaaagaaagaaaaaaagagaaaauuucaaacaauuguccuuccaggcuccucuguuugaauauuuggccuguaacugcugggauucuuugagcucaauuaggggauguguggucuuucaccuuucucucucucucucucucucucucucucuauuuuauuuuauuuuaugguuguuuuguuuuuguuuuguuuuguuuuguuuuguuuuugagacggggccuuccuauguagcccuagcuggccucgaucucacacacagaagaacuucccuagcacuuugucgaugguaagugaacugucuaggagccuguggcaggggcuuguaaccgcccuugcauggcucuuucugaguuccuguugcccugaaggaggaugacgugggcugauccaugggugucaaggccaugucacuuggugagcugcucccagugaccaugauccccacgggagagaggcagguacaagggaucugggagaacacuacagacuuaauacacagaucacauaagugaaucgcaaaagaccucugcaagccaaagaaaugguuuagcaggucagggugcacagccacaaagcuuaaugacaugaguuagaaucccugguacucacaggauagagggagagaaccaaccccaaauguagucuucugauugccacaauuauaccaugguaccaauauguauacaaacacacacacacaugcauguacacaugcauaaaaaaaugaggaggaggagaagagagaaggaagaaggaggaggaagaaggaggaagaaggaggaggaggaagaaggaggaagaagaggaagaggaggagggagaggaagaagaaggagaaggaagaagaagaagaggaagaagaagaagaagaggaagaagaagaggaagaagaagaggaagaagaagaaggggaagaagaggaaggggaagaagaggaagaggaagaagaggaagaggaagaagaggaagaggaagaggaacaggaagaggaagaagaaggaagaagaagaagaagaggaagaagaagaggaagaaggagaggaagaagaggaagaggaggaggagaagagagaaggaagaaggaggaggaagaaggaggaagaaggaggaggaggaagaaggaggaagaagaggaagaggaggagggagaggaagaagaaggagaaggaagaagaagaagaggaagaagaagaagaagaggaagaagaagaggaagaagaagaggaagaagaagaaggggaagaagaggaaggggaagaagaggaagaggaagaagaggaagaggaagaagaggaagaggaagaggaagaggaagaggaagaagaaggaagaagaagaagaagaggaagaagaagaggaagaagaagaggaagaagaagaaggggaagaagaggaaggggaagaagaggaagaggaagaggaggaagaggaagaagaggagggagaggaagaagaggaggaagaggaagaagaggaggaagaggaagaagaggaggaagaggaagaagaggaggaagaggaagaagaggaggaagaggaggaagaggaagaagaggaggaagaggaagaagagaaagaggaagaggaagaagaagagaaagaggaagaggaagaagaggaagaagaagaagagaaagaagaagaggaagaagaagaagagaaagaagaagaggaagaagaagaagaggaagaagaagaggaagaagaagaagaggaagaagaagaggaagaagaagaagaggaagaagaagaagaggaagaagaagaagaggaagaagaagaagaagaagaagaagaagaggaagaaagaagaggaagaaagaagaggaagaagaggaagaaagaagaggaaggaagaagaggaaggaagaagaagaagaaagaagaagaagaaagaagaagaggaaggaagaagaagaagaaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaagaggaagaagaagaagaggaaaaggaagaggaagaagaagaagaggaagaagaggaggaagaagaagaggaggaagaagaagaggaggaagaagaagaggaggaagaagaagaggaggaagaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaaggaagaagaagaggaagaagaagaagaggaaaaggaagaggaagaagaagaagaggaagaagaggaggaagaagaagaggaggaagaagaagaggaggaagaagaagaggaggaagaagaagaggaggaagaagaagaggaggaagaagaagaggaggaagaagaagaggaggaagaagaagaggaggaagaagaagaggaagaagaagaagaggaggaagaagaagaggaagaagaagaggaagaagaagaggaagaagaagaaggagggggaggaggaggaggaggggaagaagaaaaggaagaagaaggaagagagaaggaagaagaaggaagaagaaggaagaagaaggaagaagaaggaagaagaagaggaagaagaagaagaggaaaaggaagaggaagaagaagaggaggaagaagaagaggaggaagaagaagaggaggaagaagaagaggaggaagaagaagaggaggaagaagaagaggaggaagaagaagaggaggaagaagaagaggaggaagaagaagaggaggaagaagaagaggaggaagaagaagaggaagaagaagaagaggaggaagaagaagaggaagaagaagaggaagaagaagaggaagaagaagaaggaggaggaggaggaggaggaggggaagaagaaaaggaagaagaaggaggaggaagggaaggaggaggagagggagaaggagcaggagcagcagcuggggagcuggcucaucgggugagaaugccuacugugcacgucugaggaccugaguuuggagccacaacccccucacaaagacaggcauggcuguccuugacuguaagcccagcauugagcguggagacaggcggcucccaggagcuugcagacagcuuagccugacagaaacagcaagcuucagguucaaggaggggcugauucaaggcaacggggcagaagacaccugacacccgcucuggccuccaaaucuaucugugugggugggugugucccccaacacacacaaacaaggguacagcacauacacugcaugugcacacauacacugcacauacacugcacacacacucacuguguacacaugcacacacacauacauuguacacacacagcacuuuugcacacccacauauacugugcauacacauuguacacacauacauagcacacacacacacacuuuaaaagaaacaaaggggguagagagaaggagaggauggagguggacagggacugucgcucagugaagaucacuugcccaguuuguucaauccccaacaucaaaaucaaucaaucaaucaaucaaucaaucaaucaaaccaagacuguauugcagaaaccucagucacagaauaucuaugacuucaaugggcucuggaccaggacagguguccuggcccuaagugaugacugccaagucacucacucaccugcuuucguggucucagggacaaaggcacccaguagggcagcagugcaucagcccggggcacaggcagguggcccccaaacuugguguagcauuggcaacacgcauacuccuggggaacagugcggaggccggaggacaccugagcaagacacacagagcacagcacucagugggguacaccugaccgagacacagacaggacagaacuaagugugaaaguggggggagggggacagcacccaggggaagggacaggucugccugugacucagaaugaggcugcggcuacauggcuguuugccagcgugggugugcaagcuagcuuguggggaauccuggucacucacugugagcaagucugucuauggaagacuggagcaacucgaggagggagggcaagccugugguuuucugcauggcacagaccacuuauuaggaccaccaccccuuccaggggcagaggaaggugccgaugaccagggcuagucacugaaggagcuuccggauucccuggggcuccuggucucaggagggacuaguagggaagaugugaggcuguacagauguauggggacaucuucugggcggagcccagccugagacucuccucccccuccucucacccauaggauggacaagaggcugagggaauuuccucaccgacugacccgugaugcacacauccuuuccaaaggucugaaacgaacccuuccuagaaaagacaaauacggaugugaagguucugaguucugugcaaacuuugggcugggcaucgguggcccuuggcacuacacuaaaggcggagaggucguccuucugagcccaggagguagguauuucagggagacagaagggcaggcuagcacaggugauaucuuccuaacuggugugagacccuguguucccaagccaaccuguuucaauacacuccagcuaaagccaggcuuggcucucaggaggguccuagggccugaagaucccagggcuccacuggccccugugaggcuuuguauacacaggcuuacugcaguaagaggaagaucaugucaaaacugucacaaaaauccaguagaccugaugacuuugccucaaagaggacaggguaagacauaagagaacagggggugcagcaaaauaaagggggacagaguggcagaguggaacaaagagggacagaagacgggggggugggagggacacagcaggaccaugagcucggagugacaguuaacucucccuggaucccagccacacacugccaggauauuggccaugagagcaucuagcaugcagacaucaaacaccaggcaaaacugaguuuccauggcuggugucagcuugcuucacaucagaaaucacugcggccgggugguuuuauauaauaaucucaaucauuauugucugcuuugguguuuuguugaggcaggauuucaccguguaacacacagcaauccuccugcuuccgucucccaagugcugagaucacaggagcgugcuuggugugcuaagggccuuugaacucaguucucaugacugauaacugaaaauaagacacaggggcugaccggcacaacaucucaggggcugaccggcucaacauccggacuacccacaguaguccagccucgaggugaggucaagcugaucugagauuggucacuacagucauaacccuuggaacugccugcuagaauagcgagagcaguuguucuccuucuuugcugaaggaguuacccuaauuaccacaggaagucuggguggucaccuggucugugagagaaaccugcgcaaaggaaaggagagggccggggggggggggggaaacauccgggaccauaguccgugcacaccuggauacagccaugccugaaggccugcuccugacauuuccaagguuggaaagaguaggucgccacugcgcuaccgcuggacugggcagccucggggcucccggcacucacaggugagcuccgaggucacccguguggacucugggcugaccugaucugucaugaugcacuguguugggcaugugcuauacagccagucggaccagagccuccaagguccucacuaaagccagaggguugcgcugcuucucaacagcuucccgcucgaccugcugauuggcccucgaucagccaaucgggagcugucguauucgggugugcacugagcugacagcugauuggcuacucgcagguggcucaugggagcagugggacagagaggacauuuggcucgagcuccauauccucucgucgccuggguggacauggagaccagcccgaagacacucaccauuuucuguggauggaucugugcgcgcguaggacuacccggucccgauccccuguaaagagacagagggagguaggaccggaccaaaggggguccccaugggcuaaauuccucuuugggucgcagauaccaccagggauccccaaagccauguguuaucaaguagaguaacagcuugguggaccagaacuucacagccugucagauacauucacucugugcaucccagauaccaucagagacacaccucuacucaaagccguuuguuaucaaauacggugacagcuuggagaaccugggcuucgcaugugcgcgccggucagacgugcaugaauuguaacuuaaaagaaauguugccauccagggcuuuggucagaccagacuuagcguuugggacccgugagauggcuuagcaggagagugcuccugcugccaagccugacaaccugaguucgaucccgggacccacauaguggaaggcgaguacucccuuacaucucaacugccuguuccgaaacagcccacagcuguuacgggagaaaauccagucauacuucaggcagggguuaaaauccacaauuuacauagaacugccaaaguuaaauaccgagggaacaaagcugccaccuggacuggugaagggaacagacuuuggcucccuccaggggcugcccuuagcagaggaugggggguguggauaccugccccugccuccgugcugccauggcaaccacuccagagcacaucccuaaaaccaccccaugacucugggguccgccccuuggccgaccuucucaucuguuuccugagucccugugacgacuuuggauuccugucuugggggucugccccuagaggaucucaaguucuucccagcaccccgcggacagucaacacccaccaaagggguccuuccccucccccacagucccucggcuucgcgccacagaccgacaguccacagcuggcaacagcccagagaccuggugggcuggggcaggcacugugguagcggcuggugcagcggggugccgggccccugcuaguaaacaacaagaaacaacucagcaaaaagaaacacccguggauacagagaaagaagaauggcugccauagccauucuagaaagcacagcaagcccacagcugaggugucgaagcugcaggaaagaggaucccagcuauucaggaggcugagccuggagccugaagaccauuugagagcaugacggaugucaagacuuccaggccagccuagacuacugaggaacccugacucaaaaugcaaaaauaaaauaaaauaaaacaagaugaaaaaauaagggucuggagagauggcucagggguuaagagcacugccugcucuuccagacguccugaguucaauucccagcaaccacuugguggcucacagccaucugucaugcgaucugacgcccucuucuggugggucugaagacaucgacaguauacucauauacauaaaucuuuuuaaaauuauauaaaauaaaaaucaggcaggcaggggcaguauaugccuuuagucccaauacucagagaggcagaagcagguggaucucuuagaguuggaggccagccugguuccaggauagaccagacuacauauauucccuccuccugcggacacuucccaggucugucaggcuggacguuggaggguucuaagacaaggucaccccagcaccuccgacuagagucaguuacaugucuugucucgugcccuugcuacagggcucuuagcgucuugcccuacugugguauugugagcuucccggggguugacacucugucagcucagccagcuuggccauuaccuuuuccuccuggggucgcugguaucauggccaucccuuuguucccugucuccaguggugacacgucccaguucuuucagugguugugacuggucuuucuucacucugcccuccagugugcugugggacacagcaucaccaccaucauccucacuaucaucagagcgggaaagggaagaggcccacacggguucuaauaacuugcuacuccccagacgccugucagccugcuccccaugguccuagggcucccuugaagugugugggagaggcagccaccuacuugccugugcaccgucugugucccccacaaccaug

SEQ ID NO: 4844 - RNA, 1404 nt, Mus musculus
ugggagcagugggacagagaggacauuuggcucgagcuccauauccucucgucgccuggguggacauggagaccagcccgaagacacucaccauuuucuguggauggaucugugcgcgcguaggacuacccggucccgauccccuguaaagagacagagggagguaggaccggaccaaaggggguccccaugggcuaaauuccucuuugggucgcagauaccaccagggauccccaaagccauguguuaucaaguagaguaacagcuugguggaccagaacuucacagccugucagauacauucacucugugcaucccagauaccaucagagacacaccucuacucaaagccguuuguuaucaaauacggugacagcuuggagaaccugggcuucgcaugugcgcgccggucagacgugcaugaauuguaacuuaaaagaaauguugccauccagggcuuuggucagaccagacuuagcguuugggacccgugagauggcuuagcaggagagugcuccugcugccaagccugacaaccugaguucgaucccgggacccacauaguggaaggcgaguacucccuuacaucucaacugccuguuccgaaacagcccacagcuguuacgggagaaaauccagucauacuucaggcagggguuaaaauccacaauuuacauagaacugccaaaguuaaauaccgagggaacaaagcugccaccuggacuggugaagggaacagacuuuggcucccuccaggggcugcccuuagcagaggaugggggguguggauaccugccccugccuccgugcugccauggcaaccacuccagagcacaucccuaaaaccaccccaugacucugggguccgccccuuggccgaccuucucaucuguuuccugagucccugugacgacuuuggauuccugucuugggggucugccccuagaggaucucaaguucuucccagcaccccgcggacagucaacacccaccaaagggguccuuccccucccccacagucccucggcuucgcgccacagaccgacaguccacagcuggcaacagcccagagaccuggugggcuggggcaggcacugugguagcggcuggugcagcggggugccgggccccugcuaguaaacaacaagaaacaacucagcaaaaagaaacacccguggauacagagaaagaagaauggcugccauagccauucuagaaagcacagcaagcccacagcugaggugucgaagcugcaggaaagaggaucccagcuauucaggaggcugagccuggagccugaagaccauuugagagcaugacggaugucaagacuuccaggccagccuagacuacugaggaacccugacucaaaaugcaaaaauaaaauaaaauaaaacaagauga

SEQ ID NO: 4845 - RNA, 1404 nt, Mus musculus
ucaucuuguuuuauuuuauuuuauuuuugcauuuugagucaggguuccucaguagucuaggcuggccuggaagucuugacauccgucaugcucucaaauggucuucaggcuccaggcucagccuccugaauagcugggauccucuuuccugcagcuucgacaccucagcugugggcuugcugugcuuucuagaauggcuauggcagccauucuucuuucucuguauccacggguguuucuuuuugcugaguuguuucuuguuguuuacuagcaggggcccggcaccccgcugcaccagccgcuaccacagugccugccccagcccaccaggucucugggcuguugccagcuguggacugucggucuguggcgcgaagccgagggacugugggggaggggaaggaccccuuugguggguguugacuguccgcggggugcugggaagaacuugagauccucuaggggcagacccccaagacaggaauccaaagucgucacagggacucaggaaacagaugagaaggucggccaaggggcggaccccagagucauggggugguuuuagggaugugcucuggagugguugccauggcagcacggaggcaggggcagguauccacaccccccauccucugcuaagggcagccccuggagggagccaaagucuguucccuucaccaguccagguggcagcuuuguucccucgguauuuaacuuuggcaguucuauguaaauuguggauuuuaaccccugccugaaguaugacuggauuuucucccguaacagcugugggcuguuucggaacaggcaguugagauguaagggaguacucgccuuccacuaugugggucccgggaucgaacucagguugucaggcuuggcagcaggagcacucuccugcuaagccaucucacgggucccaaacgcuaagucuggucugaccaaagcccuggauggcaacauuucuuuuaaguuacaauucaugcacgucugaccggcgcgcacaugcgaagcccagguucuccaagcugucaccguauuugauaacaaacggcuuugaguagaggugugucucugaugguaucugggaugcacagagugaauguaucugacaggcugugaaguucugguccaccaagcuguuacucuacuugauaacacauggcuuuggggaucccuggugguaucugcgacccaaagaggaauuuagcccauggggacccccuuugguccgguccuaccucccucugucucuuuacaggggaucgggaccggguaguccuacgcgcgcacagauccauccacagaaaauggugagugucuucgggcuggucuccauguccacccaggcgacgagaggauauggagcucgagccaaauguccucucugucccacugcuccca

SEQ ID NO: 4846 - RNA, 3960 nt, Mus musculus
cagugaugacggggacaagccauuccucucaggcagcccuugucccccuccuggcuccagaagggcagcauaggcccagaagcugcaggcguggacagaaacgaggucucccgggcuccgggugcggaaggcucaguggaaacuuucugagugguugucuucaaaaggcccaccuagcacaggacuccagagaaugcuucguugagcccggagcagcuguccagaccugguguccagagugauccagcagcuccacgcagcaagcuccagagaucagccacagacuggugcccccccaccccaggcagcaaucggcugcaucauggccucacuggggcacaggcaaguggagucagacccaacccccagcuguucucucagcucugccccacaucugacccucucuagcuccucauccacaccuagacagccaggaaacuauaucugcaggccucacugcagcuaucuuagcaaccuggaggccauucuuagcaaggcaauccagguauauccucagccccuucgggggcuucugugacgcucagggagccacaauccuuaucacggcuccuggggcaguagauaacgcugaagagccacacacgagagacuccauccaacucuacagcucagccuccuuccccgacggugcuccuugcugcuccacggugccaugugcucccucuaugaagccuccuguccccucagcccgaaauguucugccugucaccagccauucuccgcagaacggcagggcuaugccuagcuccagccagccacuagcccauguggacuccuccccagucuccagcccagguguucccuacucagguggcuccuuguguccuuucuccuucccacacuucuccacuggcaucuucuacagggacagugcagagaccuugaacaaacaucccgucguacauggccaccaucccagugugcauacagaaagaggccacccuggccauuaagaggugggcaccacuguggccuguaaggagggauggcggggacagugaggagcuucgaggacaugcuccuuccugugcgggagggaaagcaagauggugcagccacugucagaucgaagcaggguugguuuuuguuguuguugaaguauuucuguguauguguguuugccugaauauauguuaguguggcacauccacacggcacccacagugccagaagaaggcacagaagccccuggaacuggaguuauaagauggcugugagcugucauauggauucuggauacaaaacccaaguccucugcaagagcagguagugcucauaaccagugagucaucucuccagcccugggcagguucuggaggcugugacucccccccccccccacagugccucgcuguacucugaagacccuacccacacaaacgauaugccaggguguguagagcuauucacaggaugcccaacugcaaauaacccaagaucucauagcaggagaagcuugagguacacccacccccagaauacuagucagccagugagccgugcaggagugugacugacaggugcugcgggacgggggaaccccgacacgggcaguuacauagacucagcagggaaacgaccgccaugggacagacggcuguaagugagaagcccaagucugcaggauaaaucacauagacaguuaacaguguguacuguuagauucgaguaggaugugcagguguggugggaccagcucguugugauuccaagaccugagagucugaagugacaggagcaggagcuucaagccagacucaucuaguuagagagacuuggucucucucucguguguguguguguguguaaguguaugaguauugugauguguauauaugaugugugagugugauguauauaugauguguaauaugugugauaugugugugugaugugugugugauaugcguguaugauaugugugugauacauguauguguguauaagugugugauguguguguaugagugugugaugugugugugauguaugugaguguauauucccuauggaaacaguugaaaaaagccuuaaaggggcaguaauggaagcaagucgagaaauggaaugagcucccuacuguuugcacagacgcaaacaguuuagagaaaggugacaucauucuguccccacuguggggcuuaagugucccucaacucaaaaaaaaaaaaaaaaaaagaaaagaaaagaaaagaaaagaaaaaaaagucccaugcagucacuggagacaauaccuccagcaucuugcccagccucugcaauguccuggguucaguccccaguacagccuguaaauaaaaccauuucuaccggggcagaagugguuacacacagccaaacuugaaaggcagugguagccgggcacaguggugcacaccuuugaucccagcacucgggaggcagaggcaggcggauuucugaguucgaggccagccuggucuauagagugaguuccaggacagccagggcuacacagagaaacccugucucaaaaaaccaaaaaaaaaaacaaaaaucaaaacuugcuuggacagacucaucuuuuucuaaaugucucuagcacuaaggauggggcugcauggaggccucuccccuggccagagccccuuccagggaacuucuaagagcccacuacuuggaggauugcgacaaacacaccagguuaccaggcaggaggugacagcuaagccacauguugcaccuuccuuuccagaucaaggugaagcaggauaaggaagagaucuuccccaguggaagaggauggagaagacccucacgguguagcggcuuccccagagguucccacaccgccuugugccccagugggcuuugaagccacaagaguccucuuugcuaagguauuguggacugcaguaacccggagcgcccacuagaggucacaccacaaccucuuuaaaaggaauggucagauugacagacggugccuguagaugggagagcuaacguaggagguagacuacaucagugccagaucaugaccccuccaugagcccccaucuguaaugccagcucccccauguguaaucucaguuccagaaagcauccaccccugcccucacagcuggcuggcugcuguuucccacaggaugagaaaaggcuggaaaggaaagggaaagucuggcgaaaccaccugauauuugcuuuaaaguauuucaggucuggagcuggaccucagagguaggcaccugccuggugucacccccaccccugugaaaaugaaacugucucagagaccuguguggagacauaccaguccaucacuagucgcaccgcaccuucccaucuggaccccaauuucucauucugacaggaggccacugcaccucagauaugucugaagcagggugccacccugggggagggcagaagcccaaugguggccacaaagcaggagcgggcguuaacugcaugcuuuuuaaguuucauagguugcauaucuguguguguguguguuguguaugcauagcuauacacaucugugaaguccugagguugacacugaguguccucaauugcucuccacuuuuuuuuuuuuuucgagacagaauuucucuguguagcccuggcuguccuggaacucacucuguagaccgggcuggccucgaacucagaaaccugccugccucugccucccgagugcugggauuaaaggcgugugccaccacgcccggcuucacucuccacuuuuaaaaaaaaaaaaauuuuuuuuuaaaggcuauuuuaaaaaugugugucacagggcugguaagauggcucagcgguuaagagcacaaacuauucuucugaagguccugaguucaaauuccagcaaccacauuauggcucacaaccaucuguaacaagaucugacgcccucuuccagagugucugaggacagcuacaguguacucacauuaaauaaauaaaucuuuuuaaaaa

SEQ ID NO: 4847 - RNA, 3960 nt, Mus musculus
uuuuuaaaaagauuuauuuauuuaaugugaguacacuguagcuguccucagacacucuggaagagggcgucagaucuuguuacagaugguugugagccauaaugugguugcuggaauuugaacucaggaccuucagaagaauaguuugugcucuuaaccgcugagccaucuuaccagcccugugacacacauuuuuaaaauagccuuuaaaaaaaaauuuuuuuuuuuuuaaaaguggagagugaagccgggcgugguggcacacgccuuuaaucccagcacucgggaggcagaggcaggcagguuucugaguucgaggccagcccggucuacagagugaguuccaggacagccagggcuacacagagaaauucugucucgaaaaaaaaaaaaaaguggagagcaauugaggacacucagugucaaccucaggacuucacagauguguauagcuaugcauacacaacacacacacacacagauaugcaaccuaugaaacuuaaaaagcaugcaguuaacgcccgcuccugcuuuguggccaccauugggcuucugcccucccccaggguggcacccugcuucagacauaucugaggugcaguggccuccugucagaaugagaaauugggguccagaugggaaggugcggugcgacuagugauggacugguaugucuccacacaggucucugagacaguuucauuuucacaggggugggggugacaccaggcaggugccuaccucugagguccagcuccagaccugaaauacuuuaaagcaaauaucaggugguuucgccagacuuucccuuuccuuuccagccuuuucucauccugugggaaacagcagccagccagcugugagggcagggguggaugcuuucuggaacugagauuacacaugggggagcuggcauuacagaugggggcucauggaggggucaugaucuggcacugauguagucuaccuccuacguuagcucucccaucuacaggcaccgucugucaaucugaccauuccuuuuaaagagguuguggugugaccucuagugggcgcuccggguuacugcaguccacaauaccuuagcaaagaggacucuuguggcuucaaagcccacuggggcacaaggcggugugggaaccucuggggaagccgcuacaccgugagggucuucuccauccucuuccacuggggaagaucucuuccuuauccugcuucaccuugaucuggaaaggaaggugcaacauguggcuuagcugucaccuccugccugguaaccugguguguuugucgcaauccuccaaguagugggcucuuagaaguucccuggaaggggcucuggccaggggagaggccuccaugcagccccauccuuagugcuagagacauuuagaaaaagaugagucuguccaagcaaguuuugauuuuuguuuuuuuuuuugguuuuuugagacaggguuucucuguguagcccuggcuguccuggaacucacucuauagaccaggcuggccucgaacucagaaauccgccugccucugccucccgagugcugggaucaaaggugugcaccacugugcccggcuaccacugccuuucaaguuuggcuguguguaaccacuucugccccgguagaaaugguuuuauuuacaggcuguacuggggacugaacccaggacauugcagaggcugggcaagaugcuggagguauugucuccagugacugcaugggacuuuuuuuucuuuucuuuucuuuucuuuucuuuuuuuuuuuuuuuuuuugaguugagggacacuuaagccccacaguggggacagaaugaugucaccuuucucuaaacuguuugcgucugugcaaacaguagggagcucauuccauuucucgacuugcuuccauuacugccccuuuaaggcuuuuuucaacuguuuccauagggaauauacacucacauacaucacacacacaucacacacucauacacacacaucacacacuuauacacacauacauguaucacacacauaucauacacgcauaucacacacacaucacacacacauaucacacauauuacacaucauauauacaucacacucacacaucauauauacacaucacaauacucauacacuuacacacacacacacacacgagagagagaccaagucucucuaacuagaugagucuggcuugaagcuccugcuccugucacuucagacucucaggucuuggaaucacaacgagcuggucccaccacaccugcacauccuacucgaaucuaacaguacacacuguuaacugucuaugugauuuauccugcagacuugggcuucucacuuacagccgucugucccauggcggucguuucccugcugagucuauguaacugcccgugucgggguucccccgucccgcagcaccugucagucacacuccugcacggcucacuggcugacuaguauucuggggguggguguaccucaagcuucuccugcuaugagaucuuggguuauuugcaguugggcauccugugaauagcucuacacacccuggcauaucguuuguguggguagggucuucagaguacagcgaggcacugugggggggggggggagucacagccuccagaaccugcccagggcuggagagaugacucacugguuaugagcacuaccugcucuugcagaggacuuggguuuuguauccagaauccauaugacagcucacagccaucuuauaacuccaguuccaggggcuucugugccuucuucuggcacugugggugccguguggaugugccacacuaacauauauucaggcaaacacacauacacagaaauacuucaacaacaacaaaaaccaacccugcuucgaucugacaguggcugcaccaucuugcuuucccucccgcacaggaaggagcauguccucgaagcuccucacuguccccgccaucccuccuuacaggccacaguggugcccaccucuuaauggccaggguggccucuuucuguaugcacacugggaugguggccauguacgacgggauguuuguucaaggucucugcacugucccuguagaagaugccaguggagaagugugggaaggagaaaggacacaaggagccaccugaguagggaacaccugggcuggagacuggggaggaguccacaugggcuaguggcuggcuggagcuaggcauagcccugccguucugcggagaauggcuggugacaggcagaacauuucgggcugaggggacaggaggcuucauagagggagcacauggcaccguggagcagcaaggagcaccgucggggaaggaggcugagcuguagaguuggauggagucucucguguguggcucuucagcguuaucuacugccccaggagccgugauaaggauuguggcucccugagcgucacagaagcccccgaaggggcugaggauauaccuggauugccuugcuaagaauggccuccagguugcuaagauagcugcagugaggccugcagauauaguuuccuggcugucuagguguggaugaggagcuagagagggucagauguggggcagagcugagagaacagcuggggguugggucugacuccacuugccugugccccagugaggccaugaugcagccgauugcugccuggggugggggggcaccagucuguggcugaucucuggagcuugcugcguggagcugcuggaucacucuggacaccaggucuggacagcugcuccgggcucaacgaagcauucucuggaguccugugcuaggugggccuuuugaagacaaccacucagaaaguuuccacugagccuuccgcacccggagcccgggagaccucguuucuguccacgccugcagcuucugggccuaugcugcccuucuggagccaggagggggacaagggcugccugagaggaauggcuuguccccgucaucacug

SEQ ID NO: 4848 - RNA, 28364 nt, Mus musculus
agcagcuuagaauuccaauagcuuuuaaaaaaaacaaaaccaaccccccaaaaaaacaaaaagccucacaaaacagcagaccucuguaccccccccccagucuaauguaacaggcuagccauuaauacaauaguaaaagacauuauaaccacagcacuaucucagguggcacagcagauggacccaguguggugggucagacacugaccauugaaaggggccagguaggggugucuuucagggcagugacauguuaggauaaaaccaaaauagaaagcacugggcaaaauggcgguggucggagcuugauuugaaaauaaaaaccuacagaugggcauccucagaacaucacaaacaggaaugacagggccuucucagagagccugggucagcaccaugaaucccugcccuuuaacccaggcuguaucuggggacacaccccaggauggaacugggucccugcccucauuuccagggaagagaccccaguucccauaucugggagaaccuucaagaggcacucugaccuugaccuugcuuccucaccccaaugaaagggaaccccagaagcacagaggagaggucaggguggccagugguaagucaccacuauguaagaacugcauaguagccauuccaguagacaccccuucagggaggccauggucugaggcaauggcagaggccagcaggggacgcacauccugaagucccuccagcagaucagcuccuucagugaugugcuggcuggacccaacugucucacccagagcacaacgggaaggcugcaggauggucccacacauguagccaguggcuuucauacucagggagcuggaguggucacaccacacugguggcagagagcagaggggugcuuggugccuauuuuucugaacaauggcuaaggguggggcuggagggagcaguagugacuuugacagaaugcuacuagcagucucaagaacaauggggacagaccaggugcuugggggugggggugggggugggagagccauggugcuggucugguucuaagagagguggggcagggcggggagugcugugcgugugagagccggggcacugcugcauugugugcacagagcacaaggcccugcagcggacagcuaggugcuguuagggucauggcugcagagaucuuucauauggagccaggacuucagggcggcgagagcugagcucuacauuuucaaccuaacaagugacccacacaguagagcucugucucaugagaaagguugggguuccaucucuagggucccagaaaacuaaaguccaagcuagcauaugugucguccaucugucaguccaaguccacaguggaacaggugaugugcaagucucaguaguucuucugaccuggugacagugaugcgguccccuugaggcacucuaugcuacugaacgacagccuugggaaaagagcuguggccagcaguucccacagggccggacugugcggccacggcaucuccugcuccuugcuacccuguuuuguuaaaaaauaaucaucucgcuaguguaaacuugacccaaaugcacgcuacaaaaaccaaaacaaaacaaaaaucacaggggagaaagccuggauguggcaguccccagaaagucagaaaguccaggccucaggucccagcacgccucauacugggugcugugucugcauggaccauggacggucaccuucugggaccaaaucguaccaguuuucuuucacagccacuguggacaccugacguuugagggacaguggauuguguuaggcggcugguggugcucacuggagcuguggggcugacaggccuggccgcugaucuuccaaaggagaguugucuggagcaggcacagcgcggcagcacccaggacacgugacuaagucuccugagguaccaccugcaucaacuucuggcagagcaccgucacagagacugcggggagagggaggacaggagugaacucaggguggaggaucgggcgugagcucugcccgccuacucucaccaguccguuuacccuuuugaaaucucaggugaugaggcuggacauggugaacacacguccuacgccaacuggaaucagccagagcugggcgccucagauacaacuuuuucaggcucuauguugucaggcuaccgugucugagcuaguugccaguggugggguuuuugccaguucgcagggcagcuggccacagaaugccugcuaagaccagcgagggugggaccccaagucuacucccuguacccccaugacucucaauguuggcccacacacuagugugcaaacccuuggcuugcaccacgaagccugaggcccagcaugaaugauucucuugguuuguagggugcacauggcaggaccuacgaucccucaucccuguuguucccgcccugacugguaugggcaguggugugcacacuuacagauagccugcagaauccacuugggcuuguucuuccaccagacaccaaagaaguagacaggcagcccgcugaggaugauggcgaagccaaugccacacuccaugggugucuuccagaaugacacggcaaugaggaagaggcaggccaggauaaagaacaccgggagggccagauucaccugggacacaauggcgacauguaggccaccaggaucuccugguggagagucuccuccacacacccauggcccguggacacaguggaaggcucccaccucuugcccuguggcuggcgugugcccucgagccaucaucuucuuucgggucugccuaccuacaccucccuagaccuugggccuuugccuucaagugguuuaacugccuccagccgcccgccuugccugucuugaacggucaugggccuguggagggcagaagccuuguccuguucaaccccacucugaccgcaguacacagugcugagcaucuaagaacuggaaacucaccugguauagguaggaaugaacacagcuagccugcuuucucuugaggcuuccacagggcagcagagguaggcucugcaguccucacaccaggcauggaaacccuggcuggaauacccaccuauggccgccuagagagcgaguggcagguuggcccuucugggaagaaccuggcuacccaccaacaagcaaggagcccugccuucucagagggcccuuuguggagauaaaggcucaucccaaagccacagcuuguaacuagcccaagcagacaggcuucuggcagagcagccugaacacugaauaacccaacagacagagcugggcuuaggccagacugcuguccagaaucccacagucuuaaaaauggacucccacugugggaaagagccucagcagaauagacuccaaccaugugccuggggaugaagcccacggguaucugugagcuuucuauggaccagcugugggcagucugacuguccccauagccuggaggacugaguggcacaagccagcaugguuggggucuuccacuaacuggcuaccagguuccuuguguuauugguggagaccaccaaguacaggcaggaagacaguguggcugugucagccuugugcccaaggagaacacgcuggcuaacagaagcugcugcccaacagcucucuugggacaagucugacacuuguucugaccccagcagauugccuccaauguacccuucauacaguacucaagcagaagaggacagguucucuuguuugccaaggagacccggaggaaggccaggcugggaucagacaccguguugguccagggcuccuuggaugcagcccugccucuaagaaugacaccuagggacugaauaggaacaccacccaacacuuaccuugaugggacgcuccagcucaggcuucuugaaucggagccacaucauaccgaugauggccagggccacacacagccaguugaagaagcugaagaaguugaugauggagaagauaucucuggagaaggcguacaucagcgucaugauacacugaaaccaaagacggagccaggugaggcgggcagggccaugcugaugcgggagggugccagaggccucuggacagcagacugccagcucugccagugucuggcugagcacauuagcuggcuccugcuuuaaggagugacugcuguggcugugugugaggucuugggaugcagugggaccugagaggcacaugaaacuuagcaccgccuguggccucccaugccagaagugaccaaaauauccaccaggggacccuuccgacaaagcacagcauacacuacaccucacaccacuaucaaaagcaaacucaaagugaugcugacuguguuuccugaggaaccccgaauuccugacucagcaagugggaggcagcaaaauguguuuaggcuuucuggggucauggugacuauuuuguuacacagcaggggagaacacaacagaagggcacggagaacagugugguccaacugugugcugaggccguuaacacagcacaggcguggcagagcaaacuggcauagcuggcgcagacaugcuaucugagcagauguuccugcugggaagggauuucauuucaucacuugaugacugacugagcuaucucuuuagaaccacaaugggguucugaacuuaaaaaucugcucguguauugcaaucuggagcauccugacagccaugugcaugauacacaguucccaacuacauauugugcugggcacagacucagggcccugaguggugaggacagaccaggcaggaccacgugguacacucaccgugaacaccagugauggcacaggugucagcagcuguggguggaucauggagaggacagaaggcagguggcccucccuggaucccacgaagaacagucuguggauggagcagugggcaaucagcccuggccccaccacccagacauagaugagagauaccuggagcuagggaggguugucagcuauacugggaggggccuggccuuugccccaacacaggaccuucaauguccuugaccuauuguccuaacaaggacagaaaccuggggcuguaccuuacuucuagcccaucgaagcauucuaucacaaauaaacagacagcuuucaaagccugugaacagaagaauuccgaggcgcugucaagcacucaccuugaggacgugaacagagacccauugacagagccgaagcaagacaagcccacaaagacaggaaugauccaggacaugacacccaagugguaguucccgaaguccuggauagacauaacacaggaugagcacucaacuacaguggcgcacaggcaggcccucaaaucuggcccuggagcagcuuaguccaugacucagcccuuaaccccaggcuucuacaguaugcggccaucuugcaguuagugucugcacuaagagggaacacacagcgucucacagcgggccauccccgagucuuguuguagggcacacauaaggugcacuguccccuuacugacagcugcuucccgucuuccaagagacuggugugacagggauuuauaaaccgugaacuuagaggcaacacuuaaauacacaagagcagaagcaccaucaccgccuuuccccugugggccccuuuaguggacaccaaucaugaccaccagauucccagguauggugagccuugggcacaggucucggggacgggccaaucucagguuucugggcugaggagaagcugaugggcagagccuuaccacagccacagcuucagaugucagcaucugguugguagagaggguagugaaauaggccagguucgucagcacauagaccagugugacaaugggcaaggagaugaugauggccaggggcagguuccugaaaggauaggcagagacacgucagugugaccaggauguagagccggaccccaggagaggagccagaucccugcccuucacagguggcuccacaucugggccucacuuuuugggcaaacaauggagacgcacauggccugacaagcccacuggacuugggcaggagugcauggcugaagcacggcucacaccaccaccccucaaauccugagcaucuucuugguggcucugaaggcugaagagagccaagacugcccaaugugaucacccacgguccuaccugugaggugcauacccuagacaaguccccuccagcugguauccagggccgagagccacagcugccccucucuggccuagaaccaacccuaucccuacaacauccuuacugcaggccccugacacagccuuccacagaaauaggcagggcucaucaacaggcucugacaguguguaguuucucugucaccuuaagacagaaaugaaauaugucacugccauuucuguacauaccuguagggguugaucaucuccuccgugacaaaauucagauaguuccuagaaaccagacaauaguaugucauuauacuguacacacagucauuggggaggggggaggggggaaacagugcaaccagaacccugggcugcucugggugggugugguguuugaaugagaucaacccccuuaggcucacagauuugcauacucagcuggugggaaggauugggagguguggcuuuguuggauuggguguggcuuuugugccucuagggugggcuuugaagucucugcugccugcuuacagucaggaugugaagcccucagcaauggcuucagcaccacuaaagcugccacacuccaggcugugacaacacucccaauggaaagcuuucuuuccuaagaguugccuuggucguggugucucucuacagcagcagcagcacacugauugugacaaaggggucaggaaaauccucccagggacccuacuggugacagcagcuaggcaguggccacccuuggaaccagcuccucacucuaucugaggggagcauacaggccaucccauuaaaccacucuuguggcuucaucccaagucucucucuauacagcuguccuaaaagcagaggccagguuggacacccuguggagaacugcagacaggacccagaucucccugccugucucauaaaggucgugcagcaauucaagauguucuuggguucaguccugcccacuugaaucaccccuguauggucagagcacugagauucugagcacaucagaggaccauguguucccaggccaaggggcucagauguuccagaaccuaccauccuccguaggcgaagaggccgcuguacaaagccaacacaauguuccccacguccagauuggugccuucaaaggacaacuucugcugcagguuggacgcaucaccugcaaugcauuaaagagaacaaaacugguuagaggacuuggacagaggucacacuacaaguucuggaguguuucugaagcaaaauacuguaccaaacagaagcucaggaugcaggcauuuaccgcagcagacugacuguacccgacuggccaucugaccugaccaccuaccuccuacacucccuggccacuuaagaggauuauggccuuccuagaaacccacgagaucucugcagacugaggacaggcccuggcugggaggacccggcucuagagccucuucugacacagagcaggauguucauauguggccugcagguggucccauuagcuuucagcuacacagagauuggcuugacaccuuggcccuugcuaugaagcucaggaggcccugggacagggcugcuaggaaugaagugagaagaauucagaucagaccugugucaucccaagugugugagcaaauguacccaagaaugaagacagggugaacugacaagagccaggacacugggagacacccugcuuggagcagaggccacuucacacacccccugcuugcacucagaugaccacacagcccagguuccagguaguguucuuucugaguaauuucuagaccaguggcuacuggaguagagucuuggggugcucuuuggguugcuaggaugaccuuccugaggcuuaguuaccuuuaucuaugggauggcucauuucauuaagcuuguaaaagucugcuacuuaaagaugccagacuggaaaccagauaucuggguaccagcaagguggguggcuaauucuccacagacccaggucaccuacguguggggcuuuuaauugguaggucuugugacucugggccccugagaacagcuacagcauugacacaguucacaugacuuaagaccaugaggccaacaggaguaaggugccuugaaauuggaggugcagugugaccgaaccccagaggugaacuguuuccaguuguggcuauggaagcagcacagggucugccaggucugccugacucauacuccugggucaaagucaacaaagaacccugugccccaugccagggucugacucagaaggaagccuggaccagcaguuucacagcauucugcauguaugcaaugucccaugaucauguuccaaagccugagcuacagauguccuggguuccccacccaccucaguuaggccuggucuucuaagaaggguaucacccacaugcaugcccaucugucuagguccuggucacaaggguagucagacaccaggcuuguggugugcacugcagggcagcucaggacagggcaccuucagaagugcuuugguggaggcccccacaacgcagggcgugccccucauucucugcaaugggaugcuuuggaacaaggagagccuugaugugcacggggccuaacccacacaucucugcucuggguagcacuucucucauaaguugggaaaccaaggcacagaccacaccaaggcaguauaugccaggcuacggaagacucaaagcugacucuccaccaugcugugacccucuaagggauggggaugacuaaugaauaccagagaccugggguggugaccagaacccacccugagucaacagagacagccuggaguccacagggcucuguaacacgaccucaguguagccgagaacagaacacaagcuuggggcagcgugagcuuuuccaaguuaggaggagauacacucgguccugaggcucacguaacacuucaguguuugcccuguggacaacaccaggcuuggaucaugacgugagugcagccaucacccaagaugaugguguggagccaaguaccuggcagaguagcacguccuggcucugccucauauccuggaacaccccuccaagaauggcagcugcugugacaagacaccagcuugagaaucucaguggcucuauucccagagcacacgaggcuggggcgauccuuuggggaccuuaguaauguagaauaccucuggagagugauaucagggugcacagagaaaugauacccagacugugaagucuaguacagugggcaggaugccugcuuucuauccagccugggguguuggcgggggcaggagggcugguucaauccccuuagcaggugguucucugccagggacucagcuuuggaccaguacacccaucucaaauccccacuauccuguucccacugcggauggaggugaggacucaaguccagaugugugucagggcuuguggcauucagccugggccacagcagagccgggcacacagugacuguggucugugcuggacacuggcccaggacucguucccuggaucucugacuaaauaacuuugucuccauaggcgccauggaacggacagcagacuccccugagcuguucccaggcuggacugacacacaggugaccccauagugccgucaccuuuugacagcagcuccaccuugguggcuuaaggguuugaggguguggccauacccaccagucugaucuauacaaggcagcucccuugggccuuacaguguuaauggcacagguuguugggaccagacaaucccagcaugcuauggccuuuggagcacugcugcccuuccucugggcuuguauacugucucagagccccuucucccacucuggccaugucagguggggccuggucagcaggccucccauuucucagccauaaaacacuucucuccauagggcugacaggacugcugugagaagcuauguaaaagcagagaccccagcagggugcagcccuaaaaccauacaucagaguucuagggagagcugggguaacuggggugggaaugcucacaggacuuuagugaacagcaucccaaagacaccugucaugaaaugggaaccugccccaggagaggagaggaggccgcuaaagccgaagugcccggcuugccuuccugcccuucccuggcaggugccuagugaggcacacacaaaugcugaagagcaggcgugcugggaacaaacacagauuugaacuccuuccuaccuaugacggauaaggccagucuugcagcccgacucagagaacagagguucuucaagguugguguauccuggaaaaggccagggccccaggcgagcugguaagcagaaggaacuucaggcauuuugguccuguggggcugacuguauuucaccaacccacacuacccuacagccaaccucaacccaggggcagcgcugugcugagccuacuuucugucuucuuauggguucuggggcuacaugcugcucaguuagcugugggccugccaguuuucuucagacaauuuaucuguaaagguagcuucagcaggugaaacacugccagguggcacaaucgugaauuaugggcuccggacccaacaaggauucuacucagacacaggaaacagauaaaguggccacaagaagauggaggccauguggucugcugcucuggggguuccaggaggggcauuccuguaacuggggcauagggcacugguguggaggacugagcaaaccuggcauacaucuugaggaacuguguggaccccuuaggcaugauguacaagccaguccuaguaugucugaaacuugagauguuacuccacaauaauccauacccuaagucccccaacugaauugaggcuagccugggguaccucuccaaagacagcucuagagguagaugaagaguugacacucuccuccccuaacuuguccccaggcuucccugggauggcagagcaguuaagugcuauagcccugacuccaguaugucugcauguggacaccgaaccccuaaggguucugauagggacuucagaugaggcucucucugauuuaguguuguguaaggaaacccccggggaugacuccaugcccaaggagaacacagaaggaaggcugacagaagcucucagucagccaguccugcaccucaacucaaagagcgagcgcugaugauccaggccaccuugcccaccguuccagaucuucucuaccagcauuucccauaaggcaacgcagcaagcagccagaccucagcacuccagcucagcacugcaacccuacauuguguaaugguuacaaugcgacccagcccccaccccgugagcuacaggauccaggacacuacaucucaucucucugauccuagggcaccucacuaacugauaaaacacgggacaggccgagucucuugagccaagugugggucauugucaccuacugacaaaggacauagcuaacauacaaucgaggaguccacuuguagcuauugacccaugaagcauccacgggggcauauccuccuuccacaaucccuggcaaagcaggugaccacuucuucaagcucaggcaaaugaagccugcuuuguaugguacagauggugucagccguuaaggcccucucuugggcacugugggauaccaucaucuccaauccuuaccaccugugacggccucaggaugucaguguauccuguugcugugagucgcaucccaaacagaaccacaacaaagcuaguuuguguucuccaaugacccaggacaauuaacagucacaggaaagaaccuuccagaauccacuccuacgccuggccuugagaaaaaggccuggcacccacuccuguuuuggaacagucugaccucgagccacagccgcuucaggguacuauuggcaaggggccaauugacuagaaagggacacagcaggucaggggcaguggagucccugcccaacaugucugucacuugucuuucuuacuucaggucuucuaggcucacaguggccaacucacccauucccacucaaguccagucccagcucgucagaucuaaugccagucugggcacugucuguacuucugaaaauacuggacuaaauguggacaccucaugaggucaggcugaguucucugcagccaucuagguaccaggggcagccaaagcaucuccucaccgggggagauggaugcuuacaagugcuuucagggccugggucagagccuaaucuagcugucugcaagucccucguuuauagaucuguggcuagcuggcauaugagcucuggacuccagggccugucuucucucagcccacgcggaggggacuaggggcugcagagauucugugggaggauggcagggcagacugagugauacucagacuucagcacucucccugagaggaaguaaccuggguggggcuggagagguggcucagcgguucagagcaccgauuccuuuuccagggguccugaguucgaucuucagcaacuacaagguggcucacaaccaucuacaugggauccaauaagaaaaagaaaauagccugagggcugggguggccaaugagaaagcugcucagagucacauaggaauggccaccguguucccagacccacagagguuucguuaaagcaagcucacgcacaugaccagagccagggccucugccuucaaggaccuggugaucaccacaguccucuaaggacucugcgcccaaugggaaaugagggugggcaagcgggaguggccagcauucccacccuguguccuucacaaaaaagagagggcacccaucuaggcacagacaccacaccuccacucccaccccuaccccccccccccacacacacacaggaauuuugcugccacugcauagaguccuggagcucagaaaggaacugcuggggguguggggcgugcuugugcauucaggcccgacaaaagcucugcuguccccacucugcuuguuuucacuaacagcaaguucuggggcuugauccucaccacaucucagagcggcagccaaauacgguccuuguccgcacuccuaccuccagcucuccaugugccuggcagugugagagcugugagcauagcauaugaccccuucugcccagaagacaggucuggaccacucccugcagcauccaggugaugcucugcuccacagcuggccagcaccucugugugugaggccuggccucccagagcaucuggaaaggcgcuggauggagcccucuaaaacucuaggaggugagcagcaaaggccuugcccacucugcugcuggacuccaugugggcaguucacaagcccguggauauuccugacagacauucuuuucuuuuuuuguuguuuuuguuuguuuguuuguuuguuuguuuugagacaggguucucuguguaucccuggcuugccuggaacucacucuguagaccaggcuggucucaaaaagauccaccugccucugcuuccuccucugcugggauuaaaggugugcgccaccacugcccagcuccugcuagauauucuugaaggcccaggcccagcuguggaagugccacccaggccauguuccaggauuuccauuaccucaagcacaguggcaaaugacuccagucacacagaaacacuguacaggcggauaaggccacagggaggaugcagagcuuuuugcagacagugccaccccugcaggagggcaggucccacaccucaggcuuccucaagcacuguucauccuuguucccaggcugccucaagucuguggagugaggcuccacacaggagggaaggcagagggacaacuagacuguaucauagauagacugugaacaaccaccccauucacauccacucaguccagucaggaggccuuagcaugguggaaagaguggcaugcaaggaagacagcagcugcugccccgugggagguaaggucacaguccccuguaccuaggcauuuggaacuuaucauacacacagaaaggucagaaaggaggcaggccucagccaaacccaacucuaugcugggacugcucucauccaugaaccagagaauaaggucccugcugucucugcccagagcaacacuaggaccacgggcuuccucugcagcuccugguaacugaugcugggcacuggcugcugcugucuucugccuuagccuaaguaguacccuaagcucucugcgggggcagcggcacuacacacaacucucagccugcuccuauccauucuucauuuaggccauuacagggacugagauaaaugcaaaggaggaauagcaaacagggggccugggcuucaaugcagccuguaaaggguggacaagagccaugacugugcuuguguguauuaggauugcaggcugcugucagagcaucacccagggccuggggauuauacagacauacacuuuguaugugcauggcucacuuucccuuuuccugaucccgcagccucacagacagccagagagagagacucagagguccagaugaccuccccaaaugcauauaauguguggucaaaguccaggcaguuugaaccagcugcuccucaugccgggaagggcccgagugucagggugacaagagaccuccuugcuuuucuaccucugggcaucaugcuuaaauuaaaacagggcucccgacucccaggccuggucccuguguuguacugaacagauagccacggacccucaucuagagacagauacucugaggguucguuacuauccuccugaagugaccccacuccugaaagcauucacuugucguugaagccacauugaagccaaauucccacugucugccaaccccuggacacacacacaggcaugagaaucacgacuagccaagaaacuucuggacaagagccagaggccuaagaacgucauacuuaccucagaauggucaguccugggagagcaccucacacaagggaaaugcuguccacaaagcagagagagggguacuguggugggugaggcccugucagacccccaacuuccugcacagauggacagacacuugggacuccccagagaccugcgcacuagcucgggacaaggcuuuuuguauaggcgcucucucuggcauucagcuuucucuggagccaacucaaugucugaggcgagggcgcaggcagucuucccuacagcagaagguaccacacccaacgggcucaccuugucccauguccuuccccaucuggaugaagccgagcaaaaugaugagggccagggccagcagcuuggcagccgcaaaggcguccugcacacgggucgcagccuuuacgcuguagcaguucacagcugugaggagcacuguggggaaggacagagagagcacagcaugaguccccgcagggcaggcgauccagucccgguccgggucggagcacagagaaggucaggugcuggcugggaucccacagagguaaagcccugccugccuccccgugggcucugacuuucugagacuuguuuugauaaagcuagcugguucucuggggccagggucaaagguuagaaacaucaauucuucaaagagccugauccuggcagcccuggguagccugcagcaaccuuuuuuuuuuuuuuuaaauagauaggguuuuacuauguagaccaggcugggcucagacucaagcuccuccuccugucaaagccuucugagugccaggaggacaagccugugucaccaggcccaguuccuuuuaccuggccuugugagacaggguuccacucuguagccccauuggcacugaacucagcuuccugagugcugggauuagacaugugccaccaugcauggcuaaggcuucaugucucagcagucucugccuccguagagacuccccccaucagaaccccuucaucugcaguugccuguguguauccacucuguggaagugcagacucaagugaaauucaagcagccugggggauggccccuaauccugggacagcaagcgcuagggucaagcacagcacugugaacaguaaggugaccucuccucaaagacaaccuuucccaggcuuggugaaagcagggaggcaccuugucugugugaaucugauaagccgagaggggaacaauggggcaaggugggcaccagcugcagguggaaaccgaggggaacaggugcucucaugugcggcugcagguggaaaccgaggggaacaggugcucucacgugcggcugcaggugggaaccgaggggaacaggugcucucacaagcgguugcaggugggcucagggcaugacaaaacagcaacaugucccacugcacugccauuugaucagcauauauuaaacaugaaccacagguaauauuuuguagacaacugagcaacugaaccacacagugugaaggcagggccucagggacccaggguaccaggggggcugcaggaagcaauuaccagugcugccugguccccuaaaggaacccugagaccuugacaaguguaugcaguugucuguggagugaggaacuggguuuuaacacuguacucuguguaaacauaaaugaaaacacuguaaaaccagugagcacaccuaccucgccaccuugguagcagcuggguccccauacuagagcccccagcuuccucagcucuagccccaagagagcuagagagccuccacuaugggggaggggaguuccuggcuugccuuggucaaacauuaaccaguacagccugaguggccccaguuuaccagaaucccgacuucuccaggauguagagggagcagcucccacaaaggcugugccgacucaggccucgcagaugccaggcagccagacuaauuauaugucaugaugcaguuuggugaacagaccacaaagacaggaaucugcauuaauuaucuggccauggcaaacuucagguggaagggaagcaggaagacucccuggugcuggugauggaggcuacagcaguugcuuuaccuccaggaagccagaacacucauuugcacugagucaccucccucuuuauagcuccggcugauguaacaccggcugugacuagacuagagaaagcucccuugccuguguagcugcuacugcaguugcugccgcuguaccgcagugacuugcuugaaaacucccaugucucccagaguaaaggaguaagaggagacugugggaugaacacaggcccccacccccugagaggcuucccccaucgcccuugucccuucccccacaggucaccaaucugacagcuuuccuuagacagucccacauuuccuuauagguacugacaaagaaacuugcagagcagccgagccucccuugaucccgccuccccacacacccuucuggugugcaagaggcuggcagauugcaucacuagccagaucccauuuggcuggggugagccagcaggagggguguggcuaagcccaaagccuacagccucagccuugacagcuguggucucuaagggaaaguaugacacugcucugggcuccaggaacugugccucugcugagucgcccuguaggaggugccccucuaaaccucucagaagggagcaguguauugaaccacuauccucacugucccagugggccccucugcuacucuaauacccugcccugucugggccaagccagcuucucuccugccaaaaccaggucugaucccagacugcaggccaaguggacagagaagggccagcacgggccucggcaacugggguugaacuucuuccuagcugacgacuucuccucugacaucagaagaagacagaacaaaagagacucuauacuuucaagucucuuauaaaagccagagcaggugguaaaccgguaaugcgcacugacucgggaacaagcggacaagggauuauuaugccccgcagccccgcuuucaaaaccaaacaaucugaaauaaaugaaugaauucaucuggguccaggggcuucuggccuucucgagacacugucaugagaggcggucagaagaccgaccggaaggaaccucaguucccuacccagacaauccaccaccucgucacugucuccccaccaaagacaaagccagcaggacugugccgugacaaggggauagccuggccuuagcguaggaggcgaaaggcugguccuuuuggggguuccccacgugacaccaauagauaaauguggcugugcuggcuaacagcuggaccugugagauaaaaagcccagagccucauccugggugcagauagcuaugcaggucaggcccuuggcccacgggccuaauagugauguucuucacaagguuaguucucaucccuagccaccugcauggggacacucaggcuccacggcucacacuucagagugcuggagagacccuuuacugucuggcugggucagcaaaacagugcucgggccaugggagaaguccuaggcucacccugauaccaccugacccauggcugagcaggcaccagaaucucuucccuaaagggccaaaugugacggccggagcugcugccucaguacaaugggcaggagguagaaacucauggggcuggugcugcccacacucucccaccaagucucccaggccuccuggggcaggguagagcaaguggcugguggcuucacugguuccaggaagcaugacuggucccccagggugcaucuauccuuggcccacugauuggacgaaggccugagccugggugggcuuagaugaccugucuggaggugauccuagcuccaucugaaucgagucagucagcacacgcagggauucccugauggacccaggacucccgacaucaguaguacuuccuuacuccuuaaagucuggguguuucagguuccccacucaagucucucagguagagcccaaaagagccccagugagccucugugcagguucaagaucugucuggcaauaaccagguggccaguuaccccaguacucauccuagccagacagacuccuagacuccucaggugcugguaaaaacagcccccccccccaaucacuggcgaucccacccagacaaguccaagacagccgagccucuaaggucagcaagcucccacaugcuagggccauuagcccagguugcccacuuagauacaaugggugacuucucuagaaucccuuuccugggcucccaaguaugcauguagccacacaggucaggaaaccugcagggugugauccaacuccagcauaggaugucacucugaugggccgagaauccuggcacauccgaggaacguagcugcuguggagucuucaauguuuuguuucuuaaauuugagacaggguuucucuguguagcccuagcugucccagagcucgcucuauagaugcuguccuugaacucaggcacauaccaccacaccugugccccauccucaggucuauguggauucuccaguaucuuccucucggugugggaugggacucaggccucauauacacugagcacuagucaaccacagacaguuccaggggugcaggugucccugacuauucaaacaagccuggcauauccuuucaacaggccagaaaacaucagcuuaguaagaugaaacauaggcaggagagauggcucagcgguuaaaagcaaugagugcucuuccagagguccugaguuuaaaucccagcaaccacacagugacucacaaccccuucuucuggugugucugaagacauuuacaguguacucauauacaugaaauaaauaaauuuuaaaacaaaacaaaacacccauucaccccuagugacuccccaagacuucugaagcagguuuccugaagacagaguugcaaguguuccugguaccuccagaagcugccuugccccccagcccccaggaugucugacaccucugccucugcuccuacucugcagagccacugccaccacuggcuuaaaccccaggccaggggcuucguggucccccacugaucugauuacugcuguguuggauauccacaggagcgacucuccgugagaauguaugggauucucaucaccagcuaaguguagacucucacaucuacacauggcaccacaauuccaucaucagugaagcuaucaagaaagagcaggugagacuugcuccaccauacagcaguuccuggggaaggagggggcacccggaucucuaaccuugaugucccuaaagcggcauuagaguagucuagccauaggugugggauggguguauacuuuccagaguauuugccguauggacagcagaucauagcaaacacugcauacaauaaacuugcugaauaggggugcauucaggcucaccagggcacaaccugggggagggagggagugcggguuuaguggugcuggcauagcuguuaggaacagacuccaagaccucuccaucucaaucauguccagcaggugcagugagaaaagccaggaaucccugggcuuaggggaguugccagcagaguaggccuaacaacccagaacaccacucuauagcacucugggcucagcaggugugcacccagcaccccacccugcccugggggggcuuacagcucaagagacacagucaagagcugucucagccaccacuguggcccugaauccucccacacaacccaggcuaaugagguccaagggaacccaguaaagacuccugcagcccgagcugguggcaugaucaggaauguaagccgaaggcaggccccuuauugacuacaggcagcugcugcaccaugaggucucagcaaugacaugugcuggccagccccaaggucagggugacucaguguggaucggguugcacacaccaggcuccagagaauggggugggaaauccugcuaauucuuuacauagcagcucauccuggcaaagggaaagugugggcacggcacagaaauguccagccaagggcugcucugacggcuggugcucagggaugagacaucucaggcuuccagccucccuacgguacacagaugugauguggcuggccacuggggaaagcaacggcucauaacaccgcuaaaugacgggcugcagggugugaguccuccagcugggugagggcaguggaaggaacaaaugucuaggggguguaccagaggcuggcaugggagacuguaggggguguaccagaggcuggcaugggagacuguaggggguguaccagaggcuggcaugagagacugguugcaggcagaauggaaaaggccuuggacagggggcacuguucuugaggcagcuucucacagcagcaauccacaaggcucugggacuagucaugcuggcuggggguccugagucuguuguuccccgagccucgcagcacccuuguaacaucccagagguggacagauggggcugcccguccaaagcucaccccaguggagauuguggcaggaagacaaaagggugacugggcagcucccacaaacuccauccggggaggagcccuuccucaggaaucuaaaugcugaugacccccucugagcagcuggagucccuacccuagcggaccagauucuuggaaguagugaccaagguagcacauacccuauagcacuugcuacccagcucacuccugccucaguuucccuugcuaggaaagaugggaaugauuacguugacuuuaagggcuaaaucagaggaaauaugcagaagccaugcauaugugccaugcaaauaaacaaugcucucaaggcucucgccccaccugugucucagggccuggggaccguggggcugugcagggucacuauggucaccaaccacauuucuggacaaagaucaugggcaugcuauggguuacccagccguccauaaucccuacccaacgcccacccccugccaaaaaauauuugaaauauuuaaaaauauaggaauauuuaaaaugccugcagcauuucccagccgccuuggucaacgguuuugugaacuauucaugucuggggccccagguccugugacugggugucaucugcucuguguguaugugcuuucaugucuggcuggaaaagccgauuucagugcugauuacaaagcuguacugagcucaugguuccagacacggggccacagcaacaccaaagaguuuguuucagcucagccacaguagcaacggugcccaaaaacuccagcuacuccuguggcggccuggggucucuagcagaggcaguacaggguagaaaccaggggguggcuugaagagaagggacaaaaaagccacauacauacccguucccaccccccaucuucucuagcagcuacucgggucggcagagcuuggccaggcgauggccaucagaaacccaggcagggccaagcaugagucuacaugucuucauccagaccagguccacagcuuaugccccacaccuauacuucagaggaggggagacagugagcacccuuccacuuccuucucccuccauccagccuguucuccaugcagaagcgggcuguggggcugcucccugguaagagggaagagguccaccaggcagaguacagacccaucucuacgugaucagcucugugcugucugcuaaacacagcucuccccaacacccaggcaggacggauccccacucuacaguuauagguaggguucgaggguccuuccucaaaucagaaauacaauguuccugaucuggcacuagaagggaauuaucucaggccacaggucuccaggcacaugcuagcuaagaaugucuaagacccugccagacucauuccauggagagaguagugaguuccgcagcacugaggagcccaugccaggcagccccuacgucuccugagcaguccaggggaguccucagccaccugagaucaaacgugagcagguaggggucccauucuccacccaggauagggugcacaccuucaguguuuuaggcuggucaucaggccucauccuucauacucacaaggcuggagaugggacacagguggcgcuagucaccacccagggccugccugggcuuuguucccgagucuaggcugcuccauuccugcacaccucagcacagacagccacggcccugugagauuagauaaaucucagcccagacggaaucucagcucuagucugaaagauucuguaacaagacaagcccaggcacugaguguccuggguaguucuuaugucaacuugacacaagcuagacucauuuggguagagggacacuuaagcugccugggggugagucuacaacacauuuucuaggugaacgacucauguggagagccuaccucacugugggcaaugccaacaugggugggcaggugauccuggaugccacacacacacaaaaacaaaaacaaagaaugcugagcgagccacgaggagcaaacuggugagcagcaacccucacggcuucugcgucagcucccgccuugacugcucugaugauggacuacaagcugagaggaaaguaaaacccuuccccagguuugcuucuggccaugguguuuaucacagcaguagaaaugcaccuaaaccacugggcuccaggucaagucgacagcacccaagcuucacuuaggcaaaaaugaacaugcgccuuuaaugcuagcacucuggaggcagaggcaaacaguucugugaguucaauaccagccugcucuacaaagugaguucuaggaccaccaggacuacacagagaagucuugucucaaaagcagaacaaaaccaaacagcaagccacgagauggucccuaggccucacucacacgggcucucggccacccagaacaauguggaaaacaagucuuccaaucaucaucaaagacuccgcuccaggcugcccgcaucaggccugagguugcaggagggagccagacuuguugagagggagauggccugcaccuuuaccaccaguggguucauucgggauggaggccaagucauuucccaauccagucuuaacuaggugaaggaaacuuguggagagacaaacacagaggacuccagaagacucaaccacguaaaccagaccucugcccuaaaaccugacucucagugcuuccucggggucuuuccuaaggcauggaagccagggaacacuauguuccccagaagugcccucgagaaagaacagggcacucacuccaugaacacugaaacucuccucagagugcaauccuccgggagccggcgcccaggccuucagagaccuggaagagcaccuggacucuugguauagcauuggaaauguaaaugagcuaaauaccuaauaaaaaauggaaaaaaagaaaaaaaagaaaacaaauuuuaaaagaaaggacauuugccagcccucagugcucacagccuccugugggcaagcauugcuucccauaugucacuagcaccugcaguuuccagaacuaucuugacaagagugugggcucuuuaaagacagccaugccagccuggcaugaugguacacacacuuacugccugcacuugggagacagagaacugcagaccagccagggcugcauagcaugagccugucucaaaaccaagcaagcaagcaagcaagcaagcaagcaaacaacaaaccuuaaagguacccacgacauuccuuaucccuaaagagauuaccauccauaaggagaacuggacaauuaaaauugaguaugcagugucccguuugaggccaggcucucccuggacugcccagugcuuuugaagaccaacucuagcuaugacgguuuacacaugaaccaagcacacagaagaccuuacuggucaucauccaacuggcacuacagagcagaguggguggucucagaauugaagggcacacccggcugggucugauaacaggagacagucucagggccaaagccaaaacaggcacuggcaucgagcaguggccccagugcuaacagcagccccggacuuccauggcucacaaccaagucuagcccaccuccccaucacccucucugugugcacuaucaacacagcucucaaaacaaacagauacaucggucuuagcugccugaacucaucuguaauuuugaaaguagcaugauuuauuuccagguugcucuccaccaccaaaucauguggcauuugcuucaaacgaucauuuucccccaguccugaaaaaucacacaacuguuuuugaaagcagaaaucaauccgucuugaccuaugcgucccauaaaggcuacacucaacagcuguuaccuggcacaucuugggaccccucaagcccacccacacagacugucgucugucugcagccgaguuucuuuuaguccuuuacugacaggcaggcuuuacacgauuccgcuacucaucuuaaacgagcaagcagccaucacuaccacacacaaauuuauuacuacuguuuucuuaugagucagccaguucacugauuccugauaggccgguuuuaagaacauaagugauuuuuuuuuuuaaacugcaauuucccucuuagcaaccagucagcaacugaagcugaaacaggaaacuggcauaucugccacuccacguggugcuuugcugaaggcagggaguguauugcucucacccgggacagaguagaucucucguacuuagaauucaggucgggaagcgggaugccugccgcggggucagagccgcgacccacugaggucucgcgagggcugucccgaaagcauagacacuaugaauggauuaaagaaacgcacguggguucuggggccugugacuuuagccuggaacugccgagaugguucagggauggacagauggagggauacugggauggguguugccgagcuguaaacgcaggaaccuuggcucgcgcccacccggccccgccccagcccggccccaccccagcccggaccccuacuuacgcacgcagaggcaggccacgagcuuggcagcuuccucgggcaccggacaaguggggaagaccggcuugagcaaguagguggcgaagaccagcgccacgauguacugcgaggagggccgaaugaugagcagcucgauccagagcuugaggaaggcgggcaacgagccguagaccuccagcauguaggcguagucgccgccugacuuggagaugguggugcccagcuccgcguagcagagugcgcccacgauggagaagacgccgcacacagcccacaccacgagcgacaguccgggcgaccccgcuuccuugagcacgccggugggcgucacgaagaugccagagccgaugauggugcccacgaugauggccacaccguugagcagcgugauauugcgcugcagggucacgccuucgcccucgggguccgcgccguccccgcgccgcgccuccaacaucuucucccgcgccugccgcuccuccuccgccgccgccgccgccggggucgcaaccgcgcgccucuuggcgcccgcgaccgccaugcucucggcguucccggcucggccuggauacccggcgugcgcgcggccgagccgcucuccgcguacugagaagugcgucugcguccgccccgcccgcgcggccuuuuaucucuaccguuacccgcccuccaggcuccgcccaucgccgcugcuguugguucagcucgcaaaggcccccgcccccucagcccgcgcgaccccgccuccuucgcgggcccccgcccccaagucuguuagagcacguggagcguuaagauccugaaacugaggacuacugauguguuuaacgcggcgugacuacugauggguuuaucgcggcguguuucacaagauccgaauguuguacgcggguggagagucgacucacaccuccucacaaguccugugcaggaugucagggccgauugguaagggcgugcuucuucucccgccccaggcggcgcagaggacuugucaagggagaaagcaccggaagggggguggcucaguguauagucccaacaccugcccggaauccuggcccugccucgcggguguuuaucuccgcuuccuccagugugcauauccugugcgucugggagaugaaggauaaauaucuuaucuaggauaaguggggguggguuguggggugaggcaccccuauaguccaacuugguccagaggaaacgagucugagggcgaaaugauccgucagcucuggaggaaacggaagaauagaccagaaugguagccagcuuacuccuggacuuagauauccaucuggucccaaggagggucuugacaaaagcucgauuagugguacacccaaucuggagaagcaaguuuuagaagggaaccaacccaaucuacuguagggugaaagggcuuuagguugucauucuuaggaaaucuuagguaagaggguuuuugagauaauguggucacacaucuggaagguucagcaucccaggccuggugccaucaucgugggcaccauuaucagcucuggcaucuucgugacgcccaccggugagcucaaggaaguggguucaagcccucgugguaugggcuguguaauuugagcugaugguacgcuuggaaaauuucauuggucaagauaaguccaggagccccaagacccccuccuuuucaccagcuguuccauuuucuguccaaaggaguccccaggaaaacucacagacaagcagaagggaaggugggggggggggcuuaauuuaagaaccuucagacuuguaaggauacagagcccuguaugcucugcuaaacuguccagucugccaagccuuccccacugcugaggcaugaccaaugaagaaauucaaacuucuccccaucuuuggaucuacugcugcagccaagaaugccagagcugccccuuggaagcccaugucggggagguguucagccaaagacuccaagggucacuggagcuaccucccccaacccccaguaugucagccauucacaagcaaugacaagcugguaucucuguagccugagcagugggaagccauggagcuaaaaggucacaccaacauuaaccaugccacaguacagacugccuaaacugauggcuuugggaagauugagaaacuugcuucucauucuugacauaguccuuucagagggcuaaaagcauaccaccaacccacugagacaucgcuaagauuccaagguacaucgucuaacuuaauaggacacguggcaacucuuagaaacacuucauaguaaacgaggaagccaguucugcaguuguguaacuugccugcccaguaugcgcagccucacggccuccuaccuccaggcaagcagccugcuuaccucucaccuguggguggcuaacuaacccuugcuucuuuuggaaucuguccuuguucccaguggaaucuggguucugcauc

SEQ ID NO: 4849 - RNA, 560 nt, Mus musculus
gugaaggacaaugacuuagaguuuacaaagggagaggccaaucacagcaaaagcaccccaggcaccaggaucagucagccauuucagggaaaguccaccagcccaguguucuuugugauucuguagugaugucgugaagaagaggaucguggucacagcggugauggugguaucuauaacagugauagugauaguaauuaaggugguggcaagugauuauaaccaugaugauggugauagauguguuggugaugauggugaugauggugaugguggugaugauggugaugguggugaugauggugaugguggugaugauggugaugaugguggcagucaugaaggugagggugauggugguggagguauuaugaugaagacaguggcuagagucaugguggugauagccaaacagcccaauugggugagcaccugaacaccugcgcuguacccagcaccacaccaaugccauucaagaaugcucuccccaagucucuacuuccagucugugaagaacugagccauccuccuccugaagaaaccagaacaggcaugcggca

SEQ ID NO: 4850 - RNA, 55740 nt, Mus musculus
cagccugcggggagcgcccuggcggcggccgccgguucgccgcucgcggcucgcagguuccauugagaaaagcugagcggcggcggcggcggcgucugcgccggagcagagaagccgccaccagcccgccgcccgccgggcaguccgcgcgcccgagcgcagggccguggccucgggccuccgcggcggcgccggcggcccacgcgcggcgcggcgggcugggggcgcgggccgaggcagccguggagcccgcgggccgggggcaugagccgccccgcuaccccgccgcgccccugccgcccgccgccgcccgccaggggcuagaggcggccgccgcgagggcgcgcggcgccggagacauguccaggaggaaacagagcaauccccggcagaucaagcgugagucaaacuuugcccguggugcccgccagacccccgcuggcgccccgccgccccgcgccgccccugcgcggccgcccaaccccgcugcgcccgcgaccuucaccccgcgccgcgccccccgcgccgagugccaagcgcgccguaaucuaaucucugccggcgggcagggcccccgcgucucagcaugggcacccaggggguccgggccccagagaggguggcgggucccgagagccggaaggagagugucugggggcgcggcuccagcagagccgggccaccucgcagccugcaccucccccgcauccgagauggugcggcgauagggcggccccgaucugggcucagauaaaguuuaaaauauuccauucugcaagucccauccugauaagaucgcucugucgggacgggcugaaauugugaucuuaucuggcgugcuugacucucccaggcuuuguaucuagaggcagaaggagaaagaccugggaguaagggggacuugggacugcggggaccggccggcgcccaccgcagcgcuuuggcugcagagcgacaaggcagcggaauagguaguggaggcugcuccaaccuaggcauuuggcacuggcugaccaaacccccuuuauccgcuccggcucuggaguuuucgauccgaccucugccugcugggggacauguggagauccgacccaccaacugccccuaacaacgcuacacgaauggaugcccaugggcaccgcucucuccaccuccauccgagggguuauccugaaccauccagggaccucaggcacucaaacguuguucccgagugaaguuucucgcagguucucccgugggcacuuucccgagcaaggcagacccuauaauccuacaucauccgugccccccuacaguaagacccuccugggcucuuggggcuaccagguugcggggccucuuggcugcucuaggagcgaguaagcacacaggaagagcuccuccccacgccacaccaauaauaacuucgcgccucucccggcagggcgcggggcuuccuccccggagcuucccuuuggcgagagcgacaggucaucugggcugcccaggaggugacgggaggggggcugggcauccggcuuuccagcuccagacgccugagcuaccuccucuguccacaucacacugccaccaggaccaagugugcauuuuagcuugugagaguacccccuacugaaguggggggggacggggaggaaucuggguucugguaacccgacuccccaaaugcgugcuggaccuguuuuccgaaagucuccuucuaucaugucagcugaagaauuaaagccacccacaggucccgaucugugcugguucucugguuucuuuuuccccuccucgccugugcgccucugcuggguucuguucucgcguguaugugugugugcgugagcgugagcgugugcguguguguguguguguguguguguguguguguguguguguguguguuucaguuugaugagaaaugcagauagcuagggcagggagaucucagguugggaacggaucgccagcgcugauaagcccgcaggagcccagcagagcccaacccacuugggucagcgaaaccccauacucugagaucuaggaccgagacugugcaggagagccccuccgauccccucacagugccccacgacucgagcagaagaggagagcaggccugggggggcgaggggcggcucagagcccucugugcaacucguggcccgggccccuccuccccuagcagaucuaaacgcguuaagaugcgaacguugauugucaccaugcggaggcgccugcccgccugcucucugcucaaggccaugcgugaggcccucacagcuguucgccuggugccuuggccucaccuguggcgggucucagggugcggaggggaagcaggcugagcucuaggggccgacgcccuccacgcccccaccaaagccggguugcagcugcccgcuugccucugugcgccuuuuguucugcgcaaagauagaugugccgugcugauaaggcuugcaaccgauggcagccgcgauagcguuuccauuuauuaacuucaaacgugggagaggggggagggcgaagcaggagcgcggccucagccagccagauggcugacaugauaggccaggccccuggagggggcuaggggcaggggacccucggugccccggcccaccagcuuuucuccugcccagucgauguaagcucugauaaguaggggccuaagcgugggccaguccgcccaauagcgauugccaagagagauaagaggccuuaucuacggccaccaggccccgcuggguucggguucgaggcaacagcagugugggggcauccggcggcagcagggggccugggcagcaaacgagggaacaacgugguggggugggggggaacguccaucugggacacuuuccccaaacauacuuaauuggcaagaaguugaucuucccccugaggcuagugguacaguccaucaaaaugaaagaaaacugacuucgugcugccugagaggaggggagaaagugagcggacacuccaccccucauuccaacuagguggcacucagaggcuuggggcgguuugucaccugcgaagggggguuucccccaaccaugcuggguagcucuugguuccuggcaagucuuaggugugacccguguggaguuagugaagaaaaacucgaggugguuuccaccaaccuggcugcuuuugggaagcccaggaggugcucggugggaagagaucuguagagaucugccccagcagacaagcaguaauugagagcuuguuguguguugugugcaguggggguguuuauugugccccuguuguaugcaauucucuacuuauuaagcaccugcuguaugcaagcacucacucaguucuauccacagugugagcaaaugagcagagagagccagaagggacagcaggccagucagggucccuccuuagggcuaacuucuaggcugcugagaaaaggccagcuaacuggugcacuuccacugauagucaccaggccucaguuuucugcuuugcaaaguugggcuguuggagauggugaugugacgggcugcuggugagaaccaaaucaggaagggucugacaugcagggcuggccucaguuucccucuuugaaauaagaucagcugagauaagcauuccgggcuacaggaagcccccaggucaggcgggaguuaaugaucccagaugcuaaaagauguaggucaccagacacagguuuggaggaagagucuaggacucacggcaucccaccuggugcaaccgcccuugccucugaggagauguuuucacacauucuuacaguucaguuaagcaaauuagugguagccacaggaugacuaacucauuccaagcccagaagccaucugccgccuucuaauaccuaacccccacccacagggccgguggugcugacagcaggggacagccccauucccaggagagcuggggugaggugccaauagcagccagaugguuuuuuagcuguauuuuauggacaguuuacagagaggaguccccacuccccuuuguaaguauaggauguccuuguggucaggucccuugaggcuuugcugugccaugacaccuccuggagcuuacucugucuccaugucuuccuuuccugacagugucugccauccagaacuuagagaguaugugcagggacuaagaacugccccccuccagccuugaccccacugucccaaucccuuguuauuagcauuggccugguucuuaauguuaugguccucuagaguaccggagcgcacgugugguacucugugcagaggggccugaggcaggaggcaccguggugaacccuccccugacucugcagcccacaugaagucucucuccagugcucguugggccuucuggucccaccugaguagauggauauaguacaggcagaggcagcaguacccauggauacuggucauggauaauaaccagguaacuacccgguacuaggccugaaugaaccugugcaggcccaguguucacaucauucuacugccccaaaaaggagugcuaaagaguaacccacguccuagaaagcagugaagccagagauggaaguguaaaguggacgcuguccuugcuguugggaccaggagccccaucuaggugucucaccaugcucuggcuucugucugcucucuguuauagugcucaauuuucacaucugugcagugggccuaugggagaggugagggccucugcugucccuucccagucgcccuugccaccccagugcugcucuccgagaugcuucaacucaagggcagcgccuggggaagccuuacccagcccuacccuggccugagccugggacccagucccaaaggcccaggccccucccuggaggucacaggaacccaguauggcaccgauuuaagugggucaguuggggagaaaggaggaggaaugugaugccauuaauugugccccuuaucuccuguuucuaugccaaccagacggucccggggcuugacggcucgugaauaauacuccaggccggccuaucugccaucgacaggccucacggaggcagcuguugccuccugauugguaucgaaaaaccuaugaacccagcccacauggagccgccuggccauacuaaggcccugcuggcuccugcccaccugcccaccaucccuuugaggccaccuugagguacuuaugguccuuguucccauuucacagauggggaaacugaggccacagccccccccccccauugccuugcagaccucuucuggcugaaggcauggcagagugagggguagccacaccuucaggaaucaugucauacauaccccauccccucccaugugucaggccaugugacccuuggcaagccccaucccaguaagguucacaugcucaucauuaggguguuguauggccccucaguggagauagagguagaccagucagggcugugcuccaguagagacauugagggcucuguucagguaucuucagccucggugcuuuuacagggcuucucugaggcucugucccucauauucugggacaacuuugcugacacccagcuccuccggcuucugaggaagagccugacucagccaugucccacuccuugggacuaccagagccagauacuugcugggaaguccuuauugccuguaggagcgugguaaggcguguucugcgagcaggaaccuugcuucccacccacaguguggggugaucgugccuguauccagaagcagcugccaucccuucccugccgcccuuuccuccccuucucuucacggccagguccagcuucucugagaugggaucucccugucgucccaagcucuuccccaugagauaucagcgugucacacacaggggcccugcccuuggcccacagaugugggggaaaugugaggucuugguacuaauccuguuccugaccagccucucccugcauauucacaccaacuugcuaaggaagcccuuggaccaugcagcugugguguaugugucacuugccuucuguaguccuccuucagacaccucugcccacuucuccccucugugcccuguagugguguggauccaggcagccaaguggagccccuuggaucucccugguuagugcccuuucuacaggggaucaguaggcuagugagagagagaaaaggcuugggcaggaugggagcaugggacauggguaccagcauggggaaggcaugucgaguugccugaacagagcccucccugucucagcuagcgcacaagcccucagugggccgccucuacccacuuguaaccugcaaggaguugagcucuuaccugugggcugccucucacuaaugugagcauggugagacccacaugaauggguguugccagggucaccuggccugacaggaaaacacccuguccaacuucacauaagguugucuagguucaagaaugcagaucagcccuggccagggcccaggaaaccacaggggcugcugagagccugggcauaagaagcagccccacaggagucugguaguaccagcaaugccggcuagggcuguccagugucagcccugggcaaucgaugucuaagaggccagggccucccccuuccccucucuucccauuccaguuguguguucaucccuagcauaugguccuaacuuuaggauacucagcuccuagcccauuucucccccaggggccucagucagucucauccuggugcucagccagcuugaguucucucacccacggccugggaacagcagguccuagccugcagagugguguucgccaccuuguuaggagugguauacaauagguacuuaaggaccagcagccauucggaguggacucagucaaagggagccuuagugacaugacccccauugcuuaugccuagagccaggcagccacagaggggucccccauggagaacggcucagucuggcuucucuggagaccuguguguaagugguccuuccaccucagcuucuacuuguagaguaggagucugauaagagcauuuccuuucuaggaccauagagagagcuuaggggugcacaccuuaccaggugacuugguacugggugggcacugccagcccugcuggcuuuugguguuggcauaugccugguggucuuuucccucccuugguaugggugagaacaucaaaucagucugaggccaacuaccacagaagccaggguggagagucucugagcagaaaucugcagcccauaggcuuaccccaccaccccgcauaucucugccacucuccacaggcugacguuuuccucucuccucagcagacugggcaagacuguggcaacuuauacaaagcuggccaggcacaacagcaacagcaccucacauccacaccugcugggcugcugucaccaccgcauacaccucaaguaccccuugucccuuaccugcuccaacuggcuguggcuucuaagccucagcuuuucugucuguggagugagugguggcuguaguacucugcagccucucugagccagugagguagaggcugguucccacgccuugaucaaggucuacaguagacccuggccgugcuccccacgacugugagugcuccuuucuacucaguacucacuccacaucccugagcaccccucuaggugcuuucuuaggcugggguuccccuuuuacucagaagaauuagaagacuggaguucuuuucuugccccacaagaauugggguaucaaagaggcugccccaggguuucacagcuaugcgugauggucucacuauggaaauggaaccugccugggauggggugcacagcccugucuguccccccccccauauggguggguguacuauggggccuccuuggcccuccugugaguccgucccucugagcuuuagccuucccacaacacauggcacuccccggugggagacaggauugaagagaacuggcagaugagacuugaccagccagagccaaggaagagggaaacaagccuuuguccucuucccuugucgcugauggccagcucucgguguuggcaauucugagacaguguccccugagacaguuucuugacaguuccuccugauaucugaccuuuagcccuacaacuuucccaucuuccuccaagcuuacaguugccucaguugccuguucucucagcccaggaggaaggaagggggccagggcaaacccuccugcagaacuccauugcuguucagggacaagauauccauccccaccuugccugaauggccuccgguaagggucagaaucugcggcucucccuccaggcccucucugacuuccgguacacagagaucugugauggaagggaaacugaggcucagagcccugguguggguaacccgucuccccacacucagcucaacuuccaggugugaccgagugagugugucccagcucagcuuugugucgcucccugccagccugaacagccugggcuuaaagcccagggggagaaccaaggcuuagaaaguucgaagaucagauucaugggagagacaccauguggggugagagagagcaauugggggggggggcugguaagaggagcugccacgcccaauuucaaacccagagucugaggcuuucaaguggccaaauggcucucaaccauagccagcucaggucucaacacuguucgcaagguuuuagcgaagaucagagcugcagcagacuggcugggucucacuccucugcugccuuugugucgacuauucacuuuuccacuuccugggccaccacagcaccuccugccuuagucucccuuacugagucucacacccugccugacuaagcuuaguugcccagggacagggacaucccgccucaccaggcagccuggacaguccaugggcaccaguccucccuucaccuaguuggccagccagccagcccucucuuggagcagccgcaaccugguccucccugcacugucuccggucccggccuucuccggcgcagguuucagcuccugugauaacucggaaaguugaacuggccccauuacugcacugagaugguuggcaagauacagcucgauaauggaggagauacccacgucucgguggccagcggccugggcucccgcccauuaacauuccccaccagcgauccgcgcuaucuccucuccuuccacuccucccgcagauaagaauggaaauucugacuucauagcucgcugauuaaagugucuggauuucuugauaauacacagauaaauuauguuuuugaaaaggaagguagggaggaggguggagagaagggggccuuagaggggagcccuuggccgacucugaggagauggcccucccagccucuaguccaggcugguagccaccaaauguccagccacugaaacugcagucagauccaguuaggcccagcaggcgccacucugagcugacucugguacagggacucccagaccauaggguccagccuccagaacugauggcgucucccaguacccacaccaccuugggcagaucuguguaacaacauggccuuguuugcgcagcagacauggugccucugcagccuugccaggcagcuuuaccugaguguccugcugcccugcagugccugguuagaccauagguaguucagugucacugugccccagcaaagccacgcccaccagcugugagggcccugcagcacucggaagcccagggggccccaagccuguccacagccauugugucucccagcucagcccagcugccucucaugacaggcggcacccagaugggacuccggugccauugcgagcuugucuggauaaagcugccuccuucagcugauccgagauucucacugauggugugaugcgccgagauuagggcugcgccaggcuaauccuccugcugagggacagguaaggcagccaggggggagugaggcaccugcugugugagaagagaaaccagggucugucagccccagacaccccuuggcaugguggccuggccacacuggcaggaaccccuucucaagcccuccugggcccagugggggugggggcauucagcucuuuucccaguccuguguauaugaaaucauuccugagaacugaaacucaggaaucccagagaugggaagggaaggccugaggagggcaggaacuuucccugggauccugggucuccccagguaugaugaccccagugcuggcccugcugaggggagcugucuugacugagugguggauguacccuugggccuguccugcuucucgccguguccucccauugucccucacuucucuucugaugacucaaagucacacagcacaggaggcacucugaccuagaggcucuguccagaccugagccuccagcuaccuagauguucugagguguuugcagauauaaccccccaccucuauaaagggaccuggucucuccgcuuuaaagugaaggccugggcacagagugggcaaacgcucaggauuucccaguccuacccacggaucagugcagucuagucugcagagccuugaauucagagacccuccugucucugccucccaagcgcagagauuaaagacgugcaccaucaugccugguuaaguugguauguuuauugcuuguaguaauuucauuuaccgucccccacacacacacacacacacacaaagguggcucuuuuggugagaauguuggcuugaagggauggagaggcagcuuggucaguaagugcucuccacgcaagcgugaggaccugaguucagaucuccagcccccuuauaaagagccgagcucggcagugcgggccuguaucccagugcugaggacucggggacaugcugccucuggacaauacugcaucccucucgggcaaagagcucccgcaggacuucuuauuucugaccacccccaccuggaugauucuagaaguuugucuuugucauccuggguuauuguccccacccucuccugacuaaucaccaggauuucauaccuggggugucucgggauucacacucugaaccaucaaguucaaggauaugagaggggggcuaggguccagccuacccaucacccuuuaggcgucucccuggucugagccucaguuuccguaucuguaagauggggcuagagaugcaaagguugccccgcaacccugguccugcuccccagaaccucuagccauauucucuggccaccccaucuguccuguaccuccucgcugcccaccaaauccagacugcuagacuccaggccagagaggcacagcuggacccagcuccaucugaccuggcuguguaaccuugggccaagcacuucaccucacugggccuggcuaccucauagagcagaugagcccaugaguguccuugcagguccuugugaagagcugaggagacagagcuugggaacccugaguccuggcagacaggugggacccccacccucccagguucuucuccaagccugucuuccuuccuggcuggugccugagagagaggccuccuccuucagcuccacgggugugggagggaaugggguggguguguuccgcccucccaggcccccaacaaaaagaagaaagaaagggaaccuugauaaaaagagcgauaggcgccaugcguggaggagccgcuaucagcccaucuaucugccugcucacucucgguucuucccccuuaucucaccccuccaaaugccaggaacaaaagcgucgcagacuuccaugcauugccaagccccuggcccaacucagggcugccaggagagauggcccugaaaucuaaagagaaagucgaggccccucagccucaucauuuuuggaaaaggaagacccaaauggcccauucugagaccuagcagcugggguggaauuguccaggaguggugccuaggggugggggaggucuccacggcaccccuugcacauuggcugugugaccuugggucagcaucuucccucugaggcauccaggguggguaagaaugaguuuaguggggccuggguggaccaguuuucccccauaaaguuccuuucuaccuaaaucuuucucgggucaccagaaucuaacacuuuccagaacacccccaagauccagucccaccuuugccuccccugaaaacuccuaaguccuauggauugucuuagaaauggccuggguucccaagagcagcaccacugagcccugguccccagaacguccauuccucccaccucuguccagccccuacuagcagccaaugaaaauagugugugcaaaugagcagacuugaggcucagagauuggcuacaguuccauggaggggguggggccuuaucucaaacgagagcuuguaccuguccagcccagacccacuggguggaaguccucccgggcuucugugccuucuuacugagccuuguguuugccuugaacaggcgggccuuuaaguaagcucugcugaccucagccuaagccacacccuccggcacuaggaccugggcauuccacaaacacuacagucagcuccugugccaaaugagaguggggaggugagaaguggagccgggacaggcagcaaaggcuggcagcucccucccucccuccagacccuacucgaguuauuguccccauccccuccugagccuggugacucacuaggaauguugcugaccaagucucuguggccugaggcucuggcaagaacagggaucuccguuugucuuugucacaccucaguuucccaaucuguaaaauggaaaggaaucuagucccucagcugccaggaggguuuugaaccccaucccugccccaggccucgguuuccccaccacaucaugggccauucuagagcugcccauuccguauucuuuucaaagcugcggaggugggauccugaccuugcccccagccucuccgcuccucagcguaccguauuacagaauagggucuauagucagcagucgggggcacuggcucccaccgcacccccaagccucugaccuaacagccacugguaugagcagggguuuguuguuguuguuguuguuuuaauguguaauugcaaaauaguggggaaacaagguccccuggagagcuuaggcugagaccuaagggaggaagagucaggagugaccucauggccucccucaguccuggcccccacacuaagggucucugucaccuguuuuuauuaacugugugugaggguacacuaucccaucgugaggccuuccagggggccucucagacccugccagagggcauccaucucauuugggcagcucccgccuccccccagagcacagagcuggauaaaagcuaccugcuuguuucuagaucagccuugcugucucgggaggaagaggauggaggaaaggaacagggucaagucagucugagaagcuggcauuaccacagacagggaagccugaggaguccugagggacggaccaagugcugugauacggagacagggaagggaccguggcugggacacagaugacucggaagccccacagcguugagaaagcauucuugaaucagagccgaggggcagaagcugagcgggguggagguggaguggagagaagaugcugaugguguuggugagagcgugaaggacacacaacacagggccucauguguaagcagggcagggagaggaugggguacccacaguguggaaggaggggguacccacaguguguuagaggaugggguacccacaguguguuagaggauggggcacccacaguguguuagaggauagugcacccacaguguguuagaggauaguguaccuacaguguguuagaggauagugcacccacaguguguuagaggauggggcacccacaguguguuaaaggauagugcacccacaguguguuagaggauaguguacccacaguguguuagaggaugggguacccacaguguguuagaggaugggguacccacagugugcuagaggaugggguacccgcaguguguuagaggaugggguacccacaguguguuagaggauaguguacccacaauguguuagaggauggguuacccacaguguguuagaggauaguguacccacaguguguuagaggauggggcacccacaauguguuagaggauuguguacccacaguguguuagaggguggggcacccacagugugagaggauggggcacccgcaguggguuugggaagugcucagagcacugugcuguuccagaugggcacagcccagccugcugaguggagggcuugucugucacacaggagccacccccuccugaguagccaucugccucugcccugugccacacagcgacggcuccauuagugaaacccgcucacauggcucaguucuuaucacccaucuggagaagggaucacuccagccucagcgcccaucuccgaggcuuguuuccuccucuuugccccaggcgaugagcuguggccucagcaggcccgggccccauccuaucgcaggacccccaggccauggccauccccggggagcacaaccagcccccuugauauccugggccuucccccaugcggccccucccccagaagcgcaggccauggcuucccggagugaaacaaucuuguguaaucuaucaguggcuaucgggcccaucgaggggagggacgggaguggcugggccuagagauggcgccaaccuuuagcguugauaaaguuuccgaguucagcugugaugaauguugaguaagcgcaggccgcagauaggauguggacuuggcaggcccgaggcuccggcugaaaccaaucucccucuaucagccaggcugggcuuucucaggcccccggcccucuucccuccuccuagccucccuuucucuaggccuugccccacccaggccccugccccuggggacaggguaaaggaccagcuuacugguuggaucuguccugacagaggaaccaggcuuaagccaaagggaagauacugagggagcucacagagguagcuguugaaacggagugagggcccagcgcaccccgacccuccacagguccugcaucuucaggcuugucgcuugguggugcugcuugcuguacccugauuaaaccucagcuccguccugggccuuuagacuuaggagcucagccuggacuuucugugccccuccccauccuaggucuuccuacaugcaguaccugagcucauuuuaguuuaaaugcccgccccauucaacaaaccccagaaccccgacaucccauggacugaacuagcccucugagguacauaggcccacaucugucuccaucucagacugauccccucucuugacugcacagugaguccccagcuuggacccugccuggaacuuccugguccccccagggccucuccguccacuccucaccagaacucuguaaggucggaugugggucccuggaccuugcagcccagcuaggucuccauucuguaugucccugaagagcaggccgggugguggcuaggagggcugccuuccaccucaguuuccguucauggcuuccacauuccugcaugcuggugcuagccaggcucugacagacuccagcaagugguugugggcagcguacauguaccugcagggaucugggcugaaggagccauaguuucuaaagacuacagguacaccaggagggggcaggggucacccccacaaaacagagggguguccugacuccaacugagccaggagcagcuagcagagccuagggucugguuccaggagcagacauagggggccagggguggccagaaacagagguggaaagggagauacggggauuauggagagaaacgaggccucacaagggcaacagcgaggccuuaguucucaucuacugugaauaaggauggguccagagaccuuguuacuuucugucucaguuucucauacuuagagcaggguaguaccaaauuggaacgcuaguaagugucaugcgucaaugacaugcucagcucuccauuguguucaguggcccuuucucagccccagggcugaggucugccucugaccacugguacagugugaagcacauggcuggggugccuggguccucagaggcuuccagagggccacgcagcuacacacggacuagccagagcagcagcagcagcucagggcagggaagcccaccauauucuggccauuaagucggaguuggcuuuuguguaaggguuggaaacgggagcggaauacauuuccaggaggugggggggggagcucggugcugcccacggcccagccaggaucacagcugugugaagccuugguuccucuggggauaggcaagggaaggugacugauggcagauuuucagugacuccuuuuaaaguuucuggaaccaauuugaccccaggucgccagcguguguuucuuuucacaagacagcgccaugcagagcucugcauuuuaucugggcugcaugucacccacacauaccuuuuuuuccucaguaaagauucuugccuuuaaacgucaagcaucaggaaaagccuguauuuacugugugugaaucauaucucaauaagaucuucuuaguguuugaaugcugaggucuguauagacgcauguuuacuaggauguggguccugacucugucagacccacugcucggugccucuguagugacugaggaagguaugcgucaccuucuaggauguccugaguuccaaacccacgugaccugggguggacccucgugaugcucacagccaggcacagaagcagucagcaggucaaccaucaaagaccacacgggauagagaggaccaggcaagacagagaaggacguagggcucagacuccuugggaagggacaugagcuccccacagagggucuguggggacacccucugugacacacugggugagaaacaucuccugucccauccugugucuguucaggccccgggccacccaugcugugaacaguccauagacucaaagauggcagccccuggcuccagcuccagcuugacugucaucauugggaaccccagggggcagacacacuuccccuucuaggguggggugugugcacucaagugaacaagcagugcuauauggccagcucuuuuguggccagccuagugugggcagcgucccuccugggcucugugagaucuguuccuccaauaguguccucaucucuaccaccaguuuggcugucucuuuagcgcccacuugaguuugaggucaagguugagaccacccugagcuucaaguggcccuucacucuucccggggacacuggacaccugcuaagccuuaagggccacaagggugucugaacuuguuguguacaacugugauaaggugguggucccagaggacccaaaugaccacacugagugugggacccugaaggaggagaguccuuaaauaggcugaagggguacacuggggaauucagcggccacucaaggacaaguuuggggcacuggugacagacauuuacacaggacauaugcuugggggaccuggcccuuuccuggcuggcaagacaauuugggcuauguccaaggaguauggccagaggugaaagagacucuacccugagagcccugccccacugcaguguggguaacaugccugagaugaucuuguggcacuggggucagaguuaucgucaagguucuucaccgcgucccugucgguacuuccugacugagccauuagaacugaaagcgaaggcaagucugaggagcuuaaacugugcuccgggccugcagcucuggguccaugugccucugacuccuuagcauugcucagaucagaacccccgcucagauggggccuagaugaggaccuacugucagaggucauggugccgcuagccaagaaguaaggcuuuagaacuuagaccugagaugcaggcgcgagcccuuagacuguuuggccauaguccccacugggcugaguccugugaugcuaaacucggccccugagggagggcagggcuaucuugccgccugugcguccccgccguggcccucacugccugcugcccaguggugggaacgucuguaucuguuucuauuuucucucugcucucagggccuuaucugacagcugguccugcuggaggccagggucucccuccuggcagugccaagccauuccagugaagugaggagacucuauaagcaagguggggggcuuccuauaccuccugauggccuccccagcccugcaagaaacagcaaguugucacaguaacaccaggcugugaucccagccauugucccauuuggcuguguggacuccagccuccacaagaguuuccgugaguccugccuuugagugugcucugucccccacuccacuucuuuuucuccuggcccaacugggaggagccuccucugucaucaguccuugccaccuccuccaggaagcccccccccccucucuuaacaccucucccucuuggccauucacacagguaccugugcuccuuuggggaaagaaguuuaguugugccguaucuccggcuccugguccuuacuaaaucuggcacaagggaauguggggagguuugaggagugugggagcagaugaaguggcugugguuaggaauguggcugccugcucucuggguucuaccuggcaucugucugcgagauccagggcccaaggaugggcaacagcuguugcaggucgccuuugucccauuauaggaagagaggaaagaaucucugggugacccuaaaggaaggacccugugccaggcaggcuccugugggccuuggucugaugaccaaggguuuggagcacugggugcugcucugguauuaacggugguucccaucccacaugguagucugcagagggcucauccaugacagaauccugucuggaccaaggagcccccuucaugcugccugggugacacagaugggguuuagucccccuuccaggaccugcaguggucuccauguggugguuucaaaaugaccaccaccacccuucauugcgacuccucaaagccaggagaaggcugcagucaccucacuuacaaggacuuggaaagcacugggcaucagccugcuguacagagcccgucuccauaauucaguuuuaaagcaugaaaaagggaguugaugaaauuccgcuaucagcuccgagccaauaugcaaaauaucucacccccaaucaaauagcuauuauguuuucauucccaagcggcguccggcuuaaugagcaggagacggaugggcgcuugggcgucugcucccugugauaaccaaggggcucggggcacugugggggcuguucccagugcugcccuggcuguggguggccaucaugguggccuguggaugccgcugagaaaugucgucuugcacucggaccucuccaaccugagcaguaguagccaggcagcagggacagcaucugccucacuauggguaacaggagcugugguucaagacuguacgaagggaggagcaccugucuggucagguuugaaugagguccaaguuccuuucucuccuugcagcauacccuugaggaucaugagcgaguuguucugccuuaguugaaugggccucaguuugcccauccauaaaguggguguaacccagacuucccucuugagguguguguagcagguaaugacuggcuacuuauggaaaugacauuuagauaggacuggccucagguucccuuacucuucuuugcccccacuccauggcacccagucuggcucacauuacauauucuguaugaccuuuccaugccaagaucuaacaugaacccucugugccuuagguuccccacugagacaggccuggaagaugaccucacuaggcuaugucagugggagagguuaaggagggacaucgugaagggcugggcugaggcuucuuguacacaguuggugcuuaauaaccacuuuccacaucuccuagcccugucggguuauugguggcaggaaccagugacagcugguguuugcaaagcacuggcccccagcucccuacgcugcugcagucugauagugcgggccagcaguccugggaggcugcagcugugauaguuuccauugguagcucaggagaaggaguacagagagguagagccgcuugcccaaggucacacagcaaggacacaguuuugaucugucauuguaccugguugggaacagugagguuccccaaaaggacccuagcauagggcaugcuggggaggaacaguauccagccauggaucacagauuccccugaccuacaggaccagucuccccucagccccccgcaacccccuuccuacucuccacaaccuucacgggccuagguguggcagagggcccaguaccagcuccacuggagccgacuugggaagccauagaggccccaggcaggaaugccgcguccggcugcgggcccacaccgucugcgguggugauugucuccugcaguaucagagccacguuaauuguucuggaacuaaauuaacagcaucagaaugagccgcuugcagccccgcuucuuucuccacgcuccuccacgcagcuuugugaggagcggucgccuuuguuccuguaaauggaggaacagcccugcuccaggcgccugggugugggagauccaccugggugggcaccaggcugggcuccaugacauuacugaagaaggaugcuucagcuugugcccccucauugacccagcucaguggcagucccagagggcaggcuucaucccauugacuggaguaggcaacugagacuccagggacuucccaggccuggagacgcacgaagcuccagcagagggguagguccaugcaccuaggcagaacagucuccagcauccugaagggaggcucugcucagggugggccuccaccacagcggguguccagcccugguacaaggucauagcggccaacacacguauccagccuaccuugagucugcuacugugagccucagcccucuccugccugucacccugcuauagcaaugcagcuggaacagauugggaggcuggguuuaggacuagcaccacagaacugcagccaggaaaccagccucauuuccccuuccugggacuuguguugguaccccagugccccggguugggguuccaccugugcgaguucacucacacucaguacacagcguugcuggugcagauaacuucccccacagguccuagucugagccucacccccuguccuugcucauguuccugacuuagaaaccacuguggcucuuugguccccaggagugacaugagaccccugcacccuagaauggugucaggccaucugaggccagugugagcagaauggcacugaccccuguagugugguugggauugucuggaaaccuggucgcagccuggugucucuuccgucuuguggguccccaugccauugacaugaccaauagauacuauggcucucacaguagcuucagcaugggugcaggcugacccacguugggagcugugagucuggggagaggcagguuucauuagcagggaacccucaagcauccaagcggugccuccuaguccaccccugccuggagacgugggcccgccuccagaaaggcucugaaguggugagcacugcugcucagcuuguagagagcacuugucaacuguacacaaagcccugggccggaucccugacacuuguauaccuggugugcugaugggugccucgaaugccccccccccaggagguggaggcaggagccucuaccacacaguaccccaguucucagccuuccuaacacugcaacccuuuaauacaguucuuauguuguggacccccaaccauaaaauaguuucugugcuaccucaccacugaaaucugcugcuguuacaaauuguacuguaaaucuguguuuuaugauggucuuaggagaccacuauggaaggguccuucaaccgccaaagggauggcaacccacagguugagaaccacugacaccauaaguucaaggccaacccagaaugcaugagauccugucagaaaacaacaauaacaacaacaacucaaagauggcuuguguaugcugucugcccuguccuccacccuaggguacacaccucacccucaggugcccucagucacucugacacaucaugcauggcuuuuugguuuacuuucucuagugcccugaggccucacugcucugauacucaaggcuccucccacuccaggggguguguccaagacucaagcucauuaccuccucagugaccacaaaaugacaaggacaggggucuccuggaagcuguggcuaaacagcacaaacugggggcgggguggggcggggcuauggcuaaagaacacgaacuaggggaggggcuauggcuaaagugcaugaacuggccccccccccccccccccccccccgcuguggcuaaagagaccgaacuagggguggggcuagguggaagcuguagcuaaagggcuugagcuggggaccccaggcuaggugaggauuucaguagugccucuauucucuguuccuguugcccauacccuggaguaacuucauagauuguauccucuggauccccugagagucaccgaagaacgauggggggcuuauuccagccugccaucuccacggcaagguggaugccccccgacucgucuggagggagggagaggaaagcuccccagcccccacugugaaagacaccugcauucugagccaggucacgcgucugccauguuuguguccagcaugguuuugcucaaauguaguaagcacaagaacucacccuuggagagcccuggaccaaacccccagggcaggguggcucgacagauggggccugcggggccauaagagacagcagacaugucgacuguguggcccuacgaguuugugugugaccugugaggcaggaaggccugcagugcccaucugagcccagaaggaucauccuguguugguuucuguuaguugugagugguugggaagguugggacucuuguccuagcaaggaggguguccauugccuggggagggacagacaacaggaagggcaagaacagaaaaugcauaaaaugaccccaaagcuuaggaauugcugugggccgggaguacaugggguggaguucacaugguugucaccaggggacccagaaggugucguagccuucgccucuguggguagcuggcccugcuguguccugauacccacucuacccaggcaccaaagcucagccuguacagccauuaggaaaccagggugaccuuauuuggaaacacaucaugauauccaggggcucauguccacagguucccucagagacauggaggccggagaagaagccaaggccauggacagcagccccaaggagcaggaagccccagacccagaggccccagccauagaggagcccccaaguccacccagagaagguaagugugcagacccagagagguuaagagguuugucuggggucacacagcccccaugccaacagggauccgacgaccuaggucggaugaccuagacucaucccauuaucaugucgccccuuuccucagcccccugaccuccucagauucuccugggccuccugguugcaguuugcugggucugcauuucugaaucugaggacaggccgcagaaggaagccccacagacccccuacacuacccaaacucuaggaggacaguucaggccaggucuggagguagggcaguaagacuucaagggccccaaaggccugagaagagggacucacgguggcagaguacucgggagauuagcacugcuguguucugguggccacugagcucaagggagaugguagcgagcucugggguaucuaagggacaccugcaucccgacccagguaucugggcucugcauggcugugagucuagagcccugccaccucucucugcagcucugagcuucaggagcgcuucgcuucuuacccaugagccuuucuucccccugcagcccccagcugcaugagcgggaacggcauggggaaaaggcccggggaaguggcugagucaggaaagagcuuuccacauaggcuugaggaccucagcaucucugugaaauccagaugugugcugcaggccuaugaccucaacaccgggaagguagacacagugucccuggggcucacuagccugacaggucgacucucagaaaacaagguagagagcggcuaaggaauugauguuuggccaccacacaugaagaggaaggcaaagggaaugacagaggagacagacagggacaucagagagucucacagcuugaguggggagcagaggucccacacaggucccacagccuuucaucccuagggcuccucaucgugcacgucaccagugugccagagucccugacugaguggaugcaggccagggacccuuccuuuccccuuucccuuuccauucuaagcccaguccccagccugagguucuggccuuucuguggcucugacuccccucacccucagcucccggggaaccccugccucuggagugaggaagccagugccaggccugguacacaguccugagaagugaagcuauggcugccucaguuucuccuggguggccuccaggagagcaggugccgugcucagaggcugcugcaguaucucccucaccaucggugccaccaucaggagacacacuagugcagccguggccgggcugccaaagggcaaguggcuggcggcugcuggacucugacccauggcuucccggggagcuggccuuuaucugauuggggagcuggggcugcugaagggguaggcggguggggccgggaaggaucugggacaaacagcccggccugcaccuggcaccagcggcagugauaacacagugaugggcgcgauaacgggcacuagagcauaucugacguucaggcggguccaacgcggcuccgcucgcuugguggcuggagcucagaugccagccacuuugauuuauagccaaaaauaauaggacuuuuauaccaugggauugauuuauuugauguuaaucacagcccuuaucgcgguauuaauaaucugcuggucccaugacgucaccaagggggcuuuacaggagcucaucgaucgggggccacacugguuaucuggcccgccaggaaagcaaacaugcccuuugggcuagaauugggugcggggcugguggagggacccagcuguugcaaaaaccagagagccagaagucaugggccuuggugcacugggugggcacuggguugugacagcagcuaaagaacaauuauuacugcugugaucagcaggggcugagagcuuuacaagaccaagaggaauccuggagugcuagauaaggagagaggcaggugacugugcgcccugaggccucaguuucccuccuggucauaggcuagcacugcaaggaugugacaaugcuuuccucucuacagaugugagcccaccugcagugccggcaccuccggaguccccagaagauccugaggacauggaggggcaggaguuggagaugaggccccaggaugaagagaaagaggaaaaggaagaagaggcagccauggcuagucccuggagugggccagguaaccaggcugacuagccccguauaguaguaguggccuuguuauagccuucugggcuagcuagggcuaggcuauccugggaucguggguccuccgacaccacccgugcccgggucuguguagcuggcccaagcaauguguucugagauaaucucgagaguucgcaugcccagagccugugcucugggcauuugaagggucugguguggcuggcuauggggccugagagacgauagccggagcaagagccuggagggcguguagcugacauguaggaacugcugagcacagcuucccugcagcagaugguugggauucggagcuggcuagugcccaggugggcuugcgcuugugugaggacagcugcucuuucuggggggcccaguccgucugagguuccugguuaccaucugccccacaaaccagucaggccuguaccuuugcacagacagugugugccaguugucacauuggcggcuggagcucagacugcacaggucccagaguaugacagucaugguacccuugcugccaagaaaccgugggcaucagugauuuccagggcucuuauugaggaccaagagccacugugcagagcaggugcacauacaccuaugguccucaacaagggaggugucggaugcuugagcacguggguguguggggcggcacaugcacacacgguuauugucugucggcuguguaugaacaugcagguaugacacagccgacuccugucuguggcuagaaggcaugucaaaggggucugagaaggcuuugccagggcagagacugcuccuccucuggaaaacuugggaaccaaauugggaagggguagaaaugaacucuuaacugaacacauggaugauuugguggggugcuaaggcauuagaagagugcaggagucgauuugugaucucugccgccagugucaaggaugaguggcagguguggcuaagggccacacaauggaacaucagccugaggccuuagagggaggacugaccuagaagaccgcagccagaauggggaccugcacucuugggaaauugaguccacccauagaaugucccauggcuaguugucccagagcacugucuccugccacauguacaucaggugcuuggcacaucccucgaggcucuaggugaccuggcagagguaauauggcgaugauguccgcuccugcuggagugccugggaugggcacugaugcaaucaauguccuaucucaguugaggcuuguguccccagaucucgguaccauggugggaauaauugcaccaggucacaugggugccagacccuuuccacucacaggucagugucuaaagccauggaauugggcagagcccuguaugcaggcuguccagcuucuuaccagcccuaugccgacucagucucuccagcucgaagggggucccugagccccucugaaggcauggaugccccuuacaucagccuccugcggccagcacagugucauacccacuuugguguagggcagagaacggcauaccacagcacuggcugagaacugcgccuugcuccagaggcccagaugugaagucaccuacagcaguauggaacguugcccacgguccucauccacauaaggguuauuauuuucuuagauggagaaacaaggccccuuuaguuuguagccugucuugcccccugugaaggcccugcuccaugggcugugguuuggggucagggugcaccccagcuucccgaguuauuugcauccuccggggccaggcagugcacuaucggcucccacagauaggaauuucugugcagugggcagcgaugggguugauaaguggcugcuggccaaccgccgugguagccaucgccuaucagcucccgcacaggcucugcuuaucaccgguggggaagcugcugcagaggccccgggggcucuuaucuccagggccgcccaagccucugaugggguuggaggcuuaaggccugaaggcagugcccagucuggugacagaccaagugccacuuuuaccuugcgggguugcccgagacucuuccugaccuccggcccauggcugcuuucugacaggucccugcacccacccuguuugucccaggcauccugccuaagagguaucuuucauaguuccaggcagagacagggauucccagugcaagcuagcuagcagcgcugggccauguuaaugaccucugucugcuugagagacaccccccucccaccucagugaaugagguggacaagcaaugaaggaugacuuccagcaucagccuuaggcccacauauucacgcacgcaugcacacacucaaaaugggaaaaagaaaaaaggcaccccccccucaaggaaccccgacuuggccccgaguuccaaugcuguggugaugcccaggagcaguuggcugacugcugcagacccaacuauagucuuccuugcuuuacccacacuagaguguaccccaagguugccaauaucaccaucacugucaugaucuccuaucaucuccugcuucugucucugccccuggcucccugcugccucugccugguacucagugaugguagcacuccacagucugggucauucacaguggaguuuucacccacugucaagaguucuguaucuugccggguacuggccacucuucuuugaugcugcugcugugagaggcaggagccuagcuuuguggagugucuaggaauggacuacugaccucaggaccuugguuucauggucuguaaaauagagauggggagagacauuguggccuccaacuugucagccacuagacagccugguuuuccucacagggagguaugagcaaguucauaagcccccuaaguggcugauuuucuauuacaucugcaucagacaggcaaugcuauguuugcagcucugauagccacacacugcccaggguccagcuuugcagugaccccacgguguggucucaguacucuccucugggcagagggaauguuguagcccuauguagauuauaaaacccaaggagcaugccaggaaagugucuucagagagcaugugaccaaagcccguaagugcacaaaacagguggcccugcucggggcucugcaggcugagggugaccacgaugggccugaggugccagagaggggagcccacaagaaaggaaugcaugcaagguccagaggacuuggagccagaacaguccaugagucuaaggaggcgggaguagagaggugguagcccagggccuguggauuugggcccagcaggugaggggauugagccgggagggcuuaugugucccugaggcacagcagggacacacccugggccugaugggccacagaccacucugguccagagcugaacucuacacaaacuuuccccagguugagccccaagcugggcuucccucagcucgcggcugaauucuaacugggaggaaggauagauuagaaggagagagucggaguugucaucuuugaaaugacuuuguuugcaagagugauggcuguuucaaauccagcuauggccuggaagucaaucuguaaccuugcauggccaccuugcuauggcauguggagacuugucccaggagcuuggugcccccagugucauacgccuccuaucaccagcccuuaaagucaggagacuugcaaacacaccagcccugucaccuucccccagcccccacccugccuggucuugagcaaguggcucaaaggagcaaaaguaaacagggcuggagggcuggagacugcugucagguaucacaguggguccucuuucuagggauuccuccagggccagcuucagcaaaggaaucgauagaccacccaguuccuuccaaaggacuacauagaacuggggagguuugggacacagagggacuguaaccuucccaggugcccccaaaggcuucaugcaugccaucaguacaccaacugugugcuguuugccugugccaguauuccaucuguaaugagucucuccagccuccucugagggucugucuggaagggcaacugagucacuaugguggccccaacccaucccugaggugugcuuuccuauaaaaugagugcagaggcccagaguguuccacuagcugucaguaggaaugcuagcaguggggacaagggucagcgggacuucagcagccuucuucuguccuaugggugucuugagcccagagcuuauucuagucacugcugucugagagcaggguccaggggcagagccugaacuugaggcagacuauaaaggggaaggcagaggggagcaagaggccaucagagugacuugggaaggcuaccccaagcacauuagccccaugugaccgugcuaggugacccaagaccauccauguccaggcaggacccaggucucaguucuggaagcccuggaggugaagcaggggcaucaggugaagcaggggcaucaggagagccaccugaagcccuccaggugaagcaggggcaucaggugaagcaggggcaucaggagagccaccugaagcccuccaggugaagcaggggcaucaggugaagcaggggcaucaggagagccaccugaagcccuccaggcucacugccccgaauccaugugaggauacacaggcuagaugaacagccccauccuggccuucugggagggucuagacagacagacagacagacagauagaugggcaggcaggcaggcaggccuuccagccucuuccagggacagagagaauagacaggcaugccaugggagugucgaggcgcuuagguggagaucuggccaaauccugaggaggcuguggaaggggagagcacuggcuaggaauggggcagcacccucccaugcacacuuuuggaaaagacgugacuggagcacauggcccuuaggaagaguuaggaccuguaagucugccaccuccaagcuccacagacaaagcagagcagggaaggggagcccuguggcuccugacaguugaaaccaaggcuccuggcugaccccacaguccuggccugagggagcccagcuagggugggaagaacuguugucucuuccgcccaggaguuucuuggagcccagaacucuuuccaggagcugcuaugaucugagcaagagccaaucagcccaucccaacuccuagaggcagggccaagaagccuggcccuggaucaggccaguaugucccugaacagugucagccaguacagggggugccagggugucaaggccaagugggagagcaaggggcagcacuggagaggaccccaucucuaggcugacggcugaaaggcacauuaggauacagggagguauucaggcaaggagcugggugugcagagguccugaggcacuggggucauggcauaauggagccuuaggguuaugguaauggggggaggggacacggggguaagaguucagggcacagacagucaggguccagguuaugagccauagaccuuguggacaaccagcccucacagccuugucuuguggugcuggggaugggaucccagcucucaagcuagccaggaaagcacuucaccuccaagccacaccgaggcccagaauucuuggcugcaccgugaagaugcugaaaggcacuggucggcuuugaucaccugccugggagaacggaucagugguagagcauccuggggucucggggugcaaggggcugcugcuagggccacaggagguggugguggccauuuccugucggaggcuccagccagauauccugccuagggucccagggaaccaggagacaggaccccucccucccguggagcgguaacuuguuaucuagacuguguccggcugacuaaucuugcaggcccgggguuucugugugaaccucaaggccuguuaucuggcggccgaggcaggacugcucguccugauggacagccugggagaugggccgauagcuggccaugcuccccuccccacaaccgacuggcuugcaugugugggugggaaaaaucauuccagcuauuuugcguuaucauggggccuggcguggcaagugauaggccuguuugucuaagauuagucagcaggggagggggcacugguagaugauaggggucacucuggggucagcuucagagcccagccuacuaccuuggaaccccuuugaagacuccuguuuuucugagaccccaggguugcuaugaacaaucugaagcuagaacauggugaaaagaccuaaggaaauuguaucuuuacugucgggcauguucaucgggcauguucuuccugaauagucacugaguaccuugggggugggggacaggcacccucagggccuggaaagacacaaggauggccuugaccuccuggaauguauaggaaauacaaccacccuccgaguccaaggccagagaugauucuagauggcgucggagugagacucccuaagccaacacaccaccagccacccagugauaguguguuggagcaaaagacaccaugauaagucucagcugaguguacacagcuggaucucacugcagggugaggaggaagggggcucagagguaggggaccccaucaaggggggggcacuauggugguaugcaagugauuguucugcaaacaaggguuagaggucauagccuaaggucagcaugggccauggggggauggcuggcagguggggaugggcacccuggcugccugcuggcucuauccaccugaguccuaggcuagccauaacaacuguucuugagccuugggccucagacacugcaaaggaggggacucucacaaacugcccuccuccccaugcugccucccccuccuccuuucuucucauacagugagcaucuggcccaugacacaugcuauguguccugccacacaucuugggguugaggaccucaucugagugagcagcagcuacaauggcagccaaucaccaagggacagaaaaguggccaagacauggggauguagcuaugugguccagugcccaggacucucgcagaguucuuucugacuccugaugaaugguccaaaggcacagcugguguaacagcaucaggagaaguaggagaccaggugugacagaugggucugcucugggagcaggucccauuggcuguuguguggguaaaaacagagcccagacgaauucucaaaagacacgagaguauacucuccaggcagcaggaggcacugugguaccccauuacagauguggaaacugaggcagacaagauggacagcucuggggagaacugagcaggccucuugggagaguccauugccuaccacaaagucucaucccaaggagcucucaguagacacuguaggcaguggacagacaacaggacauccagugggaagugcagguggagcccgagaggggccccaggccuggcugcccaccacguguggcccacugaccucacccccuuccggacuugcugucuguggccagggcaggcuaucucgguggcggcacuaaucaagucacuuccuucuccgcccucccaccagcuuccugccuagcuagcagccccacagccggccccgacaucagccaggcaggucccagccuugccaggggagcuacaaccauugucuuccagcagugucccuccuguccccucccugguuauaaggucgacaugggcuguguguucggugaggaacagcuguugucacugaggccgugguuaauggugccaccugugucaccagugcugcugcucugagccccagcgugugacugacuuuaacacugccgcuggcuuacuggccacagguacccuaacuguggccauugcugguaaauuguucuugcuagcaacaucaccacaggugugagagccagcucugacugccaccucacuugcuauuuucuggcugucaugccccauccuggcuagaguuacauuugccccagccauuucuaccaugaccagaguaccuaguagaaauaagaugggguggcccuggcuucuauccccauuccucucauuuugacugguagccgugauuuccucauccagagagcuuccguuucucagggugacugcuguaaggcggagcaggcaaaguggguaaacuugcacuucccugugcccacggcuaggauccauacagguccaggguccagccacggugcugagucgcacggguacugggacgcacggguacugagacauacagguacugggacauacucccuccucucucuugcugucccacaagggaaacugaggcaauucugcuuacuuguggguagcacugcccuugugugagcagcauuuaugagacccuccugugagacccaagaugggagccaggaagcaacccccacccacccccugccagcccugugacauugcuguucuuugagaggcaccccuuccccauagccacaauggcuccuuauuuauuuauuuauuuauuaccucucuaucucugugcguaacuuuugauuuccucgcugcguuuuuuccauuauggaggcgguggacgcagccgauaagaucgguccccagagaugggacaaaggggccgccgucggcucgagggcuggucauauccugcacgcaagggcccagcgcggccugagaugaggcgagaugcuaucauaccuuauugugucucaugggggcucugcccacccggcccugcccccagcugggcuaucuggguccucuggaaucaccacaggccuuggauucguccuucaagccaccaagcccccguguccucuacacauaucuggugcuauggggugacuuggggaccacuagccaaggccuaucauaguccuuugcugccuaagcagagacuugacagagcucugggaauuuauccagaaagccaggaguguggacagcagaucggugaggauggccauuguagugaagccagaggacacuucugaccuuaaaaauuuucuacaagagcugggcagugguggcacaugccuuuaaucccagcacuugacaggcaaaggcagguggaucuuugaguuagaggccagucuggucuacagagugaguuccaggacagccaggguuacacagagaaaccugauccuggggcaaaaagaguuacagaagagagcagaagucguucuaacagaugcagaccccacaggaugcuguaagaagucccugagcccagcaggcuugaccaacaugcuccacugacacucacagagccaccaaacugcagagucucccaaacccaggucacgauguauucuaggucacuuguagauugugggaaggugggacaggugccccgggacaagcuccaaugcccagccaccgcuggcugcccaguuccaggccagcagggagcugccgcaggagacauggauguaggucaggaccagccugcuuugugcuccccuuuccugaaugccuaccagccccucacaaugucaucccucuuccuuuccccgucagggaacuuaaggaaggacagagccaggucagaggcuuggguuugaacuuccaguguccugaugugauuccggccuccaagcugacagaagccuugaaggcagaggcuauugcagauggcucuuccgaggaaaagcuaacaagucccuaaaccuguuugucucccaucccccacagagccuaacucacccugaggcagaggcuugaaacucagagugucugggagucuuguacauccuuuguaggggccuuuggucugugugcucaggcccugaaaggccagugugcucuaagugguagcugugcccugacacacuggcuccccagcucccaccucacugucagcuuggcaacugccaccacuucccagacccucauacccacccugaccgcucagaccagcaccuguggccccagagagcaauggaaugaagauaaggcaggugggugcacugagcuggagccaggugaagccaagcucugggcaagaccagguuguccgugccaucauaaguaggcagggagaugugggggcucuaagcugagagcuuagagcucugucccuaugcuagggggaggaaaccaugccucagccuccucagggaugccggcugcguagaaaagagcuccuugccuuggcaugguacacaauccuccaagggauugguguguccuuugaggggugagugggugcacaggucaccguugccaugguuccuccugcuagucuggcugcuuugguugugcccuaaagggacaaagguggugucucccuccaagaaccuagaauucuggcucugaaccauacaggguccugggaugagcaagagaugccuuccaccuggcaucccuugaccuauuacacgcuaucgaugcaccuucugugagagccaacccuuccccagaacaagccccaggcggagagaggcccccugggaggaaaagccccacccuccauagcaggcucuucccagaugaacccagaucugccauuaguaagggccaggguccagccgauaaaggcuggcuguugcuccaugucaaaaaaucaauacucaacaagcacagucccagagaccagggaggggcugcggagucgcuggaggggcaggacuucagcaccuuggaccagcccuccuccaccuggcaccaguguuugggguucucagugacuuaauccuaggccagacugaccacacacacacacacauacccuacccugcucccuucugauggacaggaagcuugagguuggcuucuuccuccccagggccaccagagugguggcaggacuugaggaggaggggcuggauggcuacggagagaagugcauaggggacagaagcagggguacucucccacuccugaggucagcugccccgucucccaggcaugauacccuccugggucuggggcacaugaugcccagaauaucccucagggcuggcagucuacgaagcuagacaccucuuuccucugagguuugagccacugagaacagugacacuggcgagagggaggggacugggcggagugaggagagaaauacaggcucuggugcagcaccccugggagcagcccacccuaaggcguuguggacccugcucugcaccagcugcaccagcaccuuugcugcugccacaaguggacagagugguucagagcagggcugcuuccuggugugaguggaucgcauucuuacagguccugaacccagcuuucugguggccuccauccagcuuacugauccccauuuuccuagugacuggcagcuauaggcacucugcaaagucagaaucuaccucccgaggggcgggguggggcggggcggggcagagaccccccccccauuucccuuggaucucaccccagcccuccgugccacugcuucugaaggugguggucaagcuuguguccauggcgccugucacucugcagcuuaucugccuggugccauccucucccucugcagaaugccgggaagaaagcagagauggcugaacucuccuuacuggccaugucaccucuggaaagucccuugaccucuccaagcuugcuuucaaugccucccccacccccaucccaucuuccuuaaaaacuguuuagcagacagugacccugagcaagggcagguauaacacacacgccccuucucacagcagauuucccuuucaguguggcuugauccaggaacacauuccagcagcucucugaccccuccauccccugcugugugacucuagggcaucuuuugcccuuccggguccuugguuuagugggaacugauguccucugggcuacacaguuugccuacacuguucuguguucacaccugcagaauuuucuagaccccaccagacuggggcugcccucccucccucccuccccauucaugccuuuuucuuuccuuuacugugacuuuuaucaaaagcaaacagggugauccuugcgauaggggccgcgccccagcugccccgugggagccacagggcggguuggcgggaacgaugggcugauuagauaaguagguacugguggugagccggugggcacccacacaccaaccacagaccccacagggcauggugggggcuuuggguggcugguuuggugcuucagaggcccuggucuuuggcacaaggggccuggcccauuugagcuggggaagcuuuuugcugacguuccuacacaccacaggcuccuguuguagauuugcaacccagccgcgcugcucacaugggaaaaccggggugacuguccuaucagaaggguacucugaggucagggcuuaagagaggccauaguuagccagguggcgguaaugcacgccuuuaaucccagguggagguaggcggaucuaucuuaguguguacaagucaacuggucuacagagcaaguuccaggacaguggaggcuacacagagaaacccugucuggagaaaccaaaagagaaagaggcagggugggaugggggggcaggccauacuuggggaggaggagggacggcucagugguuaagagcacuuaauuacuuuucuagagaacccaaguuuggucuucagcucuugugucaggaagcuccagccacaaggaaucugcccccaucuucuguucucuaugagccccuagacacacauauggcauacauauauacagaucuuaggcaucccagggcuuucuccgccuccauagagagaggccaacaccagcacuaggcagugcugugcgugcugauggaaaccucugcguuucaagguaaagcguuucuagucaggucugaggggcuccaggggcaagggugccaccugggaagcuagucucugcccuguagcaaacacagccgcuuagccgacagacuauauauacaccccuucuacaacauaguaaacugaggccccggcaggacaggaacacagacacuaggguaauggcaggacuuggcuuguugguuugaacaccaguucugccccccagagcacccuaccaauggccagcuccacccacccccaccccagccaggcuccaggugaggaaguggaugggggugggggguuucuuucuguuccugggagaugaaugcggugaaggccaugcaugacuaacguuguaaacagauaaauauucauuagguuccuugaagaugcugcuggggaaugcaauuaagucccagcacguguccugggaagcaguguguaccauuguuuaccugaauaagugagcccuugacccagugccugaaaugucagccugguuccugucaagggcuuaccagggaagcauagggaagcccaggccaaaggcaccaaauuucagaccuggaagaagccagcugcucccucccaccaucccucagauggguaccaagguuguaaagugugggaucccacccaccaugcagacuccagacucucugagccucagcuucccaaguaugccuggagggauccugcaagucacgucuggugcugggcugugacgcagaaaugggaccaggguucacggucggauugcaagguuucuaacagacaaaagcacauuauccauccuccagcugagggaacagguggccagggccggaaucagguuggaagccaccaugacagcccacuguggagccgccugugcccaugagggcaucuagacacuuguuucuagaauccccaggagagagacugugaccccaaucccugcccccagauacccuucagagcucugugauagugagugugugccacaaacccagagacuagauuaugucacauccagcccagguuuucugucacuacuguggagccccaguggcaacccaucccuaaacccugggcuuuccuccgugugcuguccgucucgggguccuuggugaaagaacagcuccuccaaaccccacuuuuccugugcuguuuuacccgcuaggagcgcaucugcuggguacuagccuucucuccgcugcaagggguuggggcaggaacuagguuaucuauguaacugacuguugacugucaccagagcugcgggcacaauugcagaggucaccuugaacaaggugcuggggugagccgagguugagaucagcugcccuccccuuaccaaucugucccucuaacuggcugaccugggcccugaaccagagaggcauguuaccauagugauuguuguacacugccaccuaucccagacgucccccagucccugagugcagagugugcugcuuccccccugggagagggaccacagcccuuaucagcaaccagcccucucuggcggugcaugauacccagaggaugggauggcugccgugggaaaugccagccgugcucuuaucuggaagccugggccauggccgugaacucugauuagggugcggggccguuugccggugggugagcgaggcgauggcacccgacugccuccuuccccauagggggacuggaagcaagcugggagcccaggcuguccaugaggcccuggccaccacagguagcaucauggccaggugugucuuguggaacugcccgugucauaccacacccucagaccaaccugcauggacuuccucccuaccagguaccccaauuuaugaggacacagccucagaugaagguaccgcuguaacagggagcuccugcaaggggccaggccccaucccgaggacuguucuagacacagaauggaagugggacuaggugacuuaacugucugucucaagguccagggacacccaucucaggauggaggauccgcgucuccuuuuugacaccagggugggacucuggguggcugagccguaagcacagacucucaagagaacucuuuaauuccauuucuguccugggggccauuaugugcggaacguagacauaggcaaaaaagccaggggaggcuggcaggucacugucccaacaacagauaaacagcccuguaguagugccagguuuggauccugacaccuccugccagcaguggaccucuuggggccucgauuuucuuacccacacugggaauaaacgucacaggggccauucucugcaucccuuaggacaguacugcccaggccuuggcccugcuccuacagaugguaccgaccaucccggugucagcuuugggccaugcccugugaggcaagggaaggugagggagggggagccagugggucagcccuuuaccaggacaguguccugggugagcugcagaggaagugcagagccuuuuggccucucagccccucucccacucccaggcugauaaaggggcacaggccuccuuggccuccaguccuggcccacugccuucuuaucagccccgggaagacaaaggcccaguuacagcucuccacggggccuccuggcguauuuacaccuuaucuccaccauuagcuggccaguuaucugaugaucgcgcccauuaaggccacagccugccugaugggcuccaggaaguggggccgccacagugcucuggccaggggaccaggccaggccaugugaggccuccaucggcuggcagcccggguagcaggcagacggggcagaggguguguggcccggggaaguaccacccuuugaggaaaugaccaugucauuuaaagaaauagaggcucaaguagggacagcggcuggccaggugucccugugucccucagcuaacacugaucacuauaaccaaggaguucuuuaccccugccugugcucugcagaccacaaccuaccaaaaguucuagaagccucacgugccacaccuucuggcugucuuguccaccucccuuucuuaaggacacggucuuuuauuuagaacuaccuguuaauccagggugaucuuaucucaugaucuuuaaucuagucaugccugcagaccuuuucccacaugcaaaggacauucacagucaugggugaugucuugugaaaggccauucagccuagcacacaagguccugcacgcagaguguggcucacacacagauucugcagacugugaccaagccaugguguagccugccuguccuggucuucauggugucucuacaacccagcaugggguuggcuccccaggaaccaggccggaagugggggcugugggacagaaguguccugggggucaccaagcagccacucacccauuuguuuccccucagaggagcuggagcuggcacugcaggaugggcagaggugcgugcgcgcccggcugagccucacugagggccuauccuggggcccauucuacgggagcauccagaccagagccuuauccccugagagagaagaaccgguaaggagcugagcccuaguuggccaagcaaaccucgugccuuuccagcagggaacuuugauggaacccaaagaggcaaggguaaaagggagggacuuccuggggagcgucugcaaugaguagcacugugcuucgggaucccagggggacuuccuagaggagcaguaguggagcucagcagagaaaagaagguccaaaggaagugagcuguaaggaacaggcacccacugaguugggagggaaggggaggcuguagaaggaagccuggccuucuguccccgggagcuggugcugggugggcguggcuucugacgggguggggggagcaggugcugggugggcguggcuucugacgggguggggggagcaggugcugggugggcguggcuucugacgggguggggggagcaggugcugggugggcguggcuucccagcucugcagccgccugcucaccacagcagcccuggcuggcagagaguuccuaaggcagccuccuuccccacacagccaugcggccguuugucuuggccuugcuucugaggccgcuucuguuguggcaagucaggccggcuuccuccugcuggaauguguggguuccuuuugaaaucauuucaguuggaaaaggacagcaggacacagagaccuggguacaaacauagggcagccauguaggcagcaaaugagcagggauuggagagguuuguacaauguccacagccuaugauggcaaaggccagggccagcccuaggcuuccuggcuaguccugucaauccuaggaugaaaugucucccugccagauacugucggguaggcccuguuuccugauuuagaguguggacugaucacagauauucacuggcuggccagugucacaugcuucugggcuccuuggucugagggcacauggcugccuucugagggcccuuguugggaaggcugagacuucccuagcacccagaggccaggaugcugcacacacauucacacucgcagacucaccuucagaaauaucucagaagcacagacugaugcaguccacagacaggcagguagggagcaguagaccaccaccacucaaaacccuuuguggugagucagaaucugugcucacuggguccaaacacaccaccgacugaggccuguggccuggccauacagucuuccagccaccaggagagguaacuugucccagacuguccaguaagagcaggagcuagcucagaccaaacauguccaccuugggguuucugcuugcuauaucccaggcagauccuuccugcucagggccacucuuuccucaguccuuggggucccaggcaggucacauggaacacagaggcuugcuuuaggccuaggccuauaaagagaauguagagccaggcuguacugugaggugggaguugauccccuugccugcuggcagcaucaugaauuaagagggagagaucuggaguggugcuugacccuguacauacuugguagagccugagaauggagaggggcccaagguccagggaggaaugucauagaacagcuaguuaagguccuguaggaaggaagccagggcuuucaaaguggcugugccgggugggugugucaugugggcuguggacagcaagagacuuggagaccguugccacuggucagucaguaugcaagcaugaaccuggagccccugucuccagacuucagucaggaaaacccacauguggcaaaaggagcaaaggcaggucugcccaggccugggaaccagguccugguaugcccugugucugucucuuccaguccuaggaggcaggcugcugucucuaaguuuuuaaauucauucucauucauauucucucucccucccucccucucucucucucucucucucucuccuccucccucccuccuucccucccucuccaucugucuguccauccacacaugcccacacacacauguagaucucagaggacagcucagaggaguugcuuugcucuuucuaccuuaugaauccuagggauugaacucauauugccaggcuuagcaccacaaccucuuuacccacugaaccaucucgcuagccugcaaaguccccauuuuauagaugacaaagcuaggacucugaggcucuggcccaagucacugggcuccagagaccuaaggaagaugcagccccagcuccgcucaaacacuucucccgccaucugcaagcccccccccuguccacaggagccccaggccuugcuaccucagcuccuggauuuugucccaggcggcucagccugggaaggcaggaaggagaauccucacuaagguguaagacgccgccaaagcagugcagccccugccucugaggcucucagacggggaggaagcuccucccucucuccccucuccccucuaucucacagaauuaaauccuugauuaacccuuaucuccccagcaaggcacuaucuccgcuuuggcgccaagcguccagacacacgcuacagaugauugauuucugaaagauaugggcgccuuugcgauacuucguuuauugucuaaauauuuuugcuaacauucagcgggcucuuaucaaguucggcugaugggucccaguucucccugcagccuaaggaagaagucgccuccugccccauggcccuaucagccaccaggcaguuccuccucuccccuuagagaagaaggagggggcgcauguagauauggggccuguuucccgggcuucucuuaggcugggggcugcucaccauggggacaaauuggaagggaaaugcccccuaacacucccacccacaccagauguccaggguuaguauccaggaaggaaacugagucacacagcccugaguggauuugguaguccugucuuuaucgcucgcuaugguuugcaugccuguaagagggcaguugaaaagccuccuuagggucacagcucacaguggauaaugaugagagggagucaaggauguuaaagugggugagugggugggugggugaguagguaugggauguauacaugguauacagauggauagaaagaugaguagauuuuagguagguggauaaaugaauagcggguggguugguagauaagugaauguguacauguguauucauaaaugggcacauguguggauggacaggugaucagauagagggugggggggugaguggaugaauggauggguggaagagucgaugagcagauacagaaguguggucguggagggaugcauagguggaugugagugcacagcccuucaccccagccugccuauguuggucugccugcucagcuugcuuacuuuggccaggggccaccauagcaucagugaggccaggggaggguccgugacugcugagcgggguggcagaugcauuaagaaaagaugcuaggaaccgggcgugguggugcacaccuuuaaucccggcacuugggaggcagaggcaggcaaauuucugaguucaaggccagccuggucuacagcgugaguuccaggacagccagggcuacacaaagaaacccuggcucgaaaaaccaaaagaaaaaaaaaaaaaagaaaagaaaagaaaagaaaaaagaaaaagaaaagaugcuagaaaggcugaagugggcccagacugcgugacuucauguggaccagccuuuaggucagucccuaauggccugagguccucucaucuggggauggagugagggagccuaggcuagcccaaacucaccuuacugggacuugagggagugcuggggaaguuugguuuccauccccaucuuuguguaacaagggagggaggguacccaggaaaggcaucuccucuccagggcaugcagcccagcugugcccacugcuguucuacccagaugugaaauauaguuugagcccugcuucacuggccuggggaagcauuccaagccccgccuuaaagagacagcagcccagccugagaaaccucagcuggaaaguggcugucugcuguaaccugacagcaggcauagauguaccccgagugccacacccuguacacucugucauagcugaagacagaggccacuauccuaaggggcagaguagguccugugcucuuugaggcagagcugccugaggcgucugguggccccaggacucuuggucuucauguggcuccaucuccccuuguaccuucucuuuuuuaugucauuuguuauuugggcuacccuguuccaggugauuucauauuuucauaugaaauaugcaaagacccuuucucuaaauaagaucacucucacaauucuggugacaucugugaagccaccauucugcccaguccauagagacugggacagucaggagugucauuuggcucagucaccaggcccagucuagguuugcucuuggcuuugugggggccugagcccccuucuucuccaucuuugguuuccccgucagcuaagggagaagcuuaaaaaauauccuaggcucccaccccuccucaggcuccuccaucugcuccugagcugcagcagcuauggccucagaccugccugcagcuagcuccaucuuugggccccaaagccacccugagguaaaaggcuggggccaggaggugagcagcagggcccacccuacacagagggauggcuggcagggauggcaugagccaugcgccugugacucuccccgcaggugaucucugcccucauuucucugccugagauggccagcaucguccuugcucuccucccaacacgaaaugcaguuaacaugaacccaagcucacucuugcuggucccuuguccccuguugucccuggcccuucaaaggcccugcuccuuccccuuuacuauguacugugucucuagcccuuggcacagagcuggccuucagggacugaggggcgaguacauggaugagcagugacaguggggugggcagagcuucuuagacuuugguucuaauccuguguacacagcguguauucucggugagccucaacccuacaccuaugaagugggcgaugggcaucuggggaaaagagaggagccauaggcuguuaucacuguggaaggaggguggaucagcaggagagagggccuaauuagagucacccugugaccacaggccccagcacuaguccccagcauauggggaccugaagcccaggcagcagugugggauaccauuuuuggagcaagcugcccaccugagagggcucaccuucccugaaaacggcuuuaugagcagcaagauuugggaacagccgcagauaaagucgucucagagaugguuucugaugguuucugaugguuaucagcccgcagagucggacacugaccucuuuguugggggaacaggagcaggcucagauccacaggagaauuuaaaguggcugaugucauccagggcuggggggagggagaguuggagccaggagggagagacaaaugauggcuggaggggcagcgagugggacagaugccagggcucuucucugaccuagacacaccugaacagaggagccgggggccgggagcugaacuccuccuccgaggccuaccugagagacccagacagggagaagagugaccacaaagcccugucccaagccccaaccuauccugaugcagggcaaugacauucacacacacacacacacacacacacacacacacacacacacacacacacacacacggaaacagagaagggaccugcauggaggcgcaggaccucuguuuuggggcagccaggaacucauggcccauuucccuggggacuugaugugcuggacagcaaccacugcucccuccuagcacugcuccccaagguugcaugcaccccaugccacagugcugcaagggggugcgguaugguguuccaugcacugggacugccacagaaagagcagcuugugcagcgucagcaaaguggcgugcgugugcgcgcucguguuuuuaucaugcggugaacacgcugcuccggagagcgauaagcguuaaaccgaccgcgaggcugucagucucaguuugaggguuuagaaauauugggacgaauaauuagauuucauaucguuaccacagcacccaucagaggaucaggcagauuaauuuucucacccuccuccgcucauuaauauucauuagaguaguggaaggcugaggcagggagggccagacccagccaccucacugacagccaucugcuggggccaggaacagcuagccugugagagucagaggcccccuguguggcugcccacacccgucugcugcuuacucugugcuauccaacugugaccuugaaagcucaccuacccccugcaucccugggagccaccuccugacggaagccagccgaucugaagcaggcucuuggguagaaugcacucccucaguggacguguggcaacugccagcaagguccagggugcaaggcaauaccuagguccagagaugccuuacuguucauguuauccuucaagcagagcauaaguaagcagccguggccaguauacacagcucuagggcuuccuguauccucacauucaucugugcccagggcagaaaggcccacagagaagggcacagccucccuagcccccagcucucccaccgcccugagaugguggcaggacaaggaaggggauuccuuccccuauccugacagcaacuuugucaugugggccucaccgugcuggcauacaggaaacugaagccagaggugcagguguuaccugcuaggacuccagggcuccccuucagaaccagcuuaucuccacucccugcuccauggcaagccacguggcagcaggcaggugacguggaagccaccgggcugggcugucaugaccucaugggucacugggaguucccagcuaguaggccuuaucuuguuggcucuguauaugccaugugaaugcgaucuguaaagaguugguccacaggggucacaggagaaaggucagaccugaacccugacguuuggccccagagccuaugugggcaucacacacaaggggacccaggagugccaagcacuguccuggcaguuccccuuacagucagcagccuguuucuccuccuguuccagccuguuggucaucuuccuuacccagugagcucauugccaugaccaccgcagcgguucuuaggagccgggagugagcaggggcucuaagcuuuggguuaagaguuccuggggugcagguuucugagugaaaggcauuuauuugaaucaaacagcgaauggccgacaggaugauacacaggccugcucugccuuuacacauagugcccgaguggcuuaguccaggggcuaaguaagcucagcgaacagggaggugcccaaguggcagcagucacccaccccacccuccaaggauagacaggacugggccucugcugucccugccuuccacuggcugugucucauccuccaccggagaccaaaucccagcccagccuuccagccugggcugcacagagacauggccacguacacuuacuuccucugcugcugggcugagagccagggugcagggggcaggaagcaagcagcuuugguggcccuggggggcugagcccagagcucuucccuuccagguucagauggagcugcagaggaaguguguggcacagcccuaggcuggaacuucuaaccccaacccccuccccuuuauucugucucaguucccuggcccauaugauggggaagagggcacagagccucagcuacccacuaccccucgcucccuggcaacacagcugucuuggguuggggcagccaaucucaggagaaggacagugcucucaaugaacggacagggccaaaaguuccacccugcaccagaaaggaaagcucuacuguacagagacaugggcucgugcucucccucucucccucucucccucucucccucccucucucccucucucccucccucccucccuuucucaguuccuugcaggaaucuagcaguugcgugguaugggccauacccuuggugccagcagcucugcugucacagaaagagaacacacaucagcaggcucuauagauucagugcuugacagcucuagaccuuuguucccaacagagaccaaugcauagccugggaaugcacagcucccugccaugccuccaguuaucauaguguuugaacuacacaaguccuacugcuaugagcuaccaggcugcugaccaccacuacacaacagagcaaagccccccacucggcauccuauauagacugagccuuucccaucuccacucuucucuagggcccagcugugacccugaugguggaugagagcugcuggcuaaggaugcugccccagguccuaacugaagaagccgccaacucagagaucuacaggaagggucuguaucucaugccugccucccuccccgcuaaggucuuucagaaggcagggucacuugguucugacugguccagcucuuaaagggacaccagcuuaucuggguaacaaucaaacugccugagagagcacccugaaccccaucugagaggaugauggacaaccuuuggagcugcaaucccaugcgaaucauaaccacugacacaagagcuagagggaccacccugggcccucuacagccagccccugaacacaagagcuagagggaccacccugggcccuccacagccacugaacacaagagcuagagggaccacccugggcccuccacagccacugaacacaagggcuagaggggccacccugggcccuccacagccacugaacacaagggcuagaggggccacccugggcccuccacagccacugaacacaagggcuagaggggccacccugggcccuccacagccacugaacacaagggcuagaggggccacccugggcccuccacagccacugaacacaagagcuagagggaccacccugggcccuccacagccacugaacacaagggcuagaggggccacccugggcccuccacagccacugagagcucugcuucucuacgugggcuuagggggagacugagcaagaagagcuuccggggaccacugaaggcagccugcacuagaaaggaacacgccccaacaccagauuggauguuggcaagccgucagccaugugcuugcaccaccaggacugaccugcccauaggcuucuacaacacaguucugcccaagugugccauccacagaagacagaggcccuuauagggaugauacugauaaacaugaccugaucuggguggggccugcagacagggucacagugaccacaggaauccuguggacauugucgcuugauuuuuccuguaucacuuggcccauaaugggacuuacacaggcucuacccugcagcucagcuccuacugccaccuuagaacauacauacucccuuuucuuuucccacuuucugcugggaguggccacuggcuugagacugaggccagaagugucccuacucacagcucacaggguuccaggccauguggcagaacugcuggcccaggacaccuggguuuuuguggauugaggcugcccucuacaggcuacugugggaacagcaccaggcccaugcccaacagauugaaaaccugccuguucuggagcccaaugcguuaggacaccccucuaccccagccaagugauagugauuacauacaacccccucauauaucccugcccaugucuacccuuuuacuggagauguaagcucccccaauccuugccucagacacaggauagcacaccacaaauccagccagccacgaacgugagccugaaugcagccacuuccugccuuuugcccagacucagucaucccuggccauacagcagggccccagggugggagacaaagggaagcacccccauuaaaggcccaggaucaucacaagugccuguacccuacagaugacgcccucuggugcaggguuaccaaaguggugccuucugguggacugcuauaugugcgccuugucaccgagccccauggugcucccagacacccugugcaggaaccaguagaaccuggaggcuuggccccagugcacaccgacauccagcugcugccccagcaggcuggcauggcauccauccuugcuaccgcagucaucaacaguaaguaugugacucccaggggcagacuuugguugacacucaagucaaagguuagggcagauccuggggggggggguggucagcaugcaaaagguccaguuuacacacacggggaggggggggcaggggauaaauuaugcuccaguaagacacugaacugaaggacaguacccagcugaugcagagugacccgagugcuagauuguacauggccugcuaccauaggaagggcucagccccaagggaccuggugcgggcccccugagaaguagaaagagaaggugguggcaggcauggguguaauauaugccuaaaggcagcaguaggagcugaguccucauguccccugugcagggacaggagaauccccagugccuggguggguccuacgauuagacggggccuucagggacacaaugaaaggagagcuaagccaccaaaagccaguaccucagccuggagcugucaaggccaggcccuuccucauccagucaguaccucacccccacuuguaccccuaccagaggacgucuuccccugcaaagacugcgggaucugguaccguagugagcggaaccugcaagcccaccugcucuacuacugugccagccgccagcgugcaggcucuccugucucggcgacggaagagaaacccaaagagaccuaccccaaugagcgugucugccccuucccccagugccgaaagagcugccccagcgccagcucgcuggagauccacaugcgcagccacaguggugagugccccgugccugcccuggccaagccaggcccugcacuggacugguggucaggaaagcuugcucugccaccaugugcuaugcaguuccccgucccuccacagccuagcgcaaggcuuaccuguggcuauaugcacacuuaauaaaaggcuggguguguacuugacgcugggcggcauaugacugaugcgaacuaaaagggccaguguuccuuccuugucacugggauccaucucuguguuccaggagagcgccccuucgugugccucaucugccugucggccuucaccaccaaggccaacugugaacgccaucucaaggugcacacagacacgcucagcgguaggugugcuggagggggccgggauggggucucuggggcuaaaccugagccccaggaaccugaccacaacaguguggccuacaggugucugucacaacuguggcuucauauccaccacaagggacauccucuacagucaccuggugacaaaccacauggugugccagccaggcuccaagggugagaucuacucaccaggggcuggacacccagcagccaaacuuccuccagguaagcagccauacuggagccucacuggcccuuggauaagugaaggggggaggggccuguccauaggcaucacaugguguccuugucaacccuagaaccccaaucccuucugccuaccacauccuaccuagggccugcccugggccugacaugcagcccuguguucuuguagacagccuggcaggcuuucaacagcacucgcugaugcacagcccccugguucccgcugacaaggcacccaccccauccucaggacuggacaguaaggccgaagucaccaacggagagaccagagugcccccccaaaaugggggcagcagugaguccccugcagcccccaggaccaucaagguggaggcugcagaggagccugaagccacccgugccuccgguccgggagagccagguccccaggcuccgucucggacaccuucaccacacagccccaauccagucagggugaagacagaacuguccagccccacgccuggcucuagcccagggccgggagagcuaacaauggccgggacacucuuucugccacaauauguguucaguccggacgcgggcacaaccaccgucccuacggcgccacaggccucggagauccuggccaagauguccgaguuggugcacaaccggcuacagcagggugcagggagcuccggcgcagcgggaacacccacuggccucuucucggggacuaagggugccacgugcuuugagugcgagaucaccuuuaacaauaucaacaacuucuaugugcacaagcgccucuacugcucgggccgccgcgcgcccgaggacccgcccacugugcgcagacccaaagcggccaccggcccggcccgcgcgcccgcaggugccgccgcagagccagacccgucacgcucgucgccggggcccgggccacgagaggaagaggcgaguggcacgacuacuccggaggccgaggccgcgggccggggcagcgagggcagccagagcccgggcagcuccguagacgacgcagaggacgauccgagccgcacgcugugcgaggccugcaacauccgguuuagccgccacgaaaccuacacugugcacaagcgcuacuacugcgccucgcgccacgacccgccgccgcgccggccacccgcacccacgaccgcaccgggacccgcggcuccugcgcugacagcgccacccgugcgcacgcgccggcgucgcaagcuguacgagcugcccgcagcuggcgccccgcccccagccgcaggccccgccccugugccaguuguacccucccccacugcggagcugcccucuucuccgagaccugggagcgccagcgccggcccugcccccgcgcucucuccgagcccgguccccgacggccccauagaccugagcaagcggccgcgucgccagagcccggaugcaccaacagcucugcccgcgcuggccgacuaccacgaguguaccgcaugucgcguaagcuuccacagccucgaagcuuaccuggcucacaagaaguacucaugccccgccgcgccuuugcgcaccacugcccucugccccuacugcccgcccaacgggcgcguucgcggcgaccugguugagcauuugcgccaggcacacggccugcagguggccaagccagcggccagcccgggcgcugagccccgcacaccugccgagcgugcuccgcgcgacagccccgacggccgcgcaccacgcucuccuuccccugcucccgagaauacgccuucugacccagcagaucaaggcgcucggacacccagcaagggcccgccagcuccugcuccugcgccggguggugguggcggccaccgcuacugccgccugugcaacaucagguucagcagccuguccacuuucaucgcgcacaagaaguauuacugcucuucucacgccgccgagcacguaaagugagccuguggggccgcaccaccaggacccuugacacuuaauaaagacauucggugugauaaauucgcuggaggcccagccuguugucuuagaucuagugggccucauuccauaccccagcuugugcggcccugcaaagggcaccccaccguuuccuccaggacuuagcccgcuccagggauucaaccgccccugcagaguucuuuuccucugccucuagcucacccgcugcccugccagaaagugcauccaauugcagacuacuagagagagugaaaccuuguucuugcugagucuucgagaaagaggaccaagucccaaagugccccucccgucacaacagggguggguacuuaugacuacagaguugggccuggguauacccccuguaguccguggcuggccggcuguaggccacgucuggcagaaccaaagcaauggcagucuagccauugcuuuggccucucugcuugguccccugagaaggugugaacauggcuguucuccaacucuguaagucuuaaccggcagcuguagaagcugacagagagcccugaaaauaccauaccccaaggacccgggcccugucggccaguccaccucuccugcagccuucugaggcggccugcugauggaccuggguuuacacaagaauaaauguuccugagaguccau

SEQ ID NO: 4851 - RNA, 3610 nt, Mus musculus
ggaucauccacagcagcugacugugauucaccuggagcucuggcaggggcgugguuuugccagcugcagauagauucugugaccgugugauguuuggaauucugggaacuuuuccaaggguauauacaggcuuggguuccaagaguugagguugguugagguuuguuaguagucgugcugaaagaaggaaaaaaaaaaaaaaaggaaaaaaaucucagacucagggauuuucccaauuccucucucccuucuauccuuguuucucuccuauuuaguguuagggggugaaaccagggcauaaaggguggaaaaaggaagguggcccuugaugcccucccuguccuguccagugaguauucugggagggaugaagagagccacagugucugugacaaggguaggaagagcagagacacucagcuagguacacagacucugcugggacucugucccggcgagcuuagguggaaagucacuguccacagcaagccagcuacaccccuguccacuucugucacggccuugcugcaugagucugaccuaaugcugaguagggcaagagaugucaguacacacacacugcacaucaugccugccuguagcuguaauggacacaccgaaggggacacuggccuuaucccuauggggcaauggggacucuauaugugacugcaguguccuccaguaguguggguguauaguccuguacagugcccgggcuucacagugugcucuagcucaguccccuuccccacugugcagccuggacugcagcccagcacagugagccuuagcaauggcaaugcacagggcaucuagguucgccaaugcccacugugaugguuugacuaugcuuggguuaggaagugguguuauuaggagguguggccugguuggaguagguaagugugucgcuguguguguguuuguguguuaaagccuccuccuagcugccuucuuggcuccuucuccagccccauaucugccugaacacugucaugcucccaccuugaugauaauggacugauccuccgcgccuguaagccagccccaauuaaaugguguccuuaucagaguugccuuggucauggugucucuucacagcaguaaaacccuaagacaccaccucagacaaugcagcaaaugcauucagaggggguggggugggguggcagagugaccuugaagaugucuauagcccaucucaaguaagaacuggguugacauagaguagcuguuccucccuagcugacuuugggauaaacuguccuagacucucuagugaggggugacaaggcugaucaguagcgggagcgagagagacagcagagucuggcucugaagagggaggagccacgagcuaagucauguagaaacuucuaggguagugguucucaaccuuccuaauacugcgauauugcaggauauuucaucacauugugaacccccaaauuguguauuuacugaaaaaaaccugguucuggcugugguguggcucaucccuuagcacacaccuuuaaucucuccgacaggaagacagacacgcccuuaguacccaccuuuaaucccaaacagugaagguaaaguuaguuuguagaaggaagcacuaauguuugaaagugaugucuaauugaguggcagaaaaagugacgaaucagaggaagaucugacagaauaggcucugcccccaacucaggagagacaggaaagggaagcuaccuaaggggcagugcagagaagaggcagguuuacugagacaguuauagagagacagguugcagaaagggaacaagccagacaccagugaagccagaaggagccagagaaugaggaggagucagaagauuuggacaaauugccagaguuaguaugagcccaagcagagcacuucaggagacucagagagaagccagacugagucagucagcuuggaaaagaguucugagcagaacagcugaguuaaaucagccagcuagaacccagaaagaacuagaagggugagcuuauucagcagcaagucuccgaggcugaaaacauucuaggccuagauaagauuguguggaggcuagaaacuuccaggguaggccuagugagccucagagacaacaguuacaacaggagaauaaaaaaccuacaguuuuucgcguugugguggcccccaaccaaaacaaauauuuuuguugcugcuuuguaacuguaauuuugcuacugugauaaauugucauguaaauagcuguguuuucugauggccuuagggacuccagugaaagggucguuugaccccuuaagggucaaaccacagguugagaacugcuauucuagaggcuacagaaaucaaggucagguuucuccuuggagucuuuggcaggaaccgcuccaccgacccuuguccuucagcucccugugacagcccagggcuccuguacaucaugacuaugauagaauccacauggaccguuuaagccacuagccugaggccucuguuuaaauagccacaggagccuuccacaggagcccauacuacagcagcgacagagggccucuggcauccagagugcagguacaaaagucugcaggggcugcaggaguguaguaaaauuaaauacucagaacaggcagagaagaaaacucacugugggugcuuugcuccugagccacccagagaaugugauagguguggaagaggagacgugggagaccagggaagcaagacaaauggcagagagagagaacagacaugauacaaguucaucccugcaaaacucugcaugacauuaaaacguggcagaguuggagugacauucagacgaucugccugugggaggcagaguggggacaucuuuccuaugggagcaagaggucaaaggaccuguguguccucauagucccaagaauagaagagugucuccggagugggagccacacuguagaaggaccacuggagcccaggcagagacaaggcugggcucucagggaaggcagcuagaugcugccauggaaaccuagaugcuaaaacagcaauaaagcaucaaggagcaaugccaguucucaggaggcugaggugugggggucgugaguucuaggucagccugagcuacagaacaaaacucugccuccucucaaaacagcagcagcagcagcagcagcagcagcagcagcagcagcagcauuaacaaaagcaugcagcuuacggucaaagccgucagaccgagaacaggaacuugacaguguggcucacucuggugauguugagguuccugucauggaggggugcagacauuaaagcuuuaggaaagaguguuaaaucccagugccuagaaagugugcucugcaggugaugcugaggcaggugauacagaagcaugcucugaggaccugcccaccucugccuccagcccaaaugcucggcuuccggcuuccagcuuucuucucaggccugcagggcuucuccagaaguccgggaggcaucggugcacuugggguucucaugacuccuuucucuuccucagggauuguagcauacccuugguggugggcaggccacccuagcuaagcacgguggcaggcccaccaggugcuucugugagccauacugcccucuacugucccg

SEQ ID NO: 4852 - RNA, 2407 nt, Mus musculus
gaaagaaagaaagaaagaaagaaagaaagaaagagagagagagagagagagagagagagagagagagagagaagaaaagaaaaucccauccagcacaccuggggacaggaaagaggaugugaguaugggagaaaugggccagggacaccaggccauaggaggcggggcaccaggaguguagcuuuuaucuuguggcugaagaagccacugcaggaguugcugaaauuggguucuaaaugaagcaagagugagaagaggggacuuugguauuaacucaggcaagagccagggauggagagcauagagaacaggagggaaguucagaauccaucuggaaggccgacucguuccccaguucaucuccccagccucuacugauugcauuucugcgguggccaccaacaucuuaugaaguguuugucugaccaucucagagcucuguaugacucagagacacagaacugacagaaugaguguguaugugguugcgagccuucaugugguugugaggaauugaacuuaggaccccugcucacuccagucaacccugcucucucagucccugcucgcuuacuauaaauaaguacacuguagcugucuucagacauacccaaagaaggcgucaaaucucauuaugggugguugugggucaccaugugguugcugggauuugaacucaggaccuuuggaagagcagucagagcuuuuacccgcugagccaucucgccuauuuuauauuuuuauauaaauugaauauuaugcagcuugcacugccaugcuaacuacucaagucuggucucuuaguuacugcucuauugcugucaaaaagcaccacaaccaaggcacuccuuauaaaaaggaaucauuuaauuaggggcucacaguuucagagauuagucaguccaucaucauggaggggagcaugguagcaugcagguggacaaugucuaguuuuagaccccauuauaagggaccaaggugcauauuuuacauagcuaagcagaccuggcaacuccccuggccucaguccuuggggucagugagcucgcgggcaagcagcuucccaguaaaccuggcuugaauaagaucuaaucuggcuugauucggcucauuucacuggguagcuugagcaguugguguuaauuuucuuccagaggugggaggccagcguggccuaauccuggcuugcagauggcugcuuucucacugucuccucagaugguggugguggugguguaugaaaagagauauacauauauacaugcacacauacauaggagagaggggggagagagagggagaaccuucugucugaccugauuggcagccaccuuuaaucccagcacuagcaugaucucucaaauagcucuccuugguaucuauugaaggacaccaaucuaugagauccagaccccaccuuuauacccucacggagaggcucugcuuugaaauccauaccagcuuggugcuaggacuucacauguaaguaacuuggagggugggcggcauaguucagucgcauuauggagucaaaaguauucgacuugucaugacuggcgccuuccuaggcguccucgguguuuguagcaugugucugaacuucaucccuuucuguggcccaauuaaugcaggacuguaagaccagaacucccccccccccuuauaucaguuuaugggcauccgggugguuucacuuugaggaagacaggcagccccuaaccaguaagaccaagaucagauucaaaauuugcaaggggucaguaccuaaugaucuccguaccuuuuaucaggucauggggggggggggggguuggacuucgggcuccagcagcugagccccaucuggguaguaggaggggacugaaaaaugacccaaucaguuuaaguccuccccagggagguuacacugggucacgguaauuuaacgaugccagagauguuuagcgucacagaaacagguaagaggaucuaaauccuucaacuccaaaaucuuuuuuuuuuuuuugaggguaccagggccucgcacauacuuggcaggugcugucucaaccucagagcuacacuccagcccccaaaacacuuuuggucaaguauugauuuuuuuuuuuccgagacaggguuucuguguagcccuggauguccuggaacucacucuguacaccaagcuggccucgaauucugaaauccgccugccucagccucccaagugcugggauuaaauacagcccggcaaaauauugauauuuaauaaggcagaaaguucgugcccugaagaaacgaaugcuaaguuuucagacccuggaaguguccacucgcacucaccaagagccucaaagggcuuucccuuuccggcacgcaucccgccugcuccucaucugaucucaucccaagcaacuaccacgaagag

SEQ ID NO: 4853 - RNA, 2407 nt, Mus musculus
cucuucgugguaguugcuugggaugagaucagaugaggagcaggcgggaugcgugccggaaagggaaagcccuuugaggcucuuggugagugcgaguggacacuuccagggucugaaaacuuagcauucguuucuucagggcacgaacuuucugccuuauuaaauaucaauauuuugccgggcuguauuuaaucccagcacuugggaggcugaggcaggcggauuucagaauucgaggccagcuugguguacagagugaguuccaggacauccagggcuacacagaaacccugucucggaaaaaaaaaaaucaauacuugaccaaaaguguuuugggggcuggaguguagcucugagguugagacagcaccugccaaguaugugcgaggcccugguacccucaaaaaaaaaaaaaagauuuuggaguugaaggauuuagauccucuuaccuguuucugugacgcuaaacaucucuggcaucguuaaauuaccgugacccaguguaaccucccuggggaggacuuaaacugauugggucauuuuucaguccccuccuacuacccagauggggcucagcugcuggagcccgaaguccaacccccccccccccccaugaccugauaaaagguacggagaucauuagguacugaccccuugcaaauuuugaaucugaucuuggucuuacugguuaggggcugccugucuuccucaaagugaaaccacccggaugcccauaaacugauauaagggggggggggaguucuggucuuacaguccugcauuaauugggccacagaaagggaugaaguucagacacaugcuacaaacaccgaggacgccuaggaaggcgccagucaugacaagucgaauacuuuugacuccauaaugcgacugaacuaugccgcccacccuccaaguuacuuacaugugaaguccuagcaccaagcugguauggauuucaaagcagagccucuccgugaggguauaaagguggggucuggaucucauagauugguguccuucaauagauaccaaggagagcuauuugagagaucaugcuagugcugggauuaaagguggcugccaaucaggucagacagaagguucucccucucucuccccccucucuccuauguaugugugcauguauauauguauaucucuuuucauacaccaccaccaccaccaucugaggagacagugagaaagcagccaucugcaagccaggauuaggccacgcuggccucccaccucuggaagaaaauuaacaccaacugcucaagcuacccagugaaaugagccgaaucaagccagauuagaucuuauucaagccagguuuacugggaagcugcuugcccgcgagcucacugaccccaaggacugaggccaggggaguugccaggucugcuuagcuauguaaaauaugcaccuuggucccuuauaauggggucuaaaacuagacauuguccaccugcaugcuaccaugcuccccuccaugaugauggacugacuaaucucugaaacugugagccccuaauuaaaugauuccuuuuuauaaggagugccuugguuguggugcuuuuugacagcaauagagcaguaacuaagagaccagacuugaguaguuagcauggcagugcaagcugcauaauauucaauuuauauaaaaauauaaaauaggcgagauggcucagcggguaaaagcucugacugcucuuccaaagguccugaguucaaaucccagcaaccacauggugacccacaaccacccauaaugagauuugacgccuucuuuggguaugucugaagacagcuacaguguacuuauuuauaguaagcgagcagggacugagagagcaggguugacuggagugagcagggguccuaaguucaauuccucacaaccacaugaaggcucgcaaccacauacacacucauucugucaguucugugucucugagucauacagagcucugagauggucagacaaacacuucauaagauguugguggccaccgcagaaaugcaaucaguagaggcuggggagaugaacuggggaacgagucggccuuccagauggauucugaacuucccuccuguucucuaugcucuccaucccuggcucuugccugaguuaauaccaaaguccccucuucucacucuugcuucauuuagaacccaauuucagcaacuccugcaguggcuucuucagccacaagauaaaagcuacacuccuggugccccgccuccuauggccuggugucccuggcccauuucucccauacucacauccucuuuccuguccccaggugugcuggaugggauuuucuuuucuucucucucucucucucucucucucucucucucucucucucuuucuuucuuucuuucuuucuuucuuucuuuc

SEQ ID NO: 4854 - RNA, 40759 nt, Mus musculus
agaaagugcuuaucaaaauauuuuauuuuaggagauagcucaaaaaagacccuccacauuggacagacaccccaacaauaccccuggccuuuauuauuauuauuauuuuuuugucuuuucuguuuuuuuccuuuuuaaucaacuaaaacaauuugaugcuuaaaauaaaagacaggaaauguuucccaaucagacuuuaggcaagaauauauauauauauucuucuuuaggcaaguauauauauacuucugauccagggagggagggauggugccuguaguccagaaguguucggcuuuccuguccccagaggaagcugcugaaaacugcagcccaggaggucaccugggagaagugaggacggaggcagaagggugaggccagccccugcgugccugaagcucuuaaguuacacagaguugguguccccuguucagugcugaucuguccgucuguccauggagacucuauucuggaagaagcugguucagucugguggggagguugggacucagccucaucuucaucuuguguguggcuucuuuuccagcugagaaacuuuuuuuuucuuuuuuaauuuuuaaaaagaaucacagccaaaauaagacauugacuggaaaauccaaaauggcugcgcuuacccuacucuuuauaaaaacaugaagagucuacuccaggagugagcugggccacuacacuuucccggggaucuuggcccgcuugcgagcgauggcguccucaaccgcuuugagcuguuuaaggagcuccucucgccgugacaaugugcuggccuucccugacuuggugccugcuguggcaguaucuguggcuuugccaggcacgcuggugaccuugcuggagcccuuagacuggggugacaguggacgcuuccuguaggauugagaaggugugaggcagaggugacgaagagccugcccuuggguaagugcccagggcuccccacuucuucuguggggagacaaggaggguguaggcuagcccgcagccucuccuauuugccccacuauauaggcacccugagaaccacuggcccuugucuaggguucuucaacaagacaguaauaugcaguugugcccgacuagucugagggguuaaagaggagugggcugagacugcugucuguccuuccuuccugucuuccaugucucccauacuccuaaagccgaucaauuguccaggacaagccugucauggaaguaggcagagacuuaccuguccgcuggggcagcaggagcuuuagcguucuggccucucugccucucugguuuuggggagcccauucuuccaccugauuuccggucucgagaaccuaguaagcaaggggacagaaugaagccacugcuuuguauguggggcugucagagaacccuaguccaaagcaucaaagugaccaagugugguuagcucuaacucuggcaccugagguagaggaaggaggagcaggacuugaaugugguccuuggcucauagugagauuaaagucagcccgggucaccacgaggcccugcucagaaagucacaguaucagggcagcuggcacuuuucuuucuauaaagaauaaaacaggaaacgccagggugggugacaugagucagcaguuaagagacuggcugcucuuucagaggaccucaguucaauuccuagcacguguagggcagcucauaacugucuguaacucuaguuccauccaggggguccaauacccucacagacaaugcacgaaggcaaaacaccgauggacauaaaacauuaacaaacaaacaaacaaacaaauaaauagugaagacaagacaagacaagccaggcaaagccaagcgcuccuucagaaagcaggccuggagcuggacucaucucaucaagucuucuccuuagugagaccccucucucucagcacacgcaucugacaaugcagagaauuagaacuggaagccaacucaagaguggagugcucuccuuugucaggcugggcuagguagcagagaagagggcaaggccugagcaugacccaauggccauggcucugaggaaagaauucccucuggaguucaaagcccaagggucaugggcccagagaccugccugaagugagccccagagccucagcagcagcagucaccuccucuacaccugcuucagagaggcagguauugguuuauauugguuuuugcucugucuauuaaagcaaaccaggagaaucccccaucuuuccugcugggcuugagaugggguguccugggagauuuggagggucuccaagacucucuuagucuccaagguuaaaacaaugacucagagccacugugccuucccacaugccaaugacccuaaggugugcagaggcacagcugggucagucuggggugagguuucacugacugacugcugguugugcaggcuggguuuuauggcaacuugacacaaacuagagucaucugacaaccucgauugggaagaugccucccuaggaucugguuguggguaagccauggggcguuuacuuaauaaguaauugaauuaggaaggcccagcccacuaugggugcugcucccccuaggcagguggucaugggcgguauaagaaagcaagcugagcaggccaguaggcagcaccacgucacagcuucugcauuaggcgaccccgagcuuccuguccugaccuccaugaugaacagugguguggaaguguaagccaauaaaccuuuucuuccccaagccacuuuuggugaugguguuuuaccauagcaacaguggcccugacaacgacgacgauagccgacgugaggaggagagcggaugcacucagucauuugccugcugccucaugcagcccagccuggucuggacucuggauagccaaggaugaccuugaacuucugacccuccgucuccagugcugacguuucagauguggggccaggaaccaaacccagggcuuuugugcaagcccucuacuagcugagccccuaccugcccccucacccacuguuuugguuguauacuggaagguuggucauuauuaacagacugcauuugugucgcugggcagacauuauuuaucaucuguaaccaggaucuugugcgcuaccacugagcuauauuuaaagacuuaaaaccuuucccaucacacaccuauaaucccagcacuuuggagguggaggcaggaggaucaugaguuggagacaagccugagcuaaagaguaagaaaaugucuaaaaggaagagcaaagcucggugcgaucgcuagcacuacagugcucaucacagacacacagugggguuuuuagguuccgcuacaguuuucagaauauacuggugucaagcccccgcaggugggccuucuggcuuaugggugacauccauaguauaaccucaggcacaagaccuccaaggcuuaccucggucuggggacaaguuggccuucuuggcaggagggcucugccgguccuugucugauggcucauagcgcuuccggcuuccuuuaucagccgccugaaacagcacagugagggcgguagggcccagaucguuguuaggccaggcagaggguggcgguguaucuguuguuacuggagagugguucuuugcucccaugagccuccucuuggcugaaccccugacccuccaaagcaguucuguggcccuugccaccaugugauggggcccucugugcugcaugaggaagugccuugcaggaucucaacaugucaggccuuggcccuuccagacaugugcagagcuuugaagaugucugaugcugggguggggucaggacccaggcuggccaggccgcagguacaggcacauggaugggcgaggucccuugggcggagaccccaguacccaggcucaggugcaguaauacaggccuguccccuugucucaccuuguucagcagugucagcuuuaucuccuugugggcaacaaaggagcccuguuggggcugcccggggaccgccggcugaggcgccgcugccugcugggaggccuucccacccgcuggagcuuuagaggacuugggcggcugcgcggaugggucccgccuccgcuuuuccucucucacuccgucuucuuucuuggauuucccugucaacgacaaaccucagucacggguuccuguguacaugaccauaaagcaaagucucugucgaaagcuaacccccaagcccacaucccaagggcaagggcccuugccuaccucucuccuucuuggucugggcaggaguuggggaucgagagcuggcugaggacacaggacuggccaggucugcauacaugucaucugaguccacacugugcacugagcugcuacucgagguggcgcuggacacugaggaaacgcugcucacacucagagaccuagacacacaagcacagcugugcgcucagccccacggugacugcaagauggcugggcugcaggcugacaggagggucuccauggcuugucuuuacccaauuuccauguuuaugggaugcacacagacauaauacauagugaaaggacagcucugagucucuacuucacuaaccuggaugacccuguacuggggacugagcccuagucaacacugauaaaaagcacaacuuuaagcuaguugaugguggugcacaacagucacaacccauagucccgguaaccugggagacaggcagaucgcugugcuucaggauaacgggugugagcugcuggaggugugcuggagccccucugcucccagcuucuugggaguucaagcucaucugggcaacacagggaggcaacacagggagacucccaauucaaacgagccugcagcucagugacagggagcuugagcagaaugcaaggcccuggguuuuagugggaccacuaagacaccuuguacucuccucagggcacaggaguaggggagggagaguagauggugauacaguuuugauacagggcagugccaugacaugucuaucacaaacaccaaccagcuucuucuaagggcaucaggagacagaacagaggagcagagacagggagaagauagagucagggguucuuuaguuuucaaaaacaaacaggccgggcaugguggcccacaccuuuaaucccagaacuugggaggcauaggcagguggaucuccaugaguuucaggccagccuggucuacaagagugaguuugggcacagagaaaccuugucucaaagagccaacaaguaaaaaucccauaggucuuuaaaagagucuagauuacuaaggccuuggacaaaagcuaaggcccugaugcgggaggacagaggaaaaauggucaccagauuccaaaagcaucaagcugacucuaccuucuaacuccuuuuugguuuucuuuaagggaucuuucucccaacugcuucagggcugacucccuccaauagggaucagcaggccccgagaacacccgucuauccucaggaaagguguggguagagaaccugggacuggccucagcuuuguccagauggggagcaggagcagucucggccucuucccaaagguuagguaggugcuguugugugaagggagaccauacucgcccugagcuguguguucucggauacugaagagcccuaacauggucagcccaccuggugagggaaaaaggucaauaggggguagcaccaagcaagugaccuggaucgggaacuggagccacuguagcugcuaccacugccgcuaccacugccgcugagcguccgccugcaacacaagcagcauaguucaccucagaggcggccucacugaggcagagccguccugcacaccaggcugcuaacaggccuguuccagguugggccucugcuccuugcugcuucccuggggauggacccaccucccaggcuccagucuucaucagcaccaaggacaaagagaacugucccaggauugccauaagcccacacugcucaccuccuugggggaguccugguuugccgcuccuuucuccuggcuucucggagaucuccagguuuggcaggcucaggaccaggagcaguaguuuugguggccugugguggggcugggggaggggcuggcuucuuuauugacuucucccugugaggcaaggccgggucaaggcaggguagggcuagggucccugcucaauaaacccacaucucaggguucuacaguuuaagcacggcacaugacugcuaagguuccacgcuacagggacccaagucuaggugcugagcccgugccuccgcccaccuccugggagccagaucugcugcccuuuggaggcuguucacucuaguucaagcaugggauggggagaguggaggaggccggaaucccuggagaccccaccgagguggagcaccacagcaaacugagggggcucaggacucacccugcuuucccaggagguggggccggcucccccuugguucugacuggaggucuguguggggaaggugugggagacggggauggggacgaggagaaggaccgggaccuggggaacaaagacagugugaggaagaagucuggugcuuggcaaauucccuuacuggcuggagcuggcacauccccuaggaaacagagaccuuaggcucaggcucagcuguuucaccaucugauagaacacacacucugauaggagagaacagaaaagggcaucgcgcagucucaggaauggaggcuuguaugcaggagaaagcacaugguucugccuuagcauggggcuaaauggguggagauggcuuuggcuaaguguagaauccaagacaccuagaagccgggagguggcagagcugguaagggucccacacgccuggucggcaggcacaggcacagcacagagguagguccccaagaagugacagcaugacauaagcagggaguguacagcggggagauuauggccggaugauuuccacagugucaggugucagcaggguagacaagcagcccaggaaagggugcugguccaggcggaguuuccaggaugaaguucuaacagugagcucacacuucagucgagaggaucaaagagacuggguuggccuauguuaccuacucagaaccaccacauugaugccugugacgucgagcuagguggggccagcaaugggucagguuccugcaguccuccaugcuuucaugggcaaaggcagaugcccgggaaaccuagcauuuacucucaugggcaagcacuacaggaggcccagaauacugcgacccaggggacccuccaagccuuggcagcaggccagccuccucucccucagccccugcuucuuccucagcaggccuccugagugcggcuuugggaggggcugcuauagaugaacuucaggaaggacagcugcagaaccccaaggcuaggacuccaggucuccuuccucacuucaaagcuggacacccagaaugacaggucuccagaaggauaguacggacaccaagugaggcuacgccacugagaaaggcaugcgcacugugggaauggggagaccaugaugaagcuucuggacaauggaugggauggaguauucccacuggugucucccugcaacguuaccuuguagcuccuuggcugaccuguaggaccuuccuguguccugucuacucugggacccaaccagcuucuugcuuucugugcuccauuuacuagcaagggccagaaacacacggacugacaccuggagucuguaccucuugguccaguugcagcugcuucuccgacccaaggcccuaaccuuagagcacagggaguguuuuccugcuaccuucugccacuaucauuagcugcuugcccaaaacaaacaucauauacacaacuuucucuccacacugagucugaccuuucuaaaggccccuuguguucucuaccucuacagccucauauuuuacagaaagcuaaguggccuuugucugucucagagacucccacagguuuuccuuguccuucccacugugaggcccauggucucuucucuuuacugcacucccaccccacccccacccccgcugcugacaccugcacaaggaaccuggcaaugcuugugcucugggguuugugccagcacaucucuggauggccuccacacagccuucucuagucuaccuuccucuccuaguuuccuguuaucuuacaagagcuccuaucuucuauguucaugaagacagaaccccaugcgauuuacuccacaccggcagaagcaucagugaacaucccguaagacagccucagcacugcacgcuaacccucauuccauguacagcaagagcagcugcgugugacggcacacuucuuuccgcccagcccucgagaggcagacacaggugggaguuagaggccaaccuaaucuaauacauagcaaauuccaggccagcuagggcuauauauaaaucucaaaauguccuuaaagaaauaaaaacaagaccauaugccaggaagggguaacguugcaagggaccaaauuacacuaaggaacuacagaacauuuuauucccacacaaaugcuuagugguaacaugucccaaagcaguggguugcgugucuuuaugugucccagguaaugacgaggacugacacuuccgcuuuacugaacaccacgccaaaguuuugcucuuucuaaagagcagugacagcagcgcagggaagggacacgauggagcaucagcucaguugagggacagacggaccacugagcaccgcccuacccccaagccagccugacugaggugaagggcaccugccacuggcagacacacuaucacagaaagaaacuugccuaacucucccagggcuucugggcuggacacuguacauuccuaccugccgcucaacagagaccugaggggcagguccuaggccagccccugcaguguuggcuccucaggaugcaggguacugacaccauuuuggaagcaggcacccaggaaccugcgagagacacgacacuugacccaccccacacacccgugagcacugagccugcuagaggucagcaggcaggacuuaccuggaucggcugccugagaacgagcugugucuggaagagcggcuagaauaggagcuguaggaggaggagcgggagcgggagcgggacgagccagagccagaguaggaugaagaccgugacgaugaccugugggccaauggacagagaaggggcagugacaagguggcguucguuuacuccugcagcacugggaugugcugagccgcuguucucucgugcagugagacagcgaggcuccauagagaagaagcacuuucaaagacagagaugaucaggagcccugcagaccaacccacagugccaugcagagagcaggacugggcgcacccaggaggagggaaccagagacuaguuugagugcgggacaaagccagagugugaguuuuccagcugacccaguguucccucccauggcuguguuccuggcuguguccucugguguguuccgcccagacuccauucggaguuccuuccccugaggugcagacacagcuccuggcacccagcacgcacacaugaguucugucacuaagggaaguucucugagagcugggugacuggucagcagaguguguaguuccucugucagcaacccacagccuuucccacaggaucugagaggccuucccucccugagugaccuguaugacucgagcagacagccggugucuauguguuaggucacccaucuuucuuacugcuguaagcucuggagcacggaaagucuuaccacaacacuuggcaucaguccucccuaguaauccacugaccaggcacgcacgcaaacaacaaacuggcagccagugacuguccccaagccaccugucuucacagucccuuuguaccuggaggaauuggaagcagaggcugaggaggcggagguuuugcgacgucuucgugcccggcuuggggagacggacacgccaagcuucuucuugggagacuuggaucggcgccagggguccuuccacucaucggcucgcuucaccuggggccccacagaggugcucuccuucuuuggugguucagcuugacggcuagaaucacagagggcuagaaucaggcugccacccuuccccagcaaugcugcugugaagagagacuggaaagccagggcauucaccugagacacucgaggaaagagucagaugaagaggaaacauggcaccccuucuacuccacagucgacuuccugcagcaaugggcuuaacuuccaugccaucuuuccugggagggaucccauucucucacccucucuuuaagauuuauuuauuuauuauacguauaugaauacacuguagcugucuucagccacaccagaggaaagcgucagauuccauuacaggugguugugagccaccauguggauguugggaauugaacucaggaccucuggaagagcagccacugagccaucucuccaguccucaucuucucuuguauauaauaaguacuuuuuugguggugguggcacaugucuuuaaugccagcacuugggaggcaaaggcaggugagaucuuugaguuugaggccaggcuggucuauagagcaaguuccaggacagccagggcuacacagagaaauugucucaaaaaccaaacaaacaaaaaagcaaguacuuuaggggagucauuacuuaacucuaucuuucugacuguaccguucugacagcaacggaguccaccugguucaaacauguuuauuuuuaguguuggcacauaguagguacacaguauucaugaaauuauagcaacaagaaccauguuuuuaaacaccuguuaacaaaaaaaagugaacgaaaguccaugccuuaagccuuuucucuaaauuucaagagucugguuaacugcacccugggaaguucuugauuaaugcacagagagaaugaggcucccaggcuccucccuaacagcaccggccucguguccucagagaguuagagaaaaaggcauauauagggaaggcugcacuaccccaugcagauagaaacccugcgguuuauccuuucacagcuucuguuuacucaggcaccagccaguggcggguaccaggacucucuuaccugcugaggggcacagggggagcgacacccagugcugaagcuuaaccaccagacacgugagucuggcuugugccauuguuaucucagcccugacccuggaagcuaaugccccagguacacccaggggccgcccuaaggaaacgcaguaaggauggcguggggagagccucugauccccagcauagcugggaagaacccaggucacaggagaggcuaugugggugaaacauggguauccaacagaagccccagauuuaaugauaggucuuugggaagaaugacuggaugaaccaucauucaagaauccauuaccacguucacugagaaaaguguucauguaucauuuagagggaaaagcugcaagacugacgugugucugagugccaacgagucuggccacggagaggaucuacgaccacggagcucguguuucaggguagcagcuauugagucgacaggcuaacacccucccagcuggcaccugaguugucuucugaguggggacagucgaggucuggagucugcagagugacauuagguuguaucuuuguuucccaggacauccugagaaaacugcugaaucauuuaguggggaauaaccacccagauaucacaucagaccuagaaagccaggcagaauacaaaaccacaggaggcuacaucuccccauaggugcccucauagugcgcgugguguaucaggaccguaguauacaaagggaggggggcuggucgggaacuacagcaggcaucugcugggcaaggacagaugugcuauuuccagauacuucugaagagacaaacaaacaaaggcacaggugaucugugaccuugaucuucuguguagcugcaguacccucuaaucucccucuagcacaguaccauauccaaaggcuaccggaggcucuacagggcaagggucaacugugcugucaagagucaaugcuaaggcugacaguacacaggccaagggagacacaaggaagugagcggcagccuaugagcgaagcaaccaccccgccuaucugggaacuccagcuuggacagcugucaaaucuggggucaaagaauaaaaagcaacugauggcaaguugcuucuaaaaucaggaggguuaaacaucuaauaaagacaggaagaaggaacucauagcauguggguucuucccuacuaccucaaucugccaacacccaaggaacacacacuuuuguuuaucucccaggaaauugcacagguuucccaggacugucccacaguguauacaguuugcccucauuucagugggugacaccacuguaccucuucaugccuuacaccaugcacaugaugaugccuacuggcuaaaccccucugagcucaguaaguccuucccucugcaguuccccaggaguacaagucccagguguucucugcucugcuuugccauuacuucuugugaugcacccuuuucccaaagucagcacuugcugucugguccucucuauuagcccuacauguaugagacagcggagauguaaguguuucuuacugccauuucuccacucugcccuaaagaacacagaaggcgggcuggcgagauggcucagugguuaagagcgcagacuguucuucugaaggucccgaguucaaaucccagcaaccacaugguggcucccaaccgucuguaacaaaaucugaugcccucuucuggaguaucugaggacagcuacaguguacuuacauaaaauaaauaaauaaauaaauaaauaaauaaauaaaucuuuaaaaaaaacaaaaacaaaaaaaaccacagaaggcuaacacaugccaaucuacugagacagcaacaaaauccagaggcaagaacaucuguuaaggcagccuggucuacacaccuagcucuaagauggccauagccacauagcaagacacuaucucaaaagaaaacaaaaaccaaaccaacccaaccaaccaaucaaccaaccacagaagcaauacaagaacaaaguccuaucugugggcuucacuuagcucauauuaccaaccaaaugacaaucccagaaggucugaguucaguccugaccugcaagugcugaacuggaacaaggcuuuuccacaaccuaccacucugauucagaauuugaaaaugucuuuuugagcauacuggaaagccagaaaacccagagacacagaacugguaacagaugacaacaaaggcccuagacccauguguucuaggacagguacaaagagacacaaaaauagccuggcauaguggcacaugccuggaaaaccagcagcuggaaaacggaggcaggaaggaucauaaguucaaggcuacacuacacagagauaaaaaccaaaacgaauaguguuauuuguauuacuucagaugguaggcaaggcucacuaaaauguacuucuaacaucaugcuacccacacuguccuuggcucuugaucucacaccucuacucugcuccugcuacuuugcagaggacaagggaggggauaucuacccugguguggcagcacuaugggcugaaggucuaggaaaaauggacaaaguagcuucuuuggaagaugguccgucagaucaucaguuaugagaugaccccgcaguuccucccauagguaacccaagaagaacacauucacacaccaacacucacagcuacaacugucaaaaaguacccacagcccaauguccaccaacagacagacacaaaaggaacugaggcacagccacagugcuuucugcagauacaaucuaagaggaagaaaguagccccacaccuacacuauguccuacacaggcaggcugcuucagggaagcacgaagcuguuacccaaagaucugauggagaggccaagggcaagauguccugacagaugggauuuagggugaccuaccucgguggcuguggggaccugggcuucggcuucuccuuguccuucucccgguccuugucccugucucggucucgguguugccgguccuucucgucucgcuuggcucucucucucucccacuccucuuuccuccgcugccgcuccuugucccgcucucguucccguucucgcucccgcucucucugccugcgcucccgcucucggucacgcucucguucccgcucgcguucucguugucuguuuucucgcucucguucccucucucguuccuggguuaaaaagccagauauagacgcugagucacaaacuauuuguuagaagcagagagaaaacagggugcagguaagaggaugcuaucaagaggccauucuauucccaaguauuuccuuaaaauaaguuagcugugucugauggcaaaggccugcaacuaggagacuaaggcaggaggaucucaaauucaaggcaagccugggucaggugagagccuucuuuaagucacugaccaaguauguccagauucuuagguacuuagguuuaauucccaguaccacaaaacacagacacauauacacaaaaaaaaauacauguuaaaaaaugcauacaaauuaagagugaaguuaccccaaccaauaaauccacaacuuugccagcaccagccuguagaaaggagcccacaccacaggcccucccaugagugacccagcucauucuuagaauggcugucaugcaggcaaggccccaccacagugcuuaugaacacgucugaaggaagaauguauccccuuacugcaacuccccacugcugccuucuuuuccugcuuuaauacucagcauuaaaacccaacaaguccaauaauggcagagcugacaggcucugggccucuggagggguugggagacaccaugcaggcuccuguggcguuccuucuagcuacucacuagacugaacagagaacaaguacuguaccgggcacccuaccuccaggaggaaggaagcugugguucugggcuauaggggagucugcauagcucauaccuauggacuccuggagccaguacuugucuucagugcugugacagcugaugggugguaugugagucacggcacauaauaacucagggcuccucacuagccuuuccccgagcacgcuucccgagcaagccgagagugaggauggaauaggcagucuggagcacacagaucuuuauacacucuagguuucaggaccugaccaacauggcaaggccagccagaggcacaucuguaaccagcagauuagauggacaagaacagggcuacaagugaggacacugcucaggagacuucuaagagcgacacacucaugagggugacagucucgugaaaacugauacugacuguuuaccagcacagcuaaccuuauaaaaccauggcaggaacaaugauuccaagaaagcucacaggacaucagaugaccacaagccuagccaguggcugccugcacaaccaaccugggcucaaauucaggacuauagcuaaauacauuuugcuaacugaauaagcucacaguggauacaccacaggaggagugacugcugcugggugaggaagcacacagcacuaguuguacagccaagccagaaggaugauggauuugaggcuagccuaagguacaacauaguuagacccgucuaagggaagaggaaaguuuacacacgugaucauacuuacgcgauaguuaugauacgguucugcuucuguauacugcacccugaaauucucguacuguccaccacgccaaaaccguucuaucucauagucauaauaagggucugcauaaggcucaagucugaaaaaggagccaaaaggaaggaaaucgugucauuuaagaaugcaacagcacaaauucuacauaaagacaagccaacagaauccaaucccacauaacaaaaauacacccugaccgaguggugucugcagcuaagaacacaaggauagaacacaagcaauaggacagcagcacacaucagucaaucuggggggaagaagauuuuuaacaggugaagacaaagagaaaccgucuguauccauuucuagagaaaacacucaacaaaagaggaauuggcauuuucucaaugaguuagaaacauauucuuaaaagaccuguaaggacugucaggauggcucggacagugaaacacuagcuguagaugcuuuguguuuggcccuagaaaaccaucaacaauuccacaaagcuguccuuggacccccacaccauacaugauaugcacggacacacacacacacacaguaacacacacacacacacaguaacacacacacacacagaacaguagcagcagcagcagcacuaaggccaaagcuggagagaagcauggaggaauucucucgcaucaggacacaguaggacccauccucaccugcugguguauguagauacugaugacaagacuggcaagaggagcccagagagguggaaacacagaaaaacggucucuaucugccauccugugacacuacaccuaaguagcccaugacagagccaagucacacaaccacucacucaccucaauaaggcaggacaaaagccuaacacggaaaccuagcuccucacauacagcuagggcagaggcauagaaccacuugcgauagcagagggacggugcuuuggaaggacacauauucacccugaaggucacaaagcaacaacuaagugagaagugacagagcacgcuuagcagcauuggguucacccugcacugcucauuaguauaucccuagaaaaaccagugaggauauucccaggcuagacagauacacugacagccuuggucuacaugagaaagagacacgagccuagccaagaaaacucaaggaagaaggcagccucugagguuugacaggagccaagagcgcgaugaagcaugauuagacgggcuucauuuagugcaggaugcaggcccagggagacacgcuaggguggcaccuuuuuguguccccaguaccucacuacucacaccuggaaaucaugccaccaugcuggugagaaacuuuauaaacaaggggagauaugaaauggacuaaaaaaguaaccauaacaauguaguuaaagucaccaaaacguauaagcugcuuacuuuuggaauucucagucuuucugaaccugguaacgcaaaccacaaaauggacagcuugugcuguacaccacaguuacuuuuuaacccucuuagcugacucgcaccugcccagucagugcggagcuccaaggcaugaaggguggcaggugacauguguguuuaggggugaaggugggagguagcuaggcagugauguugaggcacaacuacuuacuccuucuuuucaucccuuaccauccaguagccagaaacgacagagcugagaacugcagagaagagucuuacgagacuaugacagugacucaacuggcaauuuacaacacggacuaucacucauccccccauguccuaagcccacacugugcacccucagcaggcagaaaugagacccaucaucuucccaguaagguuaggagccccugaugaagaagcagaggaggagcaccuuccaggccucaucguuccccugggucugacaguccacugcaacacgcaauucucuaccgagggauuuuucuucuuuuuuuuuuuuuuuuuuugagauagggcuucuuuucuuagcccuggcuguccuggauugcucuuuguacacuaggcuggccuuaaacucagauccaccugccucugccuccuagugcugggauuaaaggugugugccaccauuccgagcacuauugagauuuaaaaaaaaaaaaaagaccagcauuaaaugucugagaaagggacggaagagauggcucagugcuaagagccccuguuugaugcgauuccagagaucacaguuuaguuaucguuccuguguugggcagcucaaacagccaggaaccccagcucuagauccaauggccuccuucagccuuuguggauacauacacauauaacauaaauguuuuucauaaaaccucguuccccaagcagcugaggaagagguaaggagacaaagguucagacugcgccaagccuguaggaacuucaggaguguaccucagaggcagccucccagcauggaacuaaaggguccuccacaaaauucagaguacggagggagacagugcccugggcacuugcacuggcaacuggcagggcacgaauggggcagggcaagcagaggcuccuuacguugugucucugacaucucucgggacucgagaauuccaaucucggaagacuucauucuccuugucaaacucccggucgucuucaccaaugguuacugugaaccuuuuuucuucaaagucgggcuccugcucuuuccgaaugguugcuuuuuuuaaaaccuagccccaaagacagaaagccauucaaaauuaaguuugaaauaagggguuccaaggccacuggaaggaacacaaggaacccgagcccugcagagaaggguguggcaaguacaggacucagccagcuucugcgggccucagaggaugguuggucucugcacuggucugcugugacucauguacacaggagagcacuggggaucagcauagggggccccagaagacuucaguguaagcaaggccuucauuucaaucuccaugaagagagaacuugggcacugacaaaacaaggcugggugucaacagacucggggccacagugggcaggcaaaggggguccugagagaacuagcaagagcagacaguggguguggggggcaaggaguagcucccauagaaagguagggauugucucacugcuuaggguagcggccagaaacacuuaaaaauguuaacucuacauccacggagggucucucuggccuacugagauuugccugagacugggucugagauggcuaaauauuauuucucauucuucuuaaagaagcccagaaauguucucaccgaguccccgcacacccucugggucaaggcacuggcaguuucgcugggcccgcccauccccuggaggggacacccugugcuuuucccccagaacacagugagcucuuaccucuuuugcaugucggaguccacguucccaggcgcucucuguugggggcucuggaggggguggaggcaaaauuucaucaaccacuggcccacccuauuaaaaaaugagaaggaaauauugagguacuuaaaaaccuauuaagaaauaggacaagacauuuaacaaucaagccagcuagcugcacgcagcuggcuguccugcccagggcccacgugccccagcauuugaggcuacuucuacacaagcacaacaagccccacaggcgcuccuugacucuccauaggacacuaguuugucuucagcaagauucagacaaagcucagguaucccaucugguggcaacuaaagaggagcucacgcacccaaggguuggcaggcaucagugggugagguccaagaggcggggcaccguuggguggaaaagguuccgcuuuggugaugagggaguaguugccuuugucauucacuccaggguggauaaaccuacagcucauuccccacgugcaguuuccuagggaaacaaaaguccagugagaaaggacaccaaagaacccaacuguggagggcaguagcuggggugugcagcacuuacugacaucuugggaagcagccauccaaccuguucugcccacauaggucacuggaccucugccucaacagccuggccuaucucccucucugugcacacagguaucccaggcuuacagaggugagcagggcaggucugggccaaugguucaggccaggcacuuccaugaaauaccauucccuuauugggagcuccgccuggacccccaagggccuguucauggucagucacucggccagcuccucaccacagaucaaaaauauucuuuguguuucacugaacauguagagacauuuugugucucuauauaguauaguaacaauauaguauaaaaaggacuuuuucaugcuguguccaggauuauaaaagcacuuagagaggguuuacauuacaggaggguaugugcuacaccaucuuuuaauggggacuuggauguccucagauuuggauaccacaggaccacugggcaccucaacggaauaaagcagagaagccauagucucuagagcuaaagggcagaggcaacacuggcgccuccagggagcucuggugggugcuggacauguguuuugacucauacugagguagaaauauacaggaggcaugaauauuaucagaucucuguugaguuugucccaggguggccuucuccaaacuacuucaggauuauuucuggcccuuaaauguaugauauuaagcuauuuuaauuuaucaacucaaccaaacuacaauuugauacuuugcucacaaauaaucaguggagcuggggauuacugaaggagcugcuccacucuucagugcuuuugucucaucuauacauacgccacuaaaauuaaaaaaaagaaaaaagaaaaaaguucugggaugaacacuguggucaaguuuuuaaauccuuuuuaugcaaagaacauggucguuuaaaaacuacaaugauccaauaguuaaauacagccugaauuaacagauauuaauggaagacuaguacaaguuagucauucuagauguguaauggcaaagaauauauaauaauaauccaaaagaaguagacauuuguauggauuaagcuuauaguaacauauauggauuaaacugguuuccuaacagucugccuuuuaaauuagaagugcauuagaauguaugccuuguauauuugacugaucuucaagauuuuuaaaauauauuaaaugugcucuuuacuuguuguuguuguuuuuuuuuuuuaaauuggacaaaaauggggaaauguaguagguuuggccuaauguugcuuguauuaugaugauaaucuggguccccaaaauuccuuacacgaggguccacaaguaagacacugagggacccugcccccaguuggcucugaaugguaaauaaagaugacaccaguccacggcugggcagguggacagaggcaggacuuuuaggauucccaggcuugggacagagaaaagcgggaaaaggagauucaccauaccuggaggaggaggaagaggaggagaaacacaaugccugacaagagugaaggacagggaggcacagcuggcauguuaaggaguugagagagcaggguccagucagggcagccaaaguagaauauagaauuuaguaaguaauaacucaggauuaucggcaggagguggauuaaccauguggcgguucggaaguagcccaacuguugcacuguuuaaagcauaucagaauguaaaggcugugucuuucauucaggaauguaaaccauuggggaggguagcaggaacgcacucccgagguuuauuucuuauucaacggguagauauuugacauaaaauuuuuaugguaaaacgaaguaaaaucaggaauauaugugaauaaagcauauauucucuaaagagcauacaguagagccggguggguaugacagcagagcuuugauuccaguacucaggagaaugccugggcuacauacugacuccuguucccaugucuccagaaccuugugcagagguaguuaccaacuuaggggcagucaaacauguagucgccaaaugucuaccccauuuuucuugacuauguuauacacuuuggccugaucuuuacugcucuugucuguaagcaauuuaagaaaaaaaaaaaaaaaaagaaccuacgugauuaguagcaacagaccuaaaacuguaucaguaauacugacauaugacuauggcagaugucucggcagcaaucaaagaagcuaaacagauggcaggagguggcugcccaucaccugcuggccacaguccccauguccaguggccgagauucauccauacaaacgugcagaugccagcaagagcaagcacacgguggcuaugugcaugagcaagugcaugugucuguuaaguucagaaauggccuuuaagcuugugaucuaucgcuuggaucaguucucaucagcugcaugauuaccaccauaggcaaagcacuugccacaacagugaagauaguuuaacacugucacuuuacaaacaaaacacuuguuuugguccagagcgcacauucugacaaagugguccucuaucauaagccuugguucccuuuucagcuagucuaagcaacuacaaacaaguaauaaacacagcccgcguauaaacgucgaagugcuucacuggcuuaacaaaaucuuccugacaggaaggcagacuauccagaaauacaauuaauuaagccuuaagcaacugagcaaacugcagaccuauagcucugugcccuuacaggacuuaagacccaguggcucagggcacauaauggcuccugugacaagaaauuuuuuguccuuucucucagcuuagagacauaggagacuacagcuucucucaggaacucacagaugcuuugagacuuuaaagagaugguagcucacagagcugggauaaaugcccaugcuggcuugcaugaaccacucugggagaauccugccgguccagguagccuuugcuccugaacaugauuucuacuaagaaaugucaauuaucuacuuagauauaaacauaucagcacaugucuauggaguaugucaacugggagaagauggcaucgucuacuaugagcagaugcaugcugaggcagugugcacauucagugccgaugcugguucucugugcugcauuugaugcguugguggggcagcuauuccagguguggugcauaggaggcaaggccuuccagaggcucuucagucacaccacagcucuccaguugugggcugggaaguccacccagcguagagccugggcacuggguggucugaauggaccuuccaggaacucugcucuaacuuuucagagucaccugcaaggcugauggacauuggaaagcagucacgcccacaaguccaauucucguaugggagaacagaucugaacacccacacacugacuguucucacuucuugaaaauauuuacuuacuuuuauuuuauauguaugggauuuuugucuauaugucuuuauauguguguaccauguguguguccuuggugccuguggaggcgagaagaggguacuccuggaacuggaguuacaaaugguuguaagccaccaugugugugccagaacugaacaugugucuucugcaggaguagcaagaauucccaauugcuaggccaccucuccagacccccagaguauugccugcaaaguggcagcuuucagccuuuauggucugggcccagcucugugcucuaucuacuagcugcucugucugucuagccugaaggcuaccauccuauggaggggugugcacugagcagucucacuagagugcuaaguccuuaagggcugaacuaaggugaggcacauacaacugggcagauuuacucagaaucacuggguuauacauuuacaguggcaacauuuuauggcaugcaauuguaccuaccucuguaaaucuacaaaacaaacaaacaaccagucagagccaguacaguggugcacaccuuuaacccaaguacccaggguuggggggcacagaggcaggcagaucucaagaguuugaggucagccuggucuacagagugagacugucuuaaaauuaaaauaaacaacaauaucccugucaaaauugaaguuuuuuuccguacuaacauaccugaggcuggccuuuacacaugcgcgcucgcaguagcagugccuuacuuacuacuaugaaaacuguucuacuuucagagucccugaaugguuuggagaacucccauagacuacaggccacccugaggcauuccaaguuauaagcaugaaggagaacacacaccgauaugacaugcauagaagggcacauaagagcaugaaaagggugcacaucacugaacaucagggaguccaacaacccagacacgccagacacugcuagaaaagcuccugacagagugggaaagauuaaaggguacagcuacaguggaacuccuuagaguguaacuuggugaucuggugcucaaccugagguucaaggcucugaguuucacucccccauacacucccuucuaaaacaccaugugaacgaauauccgaauauccagcuucguuucuggaucaaccaaccccggacccucaugcccacacacaaguguguaggugguuacacuuuaauuccucuuggacaaacacaauagagggcuugauguggcagugugaauaagaaugaccccccucgggcuggugagauggcucaguggguaagagcacccgacugcucuuccaaagguccgaaguucaaaucccagcaaccacaugguggcucacaaccaccuguaaugagaucugauguccucuucugguguguuugaagcuacaguguacuuacaaguaauaaauaaauaaauaaauaaauaaauaaauaaauaagucuuuaaaaaaaaaaaaaagaaagacuuaaaaaaagaaaaaagaaugacccucccuccccuuagguuuauauauuugaaugcuuggucucuaguuacuggaacuguuugggaaggguugagaaguaugggcuuguugguggaagggucagacguugaaguuucaaaagccacaugaugcccagaugucuguccuacuugcagauaaggcucuaagugcuccauuacuacugcagcaccaugccugacugcucaccacaccgguguucauagauucacccucugaaccugggaacuuccaaacagauucuuuuucucuaaguuguccuguuuauggugucucaucacagcaauuaaaaaguaacuaagacagaugguaccaggaaugggguauugcugugauaggaccaugauaggucugucugucugucugucugucugucucuuuuuuuuauuuaaaagaacugugcaagauguugggaccuugaaguaagaaaggguuugaauacuguaaaccaggcuuaaugggacauccuaguaggagcuugggagacaaugaguagugcugagagcaauguggacuacagagucccagcucaagagguugccuaucgaacaguauuagcagcuggucuagagaccauucuuaugauauucuggcaaagaauaugguugcuuuaugguuuaagaaucugucuaagcauaaacugacagagaagaugccaagauaacccaauacugacucuguugcuuuaguauuaguaaucacucuuaugcaggucucaaauggaaaaggacaacuggggaaaacagaaauacaaaaugugagccacaaugggccacaccuuuaaucacaacccuugugaggcaggcagaggcagguggaguucuagucuacagagcagguuccagaacauccagggaaaacccugucuccagcaacagcagcagcaucagggcuggagagguggcucugugguuaagagcauguacuguuuuguagaagccuggaguucaguucucagcacccaugcuagacagcucaccacagccugugacugcagcuccagggguucuaauacuucuggcaucaacaucaucaucaucgaggccagccuggucuacaaagugagcuccaggacagccagagcuauacagagaaaccuggucuugaaaaaccaaaaaaaaaaaaaaaaaaaaaaaaaaaacaaacugagaaaacuuaacuuaggagcuaagguuugugcagagagagauaggugaaauggaacuaaggggagcggaacccucaggacccuccccagcugauccuacaugccaccugugauaaggccuaaggaaugaucuguuccuagagagcaauaaaccuaagcuuauccaaauguaauccaaggagggggcccaaguuucaucccaaggcagucaaacuuggcagcauggguucuggcuuuagagucaugaaggacacaguaaagugguuguagaaucucaagggaagaguggcugaggucaguugugagguaggugagccccaucccugucauggaauuugaagaggccauuacaugaagccaugaaaguguuggagaccccagcugcuggagguauuaaagcuguggggcaucugucaagaaagcuucgugcagacaggggguggaauaaacccaaagagaagugugcugcagucagcaaacugcaagggcggagccaacuaagcucucugacaucagacacgauuaugcagcaguucucaaccuuccuaaugcucagaccuuucaaauaguuacucauguugugguggaaauaacuauaaaauuguuuuuguuguaaauuuacuaccuuuaugaacuguaauguaaauaucuguguuuccuaauggucuuaggcaaccccuguaaaggggucagcugacccucagaggggucaugacccacagguugagaaccccuggacuauuggcacaugucucgcuggauucugaucugcauucguucagcauuuccucacucugcucaauccucuccuuuuggaauaguaacacacauuuuauguuggaaaauguaauuugccuucugauuugacuuuacauggguaagaauuaaaacauugcuuaaagccucaggagacuucagaccagaagcucucaacuuuucuaacgcuguaaccuuuuaauacaguuucuuagguuguggugacccccaaccacaaaauuauuucauugacacuuaacuguaauuuuaguacuguuaugaaccguacuguacauaccugcugugcaggauaucugguaugugaccagagggugccacucccaggcugagaacuccugcuuagucugugcugaggcugggaaagaccagugaggacuuuuaaaguagaacuaaauguauuuuucauuaugauacugccaccgcucaaauggagcggggauggaaggaaggaaggugguggucaggcucauggauuugaaugcuuggucuacagcggguacgacugcuugggaaggauuaggaggugugucacucggggaagacuuguguuucaaaagccaaucggguugguuccugguuagugccucucucucucucucccucccuccuugccuccgagcugcauuuaagauacaagcucuuagcuauggcugcagagcuaugcaugccugcugccaugcucugccacuguguucauggccucucccucuccaccaguaaccucccaaccccuuuuucuuugucgccuugaucacgguaucugaagagacagacacauacuuggccacagcuguucuguuucuuggcuucugaggaacugcgcgacuuuuacuucacguucccaccagcagugugcaaggguuccagcaugcccacaccuuugcuaagaaaacagccuuaguuuuauuucuuuuuucuuuuuuaaagauuuauuuauuuauuauauguaaguacacuguagcuguccucagacacuccagaagagggagucagaucucguuacggaugguugugagccaccaugugguugcugggauuugaacuccugaccuucagaagagcagucagugcucuuacccacugagccaucucaccaggcccccuuaguuuuauuucuaaaguaacuuuucucauuauuguuuuuuuuucuuuugagauaguauuugcagcccuggcugaccuggcacuuaagaaacaugucugucucugucuucuaaaguucugggauuaaaggugugcacaaccaugcaugucuagcuaaagaauuacuuuuguguaugugugggugcacguacauggccacaugugaguacaauaccuacagaguccauuggagggcaccagaaccccaagagcuggauuuacagccaacggccagcugccugacuugggugcugguaacugaaccuggguccuccaagaaccguaccugcuauuaacugcugaacugucucucuagcccuaugaaaaggaugaucaacugaguucaacuaaacaccaugcuuauaacuuguaggcaagccaaagguggaaaacauuccugcaaugaugaguaagacaucccagagaagucaaguucaccauucccuuuucuccugcacguuauaaacaggaggagagaaagggaagcagcaauuaacaacacccugaaaacgcuauguucauguuuguucacuguacucacccuggaaacacuacuacugcucacacucaccauccuggcuaguuuuugggucaaccugacaaaggcuacauucauuugggaagagaaaccuuaagaaaaaagccucaccaaacuucaagacuggcccauaggcaagccugugggcauuuucuuaaguaauugaugcggguagccagugucaccccaagcagguaguccuaggguguagaagaaagcaaacugagaaagacaaggggaacaagcaguaagcgggguuucucuauagccauuguuucagucccugccugccuacccucccuccucuccuuucccuuccucccucccuuccuuccuuccuucuuuccauaacggacuaugaugugggacuguaaacugaaauaccaaccaugccuccccagauugccguuggucccgguguuuuguuuuaucgaagcaacagaaacgcuaagacaaccaccuaagcugcuucucacuugacuacagaaacuucaccaugcauggccucacucgugaaaacccaaacccagcuuacuguaaccagcggugcucacccagugugcuaaagcagcaguccuacccaaguguacacagacgucucacagagagcuaccuuuacuucaucucaucugugcuugguaagccugagaccagaucagggugugaaccucuggcucuugcucugacucaugcugaugcugcuggacugucccacaaguccccaacaagcuucucaacugcaaaggcuuugugcagcagucugagagcaguaucaugagaaccaaguauagauccgugugguacacacuuuugcugcugcaauuugcacaucugcuggggacgacugcacugauuccucaugacauuaccuggaaagggucuucugcuugcacuuacauuucuugaaauaucagcacuuuaaauagcaaagauuucuaagaacuaagauguggucucacagcucuucacccuuaggguucuuggggcauuuccaagugaaggucaccuauacacugcccuguaucccaccccaacgcacacaaucggcugugcaacuuaugggccaacucuuuucacuuggcaucccaagaccagagaaagcaagccugaguggaauuuucauuaaugucccaucaccagggcaucuccugaccugagggacagagcuguuuguggcucacuccucaggcccauucuuccccaugaacaggacgggauuccacugcccaccuguggaaguuccuguucuucaagugcagugccauggccucaaccugcaucuccuccccagcucuaaugacacuaaggagaaaagggccacagcaguucugucccucaagccuccucccuguuggcgucccagcugugcucuggauccaggagacagaagucuggccucuggcgcaggggacuuuaaggcacaacagagagugaacacaggauauuuuguaccuuuaaccuggccucugagugguauggaauuugguauugguggaagaagaguggauaauggugucacaacaucuggaaaagaaguacaggaagcucuugugaacuuagacugcacacacaggcuggcgaagcgagcaaagucauccacgcgcaagagaaaacaccugccuaucuguccaaggaaaacacuaacaagaaauacacccaaaccacugaagaacauccagacuggagacucuugauuccacgucugaacccgcccccaccccuggcuuuacaaagccagagcacagauuaauguggucaguccacaucuggacuguaaggaagacaaugccccugcugaagcugcugcacugcauuaguccuuugcaggccugaugcccuuagaggcuuccccuugccuuuucaauaccacccacaaguaacggaccugcuucuaacccaucuuguaaaaaguggcucuucuaacagaggaggggaaugcuaagacuggaacagcuggccuuauagaaagaagcacucagaaacaacugccacuaugugcugcagccuugggucugcuguacacaggcccgacaccuguaggguaagaagaggggcucuccucuaaggcaguuuuuaaggcaaugacaggccaaugaaaggcccauuguuuaccaccaacagcaccucacugccaucaacucuugcagucuagccccgugaagccucacugacaucaacagugugcccagaggaggauggaucaccaccauggccccaggagagcagaggcuacacagauggccgcaaaagggcuggaggcagacaguuaccuuucaugaagaaucggcagguggggcgaggccucaccuuccggucacugggguccuucaccucgccuuccuccaagucaucauccuagaacagaggacagucaucuggaggggagccacaccacuugcccaccacaccucuucaccaggcuggaagcagagaggcugggggagcauccaccuuuuccacagguacguccucaucagcucaccuccaguuccccauucuuaagugcucaguuacacagcagauggucuccagucaccuauaaccucagaagaguacugugggaauggugggcuccaccaaacacuucagagcagagcuucuguuucuauccauugcaagcaggcaauggucauacuuuggucuuuacuacuacguacauuaacaguguauaaacccaguacuucauguccuuuacaacugaagacuccuugccacucauggggacaucaggugacccugauagcaacacuaccuauggcucauucuuuaccucaccauuacuuuagagugacccagaagcuuuacagagagcagaacccaaguugcauuuccaggguccucaggggagccaagaccugaccacuacuuuggggucucaccagccaccccugugcccaggaccuguucaccaaccuauucccaucagccuagacuccuuguagucaagcuaugcccaugguccuaugcucucuggauagcccuggcaccaggggaagagugggcaaacaugccuucugccuuggccugcugaccccaugaggagacaaaagcagaacaaagccaugagccacagggucaaagaacaaucccuggucaaacacacacgggcuguuccccguguccugcagaugcaacugaccauggcgucucuaggaacaggucagagggaucagaaaggaugcccuuguuuuccucuggugacaggggaugucacgccacaucuccugcucugcagaaccccaugcucacuaaauaucaucugacagggaacaucccuuccagcaaacaccaacaagcagcuggcccacaguccaaacugcaugcauccuaaacacucauguagaggcucugccugagagauauucaucucucagauauucaucuucagaaugccaugccaaguaggucuuggccuaggagacugucccugaggagggagucuggugaugcagcaauuaucuaagaccaugauaagaacaacaaauaugcuaagcaagaaucacaguggauaaccaggcaguggugguguaaccucgcagagaccuguggaucugaguucaaggccagccuggucuacagagcgagauccaggacauccagggcuacacagagaaacccugucucaggggaaaagaaaaaucccaguggaggcccaugagccuauagagacguagcaacaaaguucaaacaugcaaacaauauuguggaaugggaggaagacaggguccaggagaggagcuuacagggaaaguggcugcuggccuggagucacugugcuaucaugggccaggcuaaaacuuaucaguuauggugcccacuugccuaccuguccuguuauaucuucagcaugcuauugugauccuuauacacuuccaggaucccaaguguccaagacuucccaacaacaugaaccacaggguacugugggcuagaacaguaggaaggaagaaccucuccuguuacugaaggaugcugggcuggggucuuuuaguagcaugcuauuucccauagacugcaggaccauucacauggggguagcaggcacaguaggcaaaacaaaaacauacuguggaacuguguugggccagaaagucaaguggcagauucaucccauacacuguuuccaagggaaaccagcacacaaagauuauggaugcugucuagggugggcuugguucaaaccauuuccccacugcccauacccacagcacaacacaagaguuaccaguauccccccccccccaaccccuucugacuuucacugugggaagaggaagggcauuucacagggagcagccugacaccaggcacagcuaaaacacaguugauaaucccaacuggaacagcacagcaucuuuucccuuucaccaacccccgagguaaagaucaauuucuccauaggugaagcacacgcaugcacgcacacacacacacaagagccaagaaaucaugcacagccuaguucuuccugaggggaacuaagcagguaacucaggagacuguuuacuacccagcugggacaaaaugugagacaucugauacaauugcagcagcuauaccccauuuacucuaccacugggacacaaagcccugcuaccaaccagacuguauggccaaagucauccuccauccgugaaacccuaaaaugaacuaagugugcagggaccaacaggcuaccgcaggacuggugcaugugagaaccugggguccccagauaguggcccucucucuagaucaucugauauguuuaaccuaucuccuaccagacaagcaggugcuuucugagaaaccucagcuggcucaucuagucuuccucucccucaccugcuuugagcucaacugcucugaacuucaggcuaugucuuccuuccaaaccucccaaucacgcucuuccaauagaaucaucugcaaagaaaaccugaccuucacacccaugauuccaugugaagauuuaaagaugggaucuucucuugaaccugaaucucaagagaugccccgauagcucuccucucugagguucucugcaaaagccuacuucccauuccacacugugagcacuugcuuuccugccuccacacaagcucucauuucccugcacccuagcccagccuaccacugacccucucucuaggaacaagggagccugagaguccugcugggcccgcuucuucuggaucaggcacguugcucuugacagcuccaccauacucacgucuaucucgccaucaucgaucuccccgucgucauccucuuucuucuucuccuuggcagcuucuguggguucuuguucucccacacuuugaacaucaggcuucccuuccucuccgggagccccuucccccuucuccuccuccuccucagccccagccuucucagccuccuccuccugggcagcaggagcuggcuccucagggaccuccucaucauagucuaguucaugcucauccaguucccgggucaccgaggaggcuucgucccugaggucacuugucccaucuuccucaacaucaucccccuccucgcauggggaucccgcugggccccugcucagcucaugagccucugaguccugaucuugggacuugggcucacuggcucggucuuccucauccgagcgagucuccuccuggcuuuguacccugguugcauuuuccuccuccuccaaaucagacgcccuuuccccagcuccauccaaaucuuguucagauccacuuucucuuagaaugucaucaucugagagugccggcugcucuucauccucuggggagugaggauccaguucagggcucucggccacauccaucaggacccacagaucugcaaaagacacaaaccauagucucagccugggcccauccuccuggcccacaugcccucugcccauguuccacacaaccccuccucccacaugccucccuguggagugcaagggcuaacucugccgccuauggcuggccuccacucaucccugugccguccugcagcuggcacaggugaagaaaaguaaacaauaauaagccaugaacugccaaggacagcuaacuauugggacucgugagaaaugacuucugaaaguaagguuucuacacuggaaugagaucuuacccuaggucagcugcaguuucuaacugagcccuuuucucuuccucugccucucaagcaguuucuugucaccuccucaaaccccauccccugcacucuaagacuuccacccagccuacagcacugcucuucaaaagcagagcucugggaccagugacuccagaguccaaccaaagcuauccagguagcugcuguacaaaugaacuaugacagaauauuuuuagacauuuaaaucauauacuuauauaaaagaacuuuuuccuuuuagaagacacacuucuauuucuaugaauccagauuuaaugaagcaaaugguucuguuuugguuuuuccaccuccacaacucauagaaagcacuuugcucugcuggcuguagcgaugcaugccuguaaucacaacacuugggagauggaggccacccuguguuacauagugaaacccugacucaauaaaaaaugcacacugcugcacuuguuuuacagguggccaccuaaacuggggcugagaguaaguguagauaucaccuagcagcaaguagccaguauuucuaucucauaaucaacagaagucaaaucccaacacagaggaggaaggguuuggaauucauuccacucuauauucuggggcuggaaaaacaaaagcugcuccguauccagcaaaauguacaaguuauugaacucagguucacucugcgcuuagaggcaccaaggccacacaccuuuacuuucuuuauacauugucuuuccguaacuucauauuuaccuauuaaagauacaacguaguuuucaauuugugaauucaggacuuugcacaugucagguaaagugcccuaucaccaagcuacagcccaaauuuuacuuugaaaaauuuauagccugcgcugcacacugagucaaaggccugccuaggcuauagaauaaaaccugucucaaaaauaaaauaagcugggcgugguggugcacgccuguagucccagcucucgggaggcagaggcaggcagauuucugaguuugaggccagccuggucuacagagugaguuccaggacagccagggcuacgcagagaaacccugucucaaaaaauaaauaaauaaauaaauaaauaaauaaaaauaaaaauaaauaagaugggcgagcaagauggcuuaguggguaaaggcaccugcugagcaugaaaacccaagauggucucugggaccaacauggagaaagagggccagcaccugcaggcugacuucugaccuccacaugcucugacacuuacacacacacacacacacacacacacacacacacacacacacacacagagggaaagaauuuaaacaaguuaaaagaucaccuguuuuaaacauucacugucaagaguuggcaucaaaauguuucuagccaggugcaaccuagucucaagcaaaaaacuauguuugcuggguaacagaauaugcaauaaaucauuuaaaaucaaucauuuguaaaacacaaugaucacauuauaaauuuucagaucaaaucaaccuaucaacaggaagugguggugcacgccuuuaggccaguacucaggaggcagagacaaggggaucuaaagagggaugaguuccaggauagccaaggauacacagagaaacuccgucuggaacccugccccaccccaccccgcaaauaaaacaagaaaaacaaacaaaaucccaaaacccaaaacaaucuaucuuaagucacuuaaaauacauaauagauaagauucucuggucaucuaccaucacuggagaggaaggaauacugaagucaguccuauccaggacggcaaacacagacagggccagccugaagugaacagugaacugcagcccgacuggguuagagugugagagcagagagcaaguaaggacaaguuagaaguuaugugcacagccucugagcucuguagaaugcugugagcauccuuggugccuauggcacucacuccuacagugggcaggggugaaugccauguaggacagcggccagaauggggaaucugugcucucugcuguuugagagaauguuugugcacaguuccaaugugugugugugguggauagcuucaguaaguaaggcaggcuaaugccaauauacugaacacaugaacuccuugguguguaacaucugaucccuagcauugcaguuuuaauuacacugucuauuuugaugucuccacaaggcacagagacuuuucaucucuccagcugccuggguagcacugguaacaauagaagucagcaacgaugaccugaccgccaagucucauauacccuacuuaaaaccugacaaaucccuacucugccauuuuauaccuaaaggcaaccucauaaacaaagauaucuuucaaacuaacuguaugcaaaaccaaauguccagucuaauuuggaagucauacaacugauacugcagcacacaacgcccauguggcaagcugcaugcuaucuuguguacgguucacaagacucucuucuaaccugcucacagcucuuucuggggcucugguacaaguugguuugcuuuuaguuucagucaaacuugagucuaacagguuggcuuuuuuuuuuuuuuuuuaauauuccugaaagucuugagaugaaacccuauggaaagaaacgaagacugaguggccaaccagauaucugaaccuuaauaagcagcagacugguaaaggggggaggcugcucuuuauuugggcuugugaguuaaagcuugaauccuugcuuacugcuuccaggguuuaaaaucucaggccaagucaagcacagcugccaggccucaacgccgucaccugaaggacaagagcagcagcagcagcagcagcagcucccuuaugggguugucacagccugguaccugaggaugcgcuggaaacacacucuauauaugugagucugacuuagagagagaacucuccaggcaaagcaaccucauaccacuccugucaacugcagucaagucauccagagcucucaagaaaagcuugcuuacugaugacuggauaacgugggacagcccaucugucaggugcugagaaugcugaagacuccugaaaaacgaaugcauuuccucacgccucauggguuuuguuuguuuuguuuuuugagacaaggucucauucuguagcucugacuguccugaaacucaaacaucugccugucucugccucccaggugcugagauuaauggaaugugccagcaugcccagcuuccucaugcaauucuuaaucccuauaucaaccuuccaaguaaauaaacugaggcuauauggcuacugcauaugucucaggacugccauucaggaauauucuggaaccuguaugcccagacauggauggaauuauugccacuuccagcggcugaaguuacuacuauaaauccuuuuugguauagaccaugcauaaaccucuagguucuguuucccucucccucccuccaaauaucaagguacuagacacuccccacaggaacaucaauuuuacacaaagacacaaccaggcuaacuaucuugagaauucuaagaggcugguguucugugugcaugcccagugagcuuuuccacccuccagaugaauuuacaguuacuuuggcugccaggaguaagucaacuucugaucuguaaaggcaguuaauuauuggcacacaugccauaaaguaguggggcgaauagcuguccugguguguguuugcagcgaaggacagaggacuccugggaucacaggcuguucugagcaaccaaugacaaguuauaaacaagcucaaacauauaaaauuucucucuuccuuucugguaguucaaaccccagaauuccucucuaaguuaggaaucuuguuucuugcacugugcauuacucuguccaucuaacugcagcacacaaacuccaauaguuuguuugaaggcuguuauaaguugggaucuuguuuccaaaagcccauacugggaaaucaguagagggacugaucuccagccaugcuccaaaaagguccacugucucucuagguaucaguauucucuguuaagacuaauucugccgcucgguggugguggcacacgccuuuaaucccagcacucgggaggcagaggcagcggauuucugaguucgaggccagccuggucuacaaagugaguuccaggacagccagggcuauacagaaaaacccugucuucaaaaacaaaaacaaaaacaaaaacaaaacaaaaaaaaaagacuaauucugugugcuacccucugcuggcugcagggaacucaugugcuacauauaagcugugaauccggggauccuccagcccagcuacaauguuuacaaucuucuuacccacuaacccaguagugcaggacucucacaaaguuuagaacuaaccuuuaguccuccuauccacaauggugaaccuguucagggguggaaugacagucuuucaauaucucuguccccagcugcauuugacauacuggaaaaugcuugacuaaacgacaaaaccccaugaauccaggaaccaccuguugcauacuagaaagagaucuaauaaaguugccuguuuguaaaacauuguaacagaacuccagagcagcguucugcucuugugucagcagcagcucaggaaggccaaacugacuccaaccacucuacuacugacagaacaguuaugucguggucuccucacagcugggucauuuucagcaacugcuacaagcuacuuaauagccuggccuggugaauuuaccaauucagguuaaaacaacucuugggcaaacaugggguaugacuuggggaggggggcaggguuucucaucguagcccugacuagccucgaaccaauagagauauaccugccucugccucugccucuugcguucugagauuaaagacuuggucaccacugacuggccuacuacugagaaacguguuccaaguagguuuuguuaaggaggcucgauaacacacaaauacaacuucuggaaaacgacuuuuccuuugaaccaaggucucacuuuguagcuuuggcuguccuggaacucacuauguagaccaagcuagcuggaacuaagagacccccucgcuucugcuuccccccaaguucugggauuaaggugugggccaccauacucagcugugggagaugaaguuuagcagagcagagccuauguugaugucuaaguucuguuaugccugguuaaaaaaacuuauucauagcuccauccauguauagagcaagaaugucaggauguugaaaacaccacccgcaaagugacuuaagcucugcaaaaacucuucgguaaggagauggucuccuugggauggucugcagaugacaagcuaucucuuuggagaugagcaaagcaaacuuaccugcugaguguucaggaaguaaauccgaagugcucuuaaaauguuugagcauuccccaucuacgacuagagaggaguuucagcuuuggggacauauugauugguuccagaacuggcuggcuucaaacguguucagaucauucgcauucuccucucagggggcugggaaaugggaacuagccuagggacagagaaucucaaccucugccuugggauagguaaugugaugaagaagaaacaaaugccuucuucuacuacccucaaaugggucugaagauuacucuuguuaauaagugccaagaaaaagcucauuugaaacagcuauugugcccgguaaacucagcugucaaaaguauacgggaaacuaaguaucuaguaggggcgagacuauaggucuuaguuuaauuuccuucuagcacuacaaucgccuggcuacuuuacacuaaagaaauggcaucucuaagcucacaguccaagaggcgaggaggucacacuuccuaagcgacccgggacucuuggagcacaguggguccguccaaccugugcucgcuugaaguugcgagagcaaguugcaggaggcuccagagaguucaaaguucccugcagagcccgucgagaguccaagcgggccuccucccgagccaaccugcgcgauccgcuccccuuugugggcggcgaacaugugccacgccgaguggcccggaagggaaaaugacagcuucaggaaaagcaacuucaccacggcagaccgcggcgcgccacggcacccgcccggacgucccaggccgcagcgggcucgcgccugcccgcugucccggcccgcgcuucggcccgcggcugcgcacagccgggggcgcgcccgagagcucgggaggcggcgccgggcuccggggccucgcucccgccgccgcuggggcggccuucuccccgccgcccgccggcccagcuuaccucaacgcgaagacgggaggcggccacggcuccgcuguggugggggcagcguggacgagacguuccucagccuuuucgcuccucacuggcuccggcuuugggcacgacgcgggcggaacaaacgggcuccacuacccgcgggggccggccauugugcaacgucaucaggccgcgacggccgucuugcgaaccg

SEQ ID NO: 4855 - RNA, 1622 nt, Mus musculus
ggcaaccuugggaggaaauggguguucucugggcuuccccuaaccaugcaccugccuugcuccacagagucuccugcuucuaggcugguugccuacugggaugacccaccaagaucccccguccugggggaaaccccgaagccauaggacccugcggugcuacucugcugaggaauuaucucacggccaggcuccuccacaccugcuaacucgaagugccaggugggagcaggcccucccuguggcccugguggccaguuuggaggccacgggccacaggagacagcaugaaggaccucuagcuggaacacagugccccgugcugcggccggaggaggugcuggaagcugacacucacgagcgcuccaucucaccauggagauaucggugagggugaugggguccccaucggugggggcauggggagagcuuuauuuccaccccggagcccuagaucacugucuguucagggugcacacucgccccaaccucuaaaaacauguuccccuaagaagcuggggcuugcggggcuagagagauggcucagcgguuaagagcacugacugcucuggaagagguccugaguucaaaucccagcaaccacauggugacucacaaccaucuguaaugggaucugaugcccucuucuggugugucugaggacagcuacaguguauuuacauauaaucaaucaaucaaucaaucaaucaaucaaucuuugggccggagcgagugaggcgagaagggaggaaggagagagagagagagaaagagagagagagagagagagagagagagagagagagagagagagagagacucagcuaauuaaaaagaagaagaagcagcugaggcuugagcuaagugagaccagagcccucacuaaagccccugucucuauguucucagagaccauggaggaaugcagguaacaucacuuaucaagcauuaacagaaugccagcccgcucagugccugcaccauuuugucuguagcauucacauucucagacuacaaauuuuagagcaagcggggcgcagucccaggacaauagagcuccaaggagggaagcggagugggaggguugaggagauggcucacugcauaagagcauuuaguuggcaagcaugaagacuugaguucaaaucccccgcauccacauuaaaaaaaaaaaaaaaaauggagggaagagggaugcccagcccaccgagcuccgagcugcuuguggaagcucagaguggcucuggguagagccggagugcacauucuuaugguucccuccccacagcaucgacacagaugagaaccgcuacccacagaagcuggcgguggcagaaugcuugugucguggaugcaucaacgccaagacaggccgugagacagcugcccugaacucggugcagcugcugcagagccugcugguacuacggcgacagcccugcucccgagacggcacggcggacccuacaccaggauccuucgccuuccacaccgaguucauccgcgugccugucggcugcaccugcguucuucccaggucuacacagugaugacuucugucguggccccacuguggcgcaucacaauccuuccaggacagacauuccaggcaccuccacaga

SEQ ID NO: 4856 - RNA, 1622 nt, Mus musculus
ucuguggaggugccuggaaugucuguccuggaaggauugugaugcgccacaguggggccacgacagaagucaucacuguguagaccugggaagaacgcaggugcagccgacaggcacgcggaugaacucgguguggaaggcgaaggauccugguguaggguccgccgugccgucucgggagcagggcugucgccguaguaccagcaggcucugcagcagcugcaccgaguucagggcagcugucucacggccugucuuggcguugaugcauccacgacacaagcauucugccaccgccagcuucuguggguagcgguucucaucugugucgaugcuguggggagggaaccauaagaaugugcacuccggcucuacccagagccacucugagcuuccacaagcagcucggagcucggugggcugggcaucccucuucccuccauuuuuuuuuuuuuuuuuaauguggaugcgggggauuugaacucaagucuucaugcuugccaacuaaaugcucuuaugcagugagccaucuccucaacccucccacuccgcuucccuccuuggagcucuauuguccugggacugcgccccgcuugcucuaaaauuuguagucugagaaugugaaugcuacagacaaaauggugcaggcacugagcgggcuggcauucuguuaaugcuugauaagugauguuaccugcauuccuccauggucucugagaacauagagacaggggcuuuagugagggcucuggucucacuuagcucaagccucagcugcuucuucuucuuuuuaauuagcugagucucucucucucucucucucucucucucucucucucucucucucucucuuucucucucucucucuccuuccucccuucucgccucacucgcuccggcccaaagauugauugauugauugauugauugauugauuauauguaaauacacuguagcuguccucagacacaccagaagagggcaucagaucccauuacagaugguugugagucaccaugugguugcugggauuugaacucaggaccucuuccagagcagucagugcucuuaaccgcugagccaucucucuagccccgcaagccccagcuucuuaggggaacauguuuuuagagguuggggcgagugugcacccugaacagacagugaucuagggcuccgggguggaaauaaagcucuccccaugcccccaccgauggggaccccaucacccucaccgauaucuccauggugagauggagcgcucgugagugucagcuuccagcaccuccuccggccgcagcacggggcacuguguuccagcuagagguccuucaugcugucuccuguggcccguggccuccaaacuggccaccagggccacagggagggccugcucccaccuggcacuucgaguuagcagguguggaggagccuggccgugagauaauuccucagcagaguagcaccgcaggguccuauggcuucgggguuucccccaggacgggggaucuuggugggucaucccaguaggcaaccagccuagaagcaggagacucuguggagcaaggcaggugcaugguuaggggaagcccagagaacacccauuuccucccaagguugcc

SEQ ID NO: 4857 - RNA, 8187 nt, Mus musculus
cugagcagggggcgggccgaucagugaggacuugcgaagugggcugcagaguuggaccgggcugcugcgugugcgcaggguccucgucauggggcagaucgagugggccaugugggccaacgaacaggcgcuggcgucuggccugagugagugaggugggcugcggguggagggguugcucaggacccguggggcaccgcgggggaagcagggcucgggcugguucugcggaccucaaagcgcggauccucggagagaccuaccggggccuccgggcacaggacgggcgguggccgcugcaggccgugcucggccgccuguucuagaggcgaccccgcccugcacccuguuggguccgcgcugggaccucagaggaggaaguugcuuacagcuggggaagagacauucacucggugguuucccgccugguuaggaaaacccccggaagacccucuucugcgcacagcccacuuggccaggaguugggacucuggccuugaggucacucgggcuccggcuucuccccgaggggccugggauaggagcuaagcucauccuagaggagcaaucggcuccaucccacaagcgaagugugcgcagaaacuauuucacaagagucuggacaccccucagagugaucuuagcccugauggccugccgaguuaagaugcaggacacuagucuuuagucagguugacacuggccguggcuugaacaguucagcuugucugggagguuugccaaggggcagugggaccccugggcuucacuguaccaggaaaggaaccuaauagaccagaccaugagcagcaggccugagacuagaaacugcagacaugccucaaagccgaagggagccagaaaagaccugccagggcagggaggauggcccagaccccccuccacucacccgggaauagcgcaucgaagaggugauagagaaaucucccccagcccacgcuggaagcucccguggaaggccuugcaaccccaaccuuuugaaaauggcgccccucccccaccugcagucucccuucuuacccuucccagccuccugccaguagugguuuguccugugaccacuauggacgguuucaaaaguuaccuccaggaagugggggugccagacacaccuaagggugggaagaccuggcgagcgcuguccaugcagugucuccuguccucgugugugcuaaggucucuauguacugccucagcuaauuguucaggguguucaggcugacacaagucuccugugcugaggagucacaggcuguggccacuuacuuucuccaccgagugugacuuccgcuaacuuuucuuuuuacgggaaagcacaacuguccugggaagguucugaacugucuagguccaaucaacagggauguacuuuguuuccuuuuguuuuuuuaacauuugauuuuuuucagauugugugugugucuggccauguguguaagugcgggggcgcuugcagacaaaggcuagaagaggguauuggaacccauggagcugguguuacauacggguggcucugaacugccugaugcgggugcugagaaccccacucaggucccuuggagagcaacccucgcuacuaaucccugagccaucucuccagcccccuauuuuguuuuuuucuaaaucacagaaaauuccaucuguucuggccccauuaccuggcuccaucucaagacgaaagcccguuccugaccccccugcuugucuccugggcucuuccugccuuccuugcuagguugcuccuucucugucucugaguuuccugaaugugcacggggaggggggcggggggggggggcuuuuuguacaauuggcuggggucacagcugaugccuccuuuucagucuugacucagaugccaccugcugagacaucaaccucagauagugggcuucccugggauugaacccucuguuacaguguaucacuucagcaagccaggggcuugagaaucaguccuugggucucccuguuggguaaagaaugaccccucccacucaugguggucaguguagcagaagcucacagugaggacaugagucccuaaggacuauggguagcaggccgagugaaugugugacaaaguacccuucccuccugcagagugcacccuuaaagcugaccagcaaaacaggaagguuaauauguagccgagcuucaagcccagcauagcaaaacaccaauacuauuuaaagagugggagagggaccuggagucuggggauguccagaacagcauggaagcuuuuccugaggcugcuccagggucuucguacugaagaaggcaggagucagcacccuagcaagauugucauagagcaucagucccuccagcugccaagagcuguugcugccagggaucccaaacagccaaagccugagaccugggccugaggaggguguaggggugaggcugccuccacccacagaugcagaaacuagagaccucaaguaggccuauggguggcugugggauuaacacccuauuggcaugaggucacacucaccguuugaggaagugaacccugugaggagucggcacccacugggcaggggggcuggucccacuggaaagagggacccguguucuugaaugucaaaggagauaaauggccaccuggaucugagaaagggaauuuuguagacacacacaccgaucagcucuugaugguaguggguacacugcgaauguaucaccuugaagaaggaaacagaaggaagccaagaggaaccacacagacguggagcuuucuacacagaaguugugucacacguuguacaagaagggcgagcaugugagacgcugaguuccccagugugggggagggcuuggaggcuucgcaagcacugcccagagaugaggagacuuuaggcugaagagaaaaagaagucuuuuuuuuuuccagaacgaauggaaacaaaucccuccuuggauccacgaaagugaaauuagacaaagagagaaaaagucauggguuacuaccaggcuagaguucccagaccuaucguggaugccaggagacggugcagugauaaucggauauugagaaaagaauacaucuccgcuggcaagauccugcuguguuucagcuaccgagccucugugcagugguggcuagcggauguugccguagcgagagggaaacugaauccagagaugagcugauggucgagagagaggacagaaacugccagaugagaaacaaguuagggagcaaaagcaaagcggagcuuccuagggcccacccacagccgcgaggaaucuugcgauaaguagccuuaaagaucugggagaauuaauuuucaaaugugaggacaggaaagagaacuugacucugcguguuucuguuugaaaaguagcaaugauaccucacuguaccuuugaaaauccuugcuaaaacauauauauauauuuuuuuuuuuuuacuaaaaucuuuauugaguaaaacuuaauuuuuuuuuauuguuugaaacagggugugggccugaaaucugugauccuucugucuuagccucaagggugcugggauuccauacauggccacaccuagcugaaaaacaauacuuuggacgaguggccggagcucuuaaacauugaccuaucgcuccagcucuucuaucuuuuuaaaauuuacuuauuuuauauauaggaguacacuauagcugucuucagacacagcagaagaggaaaucagaucucauaacagauguuugugagccaccaugugguugcugggaauugaacucaggaccucuuccagagcagucagugcucuuaaccucugagccaucucuccaacaccucucugguucuuuuguaaccaaaaucuucagauguuucuuacacuuggugugucacgaaucucccuaaaacuacaacacggucuccuaguuuuuauuugcuuaccuguuuguuuugagacaggguuucaggcuggucucagauucacuaaguugcagaagaugacucugaauuccuggcccucccacagucauccccugaguacuaggauucuagggacuuaaauguaucccagccacuccuggagcauacuguguaagcgaggcuggccuuggacucacggucuuccugccucccccuuccaagugcugagauuacaugcaaguaccauguccagccuaugcagcccuggggguugcacugaggacuuugugcgugcuaggcaagccccccaccaacccagccaugucuccagccuuugcuuguuuguucguuugaggcacaaucacgcugggcggugguggcgcacgccuuuaaucccagcacuugggaggcagcggcaggcagauuacugaauucgaggccagccuggucuacagagugaauuccaggacagccagggcuacacagagaaacccugucucgaaaaaccaacuaaaacagaagaagaggaggaggagggugguccaugccugcaacacaaacacauggggcgaggaguuccagaccagccgguagcaacaacaccagagugagccccugauuauuuacagagcaccucacuucaacuucaugugagcuaaagacauagauacaagaacuuccugaaaugaaggagguugcccguugugugguuccgggguggggauggguguggggacccaagcauaacgcucguguaauucuacuguaacgaagucuugggcgggcugucugagacauuagugggggugaggguagcauaguacugcaggaaagcuccccucucccuccuccuccccucccccugucccuccuccccccaacaggguuucucuguagcccuggcuguccuggaagucccucuguagaccaggcuggccuuggucucacagacaucugccugccucugucuccugaguauugggauugaagguauaaugccaccagcgcccagcuauacccucccaaccccuaccccgggacagggauggaacccagaaaugugcuacuuacaaaaggaccaagagguaacagcauagcugaaaagaguuaacguuccaaccaggguguagcacuggacagcuaugguggaguucagcuugcugcggcuaccucccugaguguccucucugucccugaaccccuugcugcacagugcucugcuccaguaggcagagaauuggagauggucccaagcccggggcaagcucaagcuggcucacaccugcagcagauggcacauccuaaccaccucucuccauccuuaguucucaucacugggggcaucguggcuacugcuggacguuucacacagugguauuucggcgccuacucuauguauccuucuacuggggaccaggaagguggggugaugggagugcucucagcaugagcacaucaguucacggagugcuacacauagacugaccacagccuccagagacaggaccagcuccgucugcagcuuuagaggccaaggcccagggcuggaugcccccuugccaaaggccacagacgggguucaggcaaauguggagcugaggccgaaggucccaaggcuuggacuggcguccauugccccucugucccacccugcugcacaguagacuccuaggccagggccugagaacagaagaggcagagggcagcagccuaggccuagcauggcuuuccuuaaccucaccgcagcgcugcaggugugcucaucugucugcuggaguauccccggggaaagaggaaaaagggguccaccauggagcgaugguaagucauuccuacccgagaggccuggggaccugccccaugcagcccacucguccagagcucccagcccaaggccugcccagcugccaggcucaugugcccaggaggaaaaggacccauaacccuggaaggggacagauaaggagugacaagggcuucuagguguggucggugcugacccucugacguuuugucuucccgcugucuaguggacagaaguaccugaccucuguggugaagcuuuucgggccccucaccaggaauuacuacguccgggcugcccuccacuuccugugagucccucuguccauccccaggguaacagaagacuagaaggagacaccccaugggucuauagcuuggacaggaagguaucgcccagccagccaagccucuucuucauugaaguuuauccagauagaaaagcucagcuuuggggcuggagagauugcucagcaguuaggagcacugacugcucuggaagagguccugaguucaauucccagcaaccacaugggcucacaaccaucuguaauagaaucagauacccucucuucuggugugucugcagacagcuacacuguacucauauaaaacaaacaaauaaaucuuagaaaaagaaaaagaaaagcuuuuagagaggccccaaaccugcagugcacaccaagcuuagcaccugagccacaggugcuguacugggcuuguuacaccugcaguuuggggacacacccauauggccacgcuccagcucgggccuuuuccccagcaagaugucuguggcuugaaucaaaggacacaucgucacaaagaggagcuucuacaaaccccaagcuggaccugaugagagcuagccucugcccaucccccguccagggccccggggagggaaucucccucugcgacugugugaccagaugcccacugacugcuaucuguuugcuuccuccugucaugccucaagguugucggugccugcaggcuuccuccuggccaccauccuggggaccgucugcuuggccauugccagugugaucuaucugcugguaaguggcugcccucaauggucugccucccucccgcacccacccucaugaucuuggugcccguggcucucggagcagcuuucucgcucccauuggcugugucgaaugcuccucugcuguauccugggcacuucccugaugaagcuguacuguggcucggagaagcagcgugguugguccaggucauaccuccaagccuccgugugggcccaugucucauccaagccugccugaguuugggugguguuagguggacuucccaggagcucaugacacagaagcaucuauuuuauuuauucuuauuuuuauuuugagaagaagagcagggucucauguagcccagacuagccucaaacuugcucuguaguugaagauggcuuugaacuccugaucuuccugguccuccggcuucugucuccugaugcugggaugacagauaugugcugcuucagcuggccuaguuuguguucauuacaagccuucucuguucuaaggucauacagauaucucgcuguguccucuucugccagcuccauucuuaccaucuggauaaaauauucugguuuguugguuagaaggcguagccacaggugugugcucacaggugugugcucacaggugugugcucacaggugugugcugugcugcagacuuucuaucucucgagcauugugggauaugaaaucgaucugucaauugauucauucuggcuuuuugagacaggguuucucuguguagcuuuggcugucuuagaacucacccuguagaccaggcuggccucggacucagagauccaccugccucugccucccgagugcugggauuaaaggcgggugccaccacuauucagcauuuuuuuuuaaaagaauuguuuauuuauuuuacguauauaaguacacuauuccugucuucagacacaccagaaaaggccaucagaucccauuacaaaugguugugguuugccaugugguuucuggguauugaauucaggacuucugggagagcagcaaucagugccuccagccccaacccauguccacuggagucccuagggacaguaagcagcuucaaccauaacauagccccccucugccccaggcagccauccgaggugagcaguggacucccauugagccuaaacccaaggagcggccacagguuggaggcaccaucaagcaaccaccuaccaaccccccaccccggccacccgcagagguccgaaagaagccgagugagggugaagaggaggcagccucagcuggaggaccccagguuaacccaaugccagugacagaugaggucgugugaccuucaguggcugucuacagcuccugcuugaguuucuguggaguuguccccccccccccagggugguguugcucacuguaauaaacaugauuaauagcugguacggaca

SEQ ID NO: 4858 - RNA, 9980 nt, Mus musculus
ucgcgugggugcuuggaaacacuuuauuuaaaacucuuuugaaaagacagcaauuuaugccaugaacagaauaagaugcugacaaauguuuucuugccugaccugccaccaagcaggucucucuggcccuugagggcucuaccacugguaagggaagucccugccugaggagggaugcgguuggcucuggaaggugacagggcagggcagaaggacuccauucugucugggcuguccuacaucugcugggagcagccacagcaaguggcccgccggugcuaggguuucuucugggucaucaagagaaagcaccagacaggagccaccuccucagagaucacauggcuuggggacgccaccugucacacagacaaagcccuggccacacccacgcuccucccucuacacucaucccacauguuuuugauuuuuuuuuuuaaaaauauaacuuuguaaaugcuccauaaaaauacugcucuuccuagucaaaccuggguauugcgauagaagaguaacugcuuugucuuugcucuagaaaacaugaaaagauuaucacacaggauaagauagaaaaacgcaggguuccuaaauaucacaaaagccaguaccaaaugcucacgguggaagcgaagcuagggaccgaccgggugggcuggcagccuuggcugggcaccucuuccccuggcccugcugggcacagcuuagggcaccucauccuucuccacacacagacaccaagucugggaaaggcagccaccugcucugacccaauggccagcacuugccccuugaagcaccgagggcccagugcugcuggccaggaccuggugguccugcuugaugacaaggggccagcuagccaggaucccagccuggggauucugagaccaacucuccuuguguaacauuccacuuggccuggugaggcgcacuccugugcaggugccagggcagaagggcaacagcccuaucccuuaaagcgggagugugucuucugccccauaagaggcggguggccaggcugugccucaguucucagagagggacagagccagggcagccuggaaggcagcuucuucgucgaugcuguaguccuggggaaaagcagagaugcaugagggaggagcaggauggcucccaaacacccacugucacagugugucccaagccuccuucacagaaugccugccccaguucuuacauguguccccaaagguagccuuggaucgugugcauaccagugcucugcagguuugugaucaugaggcgcggguuucagaugguaagaaucuuucuucuacagcuuaguuuuugguguguauauguacagacaugugugugccauagugugggcaggacagaggacuuucucauuugucacauggguaccagggauugaacucaaguugucaagcuuggcaggcaguaggagccuuuaacccacuguucuuggacaagaacuggguuuucuuagauggaaguugucaaggccaugagaucuccaaccuuggggaccaggaaaaagcaagccaacccuacguggcuagaggcugcagaugaugggaugggggugggagcuucugaccuaguuaggagugggcaggggcuccugagaaaacccuucuugcuucccuucagagucuccuugaaggaaacaccuuaccagggacucaucucggcagcugcuacagagccucagggggcccgagugggcaccaagggacucagcagcuagccucgugcaugcccaagcccuugacagguuugggugccugguggccucucgcucagcacucccacggcccagcagggaaugccuaccacgaaggugucguaggagaacuugugccggugcagcagaugcugcaggaaguuggcgcuuuuguagcugggguccccccagggcauugcugagcagauggggcauaccuagaaaagaaguugggcguagcagggaggggcccuuuccugccugcucgcccacccacccacucauaguauggcaugcagagcacccuccacuuaaggugucccauccccgagagcaggccuguccccgcaucucccucaggcagaagcccuaugcccccgcugcucaccacacgguugggaucacugcggugacuuuccacgcagugcuucaccagcuccugcugauccagauugcgggcuccgcaguaggggcaggcgaagguagaccgguuggggauauugcuaggggugggaggacacugagugugccuagggcuaagaaaccagccugcccucuguagacaggcuggugcugacccauccccugcagcccacgggagcacuauaugucuugcacggaaacuccugguccuuuucuuuaccgcacacacuggacuaaugggccauggucaugacagaagggaggugacuguaugauccuuggccuaggaagaacccuuguucugcccaucuuggguccccaucguaaaggcuugccuaccuggggaugggcugagaugugggcaccacagggacgaauuuggggcaguuagccaucugcuccuggaccuucaggcaggaggaaaugugcgcucucaucuuggccagugucaccugugagaugagagaagcggagcugggcagguuaggacucaggcagcagagauagacaauggccaccaaaggcaucgggcccgucccuucugcucuuagaacaugcagagccugagcagcaaccuagagcuggggcuucuggaagggacccuggugaggaugagaauacauggagguauacggguaucacagagccacacagacacagcaguggucauggcccuaagggaagcuccucccagagagacaggacuaggaggccccaugccugggucccuagaaaggccugcaaacggaagcgucuccagcaggcaggcaggauuaguacuuauuaggaaaaaaggccucuccacccagcugguccuaucaagucaccacaacugugccagagcaagcuggccaaggacagcagccucccugaagggaagggauauaccccugccacagaggcucaccccagccugggcucagugagcaacccugaagagagaaaagaagccauggugagccuuucccugaagggggacaucaaagcuggggguggacacuccacaagaaugaggaauguggaggccacgucaguacaccacacuugucaggugggugccgcacauguccucagcagccagaguuugugcauaagagcagcagggauccaagaagguccuccugaagucaccugucauggcuggguauccaugcaguggaaauuugccccagaagacagauuauaaacuugaggugcucaggugcagugugcagucacuucacaugcgacacugacaggauucuguccucaagucucccugggaaagucuaaccagggaacccaagcaccaagcgguacagcagcugacucagcccaaggucacuccaggucaucugccuggcgaccuucaggacacugacagguuaacacagucgcaguuuauuaacuagacaggggaugucugagacguaacugcaaugugcucccagcugcuuauuuuccuaggaauagaggaggagugugggagcaaggcggggucuggggucugugagcccaucucaggugaggggaccuugugagaugauacagugaguggugcccaggccacucugcucaggacagaccggacaccaggugcaaggagcuaauacucaaaggcccuguguuugucuggcuggaccucccaccucagcucccagaaccuucuuggcuuccacagauuugucgcagccugagugcagggucugcaugggccacagugcacaggcugaguggagccuaagucaggcaguuuuugacaacauugcuccuuggagcucugaaagggucuggcagguggcuucacacuggagcagaugugguucaacagaaagggugugagcccaugcacccaguuccucuaugggagaggggagcccgucagcggaagcugcuccccccagaaccgccccccaagccugaggaaccccgagcagggcggguaccuucuuguugcaaccccgacagggugccuuguaggaugagaguugcuucucuacauggguggccuuguccacuuucuuggggucgaagggcagacggcagagugggcacagaggggacggcaccugcagacauggcuggaggcacuccccgcagaaccugcaggugauacggaccugaggcuacucccuccaugcaggcauaaacagagcggcgccuggcugcuacugcuaguucugcagacaguuuuguguuccuaucccagccccagcccacccgcagcgggacacagacaagaggugaguggucccuccaaacaggacagcccucuuacuuggcauguccccugcggccuguacccucagaaggaacaucccugcagcagggugcgggcucuuuccucaaagucuccugauuguguggugacugacagaaccuuaggggucagggaguaaaauuacuaacaacugugaagaagaaaacgccaggccuggagcccugauucaccagguggucaaagcuggccaggacaggguucuaggccacaggagucuuguguccugcgaaucaaagcucagugacaggagggacugugcacucucucgcugccaugcucccagacaccagcagcaugaguucugucuuugccuggccaaaccccgagcugguguuugugggauccucugcucagcagcugcacaccaguggggaacggaaggaaaggagugucacugugcgagcugauggcuggucuugcugccaaccugacuacaucuggaauuagcuacaaccaaauggcugggcacaccugugagggauuuuuuuuuuuuucuaauuaaagcauuugauguggguagacccacuucuaauccagaucuuugagaccuugaaucugggccguaacuucugcuggcagccgaugauauaaaggacacaaagaggaaguucgcucucugccugcuugugcuugcucucacuggcagguccauuccuucacuggcauuacacucuacuuuuuggaauucuggaguauccugaagaccagcugagacaccugaugcuguagacugaacaaguacuggauucuuuggccauuguuggacuagcaagacuauggccuguaaaccauucuaauaaaccaaucccauauauauauucauauucauucuauucuguuucucuagagaacacugacuaauacagauuuuggugucagcauugucuuugaagcaagaagagaaguauaaggaugaauuuuuagguaucugaagcaggcuuuccaauuugcugacaccuacagcuauuagagccuccccuggaagcgcacugaguacugaaagcccguggugugaacuaguuuaugaacugaagaaaaugaauggauuugauuaugcugguucaucaacugagaggcgauggauuuggugacucuguguauguguguguguguguguguguguguauauauauacacacacacacacacacacacauacauacauauauauacacaaacacauauauauauauacaauuuguagaaaaaguaaggagaaugcugcugcugguuggcugcuccuggcauccccauauaaauuaaaacgggaguagaaugagcugugugguuccaguuagccgccuucccgcacagggaauucagugaaggacaaugauggagaaugauaaaacugaccagcuccagaagggaagacacagcgggaagguuucuaggugcaggugcccuggaagagaaccuucuguccagcagccacagagugcacgcugaagagaaucaaaccucauuguaagguuggcuaaaugacagcaagaacucaagccccaaccucagagggcauggacauuaacugggaaagaguggaauccuggugccugggaugaacacgcgugggaggacgacagugaagcugagaaggcugaagccucggauccucgaaggucuauuuccugagaagucuccacccucagcagauggacuccuaccuccggcucccugaacugccucuucuaccuuugacugaggaaauuaauuguucacugucugcuaaaacagcagugacucugacuaaaggaaacgccaggcaagacagcacugaugucucucagcgcccaccaacagguagguaccucuagacccauaaccagacuuaaugcuagcaggcuccuagacaggagguaaaaaaauguagucccugaggaagugagccauacuacuaaggagcuuaaugaguuugcuaacucacuaagcagaagccuggggaauaugugugggaauggacuuuacguguguaggauaaugguggaaggaacauaaaacuagaucaggcugaguuuauugauaugagcccauuaagauucuagguuuaauguggaagcuugagguuuuaagaggugaccucugcacagaauggcaagugcucauuaauagcaccggguaggaggagggggagugacucagccuccaggacugaaggaggaggcuccgagaagacagugugaaaguuuacuucucuuggaggcuguggggucaggaugaugagccacacuggucaggugucagaauauuccugaauuugcaggugacauagccaaugucccuucuagcacuuugagaucucaagaaaauguccuuagccgggcgugguggcgcacuccuuuaaucccagggaggcagagguagguggauuucugaguucgaggccagccuggucuacagagugaguuccaggacagccagggcugcacagagaaacccugucucgaaaagccaaaaaaaaaaaaaaaaaaaaaaaaaagaaaauauucuuugaaacaaugagggugguggaccccuagguagugucaaaggucccugcacccuucuuuuugauggagcuaccaccuggcaagccauauuaacagagccaagagaaacaagaucagccugagagucgacacucagugggugugaaggacucucggaagcacuguccugcagucagaguggcuugcucucaccuaccucacccuggcagagcaggcagagauggcaccagcaaccacacacccagacuuggaaucccaguuccguuuauaggaaaugugcagcacggcccaaucccgagagugagcgaacuggugagcagaugccaggacugugcaaggaguggcugcuuuuugggguggagaauguucuagauggcgcuaaagguugugugacugagcaugaggggaaccaauggcuucuacaguuguugagcuuuuugaggcacaaggcuggagagauggcucagugacucacugguuaagagcccugguugcuccugcagacaugguggcuaucgacugucugcagcuacagucccaaggcgguccagugccauuucuggccuccaugggaggugcaugcaugauacagacauacaugcaagcaaaacacccauaaaacaaaaaauaaaaacccuaaaaacuuuaacaaaaagacuucacuuuguggccugugccaggcuuugaacucauuccugucuuaccucagucuuccaaauacuaggagugcuaccaauuuauagguaggagccaccaugccugaucugaaugaacaaaccaugcagcccuauauucuaccucagagaaacccacagggagagcaaggccacacugggaaaaaggaaaauggucccagaagagcaggccuucaaagaugcuggcguggccagaggaaggcacuccuucucuaagaaggcgaggaggucucaagucuacgcggugacucuccccaagaggaaguagaacgaaacguggggcucuuggccuaguuuccagaccacacuucucccacagagaguuccugccugcaucuacagaggcugguguagggcagcuucuccaccaugugacacaacugagggcgugaaugugggagagaacacccauugcauugccccuuccuguguucuuccacccucaaggcagccaguucccucaggcaaaguugcuuugugaagucucaagacugcuccucuguggccuugggauacagccuggagcacaccucuacaguggccuugggauaguuccuggagcacaccuccacaguggcgccacuggcaggccuccugccuguaucugcagccacaaagucuccccacuuccucuccuucucuuguccggguagcagugcagcaacucuguagggaggguucuacucacaaaaaaccucaagaaggaaacagcuucuggucaggaggugaagacagagggaucagugacauuuuaaaaggugaugugaaaacuuaacccucacacuuauuuuaaacaagggcuacacccaacagacacugcgaauuaaagguaggacugaacagcuggggaaacggaacuggcaaagaaagcagggccaccuucccaaggugacgcuguccagauaaaagccugcagagggagcaaugggaacagguuuacagguuuaaaggugcuuuucaaucccguguucuaccuuucuaagaggacaacacauacugauuggugaauaguagcaaacugaagaaugcagcaguggccugugugcaccgagugaagggauuguaaaaaaaaaaaaaaaaaaaaaaagacaacacuucacagaacacaccguaaaacacccacuugugcgugcauacaaaaaaauggguccugauccaaggcuuccugcuagaauaucacaggagcauuaggcugagcaggagcuagcugugcucuuccaagacaaccuagcagagcucuccagagggauccagucuucgguucagccugacacagggggcagggaaagucaaggcagcccuggauggagacaaggucucugccaccucccuguaugacucgcaggcacacgccuacccaagcggcuccaguucccucugcauuagagccuccaaaaucagcugccucuguuugcaaaaugccucccaccaaucugggugcaccuuguccugccccaagcagaggggcugucugcugacaaguccuccuccugcccguucucuaucggcuaaucucaagagcuguacuguggggaggucauggagcagacguucuaucuuggcucccucccaaccaggcugggguugugaaggcccugagcaccgcucccucccgcgcagagucacauccucaaguuucugcuccugaaacacgggaggaggagccgcuagauuggggguggggggugucuuggcucagcugggcaccuaacgaagugcuugaugucugggucccuuuaggccccgcuaccuggaagcuuccuguucagaauaggccaaguccuucaaaacaaaacaccaggcuccaaacgcgucccucuccuaacuuuagggaaacucauuuccuugacagucaacacgaguagacaugggguggaacagaguggguugcagaagccacaagucguuuauuuacaacggcccgcucacccgaucucugcaagcccggacccccgcgcucggcgcagcggccgcguccaccgcccucgaagcagccggcggccguuggcaacgcgcggggccggggcgggugcagggcgcgcgcgcggccggcgggcaggggcugcuuuccccacgucuccuuucggccgccagccacgaccccggcccggaccccccucccgcgggcucccggcgcgcgcucucacguguggccgcagcugccgauggccacuggccgaugguacaccuccaggcagaugggacagcugaacugcgccuccaggccgcugucgccgcccgcgggcccagccggcggcugccgcugcugcgccgaggccaccaggcugcggaacaucgccauccccggggcaggccgccgccgccgcccccuauccaggccggcagacccggcgucacugccgcgacggcgccgcgcuggcgucaccgcccaggccccaccuccc

SEQ ID NO: 4859 - RNA, 9980 nt, Mus musculus
gggagguggggccugggcggugacgccagcgcggcgccgucgcggcagugacgccgggucugccggccuggauagggggcggcggcggcggccugccccggggauggcgauguuccgcagccugguggccucggcgcagcagcggcagccgccggcugggcccgcgggcggcgacagcggccuggaggcgcaguucagcugucccaucugccuggagguguaccaucggccaguggccaucggcagcugcggccacacgugagagcgcgcgccgggagcccgcgggagggggguccgggccggggucguggcuggcggccgaaaggagacguggggaaagcagccccugcccgccggccgcgcgcgcgcccugcacccgccccggccccgcgcguugccaacggccgccggcugcuucgagggcgguggacgcggccgcugcgccgagcgcggggguccgggcuugcagagaucgggugagcgggccguuguaaauaaacgacuuguggcuucugcaacccacucuguuccaccccaugucuacucguguugacugucaaggaaaugaguuucccuaaaguuaggagagggacgcguuuggagccugguguuuuguuuugaaggacuuggccuauucugaacaggaagcuuccagguagcggggccuaaagggacccagacaucaagcacuucguuaggugcccagcugagccaagacaccccccacccccaaucuagcggcuccuccucccguguuucaggagcagaaacuugaggaugugacucugcgcgggagggagcggugcucagggccuucacaaccccagccugguugggagggagccaagauagaacgucugcuccaugaccuccccacaguacagcucuugagauuagccgauagagaacgggcaggaggaggacuugucagcagacagccccucugcuuggggcaggacaaggugcacccagauuggugggaggcauuuugcaaacagaggcagcugauuuuggaggcucuaaugcagagggaacuggagccgcuuggguaggcgugugccugcgagucauacagggagguggcagagaccuugucuccauccagggcugccuugacuuucccugcccccugugucaggcugaaccgaagacuggaucccucuggagagcucugcuagguugucuuggaagagcacagcuagcuccugcucagccuaaugcuccugugauauucuagcaggaagccuuggaucaggacccauuuuuuuguaugcacgcacaaguggguguuuuacgguguguucugugaaguguugucuuuuuuuuuuuuuuuuuuuuuuuacaaucccuucacucggugcacacaggccacugcugcauucuucaguuugcuacuauucaccaaucaguauguguuguccucuuagaaagguagaacacgggauugaaaagcaccuuuaaaccuguaaaccuguucccauugcucccucugcaggcuuuuaucuggacagcgucaccuugggaagguggcccugcuuucuuugccaguuccguuuccccagcuguucaguccuaccuuuaauucgcagugucuguuggguguagcccuuguuuaaaauaagugugaggguuaaguuuucacaucaccuuuuaaaaugucacugaucccucugucuucaccuccugaccagaagcuguuuccuucuugagguuuuuugugaguagaacccucccuacagaguugcugcacugcuacccggacaagagaaggagaggaaguggggagacuuuguggcugcagauacaggcaggaggccugccaguggcgccacuguggaggugugcuccaggaacuaucccaaggccacuguagaggugugcuccaggcuguaucccaaggccacagaggagcagucuugagacuucacaaagcaacuuugccugagggaacuggcugccuugaggguggaagaacacaggaaggggcaaugcaauggguguucucucccacauucacgcccucaguugugucacaugguggagaagcugcccuacaccagccucuguagaugcaggcaggaacucucugugggagaaguguggucuggaaacuaggccaagagccccacguuucguucuacuuccucuuggggagagucaccgcguagacuugagaccuccucgccuucuuagagaaggagugccuuccucuggccacgccagcaucuuugaaggccugcucuucugggaccauuuuccuuuuucccaguguggccuugcucucccuguggguuucucugagguagaauauagggcugcaugguuuguucauucagaucaggcaugguggcuccuaccuauaaauugguagcacuccuaguauuuggaagacugagguaagacaggaaugaguucaaagccuggcacaggccacaaagugaagucuuuuuguuaaaguuuuuaggguuuuuauuuuuuguuuuauggguguuuugcuugcauguaugucuguaucaugcaugcaccucccauggaggccagaaauggcacuggaccgccuugggacuguagcugcagacagucgauagccaccaugucugcaggagcaaccagggcucuuaaccagugagucacugagccaucucuccagccuugugccucaaaaagcucaacaacuguagaagccauugguuccccucaugcucagucacacaaccuuuagcgccaucuagaacauucuccaccccaaaaagcagccacuccuugcacaguccuggcaucugcucaccaguucgcucacucucgggauugggccgugcugcacauuuccuauaaacggaacugggauuccaagucugggugugugguugcuggugccaucucugccugcucugccagggugagguaggugagagcaagccacucugacugcaggacagugcuuccgagaguccuucacacccacugagugucgacucucaggcugaucuuguuucucuuggcucuguuaauauggcuugccaggugguagcuccaucaaaaagaagggugcagggaccuuugacacuaccuagggguccaccacccucauuguuucaaagaauauuuucuuuuuuuuuuuuuuuuuuuuuuuuuuggcuuuucgagacaggguuucucugugcagcccuggcuguccuggaacucacucuguagaccaggcuggccucgaacucagaaauccaccuaccucugccucccugggauuaaaggagugcgccaccacgcccggcuaaggacauuuucuugagaucucaaagugcuagaagggacauuggcuaugucaccugcaaauucaggaauauucugacaccugaccaguguggcucaucauccugaccccacagccuccaagagaaguaaacuuucacacugucuucucggagccuccuccuucaguccuggaggcugagucacucccccuccuccuacccggugcuauuaaugagcacuugccauucugugcagaggucaccucuuaaaaccucaagcuuccacauuaaaccuagaaucuuaaugggcucauaucaauaaacucagccugaucuaguuuuauguuccuuccaccauuauccuacacacguaaaguccauucccacacauauuccccaggcuucugcuuagugaguuagcaaacucauuaagcuccuuaguaguauggcucacuuccucagggacuacauuuuuuuaccuccugucuaggagccugcuagcauuaagucugguuaugggucuagagguaccuaccuguuggugggcgcugagagacaucagugcugucuugccuggcguuuccuuuagucagagucacugcuguuuuagcagacagugaacaauuaauuuccucagucaaagguagaagaggcaguucagggagccggagguaggaguccaucugcugaggguggagacuucucaggaaauagaccuucgaggauccgaggcuucagccuucucagcuucacugucguccucccacgcguguucaucccaggcaccaggauuccacucuuucccaguuaauguccaugcccucugagguuggggcuugaguucuugcugucauuuagccaaccuuacaaugagguuugauucucuucagcgugcacucuguggcugcuggacagaagguucucuuccagggcaccugcaccuagaaaccuucccgcugugucuucccuucuggagcuggucaguuuuaucauucuccaucauuguccuucacugaauucccugugcgggaaggcggcuaacuggaaccacacagcucauucuacucccguuuuaauuuauauggggaugccaggagcagccaaccagcagcagcauucuccuuacuuuuucuacaaauuguauauauauauauguguuuguguauauauauguauguauguguguguguguguguguguguauauauauacacacacacacacacacacacacauacacagagucaccaaauccaucgccucucaguugaugaaccagcauaaucaaauccauucauuuucuucaguucauaaacuaguucacaccacgggcuuucaguacucagugcgcuuccaggggaggcucuaauagcuguaggugucagcaaauuggaaagccugcuucagauaccuaaaaauucauccuuauacuucucuucuugcuucaaagacaaugcugacaccaaaaucuguauuagucaguguucucuagagaaacagaauagaaugaauaugaauauauauaugggauugguuuauuagaaugguuuacaggccauagucuugcuaguccaacaauggccaaagaauccaguacuuguucagucuacagcaucaggugucucagcuggucuucaggauacuccagaauuccaaaaaguagaguguaaugccagugaaggaauggaccugccagugagagcaagcacaagcaggcagagagcgaacuuccucuuuguguccuuuauaucaucggcugccagcagaaguuacggcccagauucaaggucucaaagaucuggauuagaagugggucuacccacaucaaaugcuuuaauuagaaaaaaaaaaaaaucccucacaggugugcccagccauuugguuguagcuaauuccagauguagucagguuggcagcaagaccagccaucagcucgcacagugacacuccuuuccuuccguuccccacuggugugcagcugcugagcagaggaucccacaaacaccagcucgggguuuggccaggcaaagacagaacucaugcugcuggugucugggagcauggcagcgagagagugcacagucccuccugucacugagcuuugauucgcaggacacaagacuccuguggccuagaacccuguccuggccagcuuugaccaccuggugaaucagggcuccaggccuggcguuuucuucuucacaguuguuaguaauuuuacucccugaccccuaagguucugucagucaccacacaaucaggagacuuugaggaaagagcccgcacccugcugcagggauguuccuucugaggguacaggccgcaggggacaugccaaguaagagggcuguccuguuuggagggaccacucaccucuugucugugucccgcugcgggugggcuggggcugggauaggaacacaaaacugucugcagaacuagcaguagcagccaggcgccgcucuguuuaugccugcauggagggaguagccucagguccguaucaccugcagguucugcggggagugccuccagccaugucugcaggugccguccccucugugcccacucugccgucugcccuucgaccccaagaaaguggacaaggccacccauguagagaagcaacucucauccuacaaggcacccugucgggguugcaacaagaagguacccgcccugcucgggguuccucaggcuuggggggcgguucuggggggagcagcuuccgcugacgggcuccccucucccauagaggaacugggugcaugggcucacacccuuucuguugaaccacaucugcuccagugugaagccaccugccagacccuuucagagcuccaaggagcaauguugucaaaaacugccugacuuaggcuccacucagccugugcacuguggcccaugcagacccugcacucaggcugcgacaaaucuguggaagccaagaagguucugggagcugaggugggagguccagccagacaaacacagggccuuugaguauuagcuccuugcaccugguguccggucuguccugagcagaguggccugggcaccacucacuguaucaucucacaagguccccucaccugagaugggcucacagaccccagaccccgccuugcucccacacuccuccucuauuccuaggaaaauaagcagcugggagcacauugcaguuacgucucagacauccccugucuaguuaauaaacugcgacuguguuaaccugucaguguccugaaggucgccaggcagaugaccuggagugaccuugggcugagucagcugcuguaccgcuuggugcuuggguucccugguuagacuuucccagggagacuugaggacagaauccugucagugucgcaugugaagugacugcacacugcaccugagcaccucaaguuuauaaucugucuucuggggcaaauuuccacugcauggauacccagccaugacaggugacuucaggaggaccuucuuggaucccugcugcucuuaugcacaaacucuggcugcugaggacaugugcggcacccaccugacaagugugguguacugacguggccuccacauuccucauucuuguggaguguccacccccagcuuugaugucccccuucagggaaaggcucaccauggcuucuuuucucucuucaggguugcucacugagcccaggcuggggugagccucuguggcagggguauaucccuucccuucagggaggcugcuguccuuggccagcuugcucuggcacaguuguggugacuugauaggaccagcuggguggagaggccuuuuuuccuaauaaguacuaauccugccugccugcuggagacgcuuccguuugcaggccuuucuagggacccaggcauggggccuccuaguccugucucucugggaggagcuucccuuagggccaugaccacugcugugucuguguggcucugugauacccguauaccuccauguauucucauccucaccagggucccuuccagaagccccagcucuagguugcugcucaggcucugcauguucuaagagcagaagggacgggcccgaugccuuugguggccauugucuaucucugcugccugaguccuaaccugcccagcuccgcuucucucaucucacaggugacacuggccaagaugagagcgcacauuuccuccugccugaagguccaggagcagauggcuaacugccccaaauucgucccuguggugcccacaucucagcccauccccagguaggcaagccuuuacgauggggacccaagaugggcagaacaaggguucuuccuaggccaaggaucauacagucaccucccuucugucaugaccauggcccauuaguccagugugugcgguaaagaaaaggaccaggaguuuccgugcaagacauauagugcucccgugggcugcaggggaugggucagcaccagccugucuacagagggcaggcugguuucuuagcccuaggcacacucaguguccucccaccccuagcaauauccccaaccggucuaccuucgccugccccuacugcggagcccgcaaucuggaucagcaggagcuggugaagcacugcguggaaagucaccgcagugaucccaaccguguggugagcagcgggggcauagggcuucugccugagggagaugcggggacaggccugcucucggggaugggacaccuuaaguggagggugcucugcaugccauacuaugagugggugggugggcgagcaggcaggaaagggccccucccugcuacgcccaacuucuuuucuagguaugccccaucugcucagcaaugcccuggggggaccccagcuacaaaagcgccaacuuccugcagcaucugcugcaccggcacaaguucuccuacgacaccuucgugguaggcauucccugcugggccgugggagugcugagcgagaggccaccaggcacccaaaccugucaagggcuugggcaugcacgaggcuagcugcugagucccuuggugcccacucgggcccccugaggcucuguagcagcugccgagaugagucccugguaagguguuuccuucaaggagacucugaagggaagcaagaaggguuuucucaggagccccugcccacuccuaacuaggucagaagcucccacccccaucccaucaucugcagccucuagccacguaggguuggcuugcuuuuuccugguccccaagguuggagaucucauggccuugacaacuuccaucuaagaaaacccaguucuuguccaagaacaguggguuaaaggcuccuacugccugccaagcuugacaacuugaguucaaucccugguacccaugugacaaaugagaaaguccucuguccugcccacacuauggcacacacaugucuguacauauacacaccaaaaacuaagcuguagaagaaagauucuuaccaucugaaacccgcgccucaugaucacaaaccugcagagcacugguaugcacacgauccaaggcuaccuuuggggacacauguaagaacuggggcaggcauucugugaaggaggcuugggacacacugugacaguggguguuugggagccauccugcuccucccucaugcaucucugcuuuuccccaggacuacagcaucgacgaagaagcugccuuccaggcugcccuggcucugucccucucugagaacugaggcacagccuggccacccgccucuuauggggcagaagacacacucccgcuuuaagggauagggcuguugcccuucugcccuggcaccugcacaggagugcgccucaccaggccaaguggaauguuacacaaggagaguuggucucagaauccccaggcugggauccuggcuagcuggccccuugucaucaagcaggaccaccagguccuggccagcagcacugggcccucggugcuucaaggggcaagugcuggccauugggucagagcagguggcugccuuucccagacuuggugucuguguguggagaaggaugaggugcccuaagcugugcccagcagggccaggggaagaggugcccagccaaggcugccagcccacccggucggucccuagcuucgcuuccaccgugagcauuugguacuggcuuuugugauauuuaggaacccugcguuuuucuaucuuauccugugugauaaucuuuucauguuuucuagagcaaagacaaagcaguuacucuucuaucgcaauacccagguuugacuaggaagagcaguauuuuuauggagcauuuacaaaguuauauuuuuaaaaaaaaaaaucaaaaacaugugggaugaguguagagggaggagcguggguguggccagggcuuugucugugugacagguggcguccccaagccaugugaucucugaggagguggcuccugucuggugcuuucucuugaugacccagaagaaacccuagcaccggcgggccacuugcuguggcugcucccagcagauguaggacagcccagacagaauggaguccuucugcccugcccugucaccuuccagagccaaccgcaucccuccucaggcagggacuucccuuaccagugguagagcccucaagggccagagagaccugcuugguggcaggucaggcaagaaaacauuugucagcaucuuauucuguucauggcauaaauugcugucuuuucaaaagaguuuuaaauaaaguguuuccaagcacccacgcga

SEQ ID NO: 4860 - RNA, 2781 nt, Mus musculus
uguugcaaccccgacagggugccuuguaggaugagaguugcuucucuacauggguggccuuguccacuuucuuggggucgaagggcagacggcagagugggcacagaggggacggcaccugcagacauggcuggaggcacuccccgcagaaccugcaggugauacggaccugaggcuacucccuccaugcaggcauaaacagagcggcgccuggcugcuacugcuaguucugcagacaguuuuguguuccuaucccagccccagcccacccgcagcgggacacagacaagaggugaguggucccuccaaacaggacagcccucuuacuuggcauguccccugcggccuguacccucagaaggaacaucccugcagcagggugcgggcucuuuccucaaagucuccugauuguguggugacugacagaaccuuaggggucagggaguaaaauuacuaacaacugugaagaagaaaacgccaggccuggagcccugauucaccagguggucaaagcuggccaggacaggguucuaggccacaggagucuuguguccugcgaaucaaagcucagugacaggagggacugugcacucucucgcugccaugcucccagacaccagcagcaugaguucugucuuugccuggccaaaccccgagcugguguuugugggauccucugcucagcagcugcacaccaguggggaacggaaggaaaggagugucacugugcgagcugauggcuggucuugcugccaaccugacuacaucuggaauuagcuacaaccaaauggcugggcacaccugugagggauuuuuuuuuuuuucuaauuaaagcauuugauguggguagacccacuucuaauccagaucuuugagaccuugaaucugggccguaacuucugcuggcagccgaugauauaaaggacacaaagaggaaguucgcucucugccugcuugugcuugcucucacuggcagguccauuccuucacuggcauuacacucuacuuuuuggaauucuggaguauccugaagaccagcugagacaccugaugcuguagacugaacaaguacuggauucuuuggccauuguuggacuagcaagacuauggccuguaaaccauucuaauaaaccaaucccauauauauauucauauucauucuauucuguuucucuagagaacacugacuaauacagauuuuggugucagcauugucuuugaagcaagaagagaaguauaaggaugaauuuuuagguaucugaagcaggcuuuccaauuugcugacaccuacagcuauuagagccuccccuggaagcgcacugaguacugaaagcccguggugugaacuaguuuaugaacugaagaaaaugaauggauuugauuaugcugguucaucaacugagaggcgauggauuuggugacucuguguauguguguguguguguguguguguguauauauauacacacacacacacacacacacauacauacauauauauacacaaacacauauauauauauacaauuuguagaaaaaguaaggagaaugcugcugcugguuggcugcuccuggcauccccauauaaauuaaaacgggaguagaaugagcugugugguuccaguuagccgccuucccgcacagggaauucagugaaggacaaugauggagaaugauaaaacugaccagcuccagaagggaagacacagcgggaagguuucuaggugcaggugcccuggaagagaaccuucuguccagcagccacagagugcacgcugaagagaaucaaaccucauuguaagguuggcuaaaugacagcaagaacucaagccccaaccucagagggcauggacauuaacugggaaagaguggaauccuggugccugggaugaacacgcgugggaggacgacagugaagcugagaaggcugaagccucggauccucgaaggucuauuuccugagaagucuccacccucagcagauggacuccuaccuccggcucccugaacugccucuucuaccuuugacugaggaaauuaauuguucacugucugcuaaaacagcagugacucugacuaaaggaaacgccaggcaagacagcacugaugucucucagcgcccaccaacagguagguaccucuagacccauaaccagacuuaaugcuagcaggcuccuagacaggagguaaaaaaauguagucccugaggaagugagccauacuacuaaggagcuuaaugaguuugcuaacucacuaagcagaagccuggggaauaugugugggaauggacuuuacguguguaggauaaugguggaaggaacauaaaacuagaucaggcugaguuuauugauaugagcccauuaagauucuagguuuaauguggaagcuugagguuuuaagaggugaccucugcacagaauggcaagugcucauuaauagcaccggguaggaggagggggagugacucagccuccaggacugaaggaggaggcuccgagaagacagugugaaaguuuacuucucuuggaggcuguggggucaggaugaugagccacacuggucaggugucagaauauuccugaauuugcaggugacauagccaaugucccuucuagcacuuugagaucucaagaaaauguccuuagccgggcgugguggcgcacuccuuuaaucccagggaggcagagguagguggauuucugaguucgaggccagccuggucuacagagugaguuccaggacagccagggcugcacagagaaacccugucucgaaaagcca

SEQ ID NO: 4861 - RNA, 2781 nt, Mus musculus
uggcuuuucgagacaggguuucucugugcagcccuggcuguccuggaacucacucuguagaccaggcuggccucgaacucagaaauccaccuaccucugccucccugggauuaaaggagugcgccaccacgcccggcuaaggacauuuucuugagaucucaaagugcuagaagggacauuggcuaugucaccugcaaauucaggaauauucugacaccugaccaguguggcucaucauccugaccccacagccuccaagagaaguaaacuuucacacugucuucucggagccuccuccuucaguccuggaggcugagucacucccccuccuccuacccggugcuauuaaugagcacuugccauucugugcagaggucaccucuuaaaaccucaagcuuccacauuaaaccuagaaucuuaaugggcucauaucaauaaacucagccugaucuaguuuuauguuccuuccaccauuauccuacacacguaaaguccauucccacacauauuccccaggcuucugcuuagugaguuagcaaacucauuaagcuccuuaguaguauggcucacuuccucagggacuacauuuuuuuaccuccugucuaggagccugcuagcauuaagucugguuaugggucuagagguaccuaccuguuggugggcgcugagagacaucagugcugucuugccuggcguuuccuuuagucagagucacugcuguuuuagcagacagugaacaauuaauuuccucagucaaagguagaagaggcaguucagggagccggagguaggaguccaucugcugaggguggagacuucucaggaaauagaccuucgaggauccgaggcuucagccuucucagcuucacugucguccucccacgcguguucaucccaggcaccaggauuccacucuuucccaguuaauguccaugcccucugagguuggggcuugaguucuugcugucauuuagccaaccuuacaaugagguuugauucucuucagcgugcacucuguggcugcuggacagaagguucucuuccagggcaccugcaccuagaaaccuucccgcugugucuucccuucuggagcuggucaguuuuaucauucuccaucauuguccuucacugaauucccugugcgggaaggcggcuaacuggaaccacacagcucauucuacucccguuuuaauuuauauggggaugccaggagcagccaaccagcagcagcauucuccuuacuuuuucuacaaauuguauauauauauauguguuuguguauauauauguauguauguguguguguguguguguguguauauauauacacacacacacacacacacacacauacacagagucaccaaauccaucgccucucaguugaugaaccagcauaaucaaauccauucauuuucuucaguucauaaacuaguucacaccacgggcuuucaguacucagugcgcuuccaggggaggcucuaauagcuguaggugucagcaaauuggaaagccugcuucagauaccuaaaaauucauccuuauacuucucuucuugcuucaaagacaaugcugacaccaaaaucuguauuagucaguguucucuagagaaacagaauagaaugaauaugaauauauauaugggauugguuuauuagaaugguuuacaggccauagucuugcuaguccaacaauggccaaagaauccaguacuuguucagucuacagcaucaggugucucagcuggucuucaggauacuccagaauuccaaaaaguagaguguaaugccagugaaggaauggaccugccagugagagcaagcacaagcaggcagagagcgaacuuccucuuuguguccuuuauaucaucggcugccagcagaaguuacggcccagauucaaggucucaaagaucuggauuagaagugggucuacccacaucaaaugcuuuaauuagaaaaaaaaaaaaaucccucacaggugugcccagccauuugguuguagcuaauuccagauguagucagguuggcagcaagaccagccaucagcucgcacagugacacuccuuuccuuccguuccccacuggugugcagcugcugagcagaggaucccacaaacaccagcucgggguuuggccaggcaaagacagaacucaugcugcuggugucugggagcauggcagcgagagagugcacagucccuccugucacugagcuuugauucgcaggacacaagacuccuguggccuagaacccuguccuggccagcuuugaccaccuggugaaucagggcuccaggccuggcguuuucuucuucacaguuguuaguaauuuuacucccugaccccuaagguucugucagucaccacacaaucaggagacuuugaggaaagagcccgcacccugcugcagggauguuccuucugaggguacaggccgcaggggacaugccaaguaagagggcuguccuguuuggagggaccacucaccucuugucugugucccgcugcgggugggcuggggcugggauaggaacacaaaacugucugcagaacuagcaguagcagccaggcgccgcucuguuuaugccugcauggagggaguagccucagguccguaucaccugcagguucugcggggagugccuccagccaugucugcaggugccguccccucugugcccacucugccgucugcccuucgaccccaagaaaguggacaaggccacccauguagagaagcaacucucauccuacaaggcacccugucgggguugcaaca

SEQ ID NO: 4862 - RNA, 70368 nt, Mus musculus
agaccaggcacauaaaucuacuucugcuuccacaggggggaugcacgggccugcaucacagagcaguuauguuauagcugccgagugaacaugaaggaccuggugaguggcuguccaucugucccuguaagcuauccccacggucccguggcuucucacacuccaucucuuguagcccuccuuggacccauugccacccuacguccuugcugaggcucagcuccgcagccagagguaacgccuaugcuuuggggaggcuggggacaccccuggccuaguucucacugcacucucccacaggggcucggucucugaggaaauccaggaguaucugauuacagaugaggaggaagacagcugagucgugcggagccaugaagcaggaaggcgaggacaaaaggauuggucugugacaguccguuuguauaaauaaaaauguuuuacuuagaaaacccuacaguacuugugggaagggagagccaggcccccagaccaacuggcagggacgcaauggguagggacacagcgucccuuugacagcagcaucaucagggcuuacguaggccaggaccugucacagcucgugccuugggcagcuacacuccaacccaaggagcucugccagcccugguggucaugcugcccugaggcagcuccuucauucccggugcccagggccugggcuccuacucccucucacguguccacuuaaucauggucucuggagaucgguacaggaagaugagcuuggcguauagcuccuccuccagcuccagcucccgggucucgcgcaccaagaagauguccuggcacagcuugaggaugcgguccacacacggcaguuccucgaacaugauggagugagagaucucgcugaagaagccccgcacaaacuugccaaccaccagcacgauggagacguacagccccacaauccugucgggagaggcgggcaugugagccgggaccacucagaacccuuggggcucucggagaucccucugcaguacucacccguagccggccaggaagcccaggcuaggugggcugaccuugucacugaagaugaccaugggcagcagguugcagucagccuugcaguccugcagcucgaugacccaccacucgaggaagucggaggccuuggugcccgcuugcuccccagaggccccugugcccacuugcucccuccgcagcuggaugcgcacaccaagguaguccucuuccucaucugaguugagugggauaguuagagucgggcuacacuggcccccggccuagcccgcaucccuacaucccugcacccacacuuccggccuagcccacaucccugcgcccugcucccacacugaccuggcugcagcugcuucacaggguuggcuucaggcccauugggagcacgaauguacuuggggaagagauggggaaugacccugugggaggagucagcaagucaggggcaucuuagcccuccugcccacaugccccacaguggcccccacucacacugacugcucaggucaggggcaucuuagcccuccugcccacaugccccacaguggcccccacucacacugacuggucaggucugcccucgagcaguugggccagcugccuucgugccguacuguugggggccagcuccaaggugugcuucucauuaguauacuccacagugccacccuuggccaggucccuggggagcaggcaguguuaggcaguguggggcaucccccagacccucauaagaacaggacccaccuuuggaaauuccagguaaagcgcaguguaaugucggcugugccguuguacagcuccugcuucaucugggcucggcugggugggcugaugcgccacagcgcccccgagcugcccucgaucugugcagugacgauguccucaggacuguacuggcuaaugaacugcauggcuagcugugugggguaugcucaguuaggggcagcaggccaccuuuccuccgucagcccuccucacacaaauggguccagugcaggucacuuacuggauaggggucaaacugcugggacagcuccucguaggccuggggugugaauggcacaauggauggcugcugggcgcucauggugaacaguggcuggggauggaagcacgcucagcauggagccccucaggcucaggggacggguggguugcuggcuggcuacucaccucauagccgccuagcuugagggugacggugacaucaaugggcugguugacgaccccgaccacagagcggaucagugacaugaagagcagagggaaccagaugauggcgaugaggaagaggauaaugaggccucccauaccauacuugacaauuuucuucuucuucugccccuugggcuggggguauuucuggaagggagacacugguuacccucccaaccccguagccacaggcucuaagccucgaccuggugucacugcauaggccugagcuccagagauaaccaucagugggggcagcuggggaaucagcuacaugccacgcucucagagaaggcagccuuucuacacagcugcaggcagggucauuggagcagagagcuuggugugacaaucuuagacauggccaaggacacuuguggaacaccagaccugagcaggagaggaagacuauuuuaaaaacugauguuucaggagugauggagagagcacacugcucugcuagggaccagaguucaguuugcagaagucauguuagauggaucacaacugccuguaccuucagccccagggcaucuggugcccucuucuggcuuccgugggcaccugcacucaugcacagacacacacacaaauagaacaguugaccugaguacacgcagggugugaucugagcauccuuucucaauggacagugaccucacaugcgccauguguaggggaacagugaaagcagcaguccguccauggaaaaggcagacgcgucagggguccugcacugcacaggaucgcuuauguggcucuaagcaggaguauugaccugcuacaaggaaggaucuugggagcauugcuagguggaggaucaccgcugaggcgaggaagccugguaugaaaugguucuguguaaacaggcaaacucacgucaaggagacuacagaucaccaaggguggagaggagauggggagcaauaaagaggacauguccuaaauguccucugugggcauuaggacauuaggugauggccuaaagcuggcugcagugaugaacaccugucugugaguaugcuaaaccacgaaacaauucugguaacaaacagcuaauagucccuaccacacaaacccaguggcgcacaaggcaaguccgcuguccacaagaguucuagaaagcucccuucuuugagcugcugugcaugcagauugugaauucccaacaaguacccauccguccucucugcccuggcaccuucucugucucucggcugcacuugaugauaaagauguuggcauagaugucuuccacacacauccaguuggacagggacagcguggugucgguccacacccaguccaugacggcccgcagcuccaccaggaacggcacuagacggaaccugccaaggccaggguugcaucagcagggccagccugcaauggcuucugacugcuccugacgaucccuaggcagaccacacucaccccuggaaaaggaagagguuuagaugguuguauuucuuggugaggaaguugcccaagauacgggugggguagccacagcggaucugguaggcggacagggcaaaguaaaugcacuugacgaaguaccacagcugugccaccgcauucuggcugaacauccugaaugggacaggacagggugucagggagacaugacaaacgguucaggaggccaaccggagcugugccacacccagagaguacaguaccucaggacagacugaggccccaacgugcagagccucacaccacccaccucucagugacagccgguaagauaaagaacauccagaugugaaucgccaccaccaggaccaccugaaaggccagcuuucccaggacagucuugcgcagguagagggcacggucgaugaccauggugccaaacuggaccagcagcaugaacaggaaggccuguggcaccuggucaucugacagcgaggaugcaaugucuguggcugcagagugcuucuguagcagaggguacaaguuggggagauggagcggcaguacaacacaggguccuaagcccaggcacuccaaagacuuagaggccagccaucugugcuggggccucaggucaacuuaccccaaaagcccaaaaaccaaagaugaugaugaugaugucgacaauaucggccaggaacaugagggcguagacgucgguggccgcccgguacuuugugugcagaaugucauggaagaaacgcugcaaggguugguagaagcucugggcccuguggauggacagccucagagguuauagagccagggacuaucuucuugcccuaacaccccucccauuccuagccaggccacucacagugacacacagaagcucugcagccggcgcccagcugccuucauucucucccgaaacuucgauuuuucuugagugugacgcggccucuuucucucuguaguuucuuuuccuucucccuccucgugcucagucucuguggguauguauguccagggaaguaccagugagccuaucagggacuggguguccacccugauaggcugaccucaccccacuucauggacagcacaggaaacucccggcagacacuauugaggagcaacugcuacuguauccucucucgggguggccccaagacuucagcccauagauacucaucccaggcauagggacagcuccaaggauggauacaggaagagcacugagcaauggugugcucccaagugcguuaucccuguacuaggcuggccaucuccaacugaggggucaucugugucuccuucccucccaggaacauggcaggggucuagucugggcucucacccaugacugcuguuccuuuggguccuggagucuccuugcgccuccugaagcguaugcugaugugccucgugugccggggcuuaagguccucugggggaucuuggauaacauccuuggaucuaauacuuccuuucccuuggauguggucccugggaguaccggccaacacuggcuccuugggaugcccagugccugucucagacugcgauuccagcuuagcuucuggcucuuccuuggccucccgguccuucacacuacuccugcaaugguccuugggauagcgauccuccucauggucccagaggccauaacacuauggaggauacggguuggugaggagccugacccaggucaggucaugcuuagaccagaggcaggcgauugggcucaggaaugcccggaguugccaagccagcccugccaccccugcacuggcuggcaggcucaccaguagcugcgagcgguggaagaagagggccaugagcugcaccaggucauacuugauguagcuguccguuuucucaaggcccaggauucgcggagggaaguagggcuuguucucauagcgccgcagcacaacguagcuguuccaggggaagaagccgaacuggaacagguauuuggugaccaccaugaccugcaggacagggcacucagccaugggccauguggcccagccccuacccuacaagcugcuacccaccucagugaagacgauagcugucauccaaaagcgcuugcuaggccucgggauggucagcauggcccacaggaacacaagcacgggcagcaccagggaggcagccgaggcugucaccaugugguuaaggaugaugaugaaguaacagagcagcuccgagugugccgccacgcacugguacccagcccugagcagccgcagaguccggcccugcugugccucaaaccgcucggccuccuccagcucagggauaugcaggcgccugccgcaggaccacaggaauuugggggcaagagccaagagcaccccuggggugcagagccuugcccacaaccauggcaauagacagacucugaucccaggccugggccuagccaguuccugccucccuuacccagcuucugucccugggcuuccugcucaggagaauucccuugaaaaccugcacacagccuagucccaucucaccuauccaguagcagcucgcuggccgugcgcauccggguacgagcauuggcuaaaagcucuugggagccgugcagggaggucccagccuggagguccccagcgucggugacaaucuccucacugccacugcggguguuauagccugugcucagggggcugcuggugucgucugucaugcuacucaaaggcucuucggcucccagcccacugugagagaaaagguuacagagggaaggguggaggacuggugccgggaagacaaggggcaacugagaucaguacuguaccccaauggcuccuccagaggacacacagaaaugggggcccccgacucacccgagcccccuugggccccacaccgaccuugaggcugugcuggguccaucccgggucuccaugggaccugacaauguggccucaucuucacccacauaaagcugguccagcacaccucggcguaccucuccaaccugcagggaggauggagaagcccucagccccugggauuggacuggcucugcuccacaugggcucagcaggcagcaguggggauguggccuugaugaaguauaggaggggcuuggcucgaggggugcucacccgaagaagcuccugggugagcagguagcgcucugcgcacagcacaucgcucauggugcgguggugcuucgugaaugcacgcagccagcgcgucagcccgucuaccguggccuggcccagcacccacaggaacugcauggugcuuagcacacgcugcaucauguggcuacggccuauagagagggcaggacggugcuggagggucggcuagccauaagagcccucagcccucugcccccuucccagcaagcgcacauaccugccaucucaucuucugggacaucuacugguuccacaucuggguucaagucaccuccuggucacagacacagucaguaucagguagcccuacagcucuccugcugaagcccccaaauacaacucaccagaagccagcugcucugcccgcuccugccgugcccgcucccgacgcugccucagcacugucugggcauugguuacccaugccugguaugccaucugccagccagauuuguuaguuaggagccuggcaucucuagcugagauacccauucacucuggcaucaugguccccucccaaggaauaugacgccgagccagccauauaccagcuauggccagccaccugcucucucuccagcugcgggucuucagugccccaagcucucucuggaaauggucuccagagacagacgugcagcugcccagcuugaccagugccagggccucaaagauggacaagggcuucuccugaucccaugacaccauuuuucaguaggcacacauggccuuucucuuagagcagguggcagucauagagcucauuggguaaggagggugggugugugaacaaaggagcaauuggugaccugugaccuucacaucacagcccguaucccuagcugccugggcaggucugaagggcuagggggaccuccuaauauguaggaacuggauuccacagcccucagauaucuguuccugcacacugcccugaucagaaacucuacagacagagcaggaaggcauggcuccaccucaccuggaaggcacucugagcugcaggccugggguccucagguagggccuccucuuccuccucgcuaucugacucaaacaggaaguagucgccagaguggaugacuauagucagcaaggguaggaaagaguaugugugugugagagccuaucuccauggcaggacccugagaaguucuggaauuccuguguucaguuuugaguugggugguagcaagcccauuguuaagaaugacugauguucccucucagcaucuuccucccacaugcuccuacuugagugccacccuucccacuaggaccaucccaugcagguuucagcaggauggggaaggcgguccaugcacagaacagagaaccaugcacagguuagguccaugcacacaaccagacaggacaaagaggagcuaguaggcaggaggguuaacagcaggagcacagaggggucaaggcaggguaccuguggcgugguccagccaggggcgccaccacugucuccguggcggggaggagcccccugggcugucaggcccuguggaggggcaaggcaagcgugaacaagcaggggaggcugugagggcagccugucuuggguacaagggcaagugacagggacagaaacagacacaggacucccccaguggcaagguuccauguggugccacaugucucagagcccuggaggauggagaggggccacaagugcagguagacagucccagguggccauauggccugcagggacaaaggggaacacaccacauggcacggggcuugggacaggguucuguggcacaucacuuacauguagcacaggacaagggaguaggacccugugacacaccacuuguacagguacagggagacuucagcagcacacaugccuggaugcagagugugugugugcgcgcgugugcauguguaugucaggggcauccucugaggugauuaguucuauccacgcuuaccuggcuccuggcugggauccugagggucuuuggacuggaguuggccacgacuugccuggcucugccuguacuucuccuguuuggcacggaugcgcuucauccugcaaguagggaggagcucugagugccaggcuggccagaagggucaaagggucccuagcccagauaacaccuacugucuuuucagcugggccagggacuucuccucaaucuggcgauggaaguugaugcucuucagguuggcugcauuguagagggcaaagccccugcaggaagagcaagaccuuagcacuuaucucagacgcaugcgcuuucucuaccucagggaugagcugggcucauccccagugccuggggagccugccugguccuccuuacacugagccaugugcuggaagacaccugccaccugcagccaugagagaggaacugucaccucuuucucuggggcagaaaaccaucacagaaaaggacauaggguggcaacucugagguagguaggugaggcagcugacccuaaguuuagcuccaggggcagagaccucugcuggaagcauaauaucaugucacagcccuccagcugggggacacucaggccacugggggccacacugccuuuuaguguccagccgugggcagcaagggccgcccuaaugauaccaaggcacuggggguucuuuggucucccuucaggugacaggaucaaguggagcugcuauuguagaagaaaccccugcugaggauggggggaggggugucuucuccaccccugggagaagcagcugugcggaccuggaugccugcagggcuguggcuuucaggucagcgcugacaugcaggaaguaguggcugagaaagaugcgccguugcaagagcaggaagaagaagcagauacugucccagaugaucccggccuccuccacaggcagcaggcagucccggucccuggucaucaucucuuuggcuguggggcagagaccagcagggcuaggggucggcaccagaagcagugggucuccuuguguccgcccccacgcacaucccuugcccacucacgaucauaguagccuuugacugugcacacgaggcugaagagcuggaugacccagcagaaguugcucugcauuugcuccacgaagacacaggacaggagcugggggcgguagugggggcagguuaacucagggcccuuggggcgggcaggggcggggccaugugggcaggggcggggccgugugaguggucugcucaccgacagcauauucuuagagaugaugacagugacauuauagaggaugaggcagucccacagcacgagcugggcucgcguguccuucugcagcaggguagugccaaacagcagcagguagaagcaggcuagcagguaccccagcccgaagaugcuuaugcggguggcccccgcaacaaacaccacaacgagcaccagccagaacagguagcggaagacggccaccuucagcauauccagauaggaccuggagggggggaggugugggggagacgucacugagguuacuggguuaccccagacagcccuuuagcgagugcuucagaguggucauggguaggaccuaccugcaguggaugaaguuggguauaggguugggcuccccacgcaggggcuccagguggucaguguugaugcccgccaugcguugccacuccuccguucgcuccgcugagaagaccugccacugcugggaggcgcaaagcagcaggaggaagucaccugcaggacaggagaggugucgcaggggcaugaagcuugcaggaggagugggagaggaagggggauagggaggaggaaggggaggaggacuguacugccugggaccgagggccuccucccauuucacaaaaaaaaaaaaaaaaaaaaaaaaaaaagugucuacauaaaagcuggaaacgggcuggugaaauggcucagcgguuaagagugccgccgacugcucuuccaaagguccugaguucaaaucccagcaaccacaugguggcucacaaccauccguaacaaaaaucugaugcccucuucuggagugucugaagacagcuacaguguacacacauauaauaaauaaauacauacauacauacaucuaaaaaaaaaaaaagcuggaaacaggaaggcauccuacugaggacaccccggucuguaugugugccauacacacgcacaugugucagagaaugugggcugcuauggcucucccugcacccgugagaucauugccuugcacacccaugaacacacagguccauaucacugugugcguacacacucugggacacguuuuugugugaaugagggucagacucaucugggugagguugcaggguggcauggcucuuuuuugggaugaagugccacucgacugucaacaccuggacaaccuguccucuugcugguuccaguucuaaacaaaggucccuguguauccaacaagcaacccucccggccccgccccugaguccuuacgcuguccugcggcaggugcccugggguaaggauacgguugcacuuacugauaagguugguggaguugggggcucugaagaagucagguagguacagccacuugaugagggcggaauucauggggauggccuugcuccagcgccauggauagucuguggacagggggcacaucagaaagggcaaaugcuguccuuauccccucugcugccaggagcccuggaggcuggggacagugucacauguuccuguguggucagaaccuguucucacaucacucucuccgucucagggacacugacccacagauucagagaucccuacaggccaugaucucuaaguagaacuacaccaggcuuggagggauggggggauggggagauaagguuggaacccacggaugagccucaccugagacagggcagguaccucccaaggagggaguguuugggaugaauuaugguucauacaauuuaacagcaugaaacauaaaauaauaaaacacaaaacgagagcuggcgagauggcucagcagguaagagcacugacugcucuuccgaaggcccugaguucaaaucucagcagccacacggcgucucacaaccacccgcaaugagaucugacguccucuucuggugcaucugaagacagcuaaaguguacuuauuuauaauaguaaauaaaucucugggccggagcgagcagggaucaagugagcgguguugaccagagcaagcagagguccuaaauucaguucccaacaaccacaugaaagcucacaaccaucuguacagcuacagugugcucauauacauaaaauaaauaaaucuuaaaaauaaauaaguaaaacauaaaaugagaacuaacucagauacccuucaacuacuauacagccuggaugugguugccucggcaaccacaccugcgaggcuccuaagugaacaggacgaccuggagggcccugccaucacuuaguacugaaagcacaguugaaggguuucuccugcacccgcuaagagaaagaagcuaaagcaacagaggcccacuguaucaucccacucugugauguuacugaacuggacggacuauggacugauguccgagcggagggggcgaggcgcagggcugacuucaaagaucugcacggagggacgugcagggucgggcaugcuugucaagaaccagggcccucuaagaacaugugugaaaugaauguguggaacugucccagguacacaacccaguuauggagggauaucccaggcaaccucacaggaaggagaggcuguuuauucagcaaggaccccagcaaucaccagcagggagagagagguggcugagccaggggugucuacugaacgucacagacugggacaaucuggggaccuggaacacuuucugcucuguuuaaaacaaagagaaggggacugggguguagcucaggaacugagcacuugccuaacguguaaaccaugggcuccaccucacccuuaggaugauuaaaaaaaaaagaacuuuaaauacauagcugaaauaugcaagcucccccucccccaccaagaagcuaguggaagaccgaagacgcaugagaacagaaagaaaagcugccacuggagcaguggacagccacccuguguuaaccccgugucuguagcaccccaaugugggcaggcaagguugcuugaacaggucaaaugggcagucaugggcuacaccagguccguggcaccaccacguggaccaccaugagcucugugcccauaaaguucuucacgcuuaaccaggcacauccaaacuuugaggcauguggcaaagccaccaaccuggcuauccagaaauguccuaggcuaggagaagcuagaugaaagagagaagaggacacaggagaacggccaagcugaggacagcuacaaagaagagcuggugcuguuuuacuacagacaacacgcccgacaaggacacugcugcuauaggcugucaggagaggcugcagcccugaaggcauccacagcucuacggacauagcgccauucugcccucaggaagccaaccuugugaaauagcacagcuauggcucaaaugguccagagagaauguacaggcuacagaggaucuaacggguucccuuggcaggaauguagguguggagcuguguaagucaggaaggugaacaggaaacggcccaggaguuuccacgugaccacacauaccaagccccucagccuguggcuuaccaaugcacagugcagggggcaugcccaaacacagcagguacugguacagcaggaacagcgugaggaacagacaguaguuaggccagaggcgggcgauggccucacggcgccggcguguaaggauggccaccaaccagcaaccguguaagaucaccaugaaguucauacgcugcccaaucacauucacggccaucaagaagcagaucuggaggggaaucaagggguggauauaauaguaagaagggagcuacuccaaguccacagacucagagcagcccugccugcccugaggucuagagugacucaucuuuacuggggacgaggggagcagucucucagaccaccguccuaggacagcagaggcuagacacaucucaucauacuuagaggaagccaaggccccgggaugaguagccccacgccuggggaagacuuuagcuucagacagugcagccuuggucuagcccugccagggagacucaguccaaucuccuuggccuuccugggcuuguggcaagccucugugcuagcccugggcuaggcugugccuacagaacucaggcaucacuagagaugcucagggggaucuccugcuaucauuccugccaaaaggaugcccagccucaccuccagcccgaauuuguagaagaagaaguugaugaaauacuugaggcagcuaaguagguccugguccaaccucuggcgggugccaucugcgcacacagccugggcgggcagaggggccugcuggugcugccggcgguagugcucuuggcgccgguacaccacggccucaaacaccagcaacagaaggaucugcaggugguucugugaagguggggucaggggucagugggggucaggggucagugggggucagaggucaguggggaccaucuggggccgucaaagaccaucuacccuggcugucaguccccacucaccuggauauagcccaaguugggguaacccuuccgcaccccaaaccaguuggcagggucaacagggccacgguacagcaaagacugguugaucuccaaaggcugcaaguugguauuguuggggaagggcugcaaagaggggugagcaugagcccccaggucccagaccuggauggaguggggauuguagaugcuaucuuuuuuuuuuuuuaaagauuuacuuauuuuaugcauaugaguacgcugucacuaucuucagacacuccaaaagagggcauuggaucccauuacagauaguugugagccaccaugugggugcugggaauugaacucaggaccucuggaagagcagucacugcucuuaaccauugagccaucucucuagccccuguaggugcuaucuuaagcccaucucacagcugaagcagcagguuggguccaggguagacaacagcuguccuaccggagguucacagggccaccuugauggggaaggggacaggucaaggcccaaauagaaagaaugaagccaggugaaucuaggcacagcuguccugagggccccucuauucuuacugcaggagucacuguccccguccacauuccaugaggaaucacugggacaacuucucaggugguccccgggcccuagggacgccuccaggccuguaccucagugcaguugcuggaguacucaugcggguugacaaucuugagcugauagagcaucuugcauacaaugaugauacagguccacacgguggacaggcaggaagccaugggccggaagcgcggauagggcaaggcgaaggcccauagcaccaccagcagcagguucaucacagacaccuguggagcacagauggcagugggcagaccaggcagcaucgggacuagacuccaggacgacugccguaaccgagcaggccuggcucuagagcagccaacaaagccagggcaggagagacccugcuucagaggaggaaacagcccagguugggacacucacuucuuucagggccacccagacaguguagagggccaccagcuugaagacgugaaguucuagcaagcgccgaacgaacaccuggauucgggugaggacagccgagaagcuggccgcuagguccagcagccggucagccaccaggccccacuugcuggccguaccuguggaggugggguucagugaggggggauaggccuuggcgaagagauagacagaagugauaaggggugaggcuuaggaaggaaagggaaacuuagugggguuuagaaggaggggggaguaaaaggggggaggacacaguaaaaggggguggagcucaggauggagggguggaguucaggguggaggggccggagcucaguauggaggggccggagcucaggauggagaggggcagagcucaggauggagggggcggagcucaggauggagugggcagagcucaggauggagggggcagagcucaggauggagggggcagagcucaggauggagggggcggggcucaggauggagggggcagagcucaggauggaggggguagaccuuggugaggaggggacugaguuccagaagaaacaggaaggguuggagcuccugucugccuuccucaaaccgacauccaggagguggcagaacugggcacagauucgccucuuagcccccugugugccuuguggggcuguguucugcccacuccuuccagccucacccucagggaccuguguggccugguggggcccauccaugcucugcccaucuucccugaagacuuccucuuccuccugaugcucaagcagaggggccucgcucacugcauccugccugggaaagcccaagugucacuuccugcccuugucccuggcucucccuucccugagacagcccccccaccccaucuccaccaguccaccuguaaacucuaggccaagucuacauggcuuaaggcugccucacggcucccgcccaagcgcaggacggucggcuaacucuaugacacagcccccagcgucaaccccaguucccacagaccaaaaaacacccguggcccucgaaggcagaacaccugugagcccaucgaggguggcgggugccugguggcggcacgugcuccaggucagugagcugcaugaacggucuguggaaguagugcagcugcaggaugcaggccagcaggaagaagccagggaugaggauacuggaaaagagcuccgacacacugaacugcuccaggcccaggucgcccaaccuggcagaagagagcgagcaccaucagcccuuuacucugcccugccccaguagcccuccugaaccagaucggagagucugagcaugggacgggacgaggaaggugccucuaccgcccccugaagagcgcucagcgguacugccccuaagguacccuacucacugcucguccgugaagcccgugagguugcgccaauagguggggaaguccuggaacuggaagguguacacagcgaugagcacgagcauuguauaggccaccacgagccaccagaagacacgcagcagcuuccuccacaggguguaguagaccugcagaaggaugggggugggguggcuggugagcagggcaggugagggacagagccccacccacgagcccuaccugcccauucccuaggucaccuggaacaaggugaggcacagcaggaagaggaacauguagacgauuuuguagaccaccaggcggccggcgaagcugaccacaaugaacaugccggcgcacacauagauccaguauuugacguagaugccggugaccagcucccccaggcuccgcagcagcgucugggucugugugggcucugcagagugggacagaaggugaagugacagccuagacagagaggggacagugcagguggagguuccacccucccgcaugccacucaccagugucggccaccgugaccuccaaaagcgccgcaggcaccuuuugcuucuucagcagcuucuccuucacgaacugacgcagaaggagccagaaugugagcagauagaggagcuguggggagcaggggugucacucagggcccagcccaugagccagggccgaggagaguccucagccucuuccaugaccucagcuucaaccucacaugcguguguagguuuacauggucacagauucacggacguacgugaaagccucagagacacaggcccccaaucuuuuuuuuuuuaaauucuuuuuuuuuuaauuuuaagauauuuauuuauuuacuauauguaaguacacuguagcugucuucagacacaccagaagagggcaucagaucucauuauggguaguugugagcuaccaugugguugcugggauuugaacucaggaccuuuggaagagcagucggaugcucuuacccacugagccaucucaccagccccaggcccccgaucuuacauacuuugcccagacuugguaaacacaaguuuacacucacaugcauacagaugcauacagauagauacacuaguacacauauagucucacuugagauguauuaaaauccaccagguuacagugggcaggcaacaccacaccugccucaugcagagauacuugggugacccaagagucaaauggaccagauuugagucacagacauucagugccacacaguggagcccugucgggcagucagaauacacacagacacucacagcaucaaggacauugcggcagcaugccacauacucggucacaacgccuauauucuaggguggacucgcaggaacccacuguugacuucagauacacucuccuucaaucucuacccaaccaaaccaauggccaacgagcagagcacuggguucccagggagaaauccuaccgcuacccagauacggccagugauacucaccauggcaccgagguccaggcaaggguagcguguguguuccagucccaacuggugcaggcugacagggcccaggguggugggcagcucaggaaguuccauggcccacacguaccucaggcagcagagcgucagcccauacagcaggaugcagggcgagcagagcauagccagcugguggcggcuacgcaccguccagaugaggcaggcccagagcagcaggacgaaggucagccagcugugguacaugaugcuccacaccugcaggcacagccagggucggucagcagggacugcaugggacacucggccagagcuucagcccccaacaguaaggccucccaugagguagcccacacacaacauguacacacacccacugcacaguuacgggauguuggugacuuacaugggcaguuccagcacuguuacugguaacuggaccucagguuuugagaugaacuacaccccaccucccugcauucuaugagaagacugcaguggccagggaguggggaggaggggagggacugcuccucccugggagggggggggcuugggggaggggcuguuccuuaccaucauggcaaucagggcacacacauagcucugguccaugaugagguggcccaggccauguagcggugacaucucuuucagcucagccagccuggggcgaacuaggggugggacugagauuagcgaccagauaggaaccaugggguccuuccccauucucaauauggcccuagagcauggaguagguugucuguagugucagggccuuacaggugugagggggccaggcccaccaggcagccacagaggaugcuggccaaagccaucagaagaguccgagccuucuggaaugucauggccaaacccuacuggccucaccuuuugaagagucucuuguaggagauggcccuuucagaucggugacucucacacuuuacacacaaugacaaguugcaaaaguggaggucugcgagaugccucagcaggcuaaggugccuggcaccaggccugaggagcagaguucaagccccaugauagaaagaaagaaccaauagcuguaaguuguccucugacuuccacacacauacaauagcuugacaccccugcacacaaucaaucaauaaauguaauuaaagauuuuucuuuuaaguucaaggaaaagaaauaaggaccuagaaaaagaucuagcagucuccacaguaaugcagaccagugaaacccccaggccagcgcucucagaaugacagaggcucccggggcucccggggccuugaaccauggguagacaauucccaucugagaacagaaaauaggagaccuggagggccacccaaagggucuaggggggucagccauagaacuggcccuaggagguucaagcauaaggcaaggggugcguauaagaccuauggccaccagggggcagucuagacuugcccacagagugaucagagcgaaugggccccugcuaauaacguucccaggagggcaucccauggccacagagccuguaacucaccuggacgcuggcggacagggcucuggcugguuaguacaugcacggugcaguugucaaggucagguuccguggucaugggcaucucacccugcagaggaugugugggucagauagucgcugccgauggcuccccaucacuuuccaauaauucccugaccgccugcucaccuggguggcgucccuagccuggggcucuggcuccaggugguccaguuccagcucaugcuccucauccucccugggugucuccuuccucugaagagaccacaaccgugagugcagucccuagaauauccaccucacccgcgugccagacgccaacagaguugacagcagggacucaccagcucugagggacagcucuuguggagcuucaggagagagguggcuguguaauauagcagcagcaggauuccgggacucacauagaugggccaggcgugcuuaguguugaguaccagggcguuggggcuggaguaguuagggaggucuacgaaguucuugagaccaaauagccuguucagagagggccaggccacugacugccaggucugcgagcagcagagcuauggcugagguggguggggcuguguggaagccuuaccuggcccagauguucccaggggguaacauguccuggauaaauggugucugauagcaguauaggcaaaugagauggccggcaccaaaacagcucaccaugacacagaggguguuaaagcccagggggcugagaggaaagugacaggaccaccaggugcagauggccaggaacaccaccagguagacgcuggagaaggccgaagggugggcuaugccuacaggggauggggugggcacaggcacucugcgucacuccuggccugacccaucgggaagcugagucaccccgccgccaccgccaccgccgccacugccaugccagucagagucaagacuccagccccugccccgggguaccugccagggccagcaacacaaugaccagcguccguccagaggucaucagcagccagugggccgugacccggaagcgggaggccagccacagccugcguuugguugccagggcaggggcucccuucagccccacggcuggggcagcaucuaugucuucaucgucgucaucaucgucaucgucaucauccugcugaagucauggggaagugacgucagggucaucaccaccgaggccacuccagccucaucugcuuagcugaaguaagagaugaggccugucccacagcugccucucugauguugcccacagccugaaaccagccuuucucucccuucucacugagugggcaaccccacagccccaugcuacucuaaaacacaaaacucugccaggccaggcauaggaugccccagcuauucuggaauauaucauuuugcaccaucuuggacaggaugcccuaaaagacaagauagccacccaggucccaaaucugucccugaagauccugugucaguuuuguuagguucccggggagaggccuuuuugggauagagggaaagaauuuuuuggguuuuuaaaaagauuuauuuauuuauguuauguaugugaguccacugucacugucuucagauacagaagagggcauuagaucucauuacagaugguugugagccaccaugugauugcugggaauugaacucaggaccucuggaagagcaaucagugcucuuaaaacggcugagccaucuuuccagucuggaaaagaguguauacacacauaccaugugcccuacauuacaguuuuucaggcauuuacagacccauaauccuugauccagaggugacagaugacugccccaauuccacaggucagggagagcgaggcuacaucuguaccuuguagggcuucuagggagagaggguugacucuggggaacacagcagccucagcaccuccagcccuccaacugggcauuucccggccuuucuguaucccagaggagaugccuguguuuaggauugcugcuagcccucuuugaccccucagaauggcagaagugauuagcuaccugggaagaaacgggacagucccugccuggggcaagagacggagacccgacagaacuuguuuucucuggcacugauagcugguuucccagaacagaguuggacccgaggucucagagaaggccagaguauggcagaaaaggacacaggcugucgucagcagcacuagcucaagccagcugcuggcagcccauguccccagcugugccugugggaacaguugaggggauaccaggcacuuaggcugagugccuugacucuagagcuagaugguauggguaccucccaacaccaauagucuccauauugcauagccuuagggaaguggcuuaaccucucagucugugucccaucugcaaagcaaggcguggagccugggcauaaaagaagagccugcagguccugcccucacgggccauccggcugaggcggcuaucaagauccuggggaucacggacgagaagcaugaagguuggaggccaggccaggaggcagaguggcuggucgcugagcucaccccuucuacagcccauagaaggcagaaguaagggcauggguggggaggaucagagggaagaaggcauagcuauccugcuaugagaggacacgccccugggguagacgguaagaugaccuggccuaggccccgagaacuucuugagaggcauugagacaaaugagcaauuccaggcaaaggaagaaagggauugcuguugacagggacagauguccccccacccccagcuacccgaucuuuacugcuccacucagcccccaccucccaaggcuucgggagucccuaccccucucugguuuccucuagagcccagcaagugucagguguugaugaauggguucugggaccugcugucugagagcagggugugccugcaccaagacaccuggguggccauaaauccuaccucagcuuggggggugggggaacaggcuaagccugccauggcgugaggaagcuggaucacagaccucacacagggcucaagggugcucaguguccaguuguggccccugggggcaguggcaggaccuagcucacccgagaaauaaguuugagauggccucaggucaugcacggaggugacccuggccccuccuaacccagcuugguauacuucagcuuggcugaugcccacaagugacaguucccguugcacagauccacuggaguuucugguguuuaagaacuagggcccuagagagguggcucagaggcuaagagcacuggcuacuuuuccagagguccugaguucaauucccagcaaccacaugguggcacacaaccaucuguaaugggaucugaugcucucuucuggugugugucugaagacagcuacaguguauucaucuaaauaauaauaaauaaauaauauuaaauggggggugcuagugaaauagcucaggggguaagagcacugacugcagagcuggcaagauggcucagcguguaagagcacugacuuuucuuccgaagguccugaguucaaaucccagcaaccacauggugccucacaaccacccguaauaagaucugauacccucuccuggugugucugaagucagcuacaguguacuuauguauaauaauaaauaaaucuuaaaaaaaaaaaaaaaagagcacugacugcucuuccaaagguccugaguucaaaucccagcaaccacaugguggcucacaaccaucuguaauggguucugaugcccucuucuggugugucugaagacaguuaaaguauacucauauacauaaaauauaucaaccuuaaaaaaagaaaauggagaaggaugagaaggagaagaaagaggaggaagaggaagaggaagaggaggaggagaagagaagaagaagaagaagaagaagaacaacaacaacaacaacaacaacaacaacaacaacaacaacuguguccugcagagcaggcuuccaguggacagagccacgcaugagacaagagagcaggagaauguagcagaacucggguuccucucccacauccuucuucgcauucuacauguaaauaucuuucaaacuuaacuuuaaaagucugcauauguuaaaaucaaaacugucacugggagccgggcaguaguggcgcacgccuuuaauccuagggaggcagaggcaggcagauuucugaguucaaggccagccuggucuacagagugaguuccaggacagccaaggcuacacagagaaacccugucucgaaaacaaaacaaaauaaaacaaaacaaaaagcaaaaaacaaaacaaaacaaaacaaaaaucaaaacugucacugggagccgggcaguaguggcgcacgccuuuaaucccagcacuugggaggcagaggcagguggauuucugaguucgaggcuagccuggucuacagagugaguuccaggacagccagggcuacacagagaaacccugucuugaaaaaacaaaaaaaccaaaaaaacuaaaaaacaaaaacaaaaaccugucaccuggcagugguggugggcccacaucuuuaaucccagcacuccgggcagaaacagauggagcucugugaguuugaagcuacccuggucuacguauugaacucuaggacagcuagggcucuguuacgcagagaaacccugucucaagcaaaucaaaucaaaucaaaucaaaucaaaucaaaucaaaucaaaucaaaccaaaccaaaccaaaccaaaccaaaccaaaccaaaccaaaccaaacaaacaaacaaacaaacaaacaaaacaaaacacaacacgucuaaaacugucagagugggacugaagcacuaacacccucacgcccaucucugcugcugcggugccuuaccagcuccugggugcgccgacucugccgggcuuuccucgugaggcguccacagaggccaaggcaaagggaggacgccagcagcacucccaggucaggugcuaccagccuggugguguuaaagauguccuucagguccagccugugaagggcagggaggcagagugggcaaggugaggagaugugacgccauccuuaggauucggcucacagaggggguggagggaacgcagaucuuaccucguaaccccuauguguugagacaccuucacccaaaggcuaccuauaaggaaagggcuugaggaaggagcucccaggccaggcagggugcccagugguuauuccugugaggcccggggacccugugggcaugacuguuaggaccucauguaggacagagcauccgugauucaggaaugcugaugcugaaucuggugcuuuuuuuuuuuuuuuuuuuuugacagugucucucuauaauaauccugacuggaaguugcuauguagaccaggcuagccucaaacucacagugaucuuccugcuucuaccucccaagugccaugccuggcuggaaaauggaagaugucuuuacagacaggggagccgaaggcagccagguagaugcaugcugccugguugguccguuggcugugauuggcaggacagcaggaacucucaggcaggcggggcuggaaauggccuaggaaacugaacggagcuccagagugguagagacuugaagcccaggccuucuacacauaaagcuggcaucaguuccugccugacuagaaggcagguacccacuggauaccccgugcacagguacaagggcaaggaugcuaaggauggacagggacccugaggaacccuggugucacacagacuaagcuacaagcaggcacaggaggaagauguugacaggugggcaccagaagcccagaggccgggcuggagagaugucagcggguaagaacacugacugcucuuccaaaaguccugaguucaaaucccagcaaccacaugguggcucacaaucacccguaaugagaucugaugccuucuucuggugcgucugaaaacagcuacaaugauacuuauguauaaauauaaauauaaagcaagcagagacuaaaugagcaggguugacuagagugagcagaggucuuaaaaauucaauucccagccaggcggugguggcgcacgccuuuaaucccagcacuagggaggcagaggcagacggauuucugaguucgaggccagccuggucuacagagugaguucuaggacagccagggcuacacagagaaacccugucucgaaaaaaccaaaacaaaaaaaccaaaacaaacaaacaaaaaaacccacccccccccccaaaaaaaaaucaauucccaacaaccaucuguacucauauacagaaggaagaagaggaggcuauucuaggaauggccuggcucugcugaccuggcacaguccauauuggauuaagccuggguaagaggcuggaggccugagguuccugguuggcauccucauccccucuacccaggacugcuguccucauauucccccccacacacuugcuccuccaucacuuaccguuuugucccagaaacugguccaggugaggcacgguguguaggcauaucugaaaggcaaggugggccaccaggaagaggaggcugaggcagaguagugcacggagcaggcgaccugugugaccugugacagaaagggcagagcagggaucagugggauacugcuuacccugacagccuccagguagaccgugcccuauccaugugccugagauacacacucaguguggacagaggcucugggcaaggggacuggcugugaggaaucaggacucagugccuuccaggaggcaacagaaaugacccacgagggguugcugguucccucccgguggcaccuauuggugccuaguuggcagacccuguugugacucugguuucuaaauaagaaugucagcccagaauggggaagggacugccagacacuguuuagggaaguuuaggaagcaacucuggcccagauacuacauuggccuugcucccugcuccccaaagaccaacacuguccaagcccugaacagacgagacacaauugaauuuucuaacuuaguuagcauagagggauaucacugcuaggucuugggaacaagaagaagcaaacagaaaaacaagaaaccauuauugacuacagugaugcucaccugccccugcguggaggcuggaaaugaagucacgaggagggugguaucccagagaaggggccugggcgauggggccaaaugccuccaaaaaagugaauugccggcuggcugccuccauuuagaguguuacgggaaagaagccgcuaggcaaugguggagcaugccuuuaaucccagcacuuggaaggcagaggcagaggcagaggcagaggcagaggcagauggauuucuaaguuugaggccagccuguucuacagagugagucccaggacagcaaacaggauagauccccaaccucaggccccacugaguagcagcccccaaagaucuuguuccacugaucacucaugggaaagacaccggccaggaguuagccaucaaacuaugggacccaggucacacagggccaugcuguacaugucccauggccaugcucagccuccaacugccccagcuagcccacccagcagggaagcccuuggcugcagacagacagaggugacacagggcucugguccuugcaucugcccucugagaccuauacagagacuggaguuagccuuuagcucuuugccugugggcaaucaacccacuguagcagaacugucaauucaagccacaaggcugcugaggccaccaucauugaaaaccucagagccacaggucucuuccacaaggacagccccaaaggaucacacugauccucucuucugggggcuaccacugccaguaugucuguccuauguaguuuccugggcacaguccaaauguguggaauagccucagaacugaccuuggcccccaagggcuagcuuccuuggugacacccacuccuuuuuauuauccuccccagaggucccaugccagaagguucuagcagucagucacacugugcaucuagcuagguacccugucucacugguucccugagcuaagccuugagcaccagaggacaagaugauacuccagcugugguccacguacucucuagugcccaaccucuggcaggguaucagagaacgaaggagagacaagcauaggacgagauuagcaccaagagcaacccugacaucagagucagaggacccuugcugcagugauauugagaggcaggugcacaagcagagauaggagcucaaugcugacugucaaugaaaagugcacgguggagaccuguucuauaggacgcggcgguccuccuuggaaacagucaccacugagagccacaacuauagccacaaagagggcacgucaggacagaucugagugagagcggaaggcaugugguggagggugguagaccaucucugugguggaacagccugugagaaggcccgguggaagucagagggcagcaggucucuggggcacugaagagcugugaggacgucauagucuaacuacauuuggagccuagcacagcagggagcaccaggagagaaagagcuggcucagugaugacaggcucuacagaguaaacccugaccucuaaaauaacccugacuccucaggauggcaagguggacaacucuggaaagagcacaccaccaccaccaccaccaccaccaccaccaccaccaccaccaccaccuccaccaccaccaccuccaccaucaccaccaccuccaccaucacuacuaucaccaccuccaccaccaccaccaccaucaccaccaucacaccaccaccaccaccuuuaccaucacaaccaugaccaccaucaccaccaccuccaccaucuucaccaccaccaccaucacccagcugggcagggcuuccugcugaguuucgggaaucuccacuugcaccuaagagucaauccuugcuugauccuugccacaagcuuggagguagcagaaacccuucccaucugaccugagaguaggucuagguuccaugagacagaugagcucccaggcccagccacuccccagacucgcuguuagcacccaggcuucacccucagcccugcacagaccccagugccuccaugggccccaaaucuucaaagcccuggguuuccuacuacaccacaccuggcucuuucccaggcagggccuccucuaccuccucuaccggccugacugcuucagccacuccucugucauggggaagagagugcauugggcuuagccaggcuuaccccaaggcccuggaauggcagccaccuuugucccuggccaccuuucucuccuaccacugucugggcucugacccauuggcuugauaaaaggaucacaacuucaaagaaggaacugucaugccacacuaggacaugccauacgccuauaccauuuagacgagcaagggguuuagcacagcaauaaauagccacugguaaaagucugcacuauugcaagugcucccuagaaaaaaauggggagugagcuagggauggagaugggggcauucuaauagcagaccugucaccugaccuguggccuugacccugcugggacuccacaggcucagaggcgcuucugacucuuuccucugcuucccguauucccuccuucccaccuucaugccccauccugacgaccacagcccucccugggccucacgcaggcuggacucuugaguacuccgaggccccuaaacagguauccugcaacaaaaucucaugagcuguuggcaaauacuguccuugcaaugugagcugggccagggugugcugccucggguucuagggagggaaggaaugucuuuuguuuuucugauuccacacacugacaggaugaagagggauagcauggggaauuaccccaagagucugagcugaggcucacccggcaaggagaagaagcuggggaaggcuucucccgucuacucuggagcaaagcauggguaaacccagagagcaagaagccagcugugacccagcaucccaggguguguucaaagguguucucaaagggcaggguagucugcucacaggccuagggccccaggguugccuaccaaucaacuaacuguucaucaccccacuaucccucucccagucauauaguaccuaacagcuaagucccgcagagaggcaggagggcacuaauggacuggagaggcuaagacuggagcaggcccccugggggagaguagugaaugggggggggucaaagaagaggggcagccuaggagauaaacucugcuagggcagggagucagcuuccuagcucuaaaguacaagcaggcuguugggagcagauucacacacccugaggucugauacaucccaacucuguccugcccugugccuuguccuaccugggacacccagcccuaagccggucuagcaucuccuuccugugcagcccagcuuaggcccagccucugagaaucaggcagccgccuacguggggaacagggcccagcagagucagaccuuccagcagucagugccagggcagcagcugcacaaaucauaaacgcacacagggcgcuccacucugcaccgucgggccucacauuuuccucucacacccggaaaaaccaggcagcuucauguccccgaagggccucugaggcugggcagauagagaguuggagggucgaggagggaaagacgucccgccccgcucuccaagucucccucaggauacguccugccuggcugcgagucucugugccucccacgguugaucaggaguauuuccagcuguucacagggcacgaaacagucuugagacaaguuguuuccaaagagguccuggggacggaggaccugggcucugcagugagcagaguauggaagucagaccuucucaccacacaagaaaagauucagugccuaggcugugugucucagaggggcccaguggccggcucggggcccaguggcuaccagcacacuguucaggcugaacuccuuaaauaucugucccugcauccccagacccuacccauccucuaagaccuuccaguuccaaagaacaccgggcugggcaaccaccgugcuaugguuggcagaauggcgaacccaaaggcagcccugcccaaucucugcccccauacacaugugacucacauggcaaagagaccaaggcagagcggugggucugaugucacagcugacaacaaggggagucuguccugaagcuccaguggcugucaucacagagcauuagcagcugugaugugcuccaggaugcuacagagccacgggacucggagaggauucagucugccaucgcggcuuugagguagaaggugccaugacccaaagaugcccccaaaagaagaggagccaggaagcugaucccugaagcccucugaaaaggcacaacugcacucauaaccugacugcagccccauaagccaguggguguggcucucggcaggguggcuuguuacaggaaguccacucucacuggggcccacacaugcugaauccagcacucugagggcagugccaaggcuguaagugccuucccgggccccaggccgucacaucagacccaguucugaccuuugcugacccucagacacugucugugauacuugcagugucuccuggggcaggaucucucacuucaaugcuaacguuccccagguugcugccaugcggaucugaaccccacaaacgcagaagacaacagcgagccuucucuacuuuagaaaugugguacacuuggggaugggucacugaguacguaccgaacaccacaaaacagacgcuaggcaccuucagcauuggugaccagagcccuaggaugaaggauuucaggauguccugccucucucaggccacugccacagcagcccggaaggugaggacacaguggucccacccuucccacgucauccuauguggagacucaaggcacagcagcagccuuucccuacuucacuaugguaccacuguccacucccacguaaggacacaacgcuggccugcauagcaucuacuguuuaaaaggcaaggaacagagaagcaccccugcccagcucagauccugaugaggcccacuguggccaguucuuuacauagcaaggugguccaagguagggccuggcuuacagggugauagagacaagcuggccagagccccuggcagaacaacaucgucaguccagguaacuuaccuagaagaaagaauggaccacggugcagaucccuaaaccuucuaccugcacggaacaacuaggaccugccaauucccucugccuucugagggacacuuagugaccgauggggauccacauacaacccuuccccugucaccuucaaggacaauagagccucuugugacaagcaaccggcaggaagaaagaaacugaaccagcuacaggugugcacugaaggaacccuuagaccccaggggacugacucaggcuguuaaaacugggagccgaggccguguggcuguagaguaccuauccagauacccagcuguggucagaguccccccaaggagcugggcuccaucgccacccccugauccugcccccuuaccugguaugcugugucuugaggggccuggaagccagggcagcagcaguagaaacagcaaauagaccagcgagagagcauugaagcguaacagggaggcuagagaagagagagacaaaugguuaguacaccaacaauaggggcagcccucaccugaggggcuggggggcaguaccccccagugccccucucucacaccuguaagcaugcauacauaaggcuugugcaccacagacagaauacccauguuccugucauccgaugcccaggucccaugauaccccaaggaccugcccaaagcaguccauguacucauaacucauacguggaugcacacgagguucugaccacuccgcauaaccccacccacgcagggcucuggggcccacuccuccucaucuugcuuuuccuccuguuugaaguuucgcuuauugaucggcaggcagcucaacuaagaaaugguuaguuuuucccacuacugggugggaagucacugggaccgagcucuggacccccuccugagucacugaugggccggcgcgguucugaaccuggcuuuacaccacucugccugugcaugcccccuaccagugccagugcacagcacagcuucccucugggaacuucccugacacccugcugcccuacaccguccuggugaauucugccagggaggucaaaggaccugaagcauaggcaggugacacgcuggccacuuaaccaaaugagcaagcuucuucccagaaacacagggccuuccaggagacaagguucugggacccuaugcagcgcucagucccacccacuucuaccugugcuaugggauacaaaaggagccaggccaaagaggaucuacaugcugugugagagcccggccacacacaguaucacucacuacaagccauaucuugcuguccucaccucgggcaauugcuauuuucagaaacugacuguccuagacagguaagguuaaaaggccaugagcuaggagcuaggguacauuaggaaccccgauucccuccuggacaaagcaaccccaagagcggacuuucuguggccgggagcaucaauccuaccucauugucccucugagagucucuccugagaguggguauccuccacacauccuccucaggaugagaaccaacaacagaccuggacagccagggcagaccugaacuuggggaccaagaccgaccacagaaccaggcuccccuggaaggaagcggcagggacccaaagagcacaguacauuuaaaaaaauuaaaauugagcuauaaaugauauuuccagugccaaaagcaaaacaaaacaaacaaccuaagcugaaccaggucaccucuucaggugacacuacccacuuggggugggugacuucuucugaauucagcuuguacccucuucacagccccugccugacacagucuucuuccaggaucacaguggacaugagauguagcccaacuuccaagggcaccugcugcuucaaggagccuggcagcagggguggagaggguggugguaguggggagggcaggguguugaccacgacugcacuucucuuggcucccaagggccucucuggagucagggugcugucuucuuccugacauacauuggcuaccaugcaaggcucagcucuccuaaaucaaaucugaaguuuucaacaaugauacauuaaaaaaaaaaaucgaucuucuuuggcccaagaggcaggggggaagugcauuuguggaggcaaagcuuucugaaaucccucugcuuuccagggcucuauuucucagcccaaccagggccacguccagccuagucucacagaggcugcacccucccucacacucgcugcuuccggucagguagaugucuacccagcuuuccacuggcuugucgauccugcccaccugucuacccagcugacuacccaccagucccuucauccacaggccccugagagcuuucuccuaucuaacaucccugaugugacagguccugccucugaggacacugguucgaccucacauaccgggaauggccagcacugaaccaagcacgugaggggcagugaucaaaagcccgugucgggagccaagagcaugugccgcaugaacacguggaccucggcugagaucaccagaacccacgugaaaagauggaaagccaggcuaaggacgcgucuugguggcuugccacagaagccuggugacccgaguuuggauucccagaauugugcaaaagccaguuguaaucccagcgcaccucuaccaggagaugggagggagagaggagagacuggcuagaagcggucaggccaggugguuggcaaaagcagcagggauuaacagagaaacccugugccaaauaagguagaagaugagggccaacacccaagcuugcccuuugacuuccacgagcaugcugugacacgcacggaccuguguucauacacauacacacacuuagauuacguacagugauuggugcagguaugaaacgcugugugugguagguagcauucuguagaaacagcaacagagccugcuggucaaucaagccaacugaugaacuccaaaaaguggaacacaacuggagaagacuccugacuuugaauucuggccucccaagcacagccaaugaagggcggccaccacaggcccuggggagcagggaaagaugcuuuacccugcagccugcuuggcaagcuuaaaauucagaccccgagguucuguguguguugagugcgggagaggcuaaaguuaauuuauuauuguuuuuaagaauuaucuauuuauuuuacguauaugaguacacugucgaugucuucagacacaccagaagagggccccagaucucauuaugguuguaagccaccaugugguugcugggaauugaacucaggaucuguggacgagccgucagugcucuuaacuacugagccaucucuccagucccgcggcuaaaguuuaacuguuaucaaguuucagucaggaaaaugagaugguccugggguggccauuagugacauaugaggaugugccuaaugccaccacacuaucaaaaauagauuaagaugacaaacuucguggauagauguuuuaccggaauaaauacaugaacgguguccaaaaucugugaugggcuccagaaaccagagacccaagauggcaagggguagggacuuccaugccuggcuuccuggcaacgaggaaaugugagaugggcuacugagauugaggccuggcuacuccuaaucccagguagggccaggagaacccuacauagcuguaugugccaaagguagaugaaaugcaaggugaggcaccagggaccaggcgaggggaacgcccuguccugccucagcaacacaggucagcuugggagaugcacaggcccugagcucugcccuuuccccugccucuuuuccuuccugccugcccuccguguagagcggucccaacacuguacagagaaauaaaggcuacguccagagacgaacacucuacccaaggaaacaggcucagaggcacaacuugacacuccagggucucguucucagucaucauuccuccaagauuaucaccccucaagagcaagaagagcgagccaggagagcgagucccgccugggucagccgugcagcucuugcuucugggaagagagggaaagaaacacuaagaggcaacacaaccuggcugugucgggaugcaggguucccaggugcucccuggucccggugguguggcguauugguugaaacacauugaugugacugucacaaccaugacuuuagcagugcagaggacagaggugagauguuauuuaucacaagcagccugaaggagacagccuuccuugucuuuguccuugaagguuagcugccaccuaacugcaggagaggggucaugggggacaaagacauuccucaaagagggcagagccucagacugcucugguggagcugcugggcaaagccugugauuucacaggaaacaggccuuuccugagccagcaacaauagggacagccagaggcaggaagggccccuugcaggccagcacauacuuaacccuuuauagacccucacccuacagcacaaagcugaagacccuugcuaacauccacucugggguccucaagccauagcugagggcuaaugaaguccaccggguggcuccccuggacucugagugacccagagcagagcaacgguuugcucgucguugugggaaccgggucagggagggagggguaaggguaauaggaccacacacaacuuuuagaguacaccacacagaagguuugucaccaccccuccuccaccaugagcaugaagaugggccugcagauugggcuguaagggagaccucaccuacucaagaagccccagccuggcccagggucugucaggguaggagacgagaauccaccacucccuggaggcucuuugagccagcugcucccauaugucucuggucaaagaagccuuacagcgaccucccaaagcagaugccagacacauuuguaaauggcucuggaaaugagucugaagcacacggcagaucuguggggagcuuccccuaccacagccagugcuggacagacggacggaaaggugcagagauacagugugugcuugagaugaccggauccuuuggagggaugggcugugucaacagggagagaacacagugaagguucacacuagucugcaucaacgcagcaggccguccagcccaaguggagacaagcaagcguccagugcaggaacagcaugguuucuucgagggaagccugggugaagagcagacucaccucacccuaccaucucggcccagcacagaaacaagguugagggucucauauaaccccccaccccaccauugucacuccugucugcacaagagagggaacagguuuggauggccugcccuccuagucucuaggcuaccucccucugagaagggaggagagucucucuaggccaaaagaaagaccucggugagcagagagaguugagcagaggccccaacaggagagaccaggcuagcccaaaggacugcaacccaucucuagggcagggcagggcagggcagggcagggccugcuugggacccuggggcagccacagucucagcccuggaggaaguggugucuagacuggcaaagagcuacaaggcagagcagagccuggaguccuucuauggucccagcuaugcagcagccguguccagugguggagcagagacuccgcugagacccugggucccacagaggaguacgcuguccaaagaggccauagcugccaggcugggagaggcucagcaagguguguucggggcccagaaguaaccaauacccucagaagacuacuucucggaagggcagccucugucccaccccauggccuugcacacaggccuggacaaugccacaugcaggccaaugucugucacaauccugggguagguaucagucucacaaguguccccgaaaacuugguuuuccagggaucagagacaggggucagaggaagcaagcucuacgcuccaggguccaucugaccaggauccuggacacaucaauggcuagaacugaccaccauuggagcugagcagccgauagaucauaagaaucugugaaugugccgggcguuguggcgcacaccuuuaaucccagcacucgggaggcagaggcuggcagauuucugaguuggaggccagccuggucuacaaagugaguuccaggacagccagggcuauacagagaaacccugucucgaaaaaccaaaauaaaagagaagaaaagaaaaagaaaaagaaucuaugagugugagggucugugaacugggccccuguccccacaaugcaccacagacugccuagucaccagugggugugguaaguggccugaggugagucccugucccuagugugauuuaugugcacuuguaagaaggaauuggggcagacaaaggauccuucgagacucagaaagaccaagacuuucaauucaaacccacagaagccacacagagaccugggacuggagggaaccacacgugagccaugaccaccgcaacgugaggugaugggccacagcggcccaggagcccaggguguagcuuugggaugaaugggacugcaucuaccccauuccagccaugcgagagggcucugaugacuguagccagcagcauagggugagggcuugguggggcccuuaaguguggaggugagaagauaguacacgcugggcacagcagagaggcaggcguucagaacaaggggcuaggaggagaucccagaagagauauggagagcaggccuggaggacccaacugaaaacuugcccuuccuuuuuccuccucuguaaaaagcaccaaaggacuguugucaaagaaaaaaagaaaagaaaagauagggggccugguacuguguguccaaccuggaggacagggaggcugaguaaaagugugggggggggggcagggagggcuuugggugugucuaggacaguaagugacuuucauccaccuuucccuacacccgcagagggucucggaagcagggaaguuuagagcuguuccacaugagugucacagaggccgccaaccccagaagaugccuuagggaggccuggccagcuagcccaacuaucucuaugucccuaaacagcagggugggauaugggggugggggaggaagagggaaauguccccuccacccccggcuucaugccuguaacccuggcugcauccccaggcaggguuuccucccauugucagucaagggacagugguguccacagcuucaggacgggugggggccugauuucuuuuuucuuuucuuuuuuuuuuuuuuuaaaauauggaaugccucgcgaauuuggguauuauccuugcgcaggggccaugcuaaucuucucuguaucauuccacuuuuaguauauaugcugccgaagcgagcacgcgggccugauuucuugccuaccauuuaagaucuuuacuguaggcccccaugggaccacccagccuggcgggcuuccuguugcucuucuacaagccaaugcgcuaucuguggcucacccuuggcugggucaguacccuggccucugucucuccugcggccuaucuccuucgugacugguuuuccuccagccuuugcaggggacagcauucagaaaacaagcagcucacugccaccggaccaguguccuggaccugcaagaggcgaguagccuggcaaccagaguaacaaugucagcaagagucuuuguguccaccaguaugaguccacggggaguauagcaccagggaccccacagaugcugggacaugcccugcaacacugauccugcaagauacccagauuccuccugacugauuggcaaccacagacaagccccaucucccucagauugcucagcuguaccucaagagucccacugucccuaucuguggagcuccugcaggcacacuagauacagcaccugagaggugacacauacuucugaacaaaagagagagacgcggggcugaagagguggcucagugguuagaacacugguugcucuuccagaggaccagaguucaauucccagcaaccacauggcagcuuacuacuuucuguccuuccaguuccaggggaccuaacauccucacauagacauacacccaggcaaaauaucaaugcaauuaaauagauaaauaaaauuuuuuaaagauuuauuuauuuauuuuauauaugugagcacacuguagcugaauagaugguugugagucuucaugugguuguugagaauugauuuuuuuuuuuuuuuuuuuuuuuugagacaggguuucucuguauaguccuggcuguccuggaacucacuuuguagaccaggguggccuugaacucagaaauucuccugccucugccuccugagugcugggauuaaaggcgugcaccaccacgcccggcuauugauuuuucuuuuuucuuuuuuuuuuuuaaggaccucugcucacuccagucaacuuuauucacucaaucccugcuugcuugcuccggcccaaagauuuauuuauuauuauacauaaguacacuguagcuaacuucagauguaccagaagaggauaucagaacucauuaugggugguugugaaccaccauguaguugcugggauuugaacucaggaccuucagaagagcagucagugcucuuaacuacugagccaugucuucagcccaauaagaacuuuuauugaaaauaaacaaacauaaccaagaaccugcccauauaucugaucuuuguaaagagauaggaaggcucugaggguccacaugaucucuguaugagggggcccagagucaucuuacgaauaccucucugaaauggcuuguuuggugugucaacuugacacaagagucaucagagcagaaggagccucaguugaagaaauaucuccaugagauauaguugcaggggauuuucuaaaucauugauugauggaggagggcccagcccauugugagugaggccaucccugggcuggugguccuggguucuauaaaaaagcaggcugagcaagccauggggagcaagccaguaagcagcacccuccauggccucugcaucagguccugcuccagguuccuguccugcuuggagcuucuccagugaaagcugaauaaacccuuuccuccccagcuugcuuuauggccaugguguuuuguggcagcaauaaaaaccauagcuaaggagggcugugguggcguacgccuuuaaucccagcacucgggaggcagaggcaagcagauuucugagcuugagcccagccuggucuacagagugaguuccaggacagccagggcuacacagagaaacccugucucaaaacucaaaacaaaacaacaaagaguuuaaacuugacaucuccuuucucauaagaagaaugcugccacacauuaccacaaucacagaagugaagggcagggagggccacaagcuaucuuccucccagagcauacagagguuaccagauuagacaccuaguugggccuggugccucaggccugggaucucagcuacacaggaugcugaggcaggaggaucccaaguuccagccuggccugggauacucagcaagaccuuguugucucaaaauaaaaaauaaaaauggcuagaggccagguguggcagugcacgcuuacccuggaagcacuugggaggccaaggccggaggagcuggugggcggagaaucaggugaggucacccucagcugccuagggaauucaaggacagcggaggucacacaagaccugacaggaggugugaccuagugccucugugauagaccacuugccuaacauguaugaaauucuaggaucaacgaccacaaaauaccuaaguauaucaaccacacuaaacccggaucuucagcucuagggaagcgcccugcuagauccugcccucugccauccccagauggcugcaugaaguacaaaggaggggaccagauaacugcugcugagcaggacagcugcaggacuggggggugggguccugacccacacccuagcugcucccugccacccguugggauuccgggucuccugccugccuuauuuggccugggcugcaacuauaaacacuucugggugagauuucggccaguggguggggccaggcagaggaggaagaggaaggaggagaauuccagcagcagcuagaagcugcgcgcugggaguccggagucaaugaagccuaguggccacaccugccaccccccaggaaggcugaaagcaaaaacuuaagccaaaccaggcccagaaggcucuggccaaucccccuuccuggaagaggaggguugguacagucagcugagggcacaugaggaagccagcugcccggacuuguuccuaaagcuugggacuaaggcuccuagacuggguuagccugggcaguguggcuggauaucuuagcaccuuugaucaggcccaggugcagccagcaggaaagagggucagucaagccuaaggugcauuuugcuccuuugaagcuguccucacuugucacuucuacagccccagggagacacugagccuggcagccaugcgaagucaugguaauuucagcgcuagccaccgucuguucagauacauccaaucuggcuggccccuucuccgaguuauuccugaucugcuggagacaggaaaggcaaggggguugaggaugccuagcugacggacgcccaccucuucaggcuccaaagccgacgugaagcgcagggacaguuucaaagcacauuguggauacagagcucuaaucggaucuguuuccuucuguuagagaagaaagugaugccccuugugggagacagacaagagcagucaggagggcguguggaccaguccuggcugaucgaggagaggggucgagucgggagcugccucagccugaagcagccgggguugggagaggcacagggacuucauuuuaccuacuuggagcccggccaaacugccugggcucugggagcacuuggagcauuuaauuaccauaguguuggggguuuaauuagugcgacgcgucugggaaccgugguuucacggcucagcugaccugcauggggugggucgagucauucuggcucucucucucaacaccgaggguggccugguagccauaauaccaguaagagaacccauggacacauagucacauacucccaucugaacagcuagucaacuuuuauguuucccucagcccacagugaccuugucauacuuugaggaagucgcagagcaagaggggacaggcugagaugagguagguuauacagguaacaaacaggagguaaggcugaauauggacgcccggaggaggugggagggagggaugcccacugcccagcgagcuggacauggcccgcaaggcacugugguuccucggcucucggcuucucccuaacuuggagcaacuccacaguauccacuccuagcagagcaggucagaggugcugaaggcagugaaugcccagaagaccagcaggaaauggcuuggugcugagcccuggcucucaaccagggcugcaucaggcaaagagaucaaggauggaugauacagcuacugcuggcaccagagacaagcuggcagagggaugcuugccucccaccccaaacuucucaggacagcccagagaccagagacagagaagacacgaggagaaacucaauccgaccgugacagguccucuucccagcagaugcugcguuggucccaguuagucagucagcuaacuaacuggggacccugcucacagucucccccccuaaacaacccacaaugccuaucacacagaggcacagucuguacucuaugcgagucgcuuggagguaugagacugaagccacccaaagcugaccuacccacaggcgacaacuaucaacaaaagaggagagaacucaggguacagggugggccccauuccguaucagccauccccacccacuccucccuggagggaggaagccagaccuaucugcagccaucucuacuggcugucacagguaaacaggccggguagcacaugggcagggcccugggaaguacaugggugcagaaaauagucccuaucccauuugggagggaguuggcccgcagaacugucccuccugaaggugacacccuccucacagaccacuuggagcucagagggucuucgcccucagcaggaagcugaagaaggggcugguccuggcccuguauacuguguaccacugacaaauuuagccucggacugggaguucuucccuuaauacaccgugagcucuccagagccuggagcaagucuggugagccgcucgcagagccuccaccagggucaguccuguccacuucccugaccacauguuaccucuccccagaucguagcuacucaagagcucccacuaacuggaguaaauuguguauccaggucucccagcugagcugugaagggcacgggcugagcugugaagccaccacguggcuuacacagggaggagaagcaacggccuagcaaaccacggaaggcuuuccuagguagagccucccuuucccuacccaaugccugccaucugucagaugagggaaacugaggcacugugggcacggccccuccacagcuucaccuacuccucuagacacuacaucugucuggagaaaaacaaaacaaaacaaaaaccaaacaagccaaacaaaagaaccgggccagggcaugaucaguuucuugauccacuagcaacaagcacacauaugccuugggcucuuuccuaggagcacagagacccugagaccccacuacagacaucccagugcgggacguucacaccgcucccaggugacuguggucaguggucaauugcaauucucccacuagagccaucugagaguaccucagagguugccauggaagaggcaaacugaagcaggguggccauagacccugccccaggaccugaguaugggugugggaccugaugucacccagaguuccacguuaugauucaaaccugcccagugcccagcugguaaauugcagccaacaggaugaagccagcacgguagcucuugaauguucagagaugacauaguuggguuccaggucccucaggggcuuugugacugccagucugagcauguaagaggcuccuuagugagccggccaggcuccaaacucagggugagccccugagucucuauaaaccugggaaagacaucucuggccuuaccucuucucucaaaggaugggggugcucuaacaagacaagugggguggggagcauccccuggacaaagcacugagcaaccccagucacuugcugagaaaggaauagguuaccacaggcaauuucccuacagaguggacagcacauuccagaagccucuugaaccacacugauuagcauggaagggcuggccuuucgcucugcucugcguaaacaacccagcuccugaccugaaggcacugcccccagaauuccaagcugccagaaggcaggauuccucacugccagcuaagcaggguaccugaagaggguggagaggcuucggaaaccuagacuacacucugcagugccuggcccaccccccuggaccucucugagccagacuaguuccucugucaccacagcuccacgcucauauucugaggcuguggcacaagucugggccccacaauucucacagcggaaaccucccugagacugacacucaacagugucucucagaacugcacuagugagacugcucuggccucagacaagagcagcggcucccuuuccuccagagagggcacuggcccacuggcacugcccuggcccaggcuguggaagucacaaaagaaugucuacagcucuaaccccggauaccugcagcccagagggagcuugcccacaauggcaggaagaacacuagaccacaaauaggucaguaugagauccagaucugccacaaauacaggucagguguggcugugcgcaccugucauguuggcacuagggaaguugaggcaggaggauuguugugaguuuaaggcuagccuagucuacauggaaagugccaagcaagcuugggauacaaagugagacccaguccccaaacaaacaaaaacaauacagguaaccucgauacccaggauagacugguucugggacccuugaaugcagggagcaugccguucaugccccuuuaauaaagugcuuugcccagagccuacggccaucuucccuucuccaguacucuagauuacucacaauaccuaacacgacauacauguaccacaaacagucauuagacugaguuguucaggaauaaagacaacaaaaacagucugugcaguuuaguagaaaggcaauuaccaugaccucagagcagaggaacaagaccagagguucucacacacagaauuugcaaaaagugaggcccaacaacaggagaugcccaauggguccugugguuacacaguaauaaggaacaagggcagccaggugugguggcgcaugccuuuaaucccagcacuuaggaggcagagacaggcaaaucuggguucaaggccagccuggucuacagagugagcuacacagaggaacccuaccuggggggagggaggcaguggggguggagugggggacaaggagggccaagacucaccuuuagaagucuaugguuucccaaggccauggugaacaauaacccauguauauauaggaagcauccgucaggaugaguccucuaggggcacuagaggcagacauagugggugggugggucuggacugugggacuucagcagagggagcuccucacaggcaaagaugauagggcaggaccugcugugaggcacugggugucaaucacagaacaggaucccucacugggcacauggccacaugccccacucucuguuuggcuaugccuagguuaagugucacccaucauggagaacacaaguccucaaggccucuucaacugcacacgagagcccauggaaaugcggaaucuuaaugucuuggucagugugcuguugcugggagacaccauggccaaggcaacacauggaagaguuuacugaggcuuacucuuagaggguuagaguccaggucagagcaaggagcgugguaacaggcaggcaggcaggcaggcaggcaggcaggcauggugccacuggagcaguagcuuacaccugaucugcaagcaugaggcagagagcugacugggaagagucuuuugaaaccucaaagcccacccccagugacacaccccaccuccaacaaggccaugccucuuaauccuucccaaaaacuuccaccaacugcagaccaaguauuaaaauacaggagccugggggcugaugagauggcucagcaaguaagagcacugacugcucucccgaagguccugaguucaaaucccagcaaccacaugguggcucacaaccacucguaaugagaucugacgcccucuucuggugcugucugaaaacagcuacagugaacuuauuuauaauaauaaauaaaucuuugggccggagugugucauuccuaaauucaauucccaacaaccacaugaaggcucacaaccaucuguacagcuacaguguacucauauacauaaaauaaaugaauaaaucuguaaaaaaaaaauacaggagccugugagggccauucucuuucaaauuaccacauucagucuuaccuagacaguccaguccugggguacccucccugugacaguagacuuucagggaucccuugaggaagagagacaagguacaggguacaccucuagccaacaagcucugccugcuacaaccuguauaaaugcaugcacgguauuagcagcacaucccacagcaagcugcacugaaccacagcugcugggaggaugcagagaccacagcuggcucugaugaacuccaccagcaaaccuguaccauuuugucccaggaagguagugggcuccacagcucuaguaccuggaagcccucuggccaccacucauuagggccauagcuuuucugguagauguggauaccuggccuaaacagcuccagccaccccacauucccacuuggcuuuggcugagacucuaggcuaugcacggacucugaccauugcccugugauucaccauagcaccucuuggcccuuauguaagcuguccagggccuggucauaggcuauccagcucuccagggccuccucggcaccuuggaagaauguuacccaacugccucuugcugcuaacaccgcagggaauaaucacugucucaagaagcagccagguggagggaguucccugacccuucuaagccugagcguccaucuucccccagccacaccuugguaaaugacagcacaggacagaugggcagaugacauaaauauaaagaaaggacagagaguggauguaaagaugauggagaagcaaauaucauaagagaacagauagacgauggauggguggacagagagauggcuauagacagaugggaugccccugucucaaagcagcagaugaccccacucuagcuccagcaccccaacaggagcaguaccagccaaucagaaggagaccuagagccaaguucugcucucaacaucuguggccacaggcaggguggcaaaguucugggcuccacauguacaauggaaggcaagugaccaaggaaaaaaaucaacaaugucaauucuaaccgccacacugguagccauucuuggucccaccccaacacauggguacguagauaucacugccggacagccggagaccugggcccagcaagccucaguuuccccuuuuguaaaagaccugaccaacucucagaauacuuuguagucuuaauuuuuuucuuuucuuucuuuuuuuuuuuuucaagacaggguuucucuguagagcccuggcuguccuagaacucacucuguacaccaggcuagccucgaacucagaaaucccccugccucugccucccaaaugcugggauuaaaggcgugccccaccauuggcauggucuuaauuuucaagacuuuaaaauauggaggagaaaaguggggacacgguuccugcuaccauaccuuccccaucagaaccgacugaagccagugcucucugccugggucccacaguccucuugccuucccagaacccuuccagggaauugcuuuagcuuuacugggggucagugucaaggguauuccaggccuguggcugcagggugugugggacugaaacagaugaaagcagcaggauuccuggccugagcagggucccagcagagccuggcaggagagcuguguugcccaacccucaacagccaucccaagaccaggauacggaggccacaggagccccagaccugccggggaagagccuggugaguggcccaguccuccacagcuacugagagacucucucuggcuuugaucaccacccccuuggggaugcugaggugcuaagugcugagagguugugguugccauucuauuuccugggaggacccaccccuccccucaaaucucagagccucacagcaucaccaacucucagccugggagcggguccuguauucacaggaugaaccugggacaccuaggagaggggaaguaccacuguccccacccauagaagaugaacugugccaggagggacagagcuaucuagaaauguaccacuaagccagcuucaacaccagggaccuugccccaccaugcagaagucgggaguagagugaagaagacugaaacucagcucccacuggcuucucucuugggaccuacuagccacgaaacagaacccaacucacuccaugcucccaucuaauggaugggagcaugcucacauuucuuucuguagcuuuccccaggcucaggccauggccuggagacucuuccucagcaacucccccccccccccccaucagcuuacaauaggcauugauucucuaaguccgugaucucagaggcucacaggagggacccaaaaacccuaauucugugcccagugauguguccuggggcuggggcacaaggaggucagucaucuucagugauccaaaccuuccucccacucgauaccccgucuggcccuugaacacugccagaguauccccacagagccuuacuggcuccgggagaagcggcgagcuccccuggccagcaagaggagccgauuaagaagccacuuaggagcaaagugagggcuguucccugcauaggcaggcaggguggggacagggacagugcuggccaagggcuauauguucaguuccuggaaaaagcagugagagaaaugacgggcgggucauccuccuaccgccacauccuguuuuuauggaaaacuaaucuaauuccugauugugaagccagcagcagacauccccugggggaucccggggggccucagugucagccccauagggucaggccccuuugcccaguguccagaguggcuacccucccugccaccccacccuggaaggugguggaguuccaucuuaaccacacucuccccucccaggagaagcugcaucgacgggcuucccuaccagugaaaggcaggcuuauuuuuauccucagcccaagcuuggaccagacuaugucccacauggccucagugggucuagggauggggacagcuaucaccuggagaugccacucagcacagacaagucagagguacuaggucaugguauauuccuggggccuaggcuguguuggcagccucguggcugaguccuagcccaguucccgaaugaccuccgggccucaguuuccucaucuguaaagugugucggcaauuccaugugccuuaaaggcuaccaaacuagaaucacuguauguaugcacugugacaugcugucagcuuguccuuggcucucccagcuuccauccucaccuccuagagacugcucgcugagcgugcgugugaggcugcugagucuccaagcagccguggaagcaccaggcuauggaauucugagacugacucuugacucccauggccuuugaccacaaagagccuuucuuggcuuccugugggccucgaagggucaaggcugagcucagccucuucgcaggaaggaaaaggccuaaagacgacaacagaaccagcccuuucccugggccaggcuucaggggcaacacaggaagaacaggugggcuuuuuuaggggcuccauggcaagaaaccugugcagcugguggggcuagggcaggccucaauuaccuuacuccuuaaaaagacagaaagggagugacuggcugucuuaguuaggguuuuacugcugugaacagacaccaugaccaaggcaagucuuaaaaaaaaaggacaacauauaauuggggcuagcuuacagguuuagaaguucaauccaucaucaucaaggcgggaacauggcagcaucuaggcaggcaugaugcaggaggagcugagaguucuacaucuucaucugaaggugacuaguggaaggcugauucccaggaagcuagagugagggucuuaagcccacacccacagugacacacccacuccaacaaggccacaccuccaaauagugccgcuucccaggccgagcuuauucaaaccuugacgcuggcuaacacugcuucugcugaagcccaugugggcagaggcugagggacagaucacuggggguucuggguccuauucaccauugccagaagcagacauacacugggaauggguucuaacgcuuugucuuaauucagcucccaaaggccgaauuuccagacgcugaaggucccugcccacaucuggcuuugaucgguaauaaaggauugccauacagucaauggcugggcacuucuaaaccuccccacagcuagcacacacaccuuucugguauuccugaauuaauaccuuuuaaaaucuauauuucaucucugacauacagagucuucuaagaccaauggcagcaucaauucacagucaggccucagcaaaggaagucugacaccuucagcauccuuccugcugggucagagauaacacuacagcgaugcuugaguaucuagucaucacuuucccuuucaaagaaauaugcaugguuuggucuucaccugccaagccccgagggaaccaauggugcagacaccacgagacauccagcauucagcucacauuaugcaucucggggccugaagcaauggccggucauacccacccacccugcagcuggccacaucccauggacaggagaccuuacucagcuuccccaggccuaugaccugcacagcagggccaaggacagcaguugccacaugaagccaccaugacaguguaguacauagggaguucagagcaggacuugcccauagacauucagccagagggccucaaaguggauaaagucauagagggcgccccggccgugcuccuucggucagugaauucuggcuccauucccugagcuguguuccuggagcaaggacaucaucagacuugguagaaaauacccuuagccacugaggcaucucacugguucaagcccauuuuuaaagaugaaggguucaaaguauagccaagcagucuaacuucacccagcaacagauaucuaaucacucccgugucuuagucaggguuucuauuccugcacaaacaucaugaccaagaagcaguuggggaggaaaggguuuauucagcuuacacuuccacauugcuguucaucaccaaaggaagucaggacuggaacucaagcaggucaggaagcaggagcugaugcagaagccauggagggauguuacuuacuggcgugcuuccccuggcuugcucagccugcucucuuauagaaccaagacuaccagcccagagauggcacccacccacaaggggccuuucccccuugaucacuaauugagaaaaugccuuacaguuggaucucauggaggcauuuccucaacugaagcuccuuucucugugauaacuccagcugugucaaguugacacaaaaaaccagccaguacacuccugucuccaggaguagacaccuagaugcucuccucacuuagccaacagaaugcuccaaggcacacaccgccaacaggcaaugugugagcagacagcuaaccuuugcccugcucaagaugcacagcucccuauagcugcaaucuggccugcagagcgagauauccagccugugcaccagcccugccucccccaaguuggauuucauaaggcauuuccacccacggaaccugcagggcuaucccccgagaggugcggggccaagcaguacaguugguaaccuuacaucugaagacuuuaaagagacuggcugggggagggaagcucuaccacagaauagucacagcuggacaauugcuccagggaccgcuggccagacacucagccccacaggagcugagugcaguagacauguagugcaguagacccugauuuuguuugcuugcuguuguuguuuguuuggaggcagggucucacuauauuguuucaguuguccugaaacuauguagacuaggcuggccuugaacucagagauccacugcccaugccucccgaguguugggauuaaaggcauguaguuuuuuuguuguuguuuuugagucagggucucacacuguagcccaggcugaccuggaauuaggcaguccaggcuggccuuaaauuagcaacaauccuucugccucggccuccuaagugcugggauuacagaugugaacugccauacccagauggccagccccacuuccaaggaugaaggauucauggcuaacaagaugacucagaggauaaaggugcuugcugccaagccugacagcccaaguuugaucccaggaccuauaugguugaagaaaagacugacucccccaucuuguccucugaccuccacaugcaaauccauccauccauacugucuuagucaggguuucuacuccugcacaaacaucaugaccaagaagcaguugggggcuggugagauggcucaguggguaagagcacccgacuguucuuccgaagguccggaguucaaaucccagcaaccacaugguggcucacaaccauccguaacuagaucugacucccucuucuggaaugucugaagacagcuacaguguacuuacauauaaauaaauaaauuaaaaaaaaaaaaaaagaagaagaagcaguuggggaggaaaggguuuauucagcuuacacuuccacauugcuguucaucaccaaaggaagucaggacuggaacucaagcaggucaggaagcaggagcugaugcagaggccauggagggauguuccuuacuggcuugcuuccccuggcuugcucagcuugcuuucuuauagaacccaggaccaccagcccagggauggcaccacccacaaugggcugggcccuccuccaacaaucauugauugagaaaaccccugcagcuggaucucauggagacauuucuucaacugaggcuccuuccucucugaugacucuuaacuuacguaagcugacacacaaaagccagugaugaacagccuugugaauguguaagcugaauaaacccuuuccuccccagcuugcuucuugguuaugauguuuugugcaggaauagaaacccugauuaagacacacacacagucacauauaaaauaaaaauaauuuaaaacaucuaaacaaggagggggaaggagaauuuacuaaaacauaguuuggccaggaguggugacacuuaauuccagcacuccggaggcagagaugagauggaucucuauggggccagggccagccugaucuacagagugaguuccagggcagccagggcuguuacacagaaaacgcuugucuugaaaaacuaaaaaccaaaacaaaacaaaauucuccccaccaccuaaaaaacaacaaaaaccucaguuuguucaaaaaugcaacaaugauaucuaauacuuuaugugcuaguuuaaauauuuagaucucuauuuugaauuauguguguaugugugcaucugugugugcacaugagugggggccacaaggugcuagauccccugaagcuggagucccaggugguugugagcacuugaugugagagcagggaacugaacgcagguccuuuagaagagcaaaaagcgcucuuaaccucugagccacgcuaaagcccuggauaccaauuuaaaaaaaaauaaaaauuauguuaauuuauucuuuuucuuaaagaugaaggguucagaacucagagaagccauguagacugcccacgggcaugcagcagcacagccaagagucagaacaucuguggacgggguggggugggguuggggggaggauucaacaagaggcugagccugggacuguccucuuccuacauugcaggaggaggccauuacacagcauuaucaaccacaguucuaaaaugcuacccagaaccuacuggguucuacauagcucaggggugcucuuguggcuagcaccacacacacacagcuaacauaacucagaacacacacaguucaaugaagacuucacaaauaaccaaauacaaggguucagcucuggaugaccuggagacuuagcauggggaacagaaggccuuugcuguauucacaccaccaggccccgaccacauucaggugggcugugugaucaagaguaccucagggaggcgccugagccuaaaucugacagaggagcgagggcuuugcuuuuugccccauaagacgguugguuggagacaccuaccucaucaccaucuccugagguccccagcagcucuaucaucaccaccaccaucacacacacacacacacacacagagcaaaacuacaagcaguugaggccccucagcagggccaggcuuccuccagugaaugagaagaaucacagugucuccacacugcagccgcacuuggggcccugagugcuucuugauuggccucucuggaagggccgucaucucuggaauguaacucggccugcugguccagaagcucucgggagcuccgaguuccuuagccuugagaguaaugguucuagcuccucccacagccccaaggccacacugucuucagucaccugggucucucugauuuagacagcugaagcucuuuggcgucaagcccugugcuuuauauagcugugggggaguugggggguggaggagaggugcagaggggcuggaaguggugggagaggucugcccacccaugaugagucaaggguagaggugggagggagaagcagaggagcuuggcuggaaagucagggacacagagcuucaacgugaagacucccugcugugugguccugcagaaacccagccucacccaagggugcacaaugaagccgguggccggugcuuccccaggcuggaggauagagucccagaaggaaggggcugaccacugauugucaguguaacagcagacugcgaaggagacaccuauacauacugucuuccuuagcuaucacgaagaggaucuggagcagcccagggacaggucacccacagcagcccugaccacccacagcuggcccaccccacacuucacguauucacucucuaggcuuguuuucacugugagaacuggacacugaugcaggaggaccuuuauagagaucacugagccaacugcucagaggcugcucaaggaaggcugccuaaggcuucaaguuccgccaagccuuuuccccagccaguaccacccuuugaucaccaacaacuuucuuaggucucuguuuccacagcacugugagccucuaccccacaccccugauccuuggagauuagggccuacccaguuuuccuucccuagcugggaaggucugugcccacugauaaggucugugugaugguuaguuuuaacugucaacgugucagaagcuacaaucaaucaccugggcagucuugagaaguugucuaaauaagguuauccuaugggggauugacuugauuguuuauuggugugggaaagacccagcccacugugggcagcacuauucccuaggcagaggguccuggacugugugagagugaggaaaucaagcugaguaaaagcgagugacuauaaacguauuuguuuuucucugcucuugacuguggaggugaugugaccagcagccucgagcuccugcugcggugacaucccuacagugaugaacuguaacccagaaucaugagcuaaaaauaaaccaguuucuucccuuaaguugcuuuuuggucuggauccuuuaucacagccaccaaaaugaaauuaggacagcuuagaauguggucaccaugagaccaugucaccagacaagacuggacaggugugaccucugagaccuggagcaacauccaccucauuaccuccuccuggucucugcuaacauucccuucccaccuacaggauggcaacucccagccuuccuugaccccacuaagccaauauaaacaagaaaccacagaugcaugacacugggcacaggcagguaggagcguaacacaggguugcaguuuugccaggcccggcuaccauccccaggugcaagcuucaaggaauggguccagccaccuccacaugauggagcagaaacagggacggcccuguagggccagccaagggccacgcuggauucuggaggcugaaaaggaagcaagaaguugcacccaaaugcuacaaggcacgcugucccagauaaggacagggauggaggacugagggacaacucagcugguuggcacacagccucugaggagacuggggaccauggacugcgcagggcucccuagaggcucugcaagacauagguugucagaguaauccacaccuacaccuugugagccccuggugcagcaucagccgagcacaggaacuacccuauccuucagacuuaugccugggguccucauggacucagggcaaaguggggaaaguaggcaggguacagagguagccaugacaaccccuggggacaaggacaagaggaaucaggacaccaacacacaaggccccaggcccagcagaccaaggaggccacauuguaaggagagaacaagggcccuggucagaccugucaaucagaacaggauuacaaggagcaggagcagccacucugaggcaggacaagggcccuguguuugaaguugacccaaggacugaaaucugagcagguggacagggauggggugguggugaugggacaggacauucuguaaggcacccaggcaggugguaggcaggacagacagcauccagccacacagcaaagcagggagagucacgugcguaacgagugaaaagagucuguggaaaggcagccgucuacacagcgcaggcagcagucacacggguuagggcccgccccuaaugugacgccaugaaaacuggaagaggugugccacgcagacacaaaaacacucaagauacacggugaauggugggggaaaugucgaauucauaacaaacuccaagggccaaaccuaaaggaagccaaauggcacaugcaugccuguaaugccagccuuugggugugggugcaagagguugagguuagccugggcuacucagugauauccugucucaccuggagcucagcauauagcucuguuggucgucuccuuaccuagcaggaaugcaacccugguucaaucccuagugacauauaaaccaggcacggcggcacacacauggcaucccagcacaccaaaggaaggucgggaguucgagaacauccuuggcuacauaugaagucugaggcuagccugaguugcagaggacccugucucaaaauuaaaaauagagcugaggagaaaacucaguagagcguuugugccaugagcagaaccugaguccagucucaagaaccuacauguuuaaaaagcuggguagcagccgggcagugguggcgcacgccuuuaaucccagcacuugggaggcagaggaagguggauuucugaguucgaagccagcuuggucuacagagugaguuccagaacagccagagcuauagagagaaacccugucgcaaauaaacaaaaccaaaccaaaacaaaauaacaacaaaagcuggauagccugguguggcagugaauguuuucaucucaguaugagaggcagaggcaaccagagcucugugaguguaacgcuacccuauucuauacagcaagguucaguccagcuagggcuuuauggugagacccugcauaaaaauaauuuuuuaucaaacagcuuaaagcugaguguagcagugcauaccagugcuggggggacagccacgggucgcuucuuggguuuccuggccugcagucauaguccaacuggagaguuauagguugcugaaaaaucucucagaaaacaagguggccagcuucuagaauaaacacuugagguugaccucugaccuccuugugcaccuguguacauacaugaacacaccacauacacacacacacacacacacacacacagagagaagaaagagaaaccaaaucaagaagaugcucaauuuugggggcuugugagauggcucaaagguuaagagcacugacugaaaguccugagucccaacaacaacaugguggcucacaaccguccauaaugagaacugacacccucuucuggugugucugaagacagcuacaguguacuuauuuauaauaauaaauaaaucaaccaaaaagaaacaauaaaaacaaaaaacaaaaauaaauaaauaaaucuuugggcgggagugagcaggguugaccggagcaagcagagguacaaaaucaauucccaacaaccacaugaaggcucacaaccaucuguauagcuacaguguacuugcauacauaaaaaucaauaaauaaaucuuuuuuuaaaaagauacucaauuuuuuuaaauggcugaaagacauaaagagacacaaugaagcuagaaaguaucacacacuggacucaagagccagcucagccagcaggaguccacagaaagcaaacugaagccacgggagcccccccuucagcaacuugcacauaggcuguaggcaccaggguauagagucuggaggggucuggaguuugcacauauacccucuuccccuguacucaugagagguccuccccccaccccccaggacacaaacagaacagugagucuugugaggcaggaggauuuggaguuguaggacugccugggagugagaccuugaaggagaagauaaaaagggaacaguaccacacagcagccgggaugaagcucacacgcccgagcaaagaugcuggagaggcccaugacccgcgggcucucugaagcccagacgcagccaagacagccagggcuggagggcagcaugggggucccuucacugucugguucuggaaugguuguuuggaaagccucagguguugaaccucaccagacagugcuacagagcuacggguuccacugggugcugguaacacgcagggcucugugcaggccucggugcucaggugcaccggaaacugggcaguggcgggggaccccagagccucaaagagccuggggcagagcaagucuuacagacacauuuaccaagugaaugacgaggauagugaccagacaucaggaggagaggacaagugaagagacacuguuguggggggaggaguggcagagugaccuaguccuggaugagugacaugucuggaacccuaggggacccacccaggaagguagagcagggaaauugcugacaggauacauugaaggggcuacagcugaaggacaggacuucuggcagugagcaaggacuauguaccccaacuaugauccacaucuccuuagaaauaggcucagacagcggugguggcucaaugccuuuaaucucagcacuagggaaggagaggcaggcagaucucugugaguuugaggccagccuggucugcagagugaguuccaggacagccaggguuacagagagaaacacugucucuaagaccaaaacaaaacaagcaaacauaagcaggcuaccugggcuguggagaccugauggauaaaaguguugucaugcaagccugacaaccugaaugcuuaucccguggcagugucugugaucccagcacuccugggaugagaggcagagaugggagagucuuccagaagcucacaauccaacuagcuggaggacacacuacaguggcaaacaagauagaucuugcuucaaacaagguggaagguacagagcaguaucugaggccgaccucugaccuccacauacgugacauagcacacacacagaccuucacaugugugacauaguacauacacacccucgcacaugaaaauguccacacaggcacauucaaacacaaaaauaaacuuuaaaaaaaaaaagaaacaaggccuugcccccuuagaggccacucucccaccagcugccaugucuuggggagauaggugagacuggaaggccagagguccaaggcucucauaguagacaacguugcucgggggauugcuuggaggaaaggacacuggcgugugcuuucgaaggcagggacagcaguaggugccacaggccucagcagcacaggcaggagagggccuggaucuacacggggcuggaagaaagcaugcacccaagagauuggccacucaagguagacucaagguagacuccaucagagggaaggaaaacaguccuggccccacucagacagaggagauagggcuggcuaacaggccacagccugcaaggcugcugaaggcugcaugggaccaucucacugucgguuaugcggguaacagaaagcuggccaggacugggaggacucagcuauccucagagugaucuuaggcaaccuggauaaccugcccaccuguucuuucccaaacaggacaagaaaaacccuacagaggacagaggucauaguacgaagcucagcgcagaacgugcaggggccaugagggucaugcuagagagggaaaggaaaaauaaaaacagcugucaggcuagugauggucucauuucccuuuuaaagauuuuagccaggcagugguggcgcacaccuuugggaggcagaggcaggcagaucucugugaguucgaggccagccugguccacagaauguauaagugggggacgggaggagguacacacgagggcaggcgcccuccgagucccauagagggugucugagucucuggagcuagagucaucgauaaacaugagacccuguagguguggugcucagagcugaaucuccauccauucuccgcaacagcgguacacacucuuggcugcugagccaucucucuccagcucccucacugcccuuuuaaaauucccuggaacauugucgggauguugcuguuaaccacuguuuuaaccauaaacagaaaucaaguaugugagagagagggcgggccaggagcaugcuggagccacagcagaggcaggcacaccugcuggaagcugggauguaaggggacagcagacagacagcaggcuuuggggggaggaggguccaggaggcgaauaucaaacccuacgcuugcagucuccaaagcucaccucgggacccauaccucauccucggguccccagcauguacaggcuuccagugcagacccuggggaugaagauucuuggaaggguggccaagacuuggagggcaaagauggcuucuagacacaggaggagaaucaggcagcagggagagccuaacgcucacccucugaaggcugagcagaaacucugccuguacaguucagggagauagacaggucguauggugguuugaaugaguuuggccccagaaggcuuauauauuugaaaauuugguccccaguugguggacuguauaggaaggauuaggaggcguggcuuuguugaaagaagugugucacugagugggcucugagguuucgaaagcucccugggcccagucacaugcuuucucuaccuccaucguaguggcucagauguaagcuugcagauaccccuccaacaccaugccggccugacaccauguuucucaccaggauggucauguaacccucugaaacuguaagcaagcccccaacuaaauguuuuuguguuuuauuaaguugccuuagucaugcuaucucuucacagcaauagaacaguaaccaagauaggccagccuagcuucacguuccccagagcccagcagcuguucccuaggcccauuuuaggcugccauucaauggggguaaggaaaccacaggaggccgagguggccaccaucccucugcagccugaacccaggguucagaaacggucccagcuauauauacucacggagaaaaauagcgugcacauugcagucugguaaacaguccagucguggcugacccugucagcccguuagagagaaccaaaaauacccccuauaauuaugcuauuaaaacauaccagaaaagcggagccaccccacucagcagggguuccugggaugucuacagggaguugggaggcugaacauacugacuaaggcaucugguagcacccaagaggcuggucuggcuggacagcuauccuuguccccucuaagaugaugcuugcuucccaugguggucaguuccccaagggaccagugggaguggcuaccuggacagccuauggucuucaugcauaaaugcaacaggacccacccaguaucuccucagagggacaugugaaaggcagagguguccuugacaccagaaacuuaggugcuacugaagggaaggccgaauuggaaccccaaaacaaccauggauguuccaacaacaaaagagaugaggggacaagggcguagcaguaggugacaggcaacagaugccaccacgcugagaccagagagagcuagggaggaccaaggccucuugggaaugggggugggggguugggaauucaaaggguucaaguggaguuuaugccagcugaucugagccacaucuagccacgguccaaaaguauuaaaugaaaaacuccagaaguaugcauuucauaaguuuuuaaauuauuuuguguauguauuuguguguguguguguguguguguguguguguacguacaugggauuuguauaaacuuuugggagccuuuaccuacugagccauccuaccaacccuuaccuuuggggguuuuuuguuuguuuuguuuguuugcuuguuuuaaaaaagauuuauucauuuauuauauguaaguacacuauagcugucuucagacacaccagaagugggcaucugaucguauuacaaaugguuaagagccaccaugugguugcugggaauuaaacucaggaccucuggaagagcagucagugcucuuaaccgcugagucaucucuccagucccuguuuguuuguuuguuuguuuguuuguuuguuuuuugaagcaguguuucauuauuagcacugguugcccuggaacucugacaccuacaaaccaggcuggccuuaaacucacagagaucagucuguuucugccucccucgugcuggaaauaagggcuugugccaccauacuugauguaaaaaccuuugaaugcauuacauggugguaauuauuuaaucuuauuauuaacuaugagguuaaccucugugccuaauauguaaauuaaaucugaccacaggugcauauagagcggugaacuacaucaagaguuuguuaguacaagggcagguuuccaacauccaccacagguauuuguuuuaggaaaaaauggcuuauggacuacacuacaagagguccaccaggauuuucucuuugcuuuuccuggugcuggggacugaagccagggucucacacgucccaggccaccauccuaucacugggcuacuccaccagucccucuuucuacccuuuacuuugaaaaaagggccugauaagugacccauacaggccuugaaccuaugaucccccugccucagccuccaacggaguugggaucacaggcuuuggucaccaagacagucuugucaugaaccauguaccaaacagauaaggggacaacuauaauugaaacuugucuguggggcaagcuuuaggcucugcccaaccucccucccaugcggccacucccugcucuugcuccuggaggccucucuacaaagggggaggggggauaggcacagggaggacuccccaggccccacccagucccaaugacacuaacucuagugcaccacuuagcccuagcuggugcccuucuaaggaggcagagggccauggaaugccacagugaccucauccuuaauagccuagcgaccuauuccuucccucuggacuggcuacccgcccccccccccaugcuauacccuccucuuccuggguucucucugccucccaaaccuucagaacacagcagcaggcagcuaggacaucugcccuguccacucacacuguccugaccagauaagaagggagcagaccucggagggcccacuggggugccccacuuagagggacuuguuggagauaaccuguuuggagugucauuauuagaacucuuuggggguggaacucuuugggggcucuguuuuggaugcuguuccugaggaauaccacguuggauggcaucuucgggccccugugaggcuaacaggagccuguugguugguguaacuguugccuuuguuccucuccaccuaugaagagcugcagaggcucacagugcccucaggccuggcaaggaggagguaagagcgcucucaccucuaccucuuacaucaaucccgccucccacccccaccccaugcccaggcaccacuggccuggaaccagcacuaggcuccuggcugccacccaguacuuugucccacaagaccucgaugagaggacgcaugaaugaacuuagaagguccagggagcugcacucugagcgcggcuccgugcugcacgcaggguacaggacuggagacccccucagagucagggccugugcgaagaaagugagggccuugccuaagaagaguccucugugcggaagggaacgcaguggugggaagcccuagagaccuggccgagccgcugaaggccaaugucaucacacagcacgcagcacgcaugggaaagcacucaggggcgccuggccaccaagaaggaggaaaucaccggaugaaggacuggccuuucuccaaacacagcugaccuauccaccuccccagccugggugugagaucacagcgcgggaaccggagaucagagccuggaaguggccuuaaagcuuuuauaggcccacuuacgggggaggagaugaggccuagaacgagguuaaaggccagacgaguucagagcgagaugaagggacuggccaccgccggcuguugucuuccacccacagacucauccacccgcagcauauacuccagcagacucccuuuguccuccuagugaccugaaagagguaccugccagcaaagagggcaaagagaacggcaccccgagguucucccuuccuauccuuaugcucuugggccugugaguuaauuccacgaaauucuucuuaauuuucaacagcuacauucugacagcgagaccaaaagcuaacagugagguagaaggcagaacugagccuuagaaucaagaacuaaauguauaugacaaaguaaaacaucuaauuacacuucuaaacuagguaacagaacugaaaggggaucucagaggcacagagaggcgguucccauggggcccagacguggaguccaagggcuggcccuccccaacucuugacaguuaagagagcaaacucagugucauccuacaagcaggcagagacaccgcccaggaaguagucuggggcugggaucagaagccagcacuucugcccaccccagcaaggucacuuccucuuuaggacccucccccuggcugccagugaccaccugcaauaagaaaauggugacaagggauccucccucaguucucaggucccuagcuccuccccuaaacacaccaggacccagugggcuuccuguccugcuuacccauucccucccagacccagcaugaggcagggucccgccccucugccaggcccugucacugaggcucagcagggagucccccacaucguggcagagggaagugggaccucacccacuggguggcuaccaagacugcaguacugguggcaggaaaggcuugguucucucuguuuuauugcucuuucuggcccugaguuucaauagcucugaccacugaguaagggcugucugaagagggugggugggcaagcccgauaaccguucccaccucccggcccagaguggacagcuaauggugaccgagaaaacauucugagaagggagacacguccccacuguaaacagugauacuucucggugacaagccgucgagcccaggugccacucugucacggaugugccucccaugcuauggcgaacgaaggaagaaaacagagaccacguugcauuaccacacacaggucuucaccgggagggagggagcuuucucacuaccuggcucuugcuuggauuuuaaguuccugguuccucugugaggccaagaaucaggagaccugguccuuucucucucaagcacaaaacaucccuccugaauccagaucccuaggucuccaggucaccggguuaagucugccuggguuggucacuauucccaugggacuagggcaucaccuugccugacuuuccagauuaggggaguggcaaagaggcuaagcaccccaggaugauucaaaccuucaggaaggccugagacagcacccagcauuuaagaugacuaaccugugaagaccuuguuuccaaaacauaggacucaaacuguucagaggguggagggugagggagcccucacaagagauggagugaacguuccaccuccagcaagaggucccgcagugaugacuacaccccauagaaaugaacaggaugccagcauccccuacgucaccacacagagcucuuagcuggcucuguaucccuugcccaccuccccaggcauaaagaagacuguugguggccaagcccacacccaggcucagugucaggguagguguggccugugccuagauauguucucaugaaugaauuuuauuggggggacaguuugagccuaaggaaagacaggagcauuagucaucaauauucuuuugaaagcuccccaggugacuaacacacaggcugggugggaacccccaaagcuggcaaagccuccuucacauccuaaccagacucagucuggaagcuuccucugacacccacauacuacagcugaaaagccaggggaccucagagcccagacugauccuuggaggguaaggauaaauucuagcuaguagcacugcuguccacgagcuaagaaaugauuuugcauuuuuuuuuaacugcuggaaaaaaauaucagaguauuucaugaugugaaagcauucaccaucuggccugucagagaaaagucugccgguuuuguuuaagcacggcccuugucugugaaagaggaccucuuccaugaagauggagaagccuuucucugcacacaacaggaccaccucuucccugcccugcccuccuuguucccaaguguugacagucagugaaggagccugagaagcagcucuuguugaaucuuuaagaaggguacccgucuucuacauucucauccacccauucugcuuauauuuacagucugaccgucuacaggccagcgaggaaaagaagccacaaaugugggcccuagaccuuggcucuccuaaguccgggcugagcugaggacaguauccgcuggccccuccuuucagagcucaaugguuuucauugauuccugccuugaaaaaucccccccacccccccaccccggucucaccacauuuugguccuacaaaucaaaacuuggccuguguggaagucauugcccggguugccugacaccccccggagccuguuccugaaacagggugcacaagcaguguccguggagagauggagggaaucacgcacaacccccccaccuccaacagauggacuuccacgaggcagaccaacuuucacaguggguacacugacucucugugggcuaauuuaaucagaccccgaggaaggucacauguggaggggugcugacugcuucaggagguguaagggggugagcagcugggcaaggugcccugggugaggcugggagggcggcaauggagcccagcaccuaugacaccaaaagagagaagcucuuugcaagaaagggacguaugccaagguaggggaucuccaguucugacaucaggcagagccuccuggggcgcccugugccccagucccucuggaagguaaccaaguagggcacaaggaagacaggagcuuagcauuggacagacaaccucggaacugagacuaagaacugcgccuagggcuggaacauuaguucugguaggaaauuucugacuugaaaagcuccaggcagaacgccaccuucucccagauuggucaggaagucaugaugcaaguuugauuuuuuucuuucuuucuuucuuuuuucuuaacuacgaaagagaauagaaagucgcgcuccccucacagcucagacacuaacagccccuugcccgggccucuccucccagcccgcguggagacgcccagcgcuaucuggggcucucgcggacccgcgccucgccguugccugccgugcuuuccacucggugcccgggccgggcccgccgaggccgccagcgcgcucacgccucuggaaugcgagcgcccugggccgcgagucccgcggaaucuccucgccuaugcucgcccgccggggcggcgcggcgcagggggacgcggacgcagccuucccgcccgcgcccuccacucacccgccaggagcgugcagggcagcaacagccaguagagcccggcgcccagcacgugcggcuccaugccccgcggccgggggaccgcccggggucgcgccgccguggcuaaagggaggugcgagggccggaggaaccgcgcgccauggcacucugggcgggucuccgcacgugcggcgcgcggcugcugugaccucccgccggccucgaucucgggucgccggccggcccggccgcgcccucugguucccgacggccggaucccgcgcacgcuggguugucagcccgcccggcucggaacucacggcggcucguggaggccgagcugggccggacggcgacgcggcggcucucucccugcucccgccugcgggccuuuauaagcucggcccccgcccucccuggagugcccgccuccgcgcuucccccgacggccaggcgcgcccaggcacccccucgcugcccagcgcagucugcucgagcgccggcccuacuagccuggcuggugccggugacccggagaccucgacccgcgcgccccccaaacccuccuucagcccagcgcaguuacucgcacugugcccguggggcgcuucucccuggggcuccggggccugggacccggggugggggcaauacaagaagacucccaaagaccugacccacuuaguacccacgcgcaacugcgcccc

SEQ ID NO: 4863 - RNA, 70368 nt, Mus musculus
ggggcgcaguugcgcguggguacuaagugggucaggucuuugggagucuucuuguauugcccccaccccgggucccaggccccggagccccagggagaagcgccccacgggcacagugcgaguaacugcgcugggcugaaggaggguuuggggggcgcgcgggucgaggucuccgggucaccggcaccagccaggcuaguagggccggcgcucgagcagacugcgcugggcagcgagggggugccugggcgcgccuggccgucgggggaagcgcggaggcgggcacuccagggagggcgggggccgagcuuauaaaggcccgcaggcgggagcagggagagagccgccgcgucgccguccggcccagcucggccuccacgagccgccgugaguuccgagccgggcgggcugacaacccagcgugcgcgggauccggccgucgggaaccagagggcgcggccgggccggccggcgacccgagaucgaggccggcgggaggucacagcagccgcgcgccgcacgugcggagacccgcccagagugccauggcgcgcgguuccuccggcccucgcaccucccuuuagccacggcggcgcgaccccgggcggucccccggccgcggggcauggagccgcacgugcugggcgccgggcucuacuggcuguugcugcccugcacgcuccuggcgggugaguggagggcgcgggcgggaaggcugcguccgcgucccccugcgccgcgccgccccggcgggcgagcauaggcgaggagauuccgcgggacucgcggcccagggcgcucgcauuccagaggcgugagcgcgcuggcggccucggcgggcccggcccgggcaccgaguggaaagcacggcaggcaacggcgaggcgcggguccgcgagagccccagauagcgcugggcgucuccacgcgggcugggaggagaggcccgggcaaggggcuguuagugucugagcugugaggggagcgcgacuuucuauucucuuucguaguuaagaaaaaagaaagaaagaaagaaaaaaaucaaacuugcaucaugacuuccugaccaaucugggagaagguggcguucugccuggagcuuuucaagucagaaauuuccuaccagaacuaauguuccagcccuaggcgcaguucuuagucucaguuccgagguugucuguccaaugcuaagcuccugucuuccuugugcccuacuugguuaccuuccagagggacuggggcacagggcgccccaggaggcucugccugaugucagaacuggagauccccuaccuuggcauacgucccuuucuugcaaagagcuucucucuuuuggugucauaggugcugggcuccauugccgcccucccagccucacccagggcaccuugcccagcugcucacccccuuacaccuccugaagcagucagcaccccuccacaugugaccuuccucggggucugauuaaauuagcccacagagagucaguguacccacugugaaaguuggucugccucguggaaguccaucuguuggagguggggggguugugcgugauucccuccaucucuccacggacacugcuugugcacccuguuucaggaacaggcuccggggggugucaggcaacccgggcaaugacuuccacacaggccaaguuuugauuuguaggaccaaaauguggugagaccggggugggggggugggggggauuuuucaaggcaggaaucaaugaaaaccauugagcucugaaaggaggggccagcggauacuguccucagcucagcccggacuuaggagagccaaggucuagggcccacauuuguggcuucuuuuccucgcuggccuguagacggucagacuguaaauauaagcagaauggguggaugagaauguagaagacggguacccuucuuaaagauucaacaagagcugcuucucaggcuccuucacugacugucaacacuugggaacaaggagggcagggcagggaagaggugguccuguugugugcagagaaaggcuucuccaucuucauggaagagguccucuuucacagacaagggccgugcuuaaacaaaaccggcagacuuuucucugacaggccagauggugaaugcuuucacaucaugaaauacucugauauuuuuuuccagcaguuaaaaaaaaaugcaaaaucauuucuuagcucguggacagcagugcuacuagcuagaauuuauccuuacccuccaaggaucagucugggcucugagguccccuggcuuuucagcuguaguaugugggugucagaggaagcuuccagacugagucugguuaggaugugaaggaggcuuugccagcuuuggggguucccacccagccuguguguuagucaccuggggagcuuucaaaagaauauugaugacuaaugcuccugucuuuccuuaggcucaaacuguccccccaauaaaauucauucaugagaacauaucuaggcacaggccacaccuacccugacacugagccugggugugggcuuggccaccaacagucuucuuuaugccuggggaggugggcaagggauacagagccagcuaagagcucuguguggugacguaggggaugcuggcauccuguucauuucuaugggguguagucaucacugcgggaccucuugcuggagguggaacguucacuccaucucuugugagggcucccucacccuccacccucugaacaguuugaguccuauguuuuggaaacaaggucuucacagguuagucaucuuaaaugcugggugcugucucaggccuuccugaagguuugaaucauccuggggugcuuagccucuuugccacuccccuaaucuggaaagucaggcaaggugaugcccuagucccaugggaauagugaccaacccaggcagacuuaacccggugaccuggagaccuagggaucuggauucaggagggauguuuugugcuugagagagaaaggaccaggucuccugauucuuggccucacagaggaaccaggaacuuaaaauccaagcaagagccagguagugagaaagcucccucccucccggugaagaccugugugugguaaugcaacguggucucuguuuucuuccuucguucgccauagcaugggaggcacauccgugacagaguggcaccugggcucgacggcuugucaccgagaaguaucacuguuuacaguggggacgugucucccuucucagaauguuuucucggucaccauuagcuguccacucugggccgggaggugggaacgguuaucgggcuugcccacccacccucuucagacagcccuuacucaguggucagagcuauugaaacucagggccagaaagagcaauaaaacagagagaaccaagccuuuccugccaccaguacugcagucuugguagccacccagugggugaggucccacuucccucugccacgaugugggggacucccugcugagccucagugacagggccuggcagaggggcgggacccugccucaugcugggucugggagggaauggguaagcaggacaggaagcccacuggguccugguguguuuaggggaggagcuagggaccugagaacugagggaggaucccuugucaccauuuucuuauugcagguggucacuggcagccagggggaggguccuaaagaggaagugaccuugcuggggugggcagaagugcuggcuucugaucccagccccagacuacuuccugggcggugucucugccugcuuguaggaugacacugaguuugcucucuuaacugucaagaguuggggagggccagcccuuggacuccacgucugggccccaugggaaccgccucucugugccucugagauccccuuucaguucuguuaccuaguuuagaaguguaauuagauguuuuacuuugucauauacauuuaguucuugauucuaaggcucaguucugccuucuaccucacuguuagcuuuuggucucgcugucagaauguagcuguugaaaauuaagaagaauuucguggaauuaacucacaggcccaagagcauaaggauaggaagggagaaccucggggugccguucucuuugcccucuuugcuggcagguaccucuuucaggucacuaggaggacaaagggagucugcuggaguauaugcugcggguggaugagucuguggguggaagacaacagccggcgguggccagucccuucaucucgcucugaacucgucuggccuuuaaccucguucuaggccucaucuccucccccguaagugggccuauaaaagcuuuaaggccacuuccaggcucugaucuccgguucccgcgcugugaucucacacccaggcuggggagguggauaggucagcuguguuuggagaaaggccaguccuucauccggugauuuccuccuucuugguggccaggcgccccugagugcuuucccaugcgugcugcgugcugugugaugacauuggccuucagcggcucggccaggucucuagggcuucccaccacugcguucccuuccgcacagaggacucuucuuaggcaaggcccucacuuucuucgcacaggcccugacucugagggggucuccaguccuguacccugcgugcagcacggagccgcgcucagagugcagcucccuggaccuucuaaguucauucaugcguccucucaucgaggucuugugggacaaaguacuggguggcagccaggagccuagugcugguuccaggccaguggugccugggcauggggugggggugggaggcgggauugauguaagagguagaggugagagcgcucuuaccuccuccuugccaggccugagggcacugugagccucugcagcucuucauagguggagaggaacaaaggcaacaguuacaccaaccaacaggcuccuguuagccucacaggggcccgaagaugccauccaacgugguauuccucaggaacagcauccaaaacagagcccccaaagaguuccacccccaaagaguucuaauaaugacacuccaaacagguuaucuccaacaagucccucuaaguggggcaccccagugggcccuccgaggucugcucccuucuuaucuggucaggacagugugaguggacagggcagauguccuagcugccugcugcuguguucugaagguuugggaggcagagagaacccaggaagaggaggguauagcaugggggggggggcggguagccaguccagagggaaggaauaggucgcuaggcuauuaaggaugaggucacuguggcauuccauggcccucugccuccuuagaagggcaccagcuagggcuaaguggugcacuagaguuagugucauugggacuggguggggccuggggaguccucccugugccuauccccccucccccuuuguagagaggccuccaggagcaagagcagggaguggccgcaugggagggagguugggcagagccuaaagcuugccccacagacaaguuucaauuauaguuguccccuuaucuguuugguacaugguucaugacaagacugucuuggugaccaaagccugugaucccaacuccguuggaggcugaggcagggggaucauagguucaaggccuguaugggucacuuaucaggcccuuuuuucaaaguaaaggguagaaagagggacugguggaguagcccagugauaggaugguggccugggacgugugagacccuggcuucaguccccagcaccaggaaaagcaaagagaaaauccugguggaccucuuguaguguaguccauaagccauuuuuuccuaaaacaaauaccugugguggauguuggaaaccugcccuuguacuaacaaacucuugauguaguucaccgcucuauaugcaccuguggucagauuuaauuuacauauuaggcacagagguuaaccucauaguuaauaauaagauuaaauaauuaccaccauguaaugcauucaaagguuuuuacaucaaguaugguggcacaagcccuuauuuccagcacgagggaggcagaaacagacugaucucugugaguuuaaggccagccugguuuguaggugucagaguuccagggcaaccagugcuaauaaugaaacacugcuucaaaaaacaaacaaacaaacaaacaaacaaacaaacagggacuggagagaugacucagcgguuaagagcacugacugcucuuccagagguccugaguuuaauucccagcaaccacaugguggcucuuaaccauuuguaauacgaucagaugcccacuucuggugugucugaagacagcuauaguguacuuacauauaauaaaugaauaaaucuuuuuuaaaacaagcaaacaaacaaaacaaacaaaaaacccccaaagguaaggguugguaggauggcucaguagguaaaggcucccaaaaguuuauacaaaucccauguacguacacacacacacacacacacacacacacacaaauacauacacaaaauaauuuaaaaacuuaugaaaugcauacuucuggaguuuuucauuuaauacuuuuggaccguggcuagauguggcucagaucagcuggcauaaacuccacuugaacccuuugaauucccaaccccccacccccauucccaagaggccuugguccucccuagcucucucuggucucagcgugguggcaucuguugccugucaccuacugcuacgcccuuguccccucaucucuuuuguuguuggaacauccaugguuguuuugggguuccaauucggccuucccuucaguagcaccuaaguuucuggugucaaggacaccucugccuuucacaugucccucugaggagauacuggguggguccuguugcauuuaugcaugaagaccauaggcuguccagguagccacucccacuggucccuuggggaacugaccaccaugggaagcaagcaucaucuuagaggggacaaggauagcuguccagccagaccagccucuugggugcuaccagaugccuuagucaguauguucagccucccaacucccuguagacaucccaggaaccccugcugagugggguggcuccgcuuuucugguauguuuuaauagcauaauuauaggggguauuuuugguucucucuaacgggcugacagggucagccacgacuggacuguuuaccagacugcaaugugcacgcuauuuuucuccgugaguauauauagcugggaccguuucugaacccuggguucaggcugcagagggaugguggccaccucggccuccugugguuuccuuacccccauugaauggcagccuaaaaugggccuagggaacagcugcugggcucuggggaacgugaagcuaggcuggccuaucuugguuacuguucuauugcugugaagagauagcaugacuaaggcaacuuaauaaaacacaaaaacauuuaguugggggcuugcuuacaguuucagaggguuacaugaccauccuggugagaaacauggugucaggccggcaugguguuggagggguaucugcaagcuuacaucugagccacuacgauggagguagagaaagcaugugacugggcccagggagcuuucgaaaccucagagcccacucagugacacacuucuuucaacaaagccacgccuccuaauccuuccuauacaguccaccaacuggggaccaaauuuucaaauauauaagccuucuggggccaaacucauucaaaccaccauacgaccugucuaucucccugaacuguacaggcagaguuucugcucagccuucagagggugagcguuaggcucucccugcugccugauucuccuccugugucuagaagccaucuuugcccuccaagucuuggccacccuuccaagaaucuucauccccagggucugcacuggaagccuguacaugcuggggacccgaggaugagguaugggucccgaggugagcuuuggagacugcaagcguaggguuugauauucgccuccuggacccuccuccccccaaagccugcugucugucugcuguccccuuacaucccagcuuccagcaggugugccugccucugcuguggcuccagcaugcuccuggcccgcccucucucucacauacuugauuucuguuuaugguuaaaacagugguuaacagcaacaucccgacaauguuccagggaauuuuaaaagggcagugagggagcuggagagagauggcucagcagccaagaguguguaccgcuguugcggagaauggauggagauucagcucugagcaccacaccuacagggucucauguuuaucgaugacucuagcuccagagacucagacacccucuaugggacucggagggcgccugcccucguguguaccuccucccgucccccacuuauacauucuguggaccaggcuggccucgaacucacagagaucugccugccucugccucccaaaggugugcgccaccacugccuggcuaaaaucuuuaaaagggaaaugagaccaucacuagccugacagcuguuuuuauuuuuccuuucccucucuagcaugacccucauggccccugcacguucugcgcugagcuucguacuaugaccucuguccucuguaggguuuuucuuguccuguuugggaaagaacaggugggcagguuauccagguugccuaagaucacucugaggauagcugaguccucccaguccuggccagcuuucuguuacccgcauaaccgacagugagauggucccaugcagccuucagcagccuugcaggcuguggccuguuagccagcccuaucuccucugucugaguggggccaggacuguuuuccuucccucugauggagucuaccuugagucuaccuugaguggccaaucucuugggugcaugcuuucuuccagccccguguagauccaggcccucuccugccugugcugcugaggccuguggcaccuacugcugucccugccuucgaaagcacacgccaguguccuuuccuccaagcaaucccccgagcaacguugucuacuaugagagccuuggaccucuggccuuccagucucaccuaucuccccaagacauggcagcuggugggagaguggccucuaagggggcaaggccuuguuucuuuuuuuuuuuaaaguuuauuuuuguguuugaaugugccuguguggacauuuucaugugcgaggguguguauguacuaugucacacaugugaaggucugugugugugcuaugucacguauguggaggucagaggucggccucagauacugcucuguaccuuccaccuuguuugaagcaagaucuaucuuguuugccacuguaguguguccuccagcuaguuggauugugagcuucuggaagacucucccaucucugccucucaucccaggagugcugggaucacagacacugccacgggauaagcauucagguugucaggcuugcaugacaacacuuuuauccaucaggucuccacagcccagguagccugcuuauguuugcuuguuuuguuuuggucuuagagacaguguuucucucuguaacccuggcuguccuggaacucacucugcagaccaggcuggccucaaacucacagagaucugccugccucuccuucccuagugcugagauuaaaggcauugagccaccaccgcugucugagccuauuucuaaggagauguggaucauaguugggguacauaguccuugcucacugccagaaguccuguccuucagcuguagccccuucaauguauccugucagcaauuucccugcucuaccuuccuggguggguccccuaggguuccagacaugucacucauccaggacuaggucacucugccacuccuccccccacaacagugucucuucacuuguccucuccuccugaugucuggucacuauccucgucauucacuugguaaaugugucuguaagacuugcucugccccaggcucuuugaggcucuggggucccccgccacugcccaguuuccggugcaccugagcaccgaggccugcacagagcccugcguguuaccagcacccaguggaacccguagcucuguagcacugucuggugagguucaacaccugaggcuuuccaaacaaccauuccagaaccagacagugaagggacccccaugcugcccuccagcccuggcugucuuggcugcgucugggcuucagagagcccgcgggucaugggccucuccagcaucuuugcucgggcgugugagcuucaucccggcugcugugugguacuguucccuuuuuaucuucuccuucaaggucucacucccaggcaguccuacaacuccaaauccuccugccucacaagacucacuguucuguuuguguccugggggguggggggaggaccucucaugaguacaggggaagaggguauaugugcaaacuccagaccccuccagacucuauacccuggugccuacagccuaugugcaaguugcugaagggggggcucccguggcuucaguuugcuuucuguggacuccugcuggcugagcuggcucuugaguccagugugugauacuuucuagcuucauugugucucuuuaugucuuucagccauuuaaaaaaauugaguaucuuuuuaaaaaaagauuuauuuauugauuuuuauguaugcaaguacacuguagcuauacagaugguugugagccuucaugugguuguugggaauugauuuuguaccucugcuugcuccggucaacccugcucacucccgcccaaagauuuauuuauuuauuuuuguuuuuuguuuuuauuguuucuuuuugguugauuuauuuauuauuauaaauaaguacacuguagcugucuucagacacaccagaagagggugucaguucucauuauggacgguugugagccaccauguuguuguugggacucaggacuuucagucagugcucuuaaccuuugagccaucucacaagcccccaaaauugagcaucuucuugauuugguuucucuuucuucucucuguguguguguguguguguguguguguaugugguguguucauguauguacacaggugcacaaggaggucagaggucaaccucaaguguuuauucuagaagcuggccaccuuguuuucugagagauuuuucagcaaccuauaacucuccaguuggacuaugacugcaggccaggaaacccaagaagcgacccguggcuguccccccagcacugguaugcacugcuacacucagcuuuaagcuguuugauaaaaaauuauuuuuaugcagggucucaccauaaagcccuagcuggacugaaccuugcuguauagaauaggguagcguuacacucacagagcucugguugccucugccucucauacugagaugaaaacauucacugccacaccaggcuauccagcuuuuguuguuauuuuguuuugguuugguuuuguuuauuugcgacaggguuucucucuauagcucuggcuguucuggaacucacucuguagaccaagcuggcuucgaacucagaaauccaccuuccucugccucccaagugcugggauuaaaggcgugcgccaccacugcccggcugcuacccagcuuuuuaaacauguagguucuugagacuggacucagguucugcucauggcacaaacgcucuacugaguuuucuccucagcucuauuuuuaauuuugagacaggguccucugcaacucaggcuagccucagacuucauauguagccaaggauguucucgaacucccgaccuuccuuuggugugcugggaugccaugugugugccgccgugccugguuuauaugucacuagggauugaaccaggguugcauuccugcuagguaaggagacgaccaacagagcuauaugcugagcuccaggugagacaggauaucacugaguagcccaggcuaaccucaaccucuugcacccacacccaaaggcuggcauuacaggcaugcaugugccauuuggcuuccuuuagguuuggcccuuggaguuuguuaugaauucgacauuucccccaccauucaccguguaucuugaguguuuuugugucugcguggcacaccucuuccaguuuucauggcgucacauuaggggcgggcccuaacccgugugacugcugccugcgcuguguagacggcugccuuuccacagacucuuuucacucguuacgcacgugacucucccugcuuugcuguguggcuggaugcugucuguccugccuaccaccugccugggugccuuacagaauguccugucccaucaccaccaccccaucccuguccaccugcucagauuucaguccuugggucaacuucaaacacagggcccuuguccugccucagaguggcugcuccugcuccuuguaauccuguucugauugacaggucugaccagggcccuuguucucuccuuacaauguggccuccuuggucugcugggccuggggccuuguguguugguguccugauuccucuuguccuuguccccagggguugucauggcuaccucuguacccugccuacuuuccccacuuugcccugaguccaugaggaccccaggcauaagucugaaggauaggguaguuccugugcucggcugaugcugcaccaggggcucacaagguguagguguggauuacucugacaaccuaugucuugcagagccucuagggagcccugcgcaguccaugguccccagucuccucagaggcugugugccaaccagcugaguugucccucaguccuccaucccuguccuuaucugggacagcgugccuuguagcauuugggugcaacuucuugcuuccuuuucagccuccagaauccagcguggcccuuggcuggcccuacagggccgucccuguuucugcuccaucauguggagguggcuggacccauuccuugaagcuugcaccuggggaugguagccgggccuggcaaaacugcaacccuguguuacgcuccuaccugccugugcccagugucaugcaucugugguuucuuguuuauauuggcuuaguggggucaaggaaggcugggaguugccauccuguaggugggaagggaauguuagcagagaccaggaggagguaaugagguggauguugcuccaggucucagaggucacaccuguccagucuugucuggugacauggucucauggugaccacauucuaagcuguccuaauuucauuuugguggcugugauaaaggauccagaccaaaaagcaacuuaagggaagaaacugguuuauuuuuagcucaugauucuggguuacaguucaucacuguagggaugucaccgcagcaggagcucgaggcugcuggucacaucaccuccacagucaagagcagagaaaaacaaauacguuuauagucacucgcuuuuacucagcuugauuuccucacucucacacaguccaggacccucugccuagggaauagugcugcccacagugggcugggucuuucccacaccaauaaacaaucaagucaaucccccauaggauaaccuuauuuagacaacuucucaagacugcccaggugauugauuguagcuucugacacguugacaguuaaaacuaaccaucacacagaccuuaucagugggcacagaccuucccagcuagggaaggaaaacuggguaggcccuaaucuccaaggaucaggggugugggguagaggcucacagugcuguggaaacagagaccuaagaaaguuguuggugaucaaagggugguacuggcuggggaaaaggcuuggcggaacuugaagccuuaggcagccuuccuugagcagccucugagcaguuggcucagugaucucuauaaagguccuccugcaucaguguccaguucucacagugaaaacaagccuagagagugaauacgugaaguguggggugggccagcuguggguggucagggcugcugugggugaccugucccugggcugcuccagauccucuucgugauagcuaaggaagacaguauguauaggugucuccuucgcagucugcuguuacacugacaaucaguggucagccccuuccuucugggacucuauccuccagccuggggaagcaccggccaccggcuucauugugcacccuugggugaggcuggguuucugcaggaccacacagcagggagucuucacguugaagcucugugucccugacuuuccagccaagcuccucugcuucucccucccaccucuacccuugacucaucaugggugggcagaccucucccaccacuuccagccccucugcaccucuccuccaccccccaacucccccacagcuauauaaagcacagggcuugacgccaaagagcuucagcugucuaaaucagagagacccaggugacugaagacaguguggccuuggggcugugggaggagcuagaaccauuacucucaaggcuaaggaacucggagcucccgagagcuucuggaccagcaggccgaguuacauuccagagaugacggcccuuccagagaggccaaucaagaagcacucagggccccaagugcggcugcaguguggagacacugugauucuucucauucacuggaggaagccuggcccugcugaggggccucaacugcuuguaguuuugcucugugugugugugugugugugugauggugguggugaugauagagcugcuggggaccucaggagauggugaugagguaggugucuccaaccaaccgucuuauggggcaaaaagcaaagcccucgcuccucugucagauuuaggcucaggcgccucccugagguacucuugaucacacagcccaccugaauguggucggggccugguggugugaauacagcaaaggccuucuguuccccaugcuaagucuccaggucauccagagcugaacccuuguauuugguuauuugugaagucuucauugaacuguguguguucugaguuauguuagcuguguguguguggugcuagccacaagagcaccccugagcuauguagaacccaguagguucuggguagcauuuuagaacugugguugauaaugcuguguaauggccuccuccugcaauguaggaagaggacagucccaggcucagccucuuguugaauccuccccccaaccccaccccaccccguccacagauguucugacucuuggcugugcugcugcaugcccgugggcagucuacauggcuucucugaguucugaacccuucaucuuuaagaaaaagaauaaauuaacauaauuuuuauuuuuuuuuaaauugguauccagggcuuuagcguggcucagagguuaagagcgcuuuuugcucuucuaaaggaccugcguucaguucccugcucucacaucaagugcucacaaccaccugggacuccagcuucaggggaucuagcaccuuguggcccccacucaugugcacacacagaugcacacauacacacauaauucaaaauagagaucuaaauauuuaaacuagcacauaaaguauuagauaucauuguugcauuuuugaacaaacugagguuuuuguuguuuuuuaggugguggggagaauuuuguuuuguuuugguuuuuaguuuuucaagacaagcguuuucuguguaacagcccuggcugcccuggaacucacucuguagaucaggcuggcccuggccccauagagauccaucucaucucugccuccggagugcuggaauuaagugucaccacuccuggccaaacuauguuuuaguaaauucuccuucccccuccuuguuuagauguuuuaaauuauuuuuauuuuauaugugacugugugugugucuuaaucaggguuucuauuccugcacaaaacaucauaaccaagaagcaagcuggggaggaaaggguuuauucagcuuacacauucacaaggcuguucaucacuggcuuuugugugucagcuuacguaaguuaagagucaucagagaggaaggagccucaguugaagaaaugucuccaugagauccagcugcagggguuuucucaaucaaugauuguuggaggagggcccagcccauuguggguggugccaucccugggcuggugguccuggguucuauaagaaagcaagcugagcaagccaggggaagcaagccaguaaggaacaucccuccauggccucugcaucagcuccugcuuccugaccugcuugaguuccaguccugacuuccuuuggugaugaacagcaauguggaaguguaagcugaauaaacccuuuccuccccaacugcuucuucuucuuuuuuuuuuuuuuuaauuuauuuauuuauauguaaguacacuguagcugucuucagacauuccagaagagggagucagaucuaguuacggaugguugugagccaccaugugguugcugggauuugaacuccggaccuucggaagaacagucgggugcucuuacccacugagccaucucaccagcccccaacugcuucuuggucaugauguuugugcaggaguagaaacccugacuaagacaguauggauggauggauuugcauguggaggucagaggacaagaugggggagucagucuuuucuucaaccauauagguccugggaucaaacuugggcugucaggcuuggcagcaagcaccuuuauccucugagucaucuuguuagccaugaauccuucauccuuggaaguggggcuggccaucuggguauggcaguucacaucuguaaucccagcacuuaggaggccgaggcagaaggauuguugcuaauuuaaggccagccuggacugccuaauuccaggucagccugggcuacagugugagacccugacucaaaaacaacaacaaaaaaacuacaugccuuuaaucccaacacucgggaggcaugggcaguggaucucugaguucaaggccagccuagucuacauaguuucaggacaacugaaacaauauagugagacccugccuccaaacaaacaacaacagcaagcaaacaaaaucagggucuacugcacuacaugucuacugcacucagcuccuguggggcugagugucuggccagcggucccuggagcaauuguccagcugugacuauucugugguagagcuucccucccccagccagucucuuuaaagucuucagauguaagguuaccaacuguacugcuuggccccgcaccucucgggggauagcccugcagguuccguggguggaaaugccuuaugaaauccaacuugggggaggcagggcuggugcacaggcuggauaucucgcucugcaggccagauugcagcuauagggagcugugcaucuugagcagggcaaagguuagcugucugcucacacauugccuguuggcggugugugccuuggagcauucuguuggcuaagugaggagagcaucuaggugucuacuccuggagacaggaguguacuggcugguuuuuugugucaacuugacacagcuggaguuaucacagagaaaggagcuucaguugaggaaaugccuccaugagauccaacuguaaggcauuuucucaauuagugaucaagggggaaaggccccuugugggugggugccaucucugggcugguagucuugguucuauaagagagcaggcugagcaagccaggggaagcacgccaguaaguaacaucccuccauggcuucugcaucagcuccugcuuccugaccugcuugaguuccaguccugacuuccuuuggugaugaacagcaauguggaaguguaagcugaauaaacccuuuccuccccaacugcuucuuggucaugauguuugugcaggaauagaaacccugacuaagacacgggagugauuagauaucuguugcugggugaaguuagacugcuuggcuauacuuugaacccuucaucuuuaaaaaugggcuugaaccagugagaugccucaguggcuaaggguauuuucuaccaagucugaugauguccuugcuccaggaacacagcucagggaauggagccagaauucacugaccgaaggagcacggccggggcgcccucuaugacuuuauccacuuugaggcccucuggcugaaugucuaugggcaaguccugcucugaacucccuauguacuacacugucaugguggcuucauguggcaacugcuguccuuggcccugcugugcaggucauaggccuggggaagcugaguaaggucuccuguccaugggauguggccagcugcaggguggguggguaugaccggccauugcuucaggccccgagaugcauaaugugagcugaaugcuggaugucucguggugucugcaccauugguucccucggggcuuggcaggugaagaccaaaccaugcauauuucuuugaaagggaaagugaugacuagauacucaagcaucgcuguaguguuaucucugacccagcaggaaggaugcugaaggugucagacuuccuuugcugaggccugacugugaauugaugcugccauuggucuuagaagacucuguaugucagagaugaaauauagauuuuaaaagguauuaauucaggaauaccagaaaggugugugugcuagcuguggggagguuuagaagugcccagccauugacuguauggcaauccuuuauuaccgaucaaagccagaugugggcagggaccuucagcgucuggaaauucggccuuugggagcugaauuaagacaaagcguuagaacccauucccaguguaugucugcuucuggcaauggugaauaggacccagaacccccagugaucugucccucagccucugcccacaugggcuucagcagaagcaguguuagccagcgucaagguuugaauaagcucggccugggaagcggcacuauuuggagguguggccuuguuggagugggugugucacugugggugugggcuuaagacccucacucuagcuuccugggaaucagccuuccacuagucaccuucagaugaagauguagaacucucagcuccuccugcaucaugccugccuagaugcugccauguucccgccuugaugaugauggauugaacuucuaaaccuguaagcuagccccaauuauauguuguccuuuuuuuuuaagacuugccuuggucauggugucuguucacagcaguaaaacccuaacuaagacagccagucacucccuuucugucuuuuuaaggaguaagguaauugaggccugcccuagccccaccagcugcacagguuucuugccauggagccccuaaaaaagcccaccuguucuuccuguguugccccugaagccuggcccagggaaagggcugguucuguugucgucuuuaggccuuuuccuuccugcgaagaggcugagcucagccuugacccuucgaggcccacaggaagccaagaaaggcucuuuguggucaaaggccaugggagucaagagucagucucagaauuccauagccuggugcuuccacggcugcuuggagacucagcagccucacacgcacgcucagcgagcagucucuaggaggugaggauggaagcugggagagccaaggacaagcugacagcaugucacagugcauacauacagugauucuaguuugguagccuuuaaggcacauggaauugccgacacacuuuacagaugaggaaacugaggcccggaggucauucgggaacugggcuaggacucagccacgaggcugccaacacagccuaggccccaggaauauaccaugaccuaguaccucugacuugucugugcugaguggcaucuccaggugauagcuguccccaucccuagacccacugaggccaugugggacauagucugguccaagcuugggcugaggauaaaaauaagccugccuuucacugguagggaagcccgucgaugcagcuucuccugggaggggagagugugguuaagauggaacuccaccaccuuccagggugggguggcagggaggguagccacucuggacacugggcaaaggggccugacccuauggggcugacacugaggccccccgggaucccccaggggaugucugcugcuggcuucacaaucaggaauuagauuaguuuuccauaaaaacaggauguggcgguaggaggaugacccgcccgucauuucucucacugcuuuuuccaggaacugaacauauagcccuuggccagcacugucccuguccccacccugccugccuaugcagggaacagcccucacuuugcuccuaaguggcuucuuaaucggcuccucuugcuggccaggggagcucgccgcuucucccggagccaguaaggcucuguggggauacucuggcaguguucaagggccagacgggguaucgagugggaggaagguuuggaucacugaagaugacugaccuccuugugccccagccccaggacacaucacugggcacagaauuaggguuuuugggucccuccugugagccucugagaucacggacuuagagaaucaaugccuauuguaagcugaugggggggggggggggaguugcugaggaagagucuccaggccauggccugagccuggggaaagcuacagaaagaaaugugagcaugcucccauccauuagaugggagcauggagugaguuggguucuguuucguggcuaguaggucccaagagagaagccagugggagcugaguuucagucuucuucacucuacucccgacuucugcaugguggggcaaggucccugguguugaagcuggcuuagugguacauuucuagauagcucugucccuccuggcacaguucaucuucuauggguggggacagugguacuuccccucuccuaggugucccagguucauccugugaauacaggacccgcucccaggcugagaguuggugaugcugugaggcucugagauuugaggggagggguggguccucccaggaaauagaauggcaaccacaaccucucagcacuuagcaccucagcauccccaaggggguggugaucaaagccagagagagucucucaguagcuguggaggacugggccacucaccaggcucuuccccggcaggucuggggcuccuguggccuccguauccuggucuugggauggcuguugaggguugggcaacacagcucuccugccaggcucugcugggacccugcucaggccaggaauccugcugcuuucaucuguuucagucccacacacccugcagccacaggccuggaauacccuugacacugacccccaguaaagcuaaagcaauucccuggaaggguucugggaaggcaagaggacugugggacccaggcagagagcacuggcuucagucgguucugauggggaagguaugguagcaggaaccguguccccacuuuucuccuccauauuuuaaagucuugaaaauuaagaccaugccaaugguggggcacgccuuuaaucccagcauuugggaggcagaggcagggggauuucugaguucgaggcuagccugguguacagagugaguucuaggacagccagggcucuacagagaaacccugucuugaaaaaaaaaaaaagaaagaaaagaaaaaaauuaagacuacaaaguauucugagaguuggucaggucuuuuacaaaaggggaaacugaggcuugcugggcccaggucuccggcuguccggcagugauaucuacguacccauguguuggggugggaccaagaauggcuaccaguguggcgguuagaauugacauuguugauuuuuuuccuuggucacuugccuuccauuguacauguggagcccagaacuuugccacccugccuguggccacagauguugagagcagaacuuggcucuaggucuccuucugauuggcugguacugcuccuguuggggugcuggagcuagaguggggucaucugcugcuuugagacaggggcaucccaucugucuauagccaucucucuguccacccauccaucgucuaucuguucucuuaugauauuugcuucuccaucaucuuuacauccacucucuguccuuucuuuauauuuaugucaucugcccaucuguccugugcugucauuuaccaagguguggcugggggaagauggacgcucaggcuuagaagggucagggaacucccuccaccuggcugcuucuugagacagugauuauucccugcgguguuagcagcaagaggcaguuggguaacauucuuccaaggugccgaggaggcccuggagagcuggauagccuaugaccaggcccuggacagcuuacauaagggccaagaggugcuauggugaaucacagggcaauggucagaguccgugcauagccuagagucucagccaaagccaagugggaaugugggguggcuggagcuguuuaggccagguauccacaucuaccagaaaagcuauggcccuaaugagugguggccagagggcuuccagguacuagagcuguggagcccacuaccuuccugggacaaaaugguacagguuugcugguggaguucaucagagccagcuguggucucugcauccucccagcagcugugguucagugcagcuugcugugggaugugcugcuaauaccgugcaugcauuuauacagguuguagcaggcagagcuuguuggcuagagguguacccuguaccuugucucucuuccucaagggaucccugaaagucuacugucacagggaggguaccccaggacuggacugucuagguaagacugaaugugguaauuugaaagagaauggcccucacaggcuccuguauuuuuuuuuuacagauuuauucauuuauuuuauguauaugaguacacuguagcuguacagaugguugugagccuucaugugguuguugggaauugaauuuaggaaugacacacuccggcccaaagauuuauuuauuauuauaaauaaguucacuguagcuguuuucagacagcaccagaagagggcgucagaucucauuacgagugguugugagccaccaugugguugcugggauuugaacucaggaccuucgggagagcagucagugcucuuacuugcugagccaucucaucagcccccaggcuccuguauuuuaauacuuggucugcaguugguggaaguuuuugggaaggauuaagaggcauggccuuguuggagguggggugugucacugggggugggcuuugagguuucaaaagacucuucccagucagcucucugccucaugcuugcagaucagguguaagcuacugcuccaguggcaccaugccugccugccugccugccugccugccugccuguuaccacgcuccuugcucugaccuggacucuaacccucuaagaguaagccucaguaaacucuuccauguguugccuuggccauggugucucccagcaacagcacacugaccaagacauuaagauuccgcauuuccaugggcucucgugugcaguugaagaggccuugaggacuuguguucuccaugaugggugacacuuaaccuaggcauagccaaacagagaguggggcauguggccaugugcccagugagggauccuguucugugauugacacccagugccucacagcagguccugcccuaucaucuuugccugugaggagcucccucugcugaagucccacaguccagacccacccacccacuaugucugccucuagugccccuagaggacucauccugacggaugcuuccuauauauacauggguuauuguucaccauggccuugggaaaccauagacuucuaaaggugagucuuggcccuccuugucccccacuccacccccacugccucccuccccccagguaggguuccucuguguagcucacucuguagaccaggcuggccuugaacccagauuugccugucucugccuccuaagugcugggauuaaaggcaugcgccaccacaccuggcugcccuuguuccuuauuacuguguaaccacaggacccauugggcaucuccuguuguugggccucacuuuuugcaaauucugugugugagaaccucuggucuuguuccucugcucugaggucaugguaauugccuuucuacuaaacugcacagacuguuuuuguugucuuuauuccugaacaacucagucuaaugacuguuugugguacauguaugucguguuagguauugugaguaaucuagaguacuggagaagggaagauggccguaggcucugggcaaagcacuuuauuaaaggggcaugaacggcaugcucccugcauucaagggucccagaaccagucuauccuggguaucgagguuaccuguauuguuuuuguuuguuuggggacugggucucacuuuguaucccaagcuugcuuggcacuuuccauguagacuaggcuagccuuaaacucacaacaauccuccugccucaacuucccuagugccaacaugacaggugcgcacagccacaccugaccuguauuuguggcagaucuggaucucauacugaccuauuuguggucuaguguucuuccugccauugugggcaagcucccucugggcugcagguauccgggguuagagcuguagacauucuuuugugacuuccacagccugggccagggcagugccagugggccagugcccucucuggaggaaagggagccgcugcucuugucugaggccagagcagucucacuagugcaguucugagagacacuguugagugucagucucagggagguuuccgcugugagaauuguggggcccagacuugugccacagccucagaauaugagcguggagcuguggugacagaggaacuagucuggcucagagagguccaggggggugggccaggcacugcagaguguagucuagguuuccgaagccucuccacccucuucagguacccugcuuagcuggcagugaggaauccugccuucuggcagcuuggaauucugggggcagugccuucaggucaggagcuggguuguuuacgcagagcagagcgaaaggccagcccuuccaugcuaaucagugugguucaagaggcuucuggaaugugcuguccacucuguagggaaauugccugugguaaccuauuccuuucucagcaagugacugggguugcucagugcuuuguccaggggaugcuccccaccccacuugucuuguuagagcacccccauccuuugagagaagagguaaggccagagaugucuuucccagguuuauagagacucaggggcucacccugaguuuggagccuggccggcucacuaaggagccucuuacaugcucagacuggcagucacaaagccccugagggaccuggaacccaacuaugucaucucugaacauucaagagcuaccgugcuggcuucauccuguuggcugcaauuuaccagcugggcacugggcagguuugaaucauaacguggaacucugggugacaucaggucccacacccauacucagguccuggggcagggucuauggccacccugcuucaguuugccucuuccauggcaaccucugagguacucucagauggcucuagugggagaauugcaauugaccacugaccacagucaccugggagcggugugaacgucccgcacugggaugucuguaguggggucucagggucucugugcuccuaggaaagagcccaaggcauaugugugcuuguugcuaguggaucaagaaacugaucaugcccuggcccgguucuuuuguuuggcuuguuugguuuuuguuuuguuuuguuuuucuccagacagauguagugucuagaggaguaggugaagcuguggaggggccgugcccacagugccucaguuucccucaucugacagauggcaggcauuggguagggaaagggaggcucuaccuaggaaagccuuccgugguuugcuaggccguugcuucuccucccuguguaagccacgugguggcuucacagcucagcccgugcccuucacagcucagcugggagaccuggauacacaauuuacuccaguuagugggagcucuugaguagcuacgaucuggggagagguaacauguggucagggaaguggacaggacugacccugguggaggcucugcgagcggcucaccagacuugcuccaggcucuggagagcucacgguguauuaagggaagaacucccaguccgaggcuaaauuugucagugguacacaguauacagggccaggaccagccccuucuucagcuuccugcugagggcgaagacccucugagcuccaaguggucugugaggagggugucaccuucaggagggacaguucugcgggccaacucccucccaaaugggauagggacuauuuucugcacccauguacuucccagggcccugcccaugugcuacccggccuguuuaccugugacagccaguagagauggcugcagauaggucuggcuuccucccuccagggaggaguggguggggauggcugauacggaauggggcccacccuguacccugaguucucuccucuuuuguugauaguugucgccuguggguaggucagcuuuggguggcuucagucucauaccuccaagcgacucgcauagaguacagacugugccucugugugauaggcauuguggguuguuuagggggggagacugugagcaggguccccaguuaguuagcugacugacuaacugggaccaacgcagcaucugcugggaagaggaccugucacggucggauugaguuucuccucgugucuucucugucucuggucucugggcuguccugagaaguuuggggugggaggcaagcaucccucugccagcuugucucuggugccagcaguagcuguaucauccauccuugaucucuuugccugaugcagcccugguugagagccagggcucagcaccaagccauuuccugcuggucuucugggcauucacugccuucagcaccucugaccugcucugcuaggaguggauacuguggaguugcuccaaguuagggagaagccgagagccgaggaaccacagugccuugcgggccauguccagcucgcugggcagugggcaucccucccucccaccuccuccgggcguccauauucagccuuaccuccuguuuguuaccuguauaaccuaccucaucucagccuguccccucuugcucugcgacuuccucaaaguaugacaaggucacugugggcugagggaaacauaaaaguugacuagcuguucagaugggaguaugugacuauguguccauggguucucuuacugguauuauggcuaccaggccacccucgguguugagagagagagccagaaugacucgacccaccccaugcaggucagcugagccgugaaaccacgguucccagacgcgucgcacuaauuaaacccccaacacuaugguaauuaaaugcuccaagugcucccagagcccaggcaguuuggccgggcuccaaguagguaaaaugaagucccugugccucucccaaccccggcugcuucaggcugaggcagcucccgacucgaccccucuccucgaucagccaggacugguccacacgcccuccugacugcucuugucugucucccacaaggggcaucacuuucuucucuaacagaaggaaacagauccgauuagagcucuguauccacaaugugcuuugaaacugucccugcgcuucacgucggcuuuggagccugaagaggugggcguccgucagcuaggcauccucaacccccuugccuuuccugucuccagcagaucaggaauaacucggagaaggggccagccagauuggauguaucugaacagacgguggcuagcgcugaaauuaccaugacuucgcauggcugccaggcucagugucucccuggggcuguagaagugacaagugaggacagcuucaaaggagcaaaaugcaccuuaggcuugacugacccucuuuccugcuggcugcaccugggccugaucaaaggugcuaagauauccagccacacugcccaggcuaacccagucuaggagccuuagucccaagcuuuaggaacaaguccgggcagcuggcuuccucaugugcccucagcugacuguaccaacccuccucuuccaggaagggggauuggccagagccuucugggccugguuuggcuuaaguuuuugcuuucagccuuccugggggguggcagguguggccacuaggcuucauugacuccggacucccagcgcgcagcuucuagcugcugcuggaauucuccuccuuccucuuccuccucugccuggccccacccacuggccgaaaucucacccagaaguguuuauaguugcagcccaggccaaauaaggcaggcaggagacccggaaucccaacggguggcagggagcagcuagggugugggucaggaccccaccccccaguccugcagcuguccugcucagcagcaguuaucugguccccuccuuuguacuucaugcagccaucuggggauggcagagggcaggaucuagcagggcgcuucccuagagcugaagauccggguuuagugugguugauauacuuagguauuuuguggucguugauccuagaauuucauacauguuaggcaaguggucuaucacagaggcacuaggucacaccuccugucaggucuugugugaccuccgcuguccuugaauucccuaggcagcugagggugaccucaccugauucuccgcccaccagcuccuccggccuuggccucccaagugcuuccaggguaagcgugcacugccacaccuggccucuagccauuuuuauuuuuuauuuugagacaacaaggucuugcugaguaucccaggccaggcuggaacuugggauccuccugccucagcauccuguguagcugagaucccaggccugaggcaccaggcccaacuaggugucuaaucugguaaccucuguaugcucugggaggaagauagcuuguggcccucccugcccuucacuucugugauugugguaauguguggcagcauucuucuuaugagaaaggagaugucaaguuuaaacucuuuguuguuuuguuuugaguuuugagacaggguuucucuguguagcccuggcuguccuggaacucacucuguagaccaggcugggcucaagcucagaaaucugcuugccucugccucccgagugcugggauuaaaggcguacgccaccacagcccuccuuagcuaugguuuuuauugcugccacaaaacaccauggccauaaagcaagcuggggaggaaaggguuuauucagcuuucacuggagaagcuccaagcaggacaggaaccuggagcaggaccugaugcagaggccauggagggugcugcuuacuggcuugcuccccauggcuugcucagccugcuuuuuuauagaacccaggaccaccagcccagggauggccucacucacaaugggcugggcccuccuccaucaaucaaugauuuagaaaauccccugcaacuauaucucauggagauauuucuucaacugaggcuccuucugcucugaugacucuugugucaaguugacacaccaaacaagccauuucagagagguauucguaagaugacucugggcccccucauacagagaucauguggacccucagagccuuccuaucucuuuacaaagaucagauauaugggcagguucuugguuauguuuguuuauuuucaauaaaaguucuuauugggcugaagacauggcucaguaguuaagagcacugacugcucuucugaagguccugaguucaaaucccagcaacuacauggugguucacaaccacccauaaugaguucugauauccucuucugguacaucugaaguuagcuacaguguacuuauguauaauaauaaauaaaucuuugggccggagcaagcaagcagggauugagugaauaaaguugacuggagugagcagagguccuuaaaaaaaaaaaagaaaaaagaaaaaucaauagccgggcgugguggugcacgccuuuaaucccagcacucaggaggcagaggcaggagaauuucugaguucaaggccacccuggucuacaaagugaguuccaggacagccaggacuauacagagaaacccugucucaaaaaaaaaaaaaaaaaaaaaaaaucaauucucaacaaccacaugaagacucacaaccaucuauucagcuacagugugcucacauauauaaaauaaauaaauaaaucuuuaaaaaauuuuauuuaucuauuuaauugcauugauauuuugccuggguguaugucuaugugaggauguuagguccccuggaacuggaaggacagaaaguaguaagcugccaugugguugcugggaauugaacucugguccucuggaagagcaaccaguguucuaaccacugagccaccucuucagccccgcgucucucucuuuuguucagaaguaugugucaccucucaggugcuguaucuagugugccugcaggagcuccacagauagggacagugggacucuugagguacagcugagcaaucugagggagauggggcuugucugugguugccaaucagucaggaggaaucuggguaucuugcaggaucaguguugcagggcaugucccagcaucuguggggucccuggugcuauacuccccguggacucauacugguggacacaaagacucuugcugacauuguuacucugguugccaggcuacucgccucuugcagguccaggacacugguccgguggcagugagcugcuuguuuucugaaugcuguccccugcaaaggcuggaggaaaaccagucacgaaggagauaggccgcaggagagacagaggccaggguacugacccagccaagggugagccacagauagcgcauuggcuuguagaagagcaacaggaagcccgccaggcuggguggucccaugggggccuacaguaaagaucuuaaaugguaggcaagaaaucaggcccgcgugcucgcuucggcagcauauauacuaaaaguggaaugauacagagaagauuagcauggccccugcgcaaggauaauacccaaauucgcgaggcauuccauauuuuaaaaaaaaaaaaaaagaaaagaaaaaagaaaucaggcccccacccguccugaagcuguggacaccacugucccuugacugacaaugggaggaaacccugccuggggaugcagccaggguuacaggcaugaagccggggguggaggggacauuucccucuuccucccccacccccauaucccacccugcuguuuagggacauagagauaguugggcuagcuggccaggccucccuaaggcaucuucugggguuggcggccucugugacacucauguggaacagcucuaaacuucccugcuuccgagacccucugcggguguagggaaagguggaugaaagucacuuacuguccuagacacacccaaagcccucccugcccccccccccacacuuuuacucagccucccuguccuccagguuggacacacaguaccaggcccccuaucuuuucuuuucuuuuuuucuuugacaacaguccuuuggugcuuuuuacagaggaggaaaaaggaagggcaaguuuucaguuggguccuccaggccugcucuccauaucucuucugggaucuccuccuagccccuuguucugaacgccugccucucugcugugcccagcguguacuaucuucucaccuccacacuuaagggccccaccaagcccucacccuaugcugcuggcuacagucaucagagcccucucgcauggcuggaaugggguagaugcagucccauucaucccaaagcuacacccugggcuccugggccgcuguggcccaucaccucacguugcgguggucauggcucacgugugguucccuccagucccaggucucuguguggcuucuguggguuugaauugaaagucuuggucuuucugagucucgaaggauccuuugucugccccaauuccuucuuacaagugcacauaaaucacacuagggacagggacucaccucaggccacuuaccacacccacuggugacuaggcagucuguggugcauuguggggacaggggcccaguucacagacccucacacucauagauucuuuuucuuuuucuuuucuucucuuuuauuuugguuuuucgagacaggguuucucuguauagcccuggcuguccuggaacucacuuuguagaccaggcuggccuccaacucagaaaucugccagccucugccucccgagugcugggauuaaaggugugcgccacaacgcccggcacauucacagauucuuaugaucuaucggcugcucagcuccaaugguggucaguucuagccauugauguguccaggauccuggucagauggacccuggagcguagagcuugcuuccucugaccccugucucugaucccuggaaaaccaaguuuucggggacacuugugagacugauaccuaccccaggauugugacagacauuggccugcauguggcauuguccaggccugugugcaaggccauggggugggacagaggcugcccuuccgagaaguagucuucugaggguauugguuacuucugggccccgaacacaccuugcugagccucucccagccuggcagcuauggccucuuuggacagcguacuccucugugggacccagggucucagcggagucucugcuccaccacuggacacggcugcugcauagcugggaccauagaaggacuccaggcucugcucugccuuguagcucuuugccagucuagacaccacuuccuccagggcugagacuguggcugccccagggucccaagcaggcccugcccugcccugcccugcccugcccuagagauggguugcaguccuuugggcuagccuggucucuccuguuggggccucugcucaacucucucugcucaccgaggucuuucuuuuggccuagagagacucuccucccuucucagagggagguagccuagagacuaggagggcaggccauccaaaccuguucccucucuugugcagacaggagugacaaugguggggugggggguuauaugagacccucaaccuuguuucugugcugggccgagaugguagggugaggugagucugcucuucacccaggcuucccucgaagaaaccaugcuguuccugcacuggacgcuugcuugucuccacuugggcuggacggccugcugcguugaugcagacuagugugaaccuucacuguguucucucccuguugacacagcccaucccuccaaaggauccggucaucucaagcacacacuguaucucugcaccuuuccguccgucuguccagcacuggcugugguaggggaagcuccccacagaucugccgugugcuucagacucauuuccagagccauuuacaaaugugucuggcaucugcuuugggaggucgcuguaaggcuucuuugaccagagacauaugggagcagcuggcucaaagagccuccagggagugguggauucucgucuccuacccugacagacccugggccaggcuggggcuucuugaguaggugaggucucccuuacagcccaaucugcaggcccaucuucaugcucaugguggaggagggguggugacaaaccuucugugugguguacucuaaaaguugugugugguccuauuacccuuaccccucccucccugacccgguucccacaacgacgagcaaaccguugcucugcucugggucacucagaguccaggggagccacccgguggacuucauuagcccucagcuauggcuugaggaccccagaguggauguuagcaagggucuucagcuuugugcuguagggugagggucuauaaaggguuaaguaugugcuggccugcaaggggcccuuccugccucuggcugucccuauuguugcuggcucaggaaaggccuguuuccugugaaaucacaggcuuugcccagcagcuccaccagagcagucugaggcucugcccucuuugaggaaugucuuugucccccaugaccccucuccugcaguuagguggcagcuaaccuucaaggacaaagacaaggaaggcugucuccuucaggcugcuugugauaaauaacaucucaccucuguccucugcacugcuaaagucaugguugugacagucacaucaauguguuucaaccaauacgccacaccaccgggaccagggagcaccugggaacccugcaucccgacacagccagguuguguugccucuuaguguuucuuucccucucuucccagaagcaagagcugcacggcugacccaggcgggacucgcucuccuggcucgcucuucuugcucuugaggggugauaaucuuggaggaaugaugacugagaacgagacccuggagugucaaguugugccucugagccuguuuccuuggguagaguguucgucucuggacguagccuuuauuucucuguacaguguugggaccgcucuacacggagggcaggcaggaaggaaaagaggcaggggaaagggcagagcucagggccugugcaucucccaagcugaccuguguugcugaggcaggacagggcguuccccucgccuggucccuggugccucaccuugcauuucaucuaccuuuggcacauacagcuauguaggguucuccuggcccuaccugggauuaggaguagccaggccucaaucucaguagcccaucucacauuuccucguugccaggaagccaggcauggaagucccuaccccuugccaucuugggucucugguuucuggagcccaucacagauuuuggacaccguucauguauuuauuccgguaaaacaucuauccacgaaguuugucaucuuaaucuauuuuugauagugugguggcauuaggcacauccucauaugucacuaauggccaccccaggaccaucucauuuuccugacugaaacuugauaacaguuaaacuuuagccgcgggacuggagagauggcucaguaguuaagagcacugacggcucguccacagauccugaguucaauucccagcaaccacaugguggcuuacaaccauaaugagaucuggggcccucuucuggugugucugaagacaucgacaguguacucauauacguaaaauaaauagauaauucuuaaaaacaauaauaaauuaacuuuagccucucccgcacucaacacacacagaaccucggggucugaauuuuaagcuugccaagcaggcugcaggguaaagcaucuuucccugcuccccagggccugugguggccgcccuucauuggcugugcuugggaggccagaauucaaagucaggagucuucuccaguuguguuccacuuuuuggaguucaucaguuggcuugauugaccagcaggcucuguugcuguuucuacagaaugcuaccuaccacacacagcguuucauaccugcaccaaucacuguacguaaucuaaguguguguauguguaugaacacagguccgugcgugucacagcaugcucguggaagucaaagggcaagcuuggguguuggcccucaucuucuaccuuauuuggcacaggguuucucuguuaaucccugcugcuuuugccaaccaccuggccugaccgcuucuagccagucucuccucucucccucccaucuccugguagaggugcgcugggauuacaacuggcuuuugcacaauucugggaauccaaacucgggucaccaggcuucuguggcaagccaccaagacgcguccuuagccuggcuuuccaucuuuucacguggguucuggugaucucagccgagguccacguguucaugcggcacaugcucuuggcucccgacacgggcuuuugaucacugccccucacgugcuugguucagugcuggccauucccgguaugugaggucgaaccaguguccucagaggcaggaccugucacaucagggauguuagauaggagaaagcucucaggggccuguggaugaagggacugguggguagucagcuggguagacaggugggcaggaucgacaagccaguggaaagcuggguagacaucuaccugaccggaagcagcgagugugagggagggugcagccucugugagacuaggcuggacguggcccugguugggcugagaaauagagcccuggaaagcagagggauuucagaaagcuuugccuccacaaaugcacuuccccccugccucuugggccaaagaagaucgauuuuuuuuuuuaauguaucauuguugaaaacuucagauuugauuuaggagagcugagccuugcaugguagccaauguaugucaggaagaagacagcacccugacuccagagaggcccuugggagccaagagaagugcagucguggucaacacccugcccuccccacuaccaccacccucuccaccccugcugccaggcuccuugaagcagcaggugcccuuggaaguugggcuacaucucauguccacugugauccuggaagaagacugugucaggcaggggcugugaagaggguacaagcugaauucagaagaagucacccaccccaaguggguagugucaccugaagaggugaccugguucagcuuagguuguuuguuuuguuuugcuuuuggcacuggaaauaucauuuauagcucaauuuuaauuuuuuuaaauguacugugcucuuugggucccugccgcuuccuuccaggggagccugguucuguggucggucuugguccccaaguucaggucugcccuggcuguccaggucuguuguugguucucauccugaggaggauguguggaggauacccacucucaggagagacucucagagggacaaugagguaggauugaugcucccggccacagaaaguccgcucuugggguugcuuuguccaggagggaaucgggguuccuaauguacccuagcuccuagcucauggccuuuuaaccuuaccugucuaggacagucaguuucugaaaauagcaauugcccgaggugaggacagcaagauauggcuuguagugagugauacuguguguggccgggcucucacacagcauguagauccucuuuggccuggcuccuuuuguaucccauagcacagguagaagugggugggacugagcgcugcauagggucccagaaccuugucuccuggaaggcccuguguuucugggaagaagcuugcucauuugguuaaguggccagcgugucaccugccuaugcuucagguccuuugaccucccuggcagaauucaccaggacgguguagggcagcagggugucagggaaguucccagagggaagcugugcugugcacuggcacugguagggggcaugcacaggcagagugguguaaagccagguucagaaccgcgccggcccaucagugacucaggaggggguccagagcucggucccagugacuucccacccaguagugggaaaaacuaaccauuucuuaguugagcugccugccgaucaauaagcgaaacuucaaacaggaggaaaagcaagaugaggaggagugggccccagagcccugcgugggugggguuaugcggaguggucagaaccucgugugcauccacguaugaguuaugaguacauggacugcuuugggcagguccuugggguaucaugggaccugggcaucggaugacaggaacauggguauucugucuguggugcacaagccuuauguaugcaugcuuacaggugugagagaggggcacugggggguacugccccccagccccucaggugagggcugccccuauuguugguguacuaaccauuugucucucucuucucuagccucccuguuacgcuucaaugcucucucgcuggucuauuugcuguuucuacugcugcugcccuggcuuccaggccccucaagacacagcauaccagguaagggggcaggaucaggggguggcgauggagcccagcuccuuggggggacucugaccacagcuggguaucuggauagguacucuacagccacacggccucggcucccaguuuuaacagccugagucaguccccuggggucuaaggguuccuucagugcacaccuguagcugguucaguuucuuucuuccugccgguugcuugucacaagaggcucuauuguccuugaaggugacaggggaaggguuguauguggauccccaucggucacuaagugucccucagaaggcagagggaauuggcagguccuaguuguuccgugcagguagaagguuuagggaucugcaccgugguccauucuuucuucuagguaaguuaccuggacugacgauguuguucugccaggggcucuggccagcuugucucuaucacccuguaagccaggcccuaccuuggaccaccuugcuauguaaagaacuggccacagugggccucaucaggaucugagcugggcaggggugcuucucuguuccuugccuuuuaaacaguagaugcuaugcaggccagcguuguguccuuacgugggaguggacagugguaccauagugaaguagggaaaggcugcugcugugccuugagucuccacauaggaugacgugggaagggugggaccacuguguccucaccuuccgggcugcuguggcaguggccugagagaggcaggacauccugaaauccuucauccuagggcucuggucaccaaugcugaaggugccuagcgucuguuuugugguguucgguacguacucagugacccauccccaaguguaccacauuucuaaaguagagaaggcucgcuguugucuucugcguuugugggguucagauccgcauggcagcaaccuggggaacguuagcauugaagugagagauccugccccaggagacacugcaaguaucacagacagugucugagggucagcaaaggucagaacugggucugaugugacggccuggggcccgggaaggcacuuacagccuuggcacugcccucagagugcuggauucagcaugugugggccccagugagaguggacuuccuguaacaagccacccugccgagagccacacccacuggcuuauggggcugcagucagguuaugagugcaguugugccuuuucagagggcuucagggaucagcuuccuggcuccucuucuuuugggggcaucuuugggucauggcaccuucuaccucaaagccgcgauggcagacugaauccucuccgagucccguggcucuguagcauccuggagcacaucacagcugcuaaugcucugugaugacagccacuggagcuucaggacagacuccccuuguugucagcugugacaucagacccaccgcucugccuuggucucuuugccaugugagucacauguguaugggggcagagauugggcagggcugccuuuggguucgccauucugccaaccauagcacggugguugcccagcccgguguucuuuggaacuggaaggucuuagaggauggguagggucuggggaugcagggacagauauuuaaggaguucagccugaacagugugcugguagccacugggccccgagccggccacugggccccucugagacacacagccuaggcacugaaucuuuucuuguguggugagaaggucugacuuccauacucugcucacugcagagcccagguccuccguccccaggaccucuuuggaaacaacuugucucaagacuguuucgugcccugugaacagcuggaaauacuccugaucaaccgugggaggcacagagacucgcagccaggcaggacguauccugagggagacuuggagagcggggcgggacgucuuucccuccucgacccuccaacucucuaucugcccagccucagaggcccuucggggacaugaagcugccugguuuuuccgggugugagaggaaaaugugaggcccgacggugcagaguggagcgcccugugugcguuuaugauuugugcagcugcugcccuggcacugacugcuggaaggucugacucugcugggcccuguuccccacguaggcggcugccugauucucagaggcugggccuaagcugggcugcacaggaaggagaugcuagaccggcuuagggcugggugucccagguaggacaaggcacagggcaggacagaguugggauguaucagaccucagggugugugaaucugcucccaacagccugcuuguacuuuagagcuaggaagcugacucccugcccuagcagaguuuaucuccuaggcugccccucuucuuugacccccccccauucacuacucucccccagggggccugcuccagucuuagccucuccaguccauuagugcccuccugccucucugcgggacuuagcuguuagguacuauaugacugggagagggauaguggggugaugaacaguuaguugauugguaggcaacccuggggcccuaggccugugagcagacuacccugcccuuugagaacaccuuugaacacacccugggaugcugggucacagcuggcuucuugcucucuggguuuacccaugcuuugcuccagaguagacgggagaagccuuccccagcuucuucuccuugccgggugagccucagcucagacucuugggguaauuccccaugcuaucccucuucauccugucaguguguggaaucagaaaaacaaaagacauuccuucccucccuagaacccgaggcagcacacccuggcccagcucacauugcaaggacaguauuugccaacagcucaugagauuuuguugcaggauaccuguuuaggggccucggaguacucaagaguccagccugcgugaggcccagggagggcuguggucgucaggauggggcaugaaggugggaaggagggaauacgggaagcagaggaaagagucagaagcgccucugagccuguggagucccagcagggucaaggccacaggucaggugacaggucugcuauuagaaugcccccaucuccaucccuagcucacuccccauuuuuuucuagggagcacuugcaauagugcagacuuuuaccaguggcuauuuauugcugugcuaaaccccuugcucgucuaaaugguauaggcguauggcauguccuaguguggcaugacaguuccuucuuugaaguugugauccuuuuaucaagccaaugggucagagcccagacagugguaggagagaaagguggccagggacaaagguggcugccauuccagggccuugggguaagccuggcuaagcccaaugcacucucuuccccaugacagaggaguggcugaagcagucaggccgguagaggagguagaggaggcccugccugggaaagagccaggugugguguaguaggaaacccagggcuuugaagauuuggggcccauggaggcacuggggucugugcagggcugagggugaagccugggugcuaacagcgagucuggggaguggcugggccugggagcucaucugucucauggaaccuagaccuacucucaggucagaugggaaggguuucugcuaccuccaagcuuguggcaaggaucaagcaaggauugacucuuaggugcaaguggagauucccgaaacucagcaggaagcccugcccagcugggugaugguggugguggugaagaugguggaggugguggugaugguggucaugguugugaugguaaaggugguggugguggugugaugguggugaugguggugguggugguggagguggugauaguagugaugguggaggugguggugaugguggaggugguggugguggagguggugguggugguggugguggugguggugguggugguggugguggugugcucuuuccagaguuguccaccuugccauccugaggagucaggguuauuuuagaggucaggguuuacucuguagagccugucaucacugagccagcucuuucucuccuggugcucccugcugugcuaggcuccaaauguaguuagacuaugacguccucacagcucuucagugccccagagaccugcugcccucugacuuccaccgggccuucucacaggcuguuccaccacagagauggucuaccacccuccaccacaugccuuccgcucucacucagaucuguccugacgugcccucuuuguggcuauaguuguggcucucaguggugacuguuuccaaggaggaccgccgcguccuauagaacaggucuccaccgugcacuuuucauugacagucagcauugagcuccuaucucugcuugugcaccugccucucaauaucacugcagcaaggguccucugacucugaugucaggguugcucuuggugcuaaucucguccuaugcuugucucuccuucguucucugauacccugccagagguugggcacuagagaguacguggaccacagcuggaguaucaucuuguccucuggugcucaaggcuuagcucagggaaccagugagacaggguaccuagcuagaugcacagugugacugacugcuagaaccuucuggcaugggaccucuggggaggauaauaaaaaggagugggugucaccaaggaagcuagcccuugggggccaaggucaguucugaggcuauuccacacauuuggacugugcccaggaaacuacauaggacagacauacuggcagugguagcccccagaagagaggaucagugugauccuuuggggcuguccuuguggaagagaccuguggcucugagguuuucaaugaugguggccucagcagccuuguggcuugaauugacaguucugcuacaguggguugauugcccacaggcaaagagcuaaaggcuaacuccagucucuguauaggucucagagggcagaugcaaggaccagagcccugugucaccucugucugucugcagccaagggcuucccugcugggugggcuagcuggggcaguuggaggcugagcauggccaugggacauguacagcauggcccugugugaccugggucccauaguuugauggcuaacuccuggccggugucuuucccaugagugaucaguggaacaagaucuuugggggcugcuacucaguggggccugagguuggggaucuauccuguuugcuguccugggacucacucuguagaacaggcuggccucaaacuuagaaauccaucugccucugccucugccucugccucugccucugccuuccaagugcugggauuaaaggcaugcuccaccauugccuagcggcuucuuucccguaacacucuaaauggaggcagccagccggcaauucacuuuuuuggaggcauuuggccccaucgcccaggccccuucucugggauaccacccuccucgugacuucauuuccagccuccacgcaggggcaggugagcaucacuguagucaauaaugguuucuuguuuuucuguuugcuucuucuuguucccaagaccuagcagugauaucccucuaugcuaacuaaguuagaaaauucaauugugucucgucuguucagggcuuggacaguguuggucuuuggggagcagggagcaaggccaauguaguaucugggccagaguugcuuccuaaacuucccuaaacagugucuggcagucccuuccccauucugggcugacauucuuauuuagaaaccagagucacaacagggucugccaacuaggcaccaauaggugccaccgggagggaaccagcaaccccucgugggucauuucuguugccuccuggaaggcacugaguccugauuccucacagccaguccccuugcccagagccucuguccacacugaguguguaucucaggcacauggauagggcacggucuaccuggaggcugucaggguaagcaguaucccacugaucccugcucugcccuuucugucacaggucacacaggucgccugcuccgugcacuacucugccucagccuccucuuccugguggcccaccuugccuuucagauaugccuacacaccgugccucaccuggaccaguuucugggacaaaacgguaagugauggaggagcaagugugugggggggaauaugaggacagcaguccuggguagaggggaugaggaugccaaccaggaaccucaggccuccagccucuuacccaggcuuaauccaauauggacugugccaggucagcagagccaggccauuccuagaauagccuccucuucuuccuucuguauaugaguacagaugguuguugggaauugauuuuuuuuuggggggggggguggguuuuuuuguuuguuuguuuugguuuuuuuguuuugguuuuuucgagacaggguuucucuguguagcccuggcuguccuagaacucacucuguagaccaggcuggccucgaacucagaaauccgucugccucugccucccuagugcugggauuaaaggcgugcgccaccaccgccuggcugggaauugaauuuuuaagaccucugcucacucuagucaacccugcucauuuagucucugcuugcuuuauauuuauauuuauacauaaguaucauuguagcuguuuucagacgcaccagaagaaggcaucagaucucauuacgggugauugugagccaccaugugguugcugggauuugaacucaggacuuuuggaagagcagucaguguucuuacccgcugacaucucuccagcccggccucugggcuucuggugcccaccugucaacaucuuccuccugugccugcuuguagcuuagucugugugacaccaggguuccucagggucccuguccauccuuagcauccuugcccuuguaccugugcacgggguauccaguggguaccugccuucuagucaggcaggaacugaugccagcuuuauguguagaaggccugggcuucaagucucuaccacucuggagcuccguucaguuuccuaggccauuuccagccccgccugccugagaguuccugcuguccugccaaucacagccaacggaccaaccaggcagcaugcaucuaccuggcugccuucggcuccccugucuguaaagacaucuuccauuuuccagccaggcauggcacuugggagguagaagcaggaagaucacugugaguuugaggcuagccuggucuacauagcaacuuccagucaggauuauuauagagagacacugucaaaaaaaaaaaaaaaaaaaaagcaccagauucagcaucagcauuccugaaucacggaugcucuguccuacaugagguccuaacagucaugcccacaggguccccgggccucacaggaauaaccacugggcacccugccuggccugggagcuccuuccucaagcccuuuccuuauagguagccuuugggugaaggugucucaacacauagggguuacgagguaagaucugcguucccuccacccccucugugagccgaauccuaaggauggcgucacaucuccucaccuugcccacucugccucccugcccuucacaggcuggaccugaaggacaucuuuaacaccaccaggcugguagcaccugaccugggagugcugcuggcguccucccuuugccuuggccucuguggacgccucacgaggaaagcccggcagagucggcgcacccaggagcugguaaggcaccgcagcagcagagaugggcgugaggguguuagugcuucagucccacucugacaguuuuagacguguuguguuuuguuuuguuuguuuguuuguuuguuuguuugguuugguuugguuugguuugguuugguuugguuugguuugguuugauuugauuugauuugauuugauuugauuugauuugauuugauuugcuugagacaggguuucucugcguaacagagcccuagcuguccuagaguucaauacguagaccaggguagcuucaaacucacagagcuccaucuguuucugcccggagugcugggauuaaagaugugggcccaccaccacugccaggugacagguuuuuguuuuuguuuuuuaguuuuuuugguuuuuuuguuuuuucaagacaggguuucucuguguagcccuggcuguccuggaacucacucuguagaccaggcuagccucgaacucagaaauccaccugccucugccucccaagugcugggauuaaaggcgugcgccacuacugcccggcucccagugacaguuuugauuuuuguuuuguuuuguuuuguuuuuugcuuuuuguuuuguuuuauuuuguuuuguuuucgagacaggguuucucuguguagccuuggcuguccuggaacucacucuguagaccaggcuggccuugaacucagaaaucugccugccucugccucccuaggauuaaaggcgugcgccacuacugcccggcucccagugacaguuuugauuuuaacauaugcagacuuuuaaaguuaaguuugaaagauauuuacauguagaaugcgaagaaggaugugggagaggaacccgaguucugcuacauucuccugcucucuugucucaugcguggcucuguccacuggaagccugcucugcaggacacaguuguuguuguuguuguuguuguuguuguuguuguuguuguucuucuucuucuucuucuucuucucuucuccuccuccucuuccucuuccucuuccuccucuuucuucuccuucucauccuucuccauuuucuuuuuuuaagguugauauauuuuauguauaugaguauacuuuaacugucuucagacacaccagaagagggcaucagaacccauuacagaugguugugagccaccaugugguugcugggauuugaacucaggaccuuuggaagagcagucagugcucuuuuuuuuuuuuuuuuaagauuuauuuauuauuauacauaaguacacuguagcugacuucagacacaccaggagaggguaucagaucuuauuacgggugguugugaggcaccaugugguugcugggauuugaacucaggaccuucggaagaaaagucagugcucuuacacgcugagccaucuugccagcucugcagucagugcucuuacccccugagcuauuucacuagcaccccccauuuaauauuauuuauuuauuauuauuuagaugaauacacuguagcugucuucagacacacaccagaagagagcaucagaucccauuacagaugguugugugccaccaugugguugcugggaauugaacucaggaccucuggaaaaguagccagugcucuuagccucugagccaccucucuagggcccuaguucuuaaacaccagaaacuccaguggaucugugcaacgggaacugucacuugugggcaucagccaagcugaaguauaccaagcuggguuaggaggggccagggucaccuccgugcaugaccugaggccaucucaaacuuauuucucgggugagcuagguccugccacugcccccaggggccacaacuggacacugagcacccuugagcccugugugaggucugugauccagcuuccucacgccauggcaggcuuagccuguucccccaccccccaagcugagguaggauuuauggccacccaggugucuuggugcaggcacacccugcucucagacagcaggucccagaacccauucaucaacaccugacacuugcugggcucuagaggaaaccagagagggguagggacucccgaagccuugggaggugggggcugaguggagcaguaaagaucggguagcuggggguggggggacaucugucccugucaacagcaaucccuuucuuccuuugccuggaauugcucauuugucucaaugccucucaagaaguucucggggccuaggccaggucaucuuaccgucuaccccaggggcguguccucucauagcaggauagcuaugccuucuucccucugauccuccccacccaugcccuuacuucugccuucuaugggcuguagaaggggugagcucagcgaccagccacucugccuccuggccuggccuccaaccuucaugcuucucguccgugauccccaggaucuugauagccgccucagccggauggcccgugagggcaggaccugcaggcucuucuuuuaugcccaggcuccacgccuugcuuugcagaugggacacagacugagagguuaagccacuucccuaaggcuaugcaauauggagacuauugguguugggagguacccauaccaucuagcucuagagucaaggcacucagccuaagugccugguauccccucaacuguucccacaggcacagcuggggacaugggcugccagcagcuggcuugagcuagugcugcugacgacagccuguguccuuuucugccauacucuggccuucucugagaccucggguccaacucuguucugggaaaccagcuaucagugccagagaaaacaaguucugucgggucuccgucucuugccccaggcagggacugucccguuucuucccagguagcuaaucacuucugccauucugaggggucaaagagggcuagcagcaauccuaaacacaggcaucuccucugggauacagaaaggccgggaaaugcccaguuggagggcuggaggugcugaggcugcuguguuccccagagucaacccucucucccuagaagcccuacaagguacagauguagccucgcucucccugaccuguggaauuggggcagucaucugucaccucuggaucaaggauuaugggucuguaaaugccugaaaaacuguaauguagggcacaugguauguguguauacacucuuuuccagacuggaaagauggcucagccguuuuaagagcacugauugcucuuccagagguccugaguucaauucccagcaaucacaugguggcucacaaccaucuguaaugagaucuaaugcccucuucuguaucugaagacagugacaguggacucacauacauaacauaaauaaauaaaucuuuuuaaaaacccaaaaaauucuuucccucuaucccaaaaaggccucuccccgggaaccuaacaaaacugacacaggaucuucagggacagauuugggaccuggguggcuaucuugucuuuuagggcauccuguccaagauggugcaaaaugauauauuccagaauagcuggggcauccuaugccuggccuggcagaguuuuguguuuuagaguagcauggggcugugggguugcccacucagugagaagggagagaaaggcugguuucaggcugugggcaacaucagagaggcagcugugggacaggccucaucucuuacuucagcuaagcagaugaggcuggaguggccucgguggugaugacccugacgucacuuccccaugacuucagcaggaugaugacgaugacgaugaugacgacgaugaagacauagaugcugccccagccguggggcugaagggagccccugcccuggcaaccaaacgcaggcuguggcuggccucccgcuuccgggucacggcccacuggcugcugaugaccucuggacggacgcuggucauuguguugcuggcccuggcagguaccccggggcaggggcuggagucuugacucugacuggcauggcaguggcggcgguggcgguggcggcggggugacucagcuucccgaugggucaggccaggagugacgcagagugccugugcccaccccauccccuguaggcauagcccacccuucggccuucuccagcgucuaccuggugguguuccuggccaucugcaccuggugguccugucacuuuccucucagcccccugggcuuuaacacccucugugucauggugagcuguuuuggugccggccaucucauuugccuauacugcuaucagacaccauuuauccaggacauguuacccccugggaacaucugggccagguaaggcuuccacacagccccacccaccucagccauagcucugcugcucgcagaccuggcagucaguggccuggcccucucugaacaggcuauuuggucucaagaacuucguagaccucccuaacuacuccagccccaacgcccugguacucaacacuaagcacgccuggcccaucuaugugagucccggaauccugcugcugcuauauuacacagccaccucucuccugaagcuccacaagagcugucccucagagcuggugagucccugcugucaacucuguuggcgucuggcacgcgggugagguggauauucuagggacugcacucacgguuguggucucuucagaggaaggagacacccagggaggaugaggagcaugagcuggaacuggaccaccuggagccagagccccaggcuagggacgccacccaggugagcaggcggucagggaauuauuggaaagugauggggagccaucggcagcgacuaucugacccacacauccucugcagggugagaugcccaugaccacggaaccugaccuugacaacugcaccgugcauguacuaaccagccagagcccuguccgccagcguccaggugaguuacaggcucuguggccaugggaugcccuccugggaacguuauuagcaggggcccauucgcucugaucacucugugggcaagucuagacugcccccugguggccauaggucuuauacgcaccccuugccuuaugcuugaaccuccuagggccaguucuauggcugaccccccuagacccuuuggguggcccuccaggucuccuauuuucuguucucagaugggaauugucuacccaugguucaaggccccgggagccccgggagccucugucauucugagagcgcuggccuggggguuucacuggucugcauuacuguggagacugcuagaucuuuuucuagguccuuauuucuuuuccuugaacuuaaaagaaaaaucuuuaauuacauuuauugauugauugugugcaggggugucaagcuauuguauguguguggaagucagaggacaacuuacagcuauugguucuuucuuucuaucauggggcuugaacucugcuccucaggccuggugccaggcaccuuagccugcugaggcaucucgcagaccuccacuuuugcaacuugucauuguguguaaagugugagagucaccgaucugaaagggccaucuccuacaagagacucuucaaaaggugaggccaguaggguuuggccaugacauuccagaaggcucggacucuucugauggcuuuggccagcauccucuguggcugccuggugggccuggcccccucacaccuguaaggcccugacacuacagacaaccuacuccaugcucuagggccauauugagaauggggaaggaccccaugguuccuaucuggucgcuaaucucagucccaccccuaguucgccccaggcuggcugagcugaaagagaugucaccgcuacauggccugggccaccucaucauggaccagagcuaugugugugcccugauugccaugaugguaaggaacagccccucccccaagcccccccccucccagggaggagcagucccuccccuccuccccacucccuggccacugcagucuucucauagaaugcagggaggugggguguaguucaucucaaaaccugagguccaguuaccaguaacagugcuggaacugcccauguaagucaccaacaucccguaacugugcaguggguguguguacauguugugugugggcuaccucaugggaggccuuacuguugggggcugaagcucuggccgagugucccaugcagucccugcugaccgacccuggcugugccugcagguguggagcaucauguaccacagcuggcugaccuucguccugcugcucugggccugccucaucuggacggugcguagccgccaccagcuggcuaugcucugcucgcccugcauccugcuguaugggcugacgcucugcugccugagguacgugugggccauggaacuuccugagcugcccaccacccugggcccugucagccugcaccaguugggacuggaacacacacgcuacccuugccuggaccucggugccauggugaguaucacuggccguaucuggguagcgguaggauuucucccugggaacccagugcucugcucguuggccauugguuugguuggguagagauugaaggagaguguaucugaagucaacaguggguuccugcgaguccacccuagaauauaggcguugugaccgaguauguggcaugcugccgcaauguccuugaugcugugagugucuguguguauucugacugcccgacagggcuccacuguguggcacugaaugucugugacucaaaucugguccauuugacucuugggucacccaaguaucucugcaugaggcaggugugguguugccugcccacuguaaccugguggauuuuaauacaucucaagugagacuauauguguacuaguguaucuaucuguaugcaucuguaugcaugugaguguaaacuuguguuuaccaagucugggcaaaguauguaagaucgggggccuggggcuggugagauggcucaguggguaagagcauccgacugcucuuccaaagguccugaguucaaaucccagcaaccacaugguagcucacaacuacccauaaugagaucugaugcccucuucuggugugucugaagacagcuacaguguacuuacauauaguaaauaaauaaauaucuuaaaauuaaaaaaaaaagaauuuaaaaaaaaaaagauugggggccugugucucugaggcuuucacguacguccgugaaucugugaccauguaaaccuacacacgcaugugagguugaagcugaggucauggaagaggcugaggacucuccucggcccuggcucaugggcugggcccugagugacaccccugcuccccacagcuccucuaucugcucacauucuggcuccuucugcgucaguucgugaaggagaagcugcugaagaagcaaaaggugccugcggcgcuuuuggaggucacgguggccgacacuggugaguggcaugcgggaggguggaaccuccaccugcacuguccccucucugucuaggcugucacuucaccuucugucccacucugcagagcccacacagacccagacgcugcugcggagccugggggagcuggucaccggcaucuacgucaaauacuggaucuaugugugcgccggcauguucauuguggucagcuucgccggccgccugguggucuacaaaaucgucuacauguuccucuuccugcugugccucaccuuguuccaggugaccuagggaaugggcagguagggcucguggguggggcucugucccucaccugcccugcucaccagccaccccacccccauccuucugcaggucuacuacacccuguggaggaagcugcugcgugucuucugguggcucgugguggccuauacaaugcucgugcucaucgcuguguacaccuuccaguuccaggacuuccccaccuauuggcgcaaccucacgggcuucacggacgagcagugaguaggguaccuuaggggcaguaccgcugagcgcucuucagggggcgguagaggcaccuuccucgucccgucccaugcucagacucuccgaucugguucaggagggcuacuggggcagggcagaguaaagggcugauggugcucgcucucuucugccagguugggcgaccugggccuggagcaguucagugugucggagcucuuuuccaguauccucaucccuggcuucuuccugcuggccugcauccugcagcugcacuacuuccacagaccguucaugcagcucacugaccuggagcacgugccgccaccaggcacccgccacccucgaugggcucacagguguucugccuucgagggccacggguguuuuuuggucugugggaacugggguugacgcugggggcugugucauagaguuagccgaccguccugcgcuugggcgggagccgugaggcagccuuaagccauguagacuuggccuagaguuuacagguggacugguggagauggggugggggggcugucucagggaagggagagccagggacaagggcaggaagugacacuugggcuuucccaggcaggaugcagugagcgaggccccucugcuugagcaucaggaggaagaggaagucuucagggaagaugggcagagcauggaugggccccaccaggccacacaggucccugagggugaggcuggaaggagugggcagaacacagccccacaaggcacacagggggcuaagaggcgaaucugugcccaguucugccaccuccuggaugucgguuugaggaaggcagacaggagcuccaacccuuccuguuucuucuggaacucaguccccuccucaccaaggucuacccccuccauccugagcucugcccccuccauccugagccccgcccccuccauccugagcucugcccccuccauccugagcucugcccccuccauccugagcucugcccacuccauccugagcuccgcccccuccauccugagcucugccccucuccauccugagcuccggccccuccauacugagcuccggccccuccacccugaacuccaccccuccauccugagcuccacccccuuuuacuguguccuccccccuuuuacuccccccuccuucuaaaccccacuaaguuucccuuuccuuccuaagccucaccccuuaucacuucugucuaucucuucgccaaggccuauccccccucacugaaccccaccuccacagguacggccagcaaguggggccugguggcugaccggcugcuggaccuagcggccagcuucucggcuguccucacccgaauccagguguucguucggcgcuugcuagaacuucacgucuucaagcugguggcccucuacacugucuggguggcccugaaagaagugagugucccaaccugggcuguuuccuccucugaagcagggucucuccugcccuggcuuuguuggcugcucuagagccaggccugcucgguuacggcagucguccuggagucuagucccgaugcugccuggucugcccacugccaucugugcuccacaggugucugugaugaaccugcugcugguggugcuaugggccuucgccuugcccuauccgcgcuuccggcccauggcuuccugccuguccaccguguggaccuguaucaucauuguaugcaagaugcucuaucagcucaagauugucaacccgcaugaguacuccagcaacugcacugagguacaggccuggaggcgucccuagggcccggggaccaccugagaaguugucccagugauuccucauggaauguggacggggacagugacuccugcaguaagaauagaggggcccucaggacagcugugccuagauucaccuggcuucauucuuucuauuugggccuugaccuguccccuuccccaucaagguggcccugugaaccuccgguaggacagcuguugucuacccuggacccaaccugcugcuucagcugugagaugggcuuaagauagcaccuacaggggcuagagagauggcucaaugguuaagagcagugacugcucuuccagagguccugaguucaauucccagcacccacaugguggcucacaacuaucuguaaugggauccaaugcccucuuuuggagugucugaagauagugacagcguacucauaugcauaaaauaaguaaaucuuuaaaaaaaaaaaaagauagcaucuacaauccccacuccauccaggucugggaccugggggcucaugcucaccccucuuugcagcccuuccccaacaauaccaacuugcagccuuuggagaucaaccagucuuugcuguaccguggcccuguugacccugccaacugguuuggggugcggaaggguuaccccaacuugggcuauauccaggugaguggggacugacagccaggguagauggucuuugacggccccagaugguccccacugaccucugacccccacugaccccugacccccacugaccccugaccccaccuucacagaaccaccugcagauccuucuguugcugguguuugaggccgugguguaccggcgccaagagcacuaccgccggcagcaccagcaggccccucugcccgcccaggcugugugcgcagauggcacccgccagagguuggaccaggaccuacuuagcugccucaaguauuucaucaacuucuucuucuacaaauucgggcuggaggugaggcugggcauccuuuuggcaggaaugauagcaggagaucccccugagcaucucuagugaugccugaguucuguaggcacagccuagcccagggcuagcacagaggcuugccacaagcccaggaaggccaaggagauuggacugagucucccuggcagggcuagaccaaggcugcacugucugaagcuaaagucuuccccaggcguggggcuacucaucccggggccuuggcuuccucuaaguaugaugagaugugucuagccucugcuguccuaggacgguggucugagagacugcuccccucguccccaguaaagaugagucacucuagaccucagggcaggcagggcugcucugagucuguggacuuggaguagcucccuucuuacuauuauauccaccccuugauuccccuccagaucugcuucuugauggccgugaaugugauugggcagcguaugaacuucauggugaucuuacacgguugcugguugguggccauccuuacacgccggcgccgugaggccaucgcccgccucuggccuaacuacugucuguuccucacgcuguuccugcuguaccaguaccugcuguguuugggcaugcccccugcacugugcauugguaagccacaggcugaggggcuugguauguguggucacguggaaacuccugggccguuuccuguucaccuuccugacuuacacagcuccacaccuacauuccugccaagggaacccguuagauccucuguagccuguacauucucucuggaccauuugagccauagcugugcuauuucacaagguuggcuuccugagggcagaauggcgcuauguccguagagcuguggaugccuucagggcugcagccucuccugacagccuauagcagcaguguccuugucgggcguguugucuguaguaaaacagcaccagcucuucuuuguagcuguccucagcuuggccguucuccuguguccucuucucucuuucaucuagcuucuccuagccuaggacauuucuggauagccagguugguggcuuugccacaugccucaaaguuuggaugugccugguuaagcgugaagaacuuuaugggcacagagcucauggugguccacgugguggugccacggaccugguguagcccaugacugcccauuugaccuguucaagcaaccuugccugcccacauuggggugcuacagacacgggguuaacacaggguggcuguccacugcuccaguggcagcuuuucuuucuguucucaugcgucuucggucuuccacuagcuucuuggugggggagggggagcuugcauauuucagcuauguauuuaaaguucuuuuuuuuuuaaucauccuaagggugagguggagcccaugguuuacacguuaggcaagugcucaguuccugagcuacaccccaguccccuucucuuuguuuuaaacagagcagaaaguguuccagguccccagauugucccagucugugacguucaguagacaccccuggcucagccaccucucucucccugcuggugauugcugggguccuugcugaauaaacagccucuccuuccugugagguugccugggauaucccuccauaacuggguuguguaccugggacaguuccacacauucauuucacacauguucuuagagggcccugguucuugacaagcaugcccgacccugcacgucccuccgugcagaucuuugaagucagcccugcgccucgcccccuccgcucggacaucaguccauaguccguccaguucaguaacaucacagagugggaugauacagugggccucuguugcuuuagcuucuuucucuuagcgggugcaggagaaacccuucaacugugcuuucaguacuaagugauggcagggcccuccaggucguccuguucacuuaggagccucgcaggugugguugccgaggcaaccacauccaggcuguauaguaguugaaggguaucugaguuaguucucauuuuauguuuuacuuauuuauuuuuaagauuuauuuauuuuauguauaugagcacacuguagcuguacagaugguugugagcuuucaugugguuguugggaacugaauuuaggaccucugcuugcucuggucaacaccgcucacuugaucccugcucgcuccggcccagagauuuauuuacuauuauaaauaaguacacuuuagcugucuucagaugcaccagaagaggacgucagaucucauugcgggugguugugagacgccguguggcugcugagauuugaacucagggccuucggaagagcagucagugcucuuaccugcugagccaucucgccagcucucguuuuguguuuuauuauuuuauguuucaugcuguuaaauuguaugaaccauaauucaucccaaacacucccuccuugggagguaccugcccugucucaggugaggcucauccguggguuccaaccuuaucuccccauccccccaucccuccaagccugguguaguucuacuuagagaucauggccuguagggaucucugaaucugugggucagugucccugagacggagagagugaugugagaacagguucugaccacacaggaacaugugacacuguccccagccuccagggcuccuggcagcagaggggauaaggacagcauuugcccuuucugaugugcccccuguccacagacuauccauggcgcuggagcaaggccauccccaugaauuccgcccucaucaaguggcuguaccuaccugacuucuucagagcccccaacuccaccaaccuuaucaguaagugcaaccguauccuuaccccagggcaccugccgcaggacagcguaaggacucaggggcggggccgggaggguugcuuguuggauacacagggaccuuuguuuagaacuggaaccagcaagaggacagguuguccagguguugacagucgaguggcacuucaucccaaaaaagagccaugccacccugcaaccucacccagaugagucugacccucauucacacaaaaacgugucccagaguguguacgcacacagugauauggaccuguguguucaugggugugcaaggcaaugaucucacgggugcagggagagccauagcagcccacauucucugacacaugugcguguguauggcacacauacagaccgggguguccucaguaggaugccuuccuguuuccagcuuuuuuuuuuuuuagauguauguauguauguauuuauuuauuauauguguguacacuguagcugucuucagacacuccagaagagggcaucagauuuuuguuacggaugguugugagccaccaugugguugcugggauuugaacucaggaccuuuggaagagcagucggcggcacucuuaaccgcugagccauuucaccagcccguuuccagcuuuuauguagacacuuuuuuuuuuuuuuuuuuuuuuuuuuuugugaaaugggaggaggcccucggucccaggcaguacaguccuccuccccuuccuccucccuaucccccuuccucucccacuccuccugcaagcuucaugccccugcgacaccucuccuguccugcaggugacuuccuccugcugcuuugcgccucccagcaguggcaggucuucucagcggagcgaacggaggaguggcaacgcauggcgggcaucaacacugaccaccuggagccccugcguggggagcccaacccuauacccaacuucauccacugcagguagguccuacccaugaccacucugaagcacucgcuaaagggcugucugggguaacccaguaaccucagugacgucucccccacaccucccccccuccagguccuaucuggauaugcugaagguggccgucuuccgcuaccuguucuggcuggugcucguugugguguuuguugcgggggccacccgcauaagcaucuucgggcugggguaccugcuagccugcuucuaccugcugcuguuuggcacuacccugcugcagaaggacacgcgagcccagcucgugcugugggacugccucauccucuauaaugucacugucaucaucucuaagaauaugcugucggugagcagaccacucacacggccccgccccugcccacauggccccgccccugcccgccccaagggcccugaguuaaccugcccccacuaccgcccccagcuccuguccugugucuucguggagcaaaugcagagcaacuucugcugggucauccagcucuucagccucgugugcacagucaaaggcuacuaugaucgugagugggcaagggaugugcgugggggcggacacaaggagacccacugcuucuggugccgaccccuagcccugcuggucucugccccacagccaaagagaugaugaccagggaccgggacugccugcugccuguggaggaggccgggaucaucugggacaguaucugcuucuucuuccugcucuugcaacggcgcaucuuucucagccacuacuuccugcaugucagcgcugaccugaaagccacagcccugcaggcauccagguccgcacagcugcuucucccagggguggagaagacaccccuccccccauccucagcagggguuucuucuacaauagcagcuccacuugauccugucaccugaagggagaccaaagaacccccagugccuugguaucauuagggcggcccuugcugcccacggcuggacacuaaaaggcaguguggcccccaguggccugagugucccccagcuggagggcugugacaugauauuaugcuuccagcagaggucucugccccuggagcuaaacuuagggucagcugccucaccuaccuaccucagaguugccacccuauguccuuuucugugaugguuuucugccccagagaaagaggugacaguuccucucucauggcugcagguggcaggugucuuccagcacauggcucaguguaaggaggaccaggcaggcuccccaggcacuggggaugagcccagcucaucccugagguagagaaagcgcaugcgucugagauaagugcuaaggucuugcucuuccugcaggggcuuugcccucuacaaugcagccaaccugaagagcaucaacuuccaucgccagauugaggagaagucccuggcccagcugaaaagacaguagguguuaucugggcuagggacccuuugacccuucuggccagccuggcacucagagcuccucccuacuugcaggaugaagcgcauccgugccaaacaggagaaguacaggcagagccaggcaagucguggccaacuccaguccaaagacccucaggaucccagccaggagccagguaagcguggauagaacuaaucaccucagaggaugccccugacauacacaugcacacgcgcgcacacacacacucugcauccaggcaugugugcugcugaagucucccuguaccuguacaaguggugugucacaggguccuacucccuuguccugugcuacauguaagugaugugccacagaacccugucccaagccccgugccaugugguguguuccccuuugucccugcaggccauauggccaccugggacugucuaccugcacuuguggccccucuccauccuccagggcucugagacauguggcaccacauggaaccuugccacugggggaguccugugucuguuucugucccugucacuugcccuuguacccaagacaggcugcccucacagccuccccugcuuguucacgcuugccuugccccuccacagggccugacagcccagggggcuccuccccgccacggagacagugguggcgccccuggcuggaccacgccacagguacccugccuugaccccucugugcuccugcuguuaacccuccugccuacuagcuccucuuuguccugucugguugugugcauggaccuaaccugugcaugguucucuguucugugcauggaccgccuuccccauccugcugaaaccugcaugggaugguccuagugggaaggguggcacucaaguaggagcaugugggaggaagaugcugagagggaacaucagucauucuuaacaaugggcuugcuaccacccaacucaaaacugaacacaggaauuccagaacuucucaggguccugccauggagauaggcucucacacacacauacucuuuccuacccuugcugacuauagucauccacucuggcgacuacuuccuguuugagucagauagcgaggaggaagaggaggcccuaccugaggaccccaggccugcagcucagagugccuuccaggugagguggagccaugccuuccugcucugucuguagaguuucugaucagggcagugugcaggaacagauaucugagggcuguggaauccaguuccuacauauuaggaggucccccuagcccuucagaccugcccaggcagcuagggauacgggcugugaugugaaggucacaggucaccaauugcuccuuuguucacacacccacccuccuuacccaaugagcucuaugacugccaccugcucuaagagaaaggccaugugugccuacugaaaaauggugucaugggaucaggagaagcccuuguccaucuuugaggcccuggcacuggucaagcugggcagcugcacgucugucucuggagaccauuuccagagagagcuuggggcacugaagacccgcagcuggagagagagcagguggcuggccauagcugguauauggcuggcucggcgucauauuccuugggaggggaccaugaugccagagugaauggguaucucagcuagagaugccaggcuccuaacuaacaaaucuggcuggcagauggcauaccaggcauggguaaccaaugcccagacagugcugaggcagcgucgggagcgggcacggcaggagcgggcagagcagcuggcuucuggugaguuguauuugggggcuucagcaggagagcuguagggcuaccugauacugacugugucugugaccaggaggugacuugaacccagauguggaaccaguagaugucccagaagaugagauggcagguaugugcgcuugcugggaagggggcagagggcugagggcucuuauggcuagccgacccuccagcaccguccugcccucucuauaggccguagccacaugaugcagcgugugcuaagcaccaugcaguuccugugggugcugggccaggccacgguagacgggcugacgcgcuggcugcgugcauucacgaagcaccaccgcaccaugagcgaugugcugugcgcagagcgcuaccugcucacccaggagcuucuucgggugagcaccccucgagccaagccccuccuauacuucaucaaggccacauccccacugcugccugcugagcccauguggagcagagccaguccaaucccaggggcugagggcuucuccauccucccugcagguuggagagguacgccgaggugugcuggaccagcuuuaugugggugaagaugaggccacauugucaggucccauggagacccgggauggacccagcacagccucaaggucgguguggggcccaagggggcucgggugagucgggggcccccauuucuguguguccucuggaggagccauugggguacaguacugaucucaguugccccuugucuucccggcaccaguccuccacccuucccucuguaaccuuuucucucacagugggcugggagccgaagagccuuugaguagcaugacagacgacaccagcagcccccugagcacaggcuauaacacccgcaguggcagugaggagauugucaccgacgcuggggaccuccaggcugggaccucccugcacggcucccaagagcuuuuagccaaugcucguacccggaugcgcacggccagcgagcugcuacuggauaggugagaugggacuaggcugugugcagguuuucaagggaauucuccugagcaggaagcccagggacagaagcuggguaagggaggcaggaacuggcuaggcccaggccugggaucagagucugucuauugccaugguugugggcaaggcucugcaccccaggggugcucuuggcucuugcccccaaauuccugugguccugcggcaggcgccugcauaucccugagcuggaggaggccgagcgguuugaggcacagcagggccggacucugcggcugcucagggcuggguaccagugcguggcggcacacucggagcugcucuguuacuucaucaucauccuuaaccacauggugacagccucggcugccucccuggugcugcccgugcuuguguuccugugggccaugcugaccaucccgaggccuagcaagcgcuuuuggaugacagcuaucgucuucacugagguggguagcagcuuguaggguaggggcugggccacauggcccauggcugagugcccuguccugcaggucaugguggucaccaaauaccuguuccaguucggcuucuuccccuggaacagcuacguugugcugcggcgcuaugagaacaagcccuacuucccuccgcgaauccugggccuugagaaaacggacagcuacaucaaguaugaccuggugcagcucauggcccucuucuuccaccgcucgcagcuacuggugagccugccagccagugcagggguggcagggcuggcuuggcaacuccgggcauuccugagcccaaucgccugccucuggucuaagcaugaccugaccugggucaggcuccucaccaacccguauccuccauaguguuauggccucugggaccaugaggaggaucgcuaucccaaggaccauugcaggaguagugugaaggaccgggaggccaaggaagagccagaagcuaagcuggaaucgcagucugagacaggcacugggcaucccaaggagccaguguuggccgguacucccagggaccacauccaagggaaaggaaguauuagauccaaggauguuauccaagaucccccagaggaccuuaagccccggcacacgaggcacaucagcauacgcuucaggaggcgcaaggagacuccaggacccaaaggaacagcagucaugggugagagcccagacuagaccccugccauguuccugggagggaaggagacacagaugaccccucaguuggagauggccagccuaguacagggauaacgcacuugggagcacaccauugcucagugcucuuccuguauccauccuuggagcugucccuaugccugggaugaguaucuaugggcugaagucuuggggccaccccgagagaggauacaguagcaguugcuccucaauagugucugccgggaguuuccugugcuguccaugaaguggggugaggucagccuaucaggguggacacccagucccugauaggcucacugguacuucccuggacauacauacccacagagacugagcacgaggagggagaaggaaaagaaacuacagagagaaagaggccgcgucacacucaagaaaaaucgaaguuucgggagagaaugaaggcagcugggcgccggcugcagagcuucugugugucacugugaguggccuggcuaggaaugggagggguguuagggcaagaagauagucccuggcucuauaaccucugaggcuguccauccacagggcccagagcuucuaccaacccuugcagcguuucuuccaugacauucugcacacaaaguaccgggcggccaccgacgucuacgcccucauguuccuggccgauauugucgacaucaucaucaucaucuuugguuuuugggcuuuugggguaaguugaccugaggccccagcacagauggcuggccucuaagucuuuggagugccugggcuuaggacccuguguuguacugccgcuccaucuccccaacuuguacccucugcuacagaagcacucugcagccacagacauugcauccucgcugucagaugaccaggugccacaggccuuccuguucaugcugcugguccaguuuggcaccauggucaucgaccgugcccucuaccugcgcaagacuguccugggaaagcuggccuuucaggugguccuggugguggcgauucacaucuggauguucuuuaucuuaccggcugucacugagagguggguggugugaggcucugcacguuggggccucagucuguccugagguacuguacucucuggguguggcacagcuccgguuggccuccugaaccguuugucaugucucccugacacccuguccugucccauucaggauguucagccagaaugcgguggcacagcugugguacuucgucaagugcauuuacuuugcccuguccgccuaccagauccgcuguggcuaccccacccguaucuugggcaacuuccucaccaagaaauacaaccaucuaaaccucuuccuuuuccaggggugaguguggucugccuagggaucgucaggagcagucagaagccauugcaggcuggcccugcugaugcaacccuggccuuggcagguuccgucuagugccguuccugguggagcugcgggccgucauggacuggguguggaccgacaccacgcugucccuguccaacuggauguguguggaagacaucuaugccaacaucuuuaucaucaagugcagccgagagacagagaaggugccagggcagagaggacggauggguacuuguugggaauucacaaucugcaugcacagcagcucaaagaagggagcuuucuagaacucuuguggacagcggacuugccuugugcgccacuggguuugugugguagggacuauuagcuguuuguuaccagaauuguuucgugguuuagcauacucacagacagguguucaucacugcagccagcuuuaggccaucaccuaauguccuaaugcccacagaggacauuuaggacauguccucuuuauugcuccccaucuccucuccacccuuggugaucuguagucuccuugacgugaguuugccuguuuacacagaaccauuucauaccaggcuuccucgccucagcggugauccuccaccuagcaaugcucccaagauccuuccuuguagcaggucaauacuccugcuuagagccacauaagcgauccugugcagugcaggaccccugacgcgucugccuuuuccauggacggacugcugcuuucacuguuccccuacacauggcgcaugugaggucacuguccauugagaaaggaugcucagaucacacccugcguguacucaggucaacuguucuauuugugugugugucugugcaugagugcaggugcccacggaagccagaagagggcaccagaugcccuggggcugaagguacaggcaguugugauccaucuaacaugacuucugcaaacugaacucuggucccuagcagagcagugugcucucuccaucacuccugaaacaucaguuuuuaaaauagucuuccucuccugcucaggucugguguuccacaaguguccuuggccaugucuaagauugucacaccaagcucucugcuccaaugacccugccugcagcuguguagaaaggcugccuucucugagagcguggcauguagcugauuccccagcugcccccacugaugguuaucucuggagcucaggccuaugcagugacaccaggucgaggcuuagagccuguggcuacgggguugggaggguaaccagugucucccuuccagaaauacccccagcccaaggggcagaagaagaagaaaauugucaaguaugguaugggaggccucauuauccucuuccucaucgccaucaucugguucccucugcucuucaugucacugauccgcucuguggucggggucgucaaccagcccauugaugucaccgucacccucaagcuaggcggcuaugaggugaguagccagccagcaacccacccguccccugagccugaggggcuccaugcugagcgugcuuccauccccagccacuguucaccaugagcgcccagcagccauccauugugccauucacaccccaggccuacgaggagcugucccagcaguuugaccccuauccaguaagugaccugcacuggacccauuugugugaggagggcugacggaggaaagguggccugcugccccuaacugagcauaccccacacagcuagccaugcaguucauuagccaguacaguccugaggacaucgucacugcacagaucgagggcagcucgggggcgcuguggcgcaucagcccacccagccgagcccagaugaagcaggagcuguacaacggcacagccgacauuacacugcgcuuuaccuggaauuuccaaagguggguccuguucuuaugagggucugggggaugccccacacugccuaacacugccugcuccccagggaccuggccaaggguggcacuguggaguauacuaaugagaagcacaccuuggagcuggcccccaacaguacggcacgaaggcagcuggcccaacugcucgagggcagaccugaccagucagugugagugggggccacuguggggcaugugggcaggagggcuaagaugccccugaccugagcagucagugugagugggggccacuguggggcaugugggcaggagggcuaagaugccccugacuugcugacuccucccacagggucauuccccaucucuuccccaaguacauucgugcucccaaugggccugaagccaacccugugaagcagcugcagccaggucagugugggagcagggcgcagggaugugggcuaggccggaagugugggugcagggauguagggaugcgggcuaggccgggggccaguguagcccgacucuaacuaucccacucaacucagaugaggaagaggacuaccuuggugugcgcauccagcugcggagggagcaagugggcacaggggccucuggggagcaagcgggcaccaaggccuccgacuuccucgaguggugggucaucgagcugcaggacugcaaggcugacugcaaccugcugcccauggucaucuucagugacaaggucagcccaccuagccugggcuuccuggccggcuacgggugaguacugcagagggaucuccgagagccccaaggguucugaguggucccggcucacaugcccgccucucccgacaggauuguggggcuguacgucuccaucgugcuggugguuggcaaguuugugcggggcuucuucagcgagaucucucacuccaucauguucgaggaacugccguguguggaccgcauccucaagcugugccaggacaucuucuuggugcgcgagacccgggagcuggagcuggaggaggagcuauacgccaagcucaucuuccuguaccgaucuccagagaccaugauuaaguggacacgugagagggaguaggagcccaggcccugggcaccgggaaugaaggagcugccucagggcagcaugaccaccagggcuggcagagcuccuuggguuggaguguagcugcccaaggcacgagcugugacagguccuggccuacguaagcccugaugaugcugcugucaaagggacgcugugucccuacccauugcgucccugccaguuggucugggggccuggcucucccuucccacaaguacuguaggguuuucuaaguaaaacauuuuuauuuauacaaacggacugucacagaccaauccuuuuguccucgccuuccugcuucauggcuccgcacgacucagcugucuuccuccucaucuguaaucagauacuccuggauuuccucagagaccgagccccugugggagagugcagugagaacuaggccagggguguccccagccuccccaaagcauaggcguuaccucuggcugcggagcugagccucagcaaggacguaggguggcaauggguccaaggagggcuacaagagauggagugugagaagccacgggaccguggggauagcuuacagggacagauggacagccacucaccagguccuucauguucacucggcagcuauaacauaacugcucugugaugcaggcccgugcauccccccuguggaagcagaaguagauuuaugugccuggucu

SEQ ID NO: 4864 - RNA, 5578 nt, Mus musculus
uggugguacggccugggcggggcgaggcugaagccgcgaaaguugcgcggaauccgcgggaacuaccuuuuuggcgccauggcgcaaagucguguuaccgauuucuaugcgugccgucgcccuggccuuacgacuccgcgggccaagucgaucugucucaccccgagcccugguggccucguggcuccugcguucacccggagcagcagccgcaagcgcgcccggcccccagccgaacccgggagugaccagcccgcgccgcucgcgcgccggagguuacggcugccuggauugguaaggagcgcgcgggaguccccccagaggacccuugguuaggacaagagaaccagguucucgggcgccgaggcagaggacuggaggaauagagucgcgagcaggcugggcgcuuuuuccucuccccagggcauugcugacguaggcagaggguaccugggcuuccggggaggccgcagcuggcgggggugaauuguggugguguggggguuaugcaaagaauugagggcuggagagauggcucagcgguuaagagcacugacugcucuuccgaagguccugaguucaaaucccagcaaccacaugguggcucacagccaucuguagugagaucugaugcccucuucuagggugucugaagacagcuaccguguacuuacauauaauaauaaauaaaucuuuaaguaggagugagcagggccaagcugaagugagagaggucaaccagagcaaacagagauccuaaauucaaauucccagcaaccacaugacagcucacaaccaucaauacagcuacaguguauucauauacauauaaauaaacaaauaaaccuuuaaaaaaaaaagaauugagcuggaguuccugaaauggagagagggcccuggagggccaggccugcgagcugcuucaagacuggacagaccagguggaucuuuccuaacugcuucaucaagcaucuccauagacaggcacccccuagcgccugacuccugcccuccgagucgagugaacugauacccuaguucuggcucagcagggagcagguaccccuucccacccccaguuuauuguucugugccuucuuaaucgccaggacuccugccccaguucucugccugagcccaguuccccagcugagcccagcccuccagcugacccuagcccuccagcugacccuggcucccccguuugcccaucccccgucaagcgaacaaagaguacaacuguuuauguuggucaacagccgggcaagguaagaaggcuggacugagggugggcugugggcaggggcaugcggaauuugcagaacugacagugccuauguccccagauccccucagaggacuccgucucugagcuccaguccugccugaggcgggcacggaaguugggagcccaggcacgggcccugagagcccgaguccaagagaaugcuguggagccuaguaccccagaugccaaggugcccacagagcaaccauggugaguccuaguggggccacaagguuaaggcgaggacagaccuuugggaggcgcuguggggucugaguggguggauggccuaaaccguaccucagucuccucccuaccacuaugcccuugucccucacuugaaaaggacauugucaacuccuccugcacguggcuuguucuaaguacugugaaccccugugccugucugugacugucugccucuccaagcugagggugcagagcuaguguguggagcagguuucucaucucuuucugaugcugcccucagguagcauuagaucuguggggacuuugcaaauggguaguuuugggguucugggucacaguguccucuccuacccuguggucugguggugguggugguggggucaaaccgugugguuugauagucuaaugggaaugccucucuuugacagugucgagaaagcuccugccuaccagcgcuuccaugcucuggcucagccuggucucccaggccuuguccuacccuacaaguaucaggugcuaguugagauguuccgcagcauggacaccauugugagcaugcuccacaaucgcucugagacugugaccuuugccaaagucaagcaagguguucaggagaugaugcgcaagugaguggugugggggaggggaccuagcugcccccagugucuguccggugcccgccugccuggucccucucauucugcccucucucccauaggcgcuuugaagagcgcaaugugggccagaucaaaaccguguaucccacgucguaucgcuuccgccaggagugcaauguccccaccuucaaggacagcaucaagagaucugauuaccagcucaccaucgagcccuugcugggccagggugagucuuuggcgaggcccugggccuucucgauccucuuggacuugcggcugggcaguuggacggguuggggcucaccacagguggucuuuggcuuacagaggcuggcggugccacccagcucacagccacgugccuccugcagcgccggcaagucuuccggcagaaccugguggaacgugucaaggaacagcacaaggugagggccuggguuucuggaggcucaagcaggcucagucccugcuccgaguggacaguggccuuaaucacucugcucucuauguagcugcuuuucuggccucaaaugugaagaaagguuccucugagucccugccuuagugagggguuugcugcugggagcagguaccaugaccaaggcaacucuuacagggacgacauuuaauugggguuggcucgcagguucagagguucaguccauuaucaucgaggugggagcauggcagcauccaggcaggcaugaugcaggaggagcugagaguucuacaucuucaucugaaggccacuagcagaauacugguugccaggcagcuaggauaaaggucuuaaagcccacguccauagugacaaaccuaccccaacaaggccacucccugggccgagcaucacagucccuugcuauaguuuucuuuaaauguaagaagggcugauaccuacccuauaggcuggagcuggggcagagcugccuggaaccccaaaacuggggaguucaggauuacgucaagaucccgagaggacguuuguauucuuuagucaaccauggccaugugcuagaaacaugccucucuucauauuaucccuggucgugucuaggcacagaacagcuaaguugguguucugguuggaaauacugaaaugaguauuucaaccuucuuuccuccaggucuuccuggcuucacugaacccccccauggcggugccggacgaccagcugacccgcuggcauccgcgcuucaauguggacgaggugccugacauugagccagcugaacugccccagccuccugucacagagaagcucaccacugcccaggaagugcuggcccgugcccggagcuugaugacacccaaggugaggcucucugacuuguaacuucauuccuuucuccucagggaguauggcugccuggcccuggagggcggagguaacagcugagugccuucagguuaccagauacuuccucagcugagggcacaaagaaggugugcuuuguacgcacacgugcggcucaucgggcuguguguauaugcucugguggggcuaugcaaagagcagccuucacgagguuggggauuuuaugaaucuuuugugaccucugaccugugccuacccugcagauggagaaggcccugagcaaccuggcccugcgcucggcugagcccgguagcccugggaccucuacuccaccacucccggccacuccgccagccaccccaccugcugccucuccgagcgcccugaagggugugucccaagcacugcuagagcgggugaguccugggucucggguaggguggacuuggugacaggagugggcuuuccuuguugaccauuggcugcugacccauccccaugcagauaagggccaaggagguccagaagcagcuggcaaggaugacacggugccccgagcaggagcuucgccugcagcgguuagagcgucugccagagcuggcccgcgugcugcgcaaugucuucgugucugagcggaagccggcacucacuauggagguggucugugcaaggaugguggacaguugccaaacugcucugaguccagguuugugcaaagcaaaacaagggugagagggugggcauggucaugcucacuguguucuuggcaaggagcuaggucuauuucugaccagggacaguuugucugccauggucuuggggacccccaauucugccacuuauaggccugcucaccaggcucggagcacgggugucuuugccucuuugcuguucguucuccuggugcuugagcacggugucccccauggcucuuggcucugcuuggauccacuguacauagcaguggauaagccuugacaaaggccuauuaaugggaugucgggcaccugggugcgugagagcaaaccaucuaggcuuacacccacaauccaccugugcaggggagauggagaaacaucuggugcuccuggcagaguugcugccggacuggcucagccugcaucgcauccgcacggauaccuacgucaagcuggacaaggcuguugaccuggcuggccucacugcgaggcuggcccaccacguccacgccgaggggcugugacuuugagcuccuugccuguuucuuucaucaguacacgacgcacuuacgccuuuaagccucgccagugugggcagcuaucguugcccauggaucucauaaagugcuggcauuaaguugcuuccugaggcuuuggggcaucccagacucagcucuaggggaaguagacucugaagaguaggguauguuggauggccauugcacaaacuacucaagcauuagguauggucaagacccaagaucaagguccagguggaagccuaggcuggcauagccuugcuuccccaugagacuuaagaaucacacagaccuuggacuuuccugauuucacgggacgcugcucugagagugaaauugggccuucuguaaauaugugaagugugguuucuuuucaaaccuuauauggcccugcaugugacugcuaguuuuggcuuuuaauaaagucauguaagauuuaaauaaaauacuacugagaugaagcugaaccugucaccguaaaaucucuuuaaaugcuguugugugauguggggcaaugggcuauggacagacauccugguccuggugggugguaauuuucacauggacauggacagaaggcguuccaucaugucuccuggaccccuggcuccugucgaaguuacagcccccacaggagaggcauguggcuuuuagucauguagccaaugucacaagcuucuggcauucuggcuagacuccuucccacaguuaccuagcaacagcaagauggcaaagcccacuauaaggggcuguuuggccccuccucgcucucuuaagcucucuggcuuuuuuuucucuuucccuuccccccucucuccacguggccauggccuguccuucuaccuucucuuucuccuugccuuucuacaauaaagcucuaaaacca

SEQ ID NO: 4865 - RNA, 3278 nt, Mus musculus
auguucuuaaaauauauucaaguuuaauaauuuacauucuacuauuaacacacauaucuauuuuucuuuaaaaguacucgagaaugccaaucccagcauacccugagccuuccuccccucccuccccucccugcccagugccuucccacugggaccuggugaucugggcaccuucaaaggcccuugggggcugccaggcuaggagccccaucuggagggaguggagacagcaguuuacuccuggucccgcuuuaaaaacugggcuguucuuucaguagggagagaaccacuguggugcuccuccauggccccugcagagaguugggggugggggagaacaaaggcagcucaguugucuucagaggggauaggccuggagaacaucaggguuaaaguuaccaccgagcugcccagaaacuguugggggcgccuuugcuuuauugagggggugacuccagagaaggaagccuggggcuagaauuugucacaugggcucaacugcagccuuguuuauacuaguuagccuaugcuucaggccagaggaggcugcuugucgccugcagaguccuagugcccaggaacaaguagccccaccaggcagggagcaagcuuacacagagccugcacaggcugcuggaagccacgaggccucccccucagccccuugccaagugccccaaccuuuaaggcucaugugagggacaauagucuucccuuagcaugacacugugcagauuggcuacagccagcauaagggucaggcuccaagaaucuugcugcucagaucuccagacucagagucccacuugggcccacuuaccggcuccguccaugggcucuuaaccgagcuuuucgauggaggcuaccgugcaggaaggcagcccuguugcccgaguguguccgcagcccuccacggucuguggagcugaugccugggaaguucguccuuuugggaaguaccuggauggaacccaugucaugcuccaagacacuggucuguacccuucuugccaggguggccugaagccagggcccaggcugagaccagggcuuggggcuccugacuugugguaucacuuaggcugaaauaaucccuccaacuuuucucagaugcaaaugugaucacaggacauccugguaauagccagcaucuuccuggcccauucuggcaggccccgcccacaccaagccccgcccacgccaagccccacccuaggucugagaguuuucaucacuuccuaacucugauuaaugcccacccagcuaagaugcacaaagggucaggcacucuaaccucuccgagccugguggaggauuugugaguuauugcacaaggcucagugguggcccacaggcgcauggagaccccuggggaaacauaccuugaugacccgaccucggaaggugcucucauccagccccacagcagccuugacagaucugugcgaagcaaacucuauauaugcauagcugggggaggacagagguggugaacauuggagcaaggagugaggggcuagcuccagccccacccacacugcccagccugccauagcccgacacugaccccuugggguguccagagaacuugucgcacaggauagugacccggugaaucuccccacagggacugaaguaggccuccagcucugcagcugagccaccauaauccaccugcucacagaaaggguaccugguauaagugcugggcuauccccgucucccuccugcugaggcguuguggcagaaagggguuggagggaccccccccccaagguugguuggccccuggcugggcaugggcugaaguuguauccacuccugcccaggguucagugcugagagacaguuaaguguuuccuguguggacagcugguugggucucaggaauuagcacaugccggguauguggcccauuaaaccugaaugcuugaccucaccuucgguugaaugaacagucaaggccugggcacuauucggccccguggguuuuaccuucccucugcaccaggccucccacuuuggccuuggagacacuugcauuuacaacuccauagccuccugccucaaacucauagccagcuccacccaggccagucguggaggggucugcccagcuaaaugcccuaauugggggcagacacccuaggagggcuaugaccacgccaccccccucucuacucacauugccuacaaagacagaucuguggucagccuccacauuuuccuuggagguccuagagaagaagcagucuguagggagagagaaccucagaacuagcgggaggaccucauugaggagcccauuccucgugacccccagggaaggucgcccaggcucccgcggucacacuguggauugugggugcgauucagaguauucccucaauuguccucauaugcagcccaugccgaguacucuuccacugaacacagguggguuuagagucuuagcuaaguggucaaggauuuagaaggacaguuguccaucugaggacaggguuggcgagagucccagguuccuaccuacggucucagggcucagcagcugucugaccucagcccucucuuccucuguggccuuucucuguacacaggguggcuccggcugggcuucagcaugcuccauggcccacaguuucagcuugauggccuccaacuccuguuggccacgccacaguaaguuugagauggccuucaggccccucuagaauggagggcagguguggccagccagcgccggcagaaagccauagcuacuaggggauaaccaagaucacccuguuguuccuguagccauaguccaggacuaggagcuaaggccccugguaccucuccugcccggauaccucccccuagucagagaggccucugaggucugaagcacuggcuccuucgccccuagucaccugugcuccucccuccaugcccagguccacaccuuccugcacgguuugugacggggugcuaccugguugaauacuggggacuuggccagguucucugguuccagcagggagagaaggaagcucgcaucuucauuuuccucugcuuccuugucacuuccugcucuacucccagcccuuggcaccaaggaggucuuuucaguccugccccaggccccccaaccuugggccucaggaucugaggagaccgucuggagccaggcuucaguggggggugggaagagcucauugcucagguaaggcuccaucuguaggugagguaggcgaggagggcggaccuggggagccuugccucucugggucugcuuaccu

SEQ ID NO: 4866 - RNA, 98050 nt, Mus musculus
aggccccggucacugagccgccgccgaggacucagcugccucccccucgagcccccucgcuucccgacgcuccguccccccccccccccccgcccgccuucucccgcagccgccuuccgcaggccguuuccacugaggaaaaggaaucguaucguauguccgcuauccagaaccuccacucuuucgaccccuuugcugaugcaaguaagggugauggccugcuuccuacuggcacugaggauuauauccauauaagaauucaacagagaaacggcaggaagacccuuaccacuguccaagggaucgcugaugauuacgauaaaaagaaacuagugaaggcguuuaagaagaaauuugccugcaaugguacuguaauugagcaugcagaauacggagaaguacuucagcuacagggugaccagcgcaagaacauaugccaguuccugauagagacuggacuggcugaggacgaucagcugaaggcucauggguuuuaagugcuuguggcucucugaagcuuaagcgaggauuuccuugcaaugaguagaauuucccuucugucccuugucacaaguuuaaaaaccucacagcuuguauaauguaaucauuugggguccgcuuuuaacuuggacuaguguaacuccuucaugcaauaaacugaaaagagccaaauauauauauauauauauauauauugggaaacugagggaagcagagcugcucuaagggcaggcuuacggagacaggcuaggaagcaaguuaccuggacuucaucuucuguacuaucucuagccuggguccagccucaucugcacuccucagggacaagguuguuggugagaaucacagaaacaccguggaaagaaagguuuucuguuugagaauguuugcuuaaugaguagcagacacauccuaaccaagccauccaccggcaacugccggcaaagggagaaccauggcuggguuaggccaaguagggagagggaaagggggucccaugguggagcagggggagcagcaggagcacuaagggcugcuggugggcgacacugggcaccaggaggguugaucugggagagagaaagggagaccaaagaggccagagagggagagaagggacgguguguugaggcugacggggugugugugugggagggauuguuaauacgaucaaaaugguggagucaucugcuuuggacugcaucgcugggaagaguuuuuccccauuagucggcuuauaccauaucuuuuuuuauuuguuuguuuuuuguuuuuuguuuauuucaagauaggauuucucgggcuggugagauggcucaguggguuagagcacccgacugcucuucugaagguccagaguucaaaucccagcaaccacaugguggcucacaaccauccguaacgagaucugacucccucuucuggagugucugaagacagcuacaguguacuuacauauaauaaauaaauaaaucuuuaaaaaaaaaaaagauaggauuucucuguauagccauggcuguccuggaacucacucuguagaccaggcuggcuucgaacucagaaauucaccugccucugccucccgagugcugggauuaaaggcgugcccgguguaccauacaugcccgugccccguguccaagcugcagucugaccuacuucuuggcuuucuccuccuccugcuagguuuggcucccacuuugcagcaaacuuacagaucuaucaacaguaacuuaaaagacaggacauuuacacagcguacuguggggagaccagacaaaacaaaacagggcuuggagcacagaaaagagaaagcuugaauuuagggaacagggaaucucuuuccauuucuccaacugcucacaguauuuauaaagauucaauauugggaucuaggguccauuaggcagccauuugaacugauaaucuaagggacguugaggucaaauuugauugcaaaggggagcguguuuaguacccuucaagucaggggcuaggcuaggggcuggagguuuucuaagaggcaucccaaagaaguaugauaggguauagacgacaucauucccauggaugggggagggguagaaaaugucacugcagccuauaacuaagggcaucuccaggacucgaggaggaccaaaggaagacacaagccauucaaugaaucauaaccacaucuuaaugaaaaucaaggacuuagccugucaaagcacaaggagggacucagagcuugguaccagggcuuucauggggaccagaaggugaggacaaaaaccaagcucugggaggcggggagacucagucauaggaaaaggucugggacaggguuuugaaagcugugagagggguucgcgagauggcucaguggguaagagcaccgacugcucuucagaagcuccugaguucaaaucccagcaaccacaugguggcucacaaaugaaggcucacaaccaucuguccagcuacaguguacucauauacauaaaauaaauaagcaaauauuuaaaaaaaagaagaaaagaaagaaaaccaugggaguuuagaggagcuauggaauucauggaggccagaagguaaggaagauccaaagagagggcaggagagggguucaguaucccaguuggaccuaagaaggaugggggaguggggcucaguuaagauggccaguugggagugccuccaccuaaagagggaacuuaccaaauuacugcugaugggugggcugcuaaaccauugaugagcugaaagauaagccuguuguggguggacuggauaagaaggaucggguccuauugcagcuuagaccccgaggggaagugcaggcaccaggagagccucucugaguuauaguaucaaaauaaguguuacaacucugcuccaggguuggaagauuuccucgcagcaaguguuacagcucugaagggaaagguagccugguaguugggagccuagggaugccacaaagucauacugcucaacaaacacaagucacacugcacaacuaaccucacacaagagauuuauugggaaaaccacaggagaauggcugccucugcucaggugagaagcagcugacaacuaagcaguaggcaggcugauagaggguuucuuggggacagagucuuccaggcuggagguuuccaggguagggauuggugggauuuuugagcucagagauuggugggauuucaagcuuuugagcuuuuuacccuauaaucugguuucaaacccauaaaaauccaccugccucugccaccuuagugcugggauuaaaagcuagaaucaccuuagccuugaaaauucuuuaacuaaagauaaucccccagauuggucccugcccauccucaauuaugcucucacagacaaacugggcugcccacgacugcuuccuuuccuuugaauggaugcaucucuuaacagugagcagaagggggcuggagagauggcucagcaguuaaaagcaccaacugcucuuucagagguccugaguucaauucccagcaaccacauaguggcucacaaccaucuguaaugagaucugaugcccucuucuggugugcaugaagauagagacuauguacucauauacauuaaauaaauaaauuuuuaaccagcacucgugaggcagaggcaggcagauuucugaguucaaggccagccuggucuacaaagugaauuccaggacagccagggcuauacagagaaaccgucucgaaaaaccaaaauaaauaaauaaguaaauaaauaaaaguuuaaacaaacaaaaacagugagcagagaccucuggccacaaggccuuugggguagacagaagccagaaaagaggguuacccaggggagccugagagagcuagacucuuaucagggcuugggcugcaaggggccuauggguuccagugaguaucuucagucugggaagaucugaagagguggcucagcagcaugggugcaggacccaggguuccccugccuguuucuguccccuaacaccugggaucaugaagggugggacauugcugggacugucuggagcuacccagugugggggucacagugggccacagcuagagguuuguggucuuaaaggagagucggugauagccucacaucugacagugaagagaacucuuucucagacaacuguccccucugacaccgcccucaggaccuuugucuagggaacccagcacacucucucuacuccuguguagaagaaccuggccuggggaagauaugcuccccagagacuggucccuggccccgggccauagagacuccuccaaagaagggcuuggccugagucccagucugaggcaacaaguuaaagcaaggcugggaagcaggggcgagucucccugagugucuucccauguggagggaugggguauguuuuacuccuggaccugaaacaugaggcagaggcccacaggcauccagagaacuuugccaucagagcccccaaggggcuguccuccugaaggggucucuucccccacccucucaugugugggggagaucaauauuagggcugcucccacacacacagucuggccacccccccccccaggcauagauggugucaacccugcucuguucugucacugugguaaaacaccugacaauguaaaggaaggaagagucgaccaucccaucaaacagcagagugguaggugcuggugacaggcuaguccagggacccacaugugacuccggcuacugugcugggucuuucugugucaguuggacuuaagcuagaguccucagagaggagggagccucaacugagagaaugccucuagaagacugggcugcagccagggcuguagugauggaugggggaggauccagauggguggggucacuccugggcuggugguccuagguucugugagaaagagcaagccaguaagcuguacucuuucaugaacucagaaucggcuccugccuacagguuccugcccuguaugaguuccuucccuauuucccucagugcuggguuuacagacuguuucaucugcucugcaggaucucgugugggaauucucauucucucucccucuuuccccaucucccccacauccuuccucucuccccccucuuccuguccuucucccaaguccagaggacagcauauagggccagccauauaggggcugcacccagcaggaggccagaggaggaaggaacaaccuugguugagaugggaggguguucccuugaccgaagccguggagcugggcauugagggaugcguaggaguucucuaaguaacagcggaaggaaagcaugcuccaggcagggcaccucaaagagcauggugaccguggaggaaagggguggacaaagagcacuuggaggugaacuaacagcugugcgucagaacggcuguuggggcagaauggggggaaagguguugugguggaccaagagccaccuggacgucuucauccaggcugauacagaucuauuggggucggaucagcauagggucagaugggugugagcgcaggcaaguuggaaagccucuagcuuguggguaguuuaaagccacuggaccaauggaggccugagggagagagugaggagggaaagcccaaccagccuggagucccuggccacugggccacacacugccuggggaaggggcugggaacucuggcuaagcugacgggguucaggaaacaugggcacaagccuggugcagccuuucuagucagggacugggaccucagucauguauguaaaucaaccaagucucuaccaaugcccgcgggaucuguccaggacaguggaguggaccagcagggaccaggcacccucccuucgugccugucuugggccuuggauccaguaacgucuccugccuucuucagugcaagccagaaggaucacgcccauggccggcugaugucagcgagggccauccagaagcuaucagcaaagaagauaucccacaaaaucauggugacugcugcauacaugugguguggcgggagaugcaggggguaggcaaaggagcucuggccaaaggcagaguggcccguggggugagaccugggccugaaccccuuaagaauaagccacaugccagucuuucuugcccuucacucagccuucaggagccucugauguguucuggaagagcaaaccugaacaggcaauccaaacgugacccccaauccuccugcuccuuccucuggguuaggggccacuuugggguuuuuugguuuugcuuuuuguuuuuugagacaguuuuucuacauugucugggcuggccuagaacucacuauguagagcaaucuggccucuaacucauagggaucugccugccucuggauuaauauuaaagguaugggcuacugugcuuggcucccuccauucuucuacaagcuugggucucucuggacagcugccacaggccucagucccagccuacggcaugcugaguucuuccccaauguccacuccccgccccccuacaugcugucacucaguccaggagcccccuacaacacaugugcugaccucaaaacuuuacagagccucccucaggcacugaucacauaugcugucacucagaucgcccccccccccccaucacuuugcucuggcucugccuugcaucuuucacacuacacucuuguggcuguccaggcccaccuacaugugcugucacucaucucugaucccgcccaugacucugccccccaugcagucacucagcccuagcccugcccagaccccgcccuggccccgccccaccacacacgugcagucccuuggccugcuccccaagcacuugcgcugucacucagcccaaugcucucagcguggggguagaagaagcaccaccgcccguuccaccggccgcccagucggccacuuguccucggcucuuccgccacugccucaauggguucugcucugcuccucgcccucgggcugcuugcccagguaagcuuguaagcccuguggcaucccuuccucuagcuuugggauagcuuuccugggaccacuggccuggagugucuuugggggaaccugagagcugcggccugcaguguccagggugggccgcacucucugaagcauuguaggaagggguguccuguguuuaggggcuuccagagggagggcgacugaccugcacaucagugagcaaaaugguucaggacuggaagcaucucugaggcacgggaacagccauugggcugucccuucagucuggaagcauaucacaggugcucccuggagccucccagagccuaaggguggccagucuugagaggucuuucuauuccagagcacgaggcagagagaaggggcagaaagccacagugucuguaacacuuaugccccugguuggucuugguggugccugagucucuacccagugguccuagaggagcugcaacgcuucccuacaggaccuaagaauccagagaaaauaacuccaggccagaguagcccaacacacucucaguucacacugccuuugaccugaccgggccagcggcugugccuggauccgccuggagauggagugaucugugguccccagaucagucagucucugguacccugucuucuuaacauggcacaaagaaggauggguaaagcccagguccccaguuuuuccugcuguuggcaguccucagacuggcugcugaaugguccuggacuggccagaacgggaauguggauucuguggucccugccagggucccuuuccacagagaugugcacugaggcuguggccagccucugcgcccagaggcaacagguggcgagcacaaagaauugcuguguguggagagaggucaaccagcauugcauggguguguggugggggguccgucccuuccgggaacacacuucaggacuuccuugguucccucaaauucccacaaagccuugcaacucuacucaaguuucaguucucggcagcugacaggagccuggccagagagccccccuugcagcuggcccugggucaucagcccuacacuuccaaccagcaacaccccagcuuugggggcccacauucccuuaccugggcacaucugcuaggcuaguuaagacccaacacagaaccccagucuugugcauaacgcccugacccaucagagcccccuccauacccugggcugggauuugcuccccacuggcuacaguaacagcacccccaaggcuggaggguggguaguguuggguagcauucuucucccccuccaucaccaagcccccccucucuguugcacuagggcaacugccccccccccaggcaucuggaggccccggcagucaggugggggcaaggacccgccccgccccgaggccuggccuccugcacuuacuucacagcagcacucaaauuagcuccagugccuggggaacuuuuccuaccucccccaaaugugccccccccccagcuuuagugcuucuguaggcuuuuguccacacaccagguccuggggcugcugccgucuggucauucuugcuuccuuacugggcuuuucccuggcuacccuggcccagcugcucugucuugggcuccucuguuugggguuggaagugggcugugcacggauucagauucgcagcucacuccauggccucccuauccuggcucccucuggaaucugagcuuccagaacuccauggcagcaccaggggguguauugcguucaaaacugguccccgccaggccucaaauuuuagcugcucaggaagcugaagcaggaagaucacaaguucacggccagccugggcaauuuacugauaccucaccucaaaagaaaacuaaaagcugccaaggcuguagccaguagaacacuugcuaagcacgcuugagaucugggguucuaaucccaguaucauccacacauuaguacuagcacucauaaagaugacccccucagccccugcacuugggguucagucucucuaauugcuacuccugagcuggguugcggugcaucacggauaguccagagagaugccugcccaccucaccucugucuaggaaccaaugaagccguguggagucugcaggaaagaugggucucagcaguacuuugggggacuagucacugacacugagagagagccucaucucuagcagguccagccagcagccuguagugacucaggcuggaggcaggcugcucacaguccugagcacugugcccagccugugcuggcaggcaggcaggcaggcaggaccaaucugaucggcagggacagcugccugucugcccccuccccauucuccucugaugacugcagcagcuggacaggguggucccacagugggaauguggggccaccuaggccaggccaacagcugggcucauuccuggcaugcuggcuguccaggaaugagguggccauggauuccagccugugggagcugugcaggccugagaagccugugggaagucaaugcaggggggcuuccugcccuccaccccaaaggccauuagcucuguuaagauggaacacacaccuugcucucguggcuagggcacuugugucuucccagucagucccaucucccugucaccagaaccucugcccaggaucagugcaggggcgugcaccagugcuagacagcucucuccuuggccccuggcaauggcuaaugcuauuccauugguaguguugguaaagccucuugccuggcccaagcacauacuacaugcauagcaggauucuagucaccccacaacuccuuggaguugggaggggaucaggaaagaccccagagggaauuggccgaacaauguccccagaugucucuaggacuuuccaacuugugucuggguugguccuuggccaagagcaggccagggaugagguggggcacauuggguaucuacugaaggaagaaagucuguaacuauuuccuaucugguuugguaugggggucagaggaguggaucguguaggaauaccugccacaaagucaccuuccaggugccucuguccuuguccucuguucugaaugugggaagccugugagccagcuguggccauguggcuuuguccuaaacaccagauguccuagcuucccaaggaggccccuagccuugcccccugccugccacgucuucuggaaaguggguagggugagagaacaugggaugggcuacacaaaugcuucccaugagccggaagcuggcuguggccugcccauugggcacccacucauuccccugcagccucugaucuaggcacgaggcccugccaagacauugugguucugugaccucgugaacuugggcuguggacagccgagggacccaagguucccaggcccugccuugaccacacccggugagugccaaggccgugggcacuggcuggggcagcugauggaggccacaggacugggggggagggaggaaguucuucccaggccacgggggcuucaaagagccugggaaucccauucucaacaggucuccccaaggcagggcagacacuacagaugacaucagccuggcaugccuucuggugccaacucugccuguguggcuuugggcaaauggcucagccucuuuagaccugucucggagcuaugagaaaggcgccuucucucaggcuuuggugucaugaagagccucagaucccaacccacacacuauccugaggggaggaagauagagccagacuucccccaaagcagcggcucaggcacaucucagggucugccaccgagcucaggcaaaaagccccuguguccauggaggcuguggcccagguuccccaugccaggcaggcaggugugugccugguagggacacugcccugaccuaaaaguggcucugcaugcuggccuuggcagguucugaggccaaggugccaucugugaggacagagcuggacagagacaggaggacucuggccccuccacgcucacccuccugucuugaacaggguccucugcucucuggauuccaggacuaagugggugacaggacuuuacugcagcuggccuccacugccuugaggggcugaggaguagguggcugggguccccacuggugggaugggcucccacccaucaaacaaggggcucccaguguggugccuuaguugggcugggaaacaggacaagagagcagaaguggagccaaaaccuuugaucucaaagcaggcuagaugcaggugcacacaggacugguaccuuccugagucuuggccauccaugugugcugcaggaagggacguggagaggcugaaaucuaagccuggcugccuggcuggcuauugcuccuugcugcccuuagagcaucccccaacccaaucagccauuguauuucccuccugugacccccagccuccacagaggcuccauagaucagauccaggggccugcauagccagcaggcaaguuguccacucugcauggaacaagcacauagagccgugggagccgcugggcucuggggaggagguguggugcccaucuggcccagucccaccagucuccuuggguauaagugccauucacauaaccuccuuauaauuuuaaaacuggauuuauuuuuacgugauuugccugguguguguauaagcauauguaccacauacaugcuguacuggaggaagccagaaggaugugucagagaucccccggggccugaaguuacauauagaugacuguuagccaccauguggauucugggaaccaaacccugcuccucuauaagagcgguaauugcuuuuaaacauugagccaucacuccaaccuccauguggccugcuuucuggucccugccagggccucucaguucucucgcuugggguggagccaaguggaguuucccuaggaguggacacacagugagcacuaagcaugaacgcuaugaggagaucuccuuggaguuccugaucucauccgaccugucauucugaggggcguagucgggggcgggcuucucuccgguagccauggugauauugaggauaggauggcauucuggcugccugggauagauacaugcugaggcuggggccggcacacucaaugcugugcuggcuggcgugucugugugugguggcuccgcccuccacacuccuagcccugcucugcccugagggccacccagugcucguccuuccacaggggcagcccaaggaucugcccuuggaaggaaaggagaggugaccugccuguagaggguccacauggggaguccaggcagcaguccaggcucgucuuuagcugcauaguaagucugaggccagccugggcuauguaagacauaaacaauccucaaagcagagagacgucuggauugagggcuguugggagucugagcccuacccacccggcgaucugccacuucuguacagcaaccccuacagacugugacccuugggucucaaccuugcuaaggcuagacuggcauacugguacagcaacggaagcugcuggcucugaguaguuacauuagcuggaaugagacagaaggguacgcauggcccugcucccuguccucugagacugcaacuauggacgggacagauucagagaauuacaucuagaaagcaccucuccgcaggacagaaccuugaaggaggcacguaccagccaacaagacagaucagcagguagggcucagcagguaggggaauuugcuauuaaagacccaagugcuuuuccagaaccugcauaguggaaggagcgaacugacuccuguaagcugcccucugaccuccacacaugugcuguagcaugucucuccacccccaagauaaacaaauguaaacaaaaggcaugugaacagcccugagacagaggcugaaaucucccaagcgcugcccuuggcucaagaaggccaggcuagcaaggauucugaagggucagccccucugcuugcccuggacccuccugugggccucggggaaugcagucagggauggcuacaaaugcugagagcaucuccgagccuagcaguccccaugugcuagagccuucugcagccagcacuugcacacaugcugccgggcgguacccugcccagccuuggccugaaagccucccagcauccuagacacaugaggaugcccuagguuuuguuccuagccaacacgugcuauggaggauguggucagaaugugaccaacauccccacauauggcagccucugccagggugugcuuugugaugaggagucauucgggaaugaagacaaggggaugcaagggcguccccagcauccucagaacaccgggucucaucaucccuccaaaucaagggauggaauaaggaacaauuggaggacaggucacucaguuaaguccaaucagaaaugggaugaaaaccgugugagaagguuggcgaugccuuuggggaacugcuaugcauucugccauguacuugauuggccuuagucaaucccucugaggggugggguuaucugugaguguacacagguaauggcaguggguuuggggagaaugggugucaguagagcucccucugagcuuagggacuuggcuucaucuccugucugcagacacacaucagaucccuacagcagacauuguuuauugggugguuggaggcagugugagggucuacccuuuuccuggggucccuuuucuccagggcacugagucuuuuaaauuacaucuauuuaccguggcaggaaauaucauguugaggucagaguacaaguuacaggagucaauuaucuaucuaccaucuggcuuccagagaucaaacucagguuauccaacuuggaagcgagcaucuuuguccucugagccaacucugguucaacauguuagaggucacugccaagcuccuggguaugaugagguagaauggguuuccagaacugagauucaguuaugaaaaucacguggcguauuggauagaccauuccuuucccccagccagccucucaguugagcccugucacacccugugcccuggagcaucucuguccauggcuucuguagggcauguccucccuggucccgucccaugcucuaguccuugucacagaccaggcuggccagcaaaggagaccacagacacuaagucccacugugcaaaucagcuucggugaagccccuuggugcccugauugcccagggcucuggaugcuuggguauuccuucugcaaugcaauauuaagaagucgcaugggauauccggagcauggccccucucuguucacacagccaacuguagcagagaagccaccaacucuugggcucccuaaccugguuucuggaaguguuuaaaaucaagccccaggccugguggcagagggagguuucugaccaggugucugcugugugcauggcuaccccaggaggcuagggugugugugucagguagaccuagaugcuuaggggcagggucccucccuucccuagucuauucuaauaaaagcaggcacuguuaccauuaacuugugacauucaagcugugagggugaagagggacacauguuaccucccgcucuaacucaguggccccgucuccgacugagucccuggccccaccagcugcugucuuuccucuugggcccucacucccaggaagcaagaguuacccucuuuccugggccucguuggcaucugaccucucagggaccccaggaaaagugcagacccucauacugccuccaaccacccaauaaacaaugucugcuguagggaucugaugacccuguggacacagccuguauucuggcgucuagacaaggagaagagacagucauggacuauccauauggggacuuuaagagcuaagcuccccaggaugugucugccaaggcccacacagccugcacccugcagagugacuccccaggugguauagagcccgagcacagucccaagaaugaugucauccugguguucuugugcccugugugaugacauucuauuuguguuuuagagccuuggccuguccugggcagucccugagcccaaacccagcacccuguaccccuggcgccgggcaucagccccaggccgugugcggagagccugggucaucccacccauuagugugucugagaaccacaaacgccuccccuacccacuugugcagguaagagacgggggaugggugguccccauagggucccucauuucuuuguuaaguaaguuuuaaaaaauuuuuaaacccaccaugaucaagauuuuuuuaaagauuuauuuauuuuaaauauaugaguaaacuguagcugucuucagacacacaccagaagaggacaucagaccuuauuacagaugguugugagccaccauguggucgcugggaauugaacucaagacuucugaaagagcagucagugcucuuaaccgccgagccaucucuccaguccaguuucaacauuucuuaaagauccucuuggauauagggaagccccaccugcugacaggagcuaguuguauagccuaggaaggacuuucucacuuugugggauaaaagcgagguucccauagcccugagccacaagcgccuagcuacugcggugaacaugcccccaugcuacaugucccguccccccaagacacacacuucaucagcaguacagacagaccugugacggcucagcccucuucauccucagaauacagcugguugccaggucucaggaugcccugcagcugggcuacaguuuaggggagcaacuuguuaggcuucagagcuuuggaccucuguuggggugaaacacgaagguauuggggugcucucuggcccucauuugcucucuggcccucaccgagcccccucccucccccacagaucaagucugacaaacagcagcuaggcagugucaucuacagcauccagggucccggaguggaugaggagccccgaaaugucuucuccaucgacaaguucaccgggaggguguaccucaaugccacgcuggaccgcgagaagacggaccgcuucaggguagggccugugggaagccaaacugcucagcuucuguuccccacgugaagggcuccaggccgggugcuucugaagcaagaucuuguccuccuaagacccacaucagaggauuaaguguuugggcuccuguuaccacaccacacgccuugaggccgcgaauagguggucuuuuggagagcagagcaucacuguaacuggugagcugacaugacagccaauccuuggauccagguucuguuggauggauaggugugucauaaagaauucccagauagugguacugcccucugcagggaaugaacucugcggagugauuagccuccgcuaccauuacaaugcugggauucaggaggagcugugagagucacaaagugugcacaaggccaagagucaagccuggaacuuccuuuaucugccaggcuggcauguaguguacuuaccuaguguuugaaggcccugguuuccauccccagcauagcuagccaaugaauuauaacuagagcuuugaauaguauuacagaccuaugauacuuaggaggcucaggagggucaugaguuugaagccagccucaacuacauagcagaagccucaacuacauaccccaaggauaaagccaaacaaagccuguagaagccuuauauagccaggacccuguggacugcauccuagccggccugagacaggauagcuuucuauuucccuuuuuccaagggccaagauuucuuuuauauccuugagagauucuuccaaauuuaagaggcuguuagaguauucuuccagaggaacccauugaaugauuuuaaaaaaagauuuauuuauuauuauaucuaaguacacuguagcugucugcagaugcaccagacaagggugucagaucucauuacagaugguugcugggauuugaacucaggaccuucggaagagcagucagugcucuuaaccacggagccaucucuccagccccgauuuuuucuuuuuuuuaaugugacuugcaaugucuugcugugugucucuggcugggcuugaguuggcuguguuccugucucugccucccaagugcuuggcugugccauucucugaaaaggagcagguuuagaacauuguaaucucacgugaaacccuguuccaaaaaguaaaacuaauuaagccaggcaugguacaggcagaucaaugcgaguucaaggcuaaccuggucuacauagcgaguuccaggacaccacagcucacagagagacccugucuaaaaauaucguuuuaaauuaaaaaauaagccgggcagugguggcacacaccuuuaaucccagcucuugggaggaagaggcagguggaucucugaguuugaggccagcuugguuuacagagugaguuccaggacagccagggcuacacagagaaacccugucucgagaaaaauaaauaaauaaauaaauaaguaaaauaaaugaauuugauaggagccaaaaccauagagaaaaggagauaaaccuuaguaagagcauaauuucauccacacaaggaugcagugagcauccuggcagccauggcaagagaggaaaguuggagcccaugugcuaggagaaagcaggcucuauucagaaaaagggugcaugcccgcagcacacauuccaucccgugugcuccucaccugcgcucagcccuugcucuuccuucuucguggcuuuaggagccacagaaccauugcuuaccuucuguuuguucagcuaagggccuuugccuuggacuuggguggcucuacccuggaggaccccacggaccuggagaucguugugguggaucaaaaugacaaccggccagccuuccuacaggauguguucagaggccgcauccuggagggugccaucccaggugaggugggagcgcagccccauccaaaggguggggcuucggaagguccaaaucccagaauucccuacaaaggacuagagauacagccuucccccuccccccaccagugcgcaggcuugacaugacaggauccuccguagugcggcagaauugacaauccaaaggccauccgaaaggugggguguaagaaagccaucucuuacacuucucaugucaguguuaauuugaucugcacugaaaggcuuccggguagcuguguuccaguugugccuuuuuuguuucaugguggugaacuuugcguaauaugaacuuagcauuucugggaacccuucuguucuaguuagugaguccaugggccaugagcuuucucuagcguaguuuuuaugccacaaagaagacuccacagccuggggcagugccuccucuggcugcugcuucagguacagucuggucucagucuaccuagccuguugugguggcgcauacccgugagccuggcaccugggaaguggagacugauuuaguuaccuaaccaaucugaggcuagccuugacuacuugagacucugguaccucuucaaaaucacaagcaauccuguccuuccgcaggcaagcagguugggcggggcuaggcaggcaggcugggcggggccgggcagggccgggcagggcacuguguccagccacccucccuuccuuacugccuguacccagugcguucaaaccuggccuaggcaagagcuucacgaacagagucuugauugucggccacucgggcgcauuuuauuucagcucauuuauuuauguacguuuaccuaccaucuuuacuauguccugacuucagacuuacagaaaagucuaaaacaauucccacgugcucacugcagggaacugauaaucaguuuaaccuuuuccugucuuuucaguccgcuuagacugaaucuaaggucuuagacaugaugcuggacguugucugucagcauggucugacaacucucugcaauuaccaaagucugggaaucggugugcaugcugcccggguacagcgacuacugaucuuauccagcuuuaacuuccauaacaaugaguuuguacggacagagaauagcugggucagguguuccagucccacuucuuuccuuccuucucuuuaaccagguucuuuucuuucuagcccaucucuccuugugugccuccaaccucaccaggccccuauaguccuuggucacuacagucccauggagcggccugccugccccagggcugcccaccuauagcagggagggauugauguguggguggauaugugcagaauggggcuguguugaccucaguuccaccauagucaugguccuuagguguuuccgucucuuucugcagagauccuacaccagcuggguuggcucagcacggcaaucccacggugguugaccacauuucucucugucauccccaggcaccuucgucaccagggcugaggccacagaugccgacgacccagagacagacaaugcagcccucagguucuccauccuggagcagggcagcccugaguucuucagcaucgacgagcacacgggagagauccgcacggugcaaguggggcuggaccgugaggugaggcagccccauggaccacugagggccugggggccaguucuccacauugggucuccucacgccucagggcuccucgcaggugggguggggccuucccaccucgcagccuacacgcacugugguucuuauucucacccugguccuuccuugcuggugcaauaacaccaccaccacccggaccccagccaguugcuuaugccugggagaugccuccgaagcucuccugugcagcugcaccuggguauucuuaucccugccaccaagguagcaccaucagccaggaaucugcuucccacugccgcuaaugucugacauuuccaggaccucaacugaccucuugcucacucacugccugggacaggggcagaccccaugccuguagguggcuuugcugucauccuaaaaugguugucacuaggcaccgcaucuucuuagacaugucauauuguccccaggugguggcuguguauaaucugaccuugcaaguggcagacaugucgggagacggacucacugccacagccucggccaucaucuccauagaugacaucaacgacaaugcccccgaguucaccaaggaugagguaccacuucugccugcccccaucagcuuagagcgcuaccuuccuuuuguuggcucugagaggggacucugugagggugggugguuucauggcauagaggaggguagugcaugggcagggagcaugacacagggacgugugaggucccuuagagaagagcagcuccaggguccucagcccagaguaagucuccugggccccugcugugugaggagaauagucaguccaauauccaggagcagcuccagcaggugggauccauggcucuggaaaccagugaaauaugcuguagugagcaaugguguuaagccagaagcagggaagguaucccgagucccaggggcaggcaugcuaaggugccaacuggugagucacgggcugggaucucccaguucuuuauggaggcugcagaggcugucaguggaguggacgugggacggcucgagguggaagacaaggaccugccugguucccccaacuggguggccagguucaccauccuugaaggugauccugaugggcaguucaagaucuacacagacccuaagaccaaugaaggugugcuguccguggucaaggugagcccugucccugucauguguguucccucagcuagaauccaucacaggugucucccuguggcagcugcaacuugagcugcccuggguuccuuccagguagggcugugcuaggcgaccuccugggguaagggcacgggauggacugggugcugacuacagguaucuggccaaacugggaagcaggaagcacccucagauugccauugcuacagccuucucccuucuuauuagggugguccaaauuuuaauuaaaacuguaccagcgugauccucacucuuaccagaggaacagcugccacacacacacacucauauacacacacaugcacacacacacacacacacacacucauauacacacacaugcacacacacacacacacacacacucauacacauauauacacacacucauacacauacacacucauacacauauauaugcacacucauacacacacucauauacacacacaugcacacacacacacacacauacacucauacacauauauacacacucauacacauauacauacacacucauacacauauacauacacgcacacucauacagacacacucauauacauauacacacacucauauacauacacacauauacacaaauacacauacacauacacacacauacguacacucauacacacauacauacacucacacauacacacacauacauacauucauacacacgcucacacacgacaacaacauauguagacuuagaugcauuuggauguuggcacauuugaagauuuauugcaagaaucugaucagacaaguugaaguaggcugggacucucaagggaaaauuuuuugcuacucucaaaaccugccugguggaugaucaccaugagccagauggcaucaacuggcacauccaccacccagcugcguacaaagccuguagcuguugaguaacacaggcaccuaccacaccacacucaacaaacccaccggagcaacaggaacucaccuguuacuauuugagccuugcauaguucuuacaggucaagguuuaaauguggggggaggaaagcugggcucucuggacagaccugggcaaaggcucuuaacaccuggcauuucagcugccucugucauuccccugcagccccuggacuaugagagccgugagcaguaugagcucagagugucuguacaaaacgaggccccgcugcaggcagcugccccucgggcucggcggggccagaccagggucagcguguggguucaggacaccaacgaagcuccaguguuuccagagaacccacugaggacgagcauagcugaaggagcccccccaggcaccucuguggccaccuucucugccagagacccugacacagaacagcugcagagaaucaggugggcugcccuggggucugaggguuuaggaggugggaucagcggcuccacgacugcugagggugccucuagaaucugagggugcaagagaaaggccauugguguacaucccucaggguacuauguguguauguggggugaccauaccccacaggacaggacugggcucccacaagggcacauaguccaagacaguucuuagguagccucugauuauugaucugggcagcagcaugaucaauauuaugggcacauuauugaucaugugcaguuggguuaauaaccagcuugggguggugguagcuggcaagauggcucagugguuaaggcgcuuaccaccaagcuugcccaccuaaggucauuuccuggaacgcaccuggucagaggagagacucaauuccuccaugcccuuugcucucuuguaugucauggugcucacacaugugcacacacaugugcacacacaugcaaauaaauaaguuuuaaaaauguugaaauauaaaauggaaauaauuaaaaaaaaaacguuaguuggggcuggggguccucaaaggcugaaugcuggccaaccccaggucacauauggguaugugauaguaauauguguuugcauauaugcuaugggaccccaugucuaggcaucuugggugagccuuaucccucuccuccccuccccaccaauagcuacuccaaagacuacgacccagaagacuggcugcaaguggacggggccacaggcaggauccagacccagcgagugcugagcccugcuucacccuuuuugaaggacggcugguacagagccaucauccuagcccuggacaauggugaggggaaguggguguugucuuugucccauagcccgcugcucccuuaaguggacaacugacaggguagcuuguggguggggcucgaacuuauucgcucucccuucuuccagccauuccuccuagcacagccacaggcacccuguccaucgagauccuagaagucaacgaccaugccccugcacuggcucuuccuccaucuggcagccugugcagugaaccagaccagggcccuggccuccucuugggugccacggaugaggaccugcccccacacggggccccuuuccacuuccagcugaaccccagaguaccagaucugggccggaacuggagcgucagccagauuaacggugcgcuccccccacgcccucccccacucucucagcuccgcaacccugagacccaagagacaggccgauacaauguaucgccaugacuacauucuccgcccccgcccccccccucccuugcccgggcugggauucguuuccacaguauccaauggguagauggggaaacugauacccagugacucagguacucucugggcggaagcgggguuaaccuggagcuucagcugaccacgcugcgccuucuacagugagccaugcacgcuugcggcuccgacaucaggucuccgagggccugcaucgccugagccugcuacuccaggacucuggggagccaccccagcagcgagagcaaacgcugaacgucaccgugugucgcugugggucggauggcacuugccugcccggggcugccgcgcuucgaggaggagguguaggcgucagcuugggggcacuggucauugugcuggccagcaccguggucuuacuaggugagugaagguccuuggccccacccuuuguucugggucccuuccccacccugcguccuuuaagcgcccacacuccagccagucucucgugccuccaguucucauccugcuugccgcgcuccgcacacgguuccgggggcauucccggggcaagagucuguugcauggccuacaagaggaccuucgggacaacauccuuaacuaugaugagcaaggaggcggggaggaggaccagguaaggagaggagugguggcuuagacacacggaacccuggaaaggggucccagaauguccagcagccuccuagaagauccucuggcaaccaggaggucccuucucugaccuuagcuguuuacuaugcacacaggaugcguacgacauaaaccagcugcgccacccaguggagccgagggccacaagucgcucuuugggcaggccaccccugcgcagggaugcccccuucagcuaugugccacagccacaucgagugcuucccaccagcccaucugacauugccaacuucaucagugauguaggugcccugugggggaggggugaucgcagaauggggcaaugcaugcuuguauguauacaugcacauaugcacaaacacacaaauguccagacccugcuuccaguccccaugcuacagggugucagggggugagcucaccagcaggacccuggcugagcuuuaggaaaaccucagagggcaagugagcagguugaccacccacuuuucaaacccuguggguaggagccgaacauuagcagcuauguggccagagaaggccagccagcacuggccuuaauaguucuguuucgugucccucuggaaaucguacccaugcaugguuccugaccuccuucuguuuacuaugaugagguaggacaggacuugccuugaugucaucugaagaaagcaucaguuugaacaucgcaugagcgacuacugucuacacaaaagaugaucagaaugaggggguggaacggggauggcuaagucugagucuggccauguggggaacccccuauugacugccugcccacacagcccagagaaacggggcucccagcaaacuggggggccuccuuggggauguuaauucuagugcagggacuggucacgagauaacuggggugccaguggagauccugccucuggagggggccagaugguucuggaaaggugccugagagacugggcgugggcgggaggaagagcugcuaugacaggagacagcuucuccucacccugaggggaagggccggagggaacagaaccuucucugccagcccguucugcacaggggcguguucugcaggcccaccuuuuuuguuuguuugguuuuucgagacaggguuucucuguguagcccuggcuguccuggaacucacucuguagaccaggcuggccucgaacucagaaauccaccugccucugacucccaagagcugggauuaaaggcgugugccaccacugcaugcccaucuuaaaagagacagggcugucccugccuguagcugagcaccagagggcacccugcuugccugccugagugguccugaggucugugggggcuuuuccacagggcuuggaggcugcggacagcgaccccagcgugccucccuacgacacagcucucaucuaugacuacgagggagauggcucuguggcagggacgcugagcuccauucuguccagccugggagaugaagaccaggacuaugacuaccuccgggacuggggaccccgcuuugcucggcuggcggacauguauggacaucagugagagccagggccaagggcagaugugcuguguggauacgcccacuuggcccaacuaaggggcucucucuugggaugugcacccagaaauccuaugagggucaacagcauggcccauccuuggcuccauggcagauaaacucaaggaggucaucucugugagguccaagagaggacugagucaggaguggugggagaaucuggagcauggacuaggcagcuagagggagcacuguccuggcagagugcagaagccacccuuagucgcccugcuagggcucaucccaucuuugauucccaguugugacucuugccucuguaugaaaagcaggcgucuaaagaguggauuucaauuaaaagcauacuauuugguggaucacaggugcccagugccacucucaccacagaggguguaguggccccugucccaggccuagccuugggagggaccucagggcccucugcucagcacaguuggugggagugagaggcaggcacaggacuggugaggucagaaugugcauauguguuacauguaugggaggagagguaugaaugaggccccccuaagccccaggucuagacagaggccuaaggucuaccuuuguccucaucugagugggucuggccauggaggagaccaggcaccccucacuuucccugcuuccucugguuuccaguguccuuggggaugaugugucugcccuggugugaguuaccccagcuccaagcaucucaagugcuugguggaguccuuuguccugguuuauagggggccccaggugggaacugugauucugggaauggggccagacaggggguaauggaagaagaggguguccuucacagugggugacuccagccgugacuguguggcaguaguagaauuccaugcaggaugacagcuagggaagcaaggaccauguguuuucuauugugugagagguguccccuugggaaaggccacuagcuuacagcuggugggcuagaugacacacuacagucugaaugucacugggcaaccccaaggacagaauucaacagagcccaugauugggcucaaggaaaacaaaugaaaaacuggggugcacgcacccuagaaaacauucugcucuucucaccacaaaaccagaaggugauuuugccuuggcaucuugccauccugcggggcuuccccgcucuuccauggaaagcuucuauggccugugccgccuucccugauccuaagccugagggccaucucuguucacaugaagggggagggcagugcagaggaccagcugaggguaaauggaagaaccacagaccuaggggaugggagggccagaguccuguccgcuccagacugcuaagcagcccguggcucagccucagcuacaggaugagcacagcuaucgauugggaagcuaggaggagccuugggacagugugguccauccaggcaucccuggggacaagagacaggcgauuccaggcucugccaggcuucacccugguuacucagagcccucucgccuugggguagccaucccucucugggaacauuccuuccaagccccacccuucucccaggacagucuaguuggaggcuaccugaugccagcccagugcagaggggugcuuccugauucaaggugacagugugcgccucucucugugcuccgaugcuucccacacacuguccuacugcaagucccaccaccaaugacugcagcaccugugcacugucccugcuaaccucugacccaucaucccugcccuguaccuugugccuagggacaaguguucuagguccaaaccagguccuucuacuuaauccugucacagaagauccucuuugcccucagcucucugcaccucaguucccaugucuuaguuacucguucaaauuucugggcagagacaccaugaccaaggcagcuuucuuauacuuucagagaguuaguucaugaucaccauggugggaagcauggcagaggugggcgggcaguggaacaguagccaagagcucacaucugaucagcaaauuagaaggagagagagaaagagagaaagagagagagagagagagagagagagagcauggcuaggccugauguggguuuuugaaaccccaaagccccccccacugacacaccuucuccaaaaacagccuucuaauccuuccgaaacaguucaccaauugggaaccauucaaauauaugagcuucugggggccacccucauaaguuguauaugggaguguuccuucuuauuuauuuuuaaauacaugauuuguuauuucaagagcaacuccagaaaccaggcaggcuggacucagggcuuuucugcucuagaggccaagguccuugcugaccugggucuccugucucucuuuucugggucucugccucuucaggccuaaaauaaguagugcuaggccaagccaggcagugguggcccaugccuuuaaucccagcacuuaggaaguagaggcaggcggauuucugaguucaaggcuagccuggucuacaggcuagccagggcuacacagagaaaccacccccgaccccuguccaaaggaaaaagaaacaaguagugccaggcaaguuuauuucaacguucagucacucgugaagcagacagggcucaggugauuccuggacgggagggcagggccaguuagggcagguauuggcgccccugacaggucucacggagauguggccacugcacaacuuccguccagcccaguggcugugagaucaaggcuucuaaaggagaccggaagugaggcaggaaguagguguuagcccgaggguagggaggcuggagcuuggcuuaaaaggccugcugccccuucccuuucuuucacccggaccacuaagacugcuucuggcucacaguucuuacagccccgugccagggcaccucaugauggacaauucucuuuugguaugacccuuagccugaaacgaccaggucauuccaucagucaaagccaccuccugccauggaauuccaguguuagcagcaccagcccaaacacagguggcucaaaacugcacacaguauggcguccagggccucacuaaccccacccaccugcuucaacagguagccuagaucucuuccggggcccaccaaccugccagccauaggccugaugggagagccagccugucccaagccugucauugacuacccaggggcagccugagacaaacaggagcgucccaugagaacccuagcaagacaccccagcagacagagggcaagggacccagggggccguggagaagaaagcaggcugguucacuguucuagaucaggugugccugguugaccaaacugcagaaggccaggucgguacaugauaggggcgggaggguuguggggacaagagcggcccagagccaccaggaguccgaauagggcugagccccuagccaaaccucaaggaagccaaauuccugcgcacagggcggggacggugggcgggccucgaaaagaggaacccuucugagggaggggccaggggccaggaagcgcggaggucacccggggcggagccggugcaggcggucggacccaggugucugcggccuaagcagccagcugaugcucgcugggcucgaguccacagauggcugccaggccuggccuucucaccaaggcgucccagcagccgggcccuggguggaaggaaggugcugucaagcuggucuucaggucgucuggccucucucaccgcaggcggcgucacugcgcuggggcggcgccaggguuccuaggcgagggacaggcagguaagguuaaggcuguagccucaagcgcucgcucucuggcugcauuuccgagguuagcauucuguggguuucucauugauucguuauuugugcgcgauggacgggcuuuggguuuucaugaacacgauugacagguuucguauuggacguauuaauuuguuucuuugucggguuucucaguguagaccuggcugaugucaaacucacucuguaaaucaggcucgccuggaauucagagacccaccugccucugccucucuaaugcugggauuaaaggcgcguggcgccacugccugccuuuaauuuuuaaaauuuuuuuaauuagguauuuucuucauuuacauuuuaaaugcuaucccaaaagucccccagaccccccccccacuccccuacccacccacucccacuucuuggcccuggcguaccccucguacugaggcauauaaaguuugcaagaccaaggggccucucuucccaaugauggccgacuaggccaucuucugauacauaugcagcuagagacacgagccgccuuuaauuuuuaaaaguugaaguaggaucacaauucuaggcuguagcucaggguggauaagcauugccuaacgagaguuaugaccuaacucgagaaccccagcauucugacaaaggaaaaaaauggggguguacauuugcacugaguaugacugucauaaaaguccaacguaacccuugcuccaguuagcuucacuaccugccuucuugguccucugguuugggggcuucacacgagggaacccuaaauucucaggccuuguguaugaggagucuuuacacaaaacuucaugcaccaaguccacuuaacaccgagucuguacggcugacuaguguccacggaguucacggucuccaguggguggacaucugaguggauccaguuuuguagguuguaguccgcugugauggugcuaauuaucaacuugagaacccagaaucaccuggaaggccaacuucugaacaagcccgagggagauuaucuugauuaugcuaauugagguggaaggacucgccuucggggguggggaggugggaggaggagcuauucucuaggcggggcuccggacugugggaggguggagaaagugugcauugagcacacugcauuaucuauugcucuuuucuggagugugguggucagcugcuucacgcuccugucccugugacccucccugccaugacacugugggccaaacaagcccaccuucccuuaaguugcacccuucggguauuuucuugcagcaacagaaacaaaaagaaagcagcuuugccacgagcuucugaguacagguauucacugcaggguuuuuuccauguauucugaguaucaucuggguagugguggcggcaaauaugagcuuucuguucaggucuuaugaaauauuucccuuuuugggaaugcaggaucucuguagcccaggcggcccuguguagccauggauccuucugcccaagugggaauguugggauuuuggguguguagugccacaccccauuuacguacacuggcucuaccaagagaacuaaauucucggcucucuuaucuuuuuaaagaguaauuuuggccuuugaaaacugaugucuaaguauauguuccuaaaacuaccuuuucuuguggggcuuaacuguuuuggguuuuuuagcuauucagucaauuuuaaaaagaaaaugaucgcaucuaucuauuugugugcggaggcgcgugccuugguucaggggggucagaggacaacuuucaggaauugguucuguccuucuaagauguggguucuaggaauggaguucaggucuuugggguugggggcaagcgccuuuaccagcugagcuaucugccaucuugugucucuauguagcccuggcugucuuggagcugccuaggcuggccuggaacucaugacggagaucugccucugcuucccaagugcugggaucaaaggcgugcgccaccacugcccggcaucaaaugccuuuaaucuggggaggcagaggcaggcagauuucugaguucaaggccagccuggucuacauagugagcucuaggauagccagggcuacacagacaaaacccugucuggggagagggggaaggggggagggagaaauggggggaaugaagggaaggugggcgagggaggaggggggaagacauuugauagcaggcucagucuucccccucuuaucuccggauucucuccugccacugucaccuugaguuuugucaccuugagucuuuucaggcuuccagcucaacacagcccaguccuuggccuugaauggagaguuuaaucuuuuuagcuacugcugagagcagauuucugccauuacacuauuuucuguccgggaugguuugguuuucauuuccugaauuaccaucuuuuuuuauuacacuuuuucuugcagugaaacaaaagcguuuaguuccuuuuuuacgucuuuuuauuuacaaccugucacuauuuucuuugagguuaccauggagguuuuucuuccuuugagcuagugucugccacaugcugugggccaggcuggcaucugauacagacuccuccuccagccuccugagugcuggcacugcaggugugagcugucaccggggcuggagcugagcaggagucagagguguuaacguucuacucuggauuuaaagcagucaccagguagcuccugcugcaaagcuucaguuauggauaucgaaagauuauaucuuuauugauugugugcucauaaauauaaaccaauuaaguacacuagucucuuaaauuagguaggaagcaaaauuuggagucacaaaauaaauuacacggugaaugcuuguuuuucuuuugaaaguauuaguuuccuaaauuaugagaauaaaacacgaugaggccacaagccuucucuugggacuugcagguuuuuggcagaugaggaacugcuaaguaguugccucucagguucuguuuagucugggaaauggauucuugaugccuuccacucugccauuucccagaaccucgugcagucucucccugucccuaauguauccaguuccuuacagauuggaccuugguguuguuucuagaucacugucaagcccagggucaggacaucuauguauuauuacccuguguuauuuuaugugucuuuacaauguuuuguuuugaacauaccuuuuucgguuuguuuuaugggcauguuuugcuugcauguguguguaugaaucccaugaguguuuggugcacaucagcagagugcauuggauccauuggaccuggagcaguggaugucugugagcagcauccgggugcuaggaguuuaagcgagguccucuggaagagcagcgagugcucuugaugaaccaucuucuauguuuccagccuuuugggcaucagggggauucugaaacgguuucacuguguagcccuggcugucuuggaacucacucuguagaccaggccggccucaaacucacagauccaccugccccugccucccgagggauuaaaggugugugccaccaccaccaggcuauaaaaguaauuuaaaaaaaaacuuuuaauuuaaaacuuuuuagcuagucugguagcaaacaccuuuuaaucccagcaugagggaggcuacaguagaaucucagugaauggaagccuggccaaccuggucuacacaggaaguucccggccaguugucuccucuuugacccuggaguuacuucugaguguagugcuuaagcugaaguccuuugagaguuuucaucuaucuacuuguuauuucuacuuuaaucccauuguagucuaagaacagaccaggcaugauucccuugacauuuguuaagguaggaauguguucuuccacacccuccaugugggccugaggagcuguguuugcaguuaaagggaucuguagagucagcccauccaggagguugugggcgcugcuuacaucgggaugccauuauuggcuuucagccugcaggacuguuucuguguguuguuccucccucccucccuccccuaccucccucccucccucccuucccucccaucccucccaccccuguucuuccuuuccuguguagccgagauucaccucaauuccugcucuuucugccucugagacccugggguuacagaggagcaccucaccccccacugcaacuguuucugcuggugcugaugucugaugucugcuucuccuagugcucgcucacuuucuugcuuucucucaauccacucccuuccuugucuugaugggagucuuuuauuuaucuugagucagugucuuauacuguagcugaggcuagccccagaguuguagcaauccuacugccucuguuucuagauuugaaaauacagaugagagccacccacuguucuuggcuuuguugucaauggggucuucuuacauauugcccagauuggcccuaaacaugaagcgaccuuccugccccugcccccuguguacugggaucacaggccacaucacaaagccuugaccaguugaguuuuacagcguuuaugugcuccguguccuuugugccaccccaugucugguuuuaaucaauuugacugcuaaggaaagacaggaauguauaagcaguggagccugaccugagcccugagccccauacuccagaauaguucccagggaccaggccucuggccccaagaacugcaugcaguccacaccaagacucaugcucucacagugggacucccuugcaugccugugagauggggacaaggugcggcgugggggugggguggggggcauggaagguuggagagcgaggacacuaaggcugcacagaaacuguuuaucauccuaacguuuccuugagcguggguugagacggggucuugcuaugaagcccuagcuggccucaaacccauagcaacccccugcuuugaucugagugcuggggcuuuggcuguguacccugagaauuggugguuuuccuuucgccuuucuuuagugcagaccggcauuuuuguuuucuuuaaaccuuaaauuuccuaaugcauuguacauaugcaauauauacaauauaauguaugcaugucuguauggguguauauaauguauauaauauaauguaugcaugucuguauggguguaugcccaauguaggguuuucugcgaccuccaaaagagccuggcaaguccuuuggagcuggagcuucaggcagaugcgagcucacauccuuuucugggaacuaaauuuuggguccuuuggaggagcacaaguggucuuagcuacugagccaucucucuggccccagaccugaauuucugagucuccucucucccggaucccuaggccucgugcaaacuauccacagacuuagacaccgccuuagccugacccguguuuuucuaaagaaugucuaauauuccuuguggggaggcauucaagacaaauuccuucaguucagcuuuuuuccauuuccucccuuccuuccuuucuuucuuucuuucuuucuuucuuucuuucuuucuuucuuucuuucuuucuuucuuucuuugauauuaucuauuauuauaucugauuacaccguugcugucuucagaugcaccagaagagggcgucagaucucauuacggaugguugugaggcaccgugugguuguugggauuugaacucaggaccuucagaagagcagucggugcucuuaaccacugagccaucucuccagccccccauuuccccuuucuuaaauagagcaaaccuuacagaaaucugcuugccucugcccugggugcuggguuacaggugugcaccaccccaacuggcugcccuucaccuuggagaguaagguucccggggccaggucuccggaauaaugguuucugugcuccuuugcuuugcucccucccugucugcugagauggauagcauucuuaccauuguuucucccuaagaacagcuucuuucaggauuucuguacuuuaaaaaugguaugcccagaggcuggggagaggcucagugggcaaagugccugccagcaguguaagagugagaacccggccaggcgugguggcgcaugccuuuaguccuagcgcucaggaaaagaggcaggcagaucucuggauuugaggucuacacagugaguuccaggacagccagggcuacauaauccaaaucaaagcaaacaaaaagggugaugucacggucggagguaaaggacaggugggaaugagagccugcagucccagcacucaggaaggggaggacagcgauccuggagcaagauggcuacuuaagacuuaagggagagccugcucaaugucuaaucaaggaagacacugaugacagagcucuggccuccuguaugcaucuuaaugagggcuacuccugcugugaugaaacaccaggacuugagaaaaguguuggguuuuguuuacgcuuccacaucaugguuuaucacuaaaggaagucagggcaggagccuggaggcaggagcugaugcagaggucaugagggaggaugcuccucaugaugugcugaccuuguuuacuuaagaguucccagaaccaccagcucagggguggcacugcccacggugggccccgguuccacaucagucacuaguaaggaaaugcccucuaggcaccuuuuccaaucaggguucccuccucuucaaugacuuuggcuugugucaaguugacaaaaccagucagcacaacaugcaugcacacacacacacacacacacacacacacacacacacaucacucuuacacauguaugaguacauuccugugugcaucugcaucaggauacacacaaacacacauuucugcauauguauacagauguacaauccuauauauuuguacauacauacaaguguaugcacauauguguacaucugagcacacauaggcacauaccuauaaacauacauacaccaacauagguacauaccugugcaucuguauauacauguacaugcuuguaugaugguagauacacuaacauguguauuccuauggauccauaccuacuaacauauauucaccugugcauuugcacauacguacauacauacauauacacacauacauacauuaacacaucuaacucccauggauccacacacucuacaacacaucuacaaaucuauacaucuauaugcacacaaaaugugcacacuguauaucugcacagguccugacauaugcauacaucuauagaucuguacacgcaucuacacacaugaagguaccuacgcaccuguuaauaucauguauucugcagguuauaacaaccacauggcacgcaucaagguauuuguccagauauaccacacuuuugcaugggcacacacauacauacagacaagcucaugaaccagacuugaagaggggcacaguagcagaacugguacacuaaccaguccuguuuuccucaccuucugcauugugguguagccuguucccucaccucuccuucuacaaugucaccuggccugucauguaugggcccaacguauguuaacacacauagacacaaacacauaggaucauggcacacacuacugccccagcccggaagagacaaagacagguuuccugggcuuguugucagacagccuagaugagucacagagccccaggcuagugagagucucaaaaaaacaaggugggggcuggagagauggcucagugguuaagagcacuggcugcucuuccagaggauccagguucaauucccagcaccaacacggcagcucacaacugucuguaacuccuguuucaggggaucugacauacauucaguuaaaauacuaguguacauaaaauuuuaaaaaguuauuacaaaaaaaaaaaaaaaacaaaaacccaggguggauggagcugaagagacgguggcugagcggucaagagcacaggcugcucagcuucugucuagcccuagcuccaggggaucugauaccccuggccuacagaggcacauuauucuauacucaccccaacacacacacacacacacacacagagaaagagaaagagagacagacagacaguaugcucaaauacuaaaacaaguauauaggugggccuuauuuuacuguuggauuguucaguuuuaaaaucuccauuuguagcugggcuuggugauacaugccuuuaaucccagcacucgggaggcagaggcagguggauuucugaguuggaggccagccuggucuacaaagugaguuccaggacagccagggcucuacagagaaacccugucuugaaaaaccaaaaccaaccaaacaaacaaaaaucuccauuugugucuuugguguuuuugagauggcuucaaucuucugacugcccaccuccucccucuggcauugcagguacacaucgccaggccugauuucugggucugcagcaagcacuugaccagcugggcuacagucccugcccuguuuguuuguuuguuuguuuguuuuuuuuuuuuugaggcaggguuuugcuucuuagccaagguugaguuuugaacuuacugcauggcccagggaggccucagacuuguagccacccucuggccucagucucuccggggcuggggucacaguugguaagccaccgugugguacaugccaggcagcccugcggguauucuuugugauuucuguuucuuucacagcaugucuguauuggacaguuagcuugcuucugugaggcuuguguaacaguugcuuuaauguuuuggugggugcugccucugacacugccgcugaggugagcccugggucuuguuuacaaacucugaguucuugugaguccccacugccugcacccccaagguuagucuggcuuucagacuauuguaucugcucuuguuugguacuggggauggaaacggggggggggggggggcggugucucaaguacaccaggcaggggacacugccaagccguacuucuaugucucagcucagcucucacacccauuaugcucaggcugaacccgaggcaaccucaugugcucccucacugugcagauguguaggcugggccaucagcacaaaugagcugagaccuuuggcucuucuugcccucuccccggacucccuuuuggccaucuaaguaauguaaguguagucucuaacacuacacuucaccagucuuuaggaccacagcaaaaggcauggcagaguuaccuggucuugagcacuucugaacugggccauucucccucaggcuguucccuugugacuugcucgcuaaggaaaugggcugcuuaggaggagaauggcaaucucaugcugcccagucacccggggucaucggaggguaaggcugugaccuggggucaucagaggguaaggcugugucccggggucaucggaguagaaggcuguguaucuuaagccuucuacguuuguugagacugacuucuggccuauuggccuguucacggagaguagcccacacacagugaacaguagacaguuuuugugugcugcauggacagcagggagagccgauugauuugcggugaugacuuccugccugucugacccauuuagggaagguggggaugcuaacaucucccccugaaaagcagaucuguuguuaacagucaaggcgguucuuuaucuaccuagaacuguccuuuaauuucuucauuucagagggacagcuuuucagccaugcuucucucacugugggaggccaggcagcugcccagaccuucauggcucugcaacagugcuggcugaccuggaguccuucuguggcugcucucuuaugcuuugacacuaucaguuuauguugauugagcuuaauuucaacaaacuuaggcaacuucugaccauuguuucuucauuuuugcucuccugggucuccucagguacugcacacugccuuggcaucugcagaacacaggcuugcuuccccucaagucuuuaucguuucucagauuugaauaucucagugauccacuucccagcgcucuaacuaccaacugcuauucaacuacuucacuagguaucagggucauugcuuuaaaacaacuuauuuggucuggcuggugagacacuguguuuguaucaccagcccuguuaauucuuuagacaugauguccuuuguucuucgaacuacacucauaaguuuguuuuuggucucugucugcuaagaucagugucuuguccccaggguuucugcucagcggcagacggguuacaaugcuacuucagacuucauuugcuacuugcauaaggguccucagaugccucuugggcacuccagccuucucugccuauuaugugucuauuaaagcuuccaggaugcccguggcagaccauaguccgcauccggcucaaguguccuuggguugaggguguuucugagcagugcuguggggagaaaagggaaucccuuugaaggccaggccaggccaggccagguugagucaaaccaguguaauaguugcuuuuccggggagcugucagguacaggggacuccucuccgcugguuccacggcgauucucaaggugccagagccaaagggguguggaggaggagagccucagucuccauccagugcuaccuucuugugugagcagagccuugggagguaacuucugaagccuaagccugacaaaucucaccgcacacuucugcuaaguaccaggagcuuuggucuggaugcacuuugaugagucuaaaucuuagcauuuucugucaaacuaauauuccuuacuuuuuuuuuuuuucuuuucuuuugguuuuucgagacaggguuucucugcauagcccuggcuguccuggaacucacucuguagaccaggcuggccucaaacucagguaucugccugcuucugccucccgagugcugggauuaaagacgugcaccaccacugcccagcuauuccuuacuuuuucuucucugaauucauuucauguuuugggauuuuggaaaagaaauugcaccgacauuuuuuauuuuauuuuagcccccuguacuguauuucaguauuggugucuugugaaaauggaaaaugaccacuugcaauuuccacacccuaaauaacaagaggugcccaaaacaugauuguggcucagaagcccagucauuccuaguucaaggaccagaauaccaccaggcccagggugcagagcucacuccuguucuaaaugucacacaaauccaaaacaguugcuuuggauaugagugcuauuuuguaguuguucuccaucagagguugucaguugggagggaguuggcagagaccuugcuguguguggagggggaaguggcaugucucaugcugcagucagacaugucagacacgcauuagcuggcuggccauaagccggccacccuccaccaaaugagaacuucagcagccucaagguugagaaacccuguugugugacagcucugaaguggaguaucuccugcugccucuugggucuagaguuucagucuccuccacucugccaugugccuccccugugcucagacaucagcuccuuaggaaagaggagagcuacuuugguucuccagggcaaagcccuaacccagcuccaaaugccaacuggaggaaaugccuggauggaccuuuguccuuaggccagccuaggacccaguagaucuaacccugccucaagagccauccgagugggagagaagcugcccugaguuucuccugagaauuggcacccauuuacaggcugcaggagaguccccauccgugggccaccucuucucuuccucucgugcccucuauccuagcauggcaccuaguccugugugugugugggcacgggugcaugugcacacacaugcuguugaaaacacuguuucugugaugaacauggaucggcagcaucuguacuucagagcuuugaugugcauggaguucuuugcucucugauaaaaggccggaaggccuaagugcuccuuaugugaaguucagcucaguagagcgucucagauggcaggccacugaucacauaugggaaguuucggagacaccaggaguacagucagcucacauggacucagcuucucgggcugguagguaggauguauccccuguaaaugcugucuuuacggcaggcccugacagugauauaccagauuugugcagaguugcaaugaggcuuacgcagagggcugcaauccuugugauggaacuggugacuccauagaugcuuggaaauauggauggugcuuuaauaaaagaagcgggcuuaauaaaacaaaugugggagcccuguugguguuggaaaccuaaaacacagccugaggugucuuggaggcugaaggaggcucugcucuccagcccugucccucuaucuggaauccaaaaugaagugugcagcugcagcccaguaucuguacuuagguaugugugucaguuacuguaagagauauguguguacuuagguaugugugucaguuacuguaagagauauguguguacuuagguaugugugucaguuaccaucccgcccccacaagagagaaccggcuaccugaagggacagugccauguacaaagaacauuuuaauuaauuuauuuauuucuuuacacauaacugaaagugauguuacaguacauaaguuauuuacaacugugcaguaauguguugcaaaauaaauuaucuagaaggcagcaaaaguacauugugaauguauauaaaacuguacagguuugcggauacacucuauaggauuauuggcucuguaguguuucaaguuaccuucucagaaagagaaacaaaaugcccaagauuagagggaaauauacaaaccacguggauuugacuccauuaaaaacacuaucgaagaguccuggcugcgucccuguguccaggcaggcagcagccggacccuugccggcaccaguguccaagccugucccggggaccauggcgggacagcacuuuccugcuucucugaccuggaggucacugcuuaugaagguggacgccuuagucuauuuuccauuaguugaucagaauggaacgaggaauuaaaaacacucugcucugcgacuccucaagugcccugucaucagcuggaagaaaacccagagggcauggcugacacagagccaccuugucuguggccacggucuccuugucccaaggccuggcaaagcucugcagugucugggccuugugcucccacagcaacugguaaaaggagaugcuuucuaccucacugcaucuggaggggagacacacggccaggugcagucucugggcuccucccacuugauggacgcggugcucccuccuccgcugccgggacucaucggcagcacugggcgaccuauguggcccuuguuuguguccugugaccuuccuccgagugucaugcuggcaacaauacgaagucaucguugacgucaaccaugggcacguagaaggauggcaccucauuuacacacagggacuugugcccagcgggguccagcuccugggccuucagcugccacuccauucuuugcacggcauugagggcugcagccucauguugcugccgcaucagcaaacaugucuguggaacauacaaggugagagggacggccaggcccuggcuuccaccacugccuucaggcuucacccacaggaccccaccccgcuucuuagcccagaaccugguuuauccccugaugaagcccagguccucuggguaucagcugugugaggacagggcuagacuugcacccagcagauggaccucccccauucugaccaucagauuggaguaacuguucugugagccuggggugugcgugcgugcgugcgugcgugcgugcgugcgugcgugcgugcguguguguguguguguguguaguaaugacauuuaaaaguguacacagggacuuggauggagugggacauguuuaggacccagugaaucguuugaaacauggcgcagagaguccacccagcucaggguuuuucacguuauaagacugauccugagugaggaagggcaguuauggguacccagcaggcuagacuaugccagugaacacacugcucauaucuaucuguauaaaauaucuauaucuauaaaaugauaaaauugcugggcuaggugcgugacuucugagauugaacccugugagccuccccagcgcggccuugcagagacuucugaauggagaaccccguucaccuuuugcuucuagaagaaacacugaggaucuaucauuucacuaagauuuggccauuuuaucgccuuccuuucaggacuguuuucuuuguuaucaaauauggucaaacuuuaaugucuugucauagucugucucuccuagccggcauuaugcauaaccucaccugggcugaggugugacugagaggugacuccaggaccaaguaagagaaugggaaaacagagaaccaccucagcucugagcccgccugugacaagcacaagagcuucugauucucccaaggucuguagcaccucugaauggaugcagcucuaugcucauuaacgggcuaacucugacaucuuacugucuacggcauguauucgaugacagcuaucaggagauucuggguugauuucccugcaugagaagagaaacugggaccggcgugcuggagucugaugcuacccuacguuuggcuuuagcagcugcaggcguugauuuguguccuccuuaaugaucuaucgcuuucccauccucuguguaaacaccagacaauacucuaagugugggagguagguugugaccucucggggaggcucaggcugggucccgccaggagcugcucccuauaccuggacaaaagggaagacacuauagaccuagugugggaaccuccacagagcaccugaggcgagcgagcacucaccuucaugcggucguacuugucgucgacguccugaagccaggagaugaacuggcgggcauugaagcggucucgcacagacuuguucucaucccccugcggggucaauagggaccgugagggugagaccuuugaugagcgguucuguccuuuguccaucagagaacacuagggcgaccucauccuagcaacacgugcuucaacccucuguucuugcccuugcggauuccuagguacuggaggccguagacucagccucugacccaccaagagaugaggcuguugauaguuugcauggcaggacugcgugggaggccacuuuccuaugcauagaauguggccuccauuuuaccggugugcuuuaauguauuuuuucugcuuugaaaagcacaguugagaagucugugguggaaacaggggucuugugucaacuggggucaguuuccuuacuaucucccucuucauggagugagguuugauuuucaucacaggaagccuugaaccaaguuuaauguugccucacaaaggggagaacuuggagcugggauggacgcaucugacaaugccggcugacaugccugcauacugggggcaaggcaugguagaaacguuguguaguuguuggcccagaaccuguggucaauaucuaguguauuccaggagggaugaggaugcaggcaggaaucccuugccuuuuccuuuaaaaacaacucaggaaacugcuugaaaauuauagaccuuacaaacaaucacuuaucugcaucgguuugcugauguagaagaguaucuuaugugcuagcauguuaguauacaucuguauaaaccagcacuuaggagugggaggcagaauuaagaguucaaagcuggcccaggguacaugagacugucucuaaaaagaauaccuguuauuaaccugugaaaaauggggaaaguacguguguccuuuucccccauguguaagaaugcuaauggacugaaagagauuuuaauccaaguuuacucaauuaugcuguacauggcaaggggccuauagagcucccauggucucaacagccaggauggaacagguuauaagcagcuacaugcucaacagggacacagcccaggaauaagucuaagugcuaugagguuucuacagaggacagagagagaauaguguguaaagaacgugauggccugugugugacauccuggcagagucagggagauggugggacugugcucagugacaggauggggcaggaaugcaguucaggcacuggaacgcuguucuggcauuuggcuccaacuguacuacauaaaaccaacuucccaacagaaugaagcuaagagccucugcagccucccucacaggaacacugguccuguggcccuaaugucuuguugcuacaauuauugaccaaucauggucacuaacauagcagcucugguuaccuguagcucacgauggggcugccaucagaccugcagccagggagaggagggaggaugcuauccauccuacuugcaugcacaguugucucagagacucuguaggcuugagggcuuuguccgugacauuacugugccuucugaggcacauuggggcuagguccccacagcagucaugagcagggugggcagaguuuggauacaugggagcagauguacuggugggggucacugaccuggcuuuccagaggcauguuguagaccucggaguccaagagcauugugcaugcacugaauggcacugccugguuggcaaugguccuggcugcccggcaaugaacccgaagaaucucuugcucacaggacacaaucagcuucuccugaaggaggagaggaacagguaagcuuaagauccuugccagcaugcccccuacccgaggcuccacuuacccucucgaugcugugcugcaggcgcagcuuaccccgcacagccucuuguugcuugaacagcuccuucaggggcucagcuagagagggagggggugcaaucugcaaauauaaggcaaaagggguaagccaugauaaacauauuaaaaacugugaacauguuaaccccacaccuagaaacuuguguuagucugacgguuaccuggaaccaccacagagcagagcugcacgugaacccuacaaguaaauaauggcaggaaaggcacaagcagcugggucagguguacgcaccuaugccaaaggagcacugugggagcguggggaucuugagugaacagggugcauucaguggagaugugcauguagaauccugaaccaaggcuggaugucuuggggugagggugcaggcuaaacaaccaugauugguuaaagcaaugaggggaaccuucccaucauaucccuauggcccuguggaagugucucccagggcaaguaaauacaccagagacaaugaggagaggacaugucugcggugguccguauggagucagacuuccaaggcagacacagagagguggguugaacuguguaaaucauuuuuguugucucuaucacuaugcaucggaggaggagcaugcagcggcggggaugggcagcacauguagcucccugugaggcucaaagagaagugacaacacacacacacacacacacacacacacacacagaggaaacuccauccuuagaggugcuggggacaaagcaggaaagccugggcagcaggcagugcuacagagugacuguggcaggcaggacccaccugagguuugaauagcucacaggcuuuucacuaaggcucagcaggaaggccuggagagcagccucccucccaguggcccacauggcagaacucucacccuacauggcaggcaaggaugaugccugagaggcuugggaggcucugaggcucaucccuaacagcucacauagacuagcaagauggcuccgcaaguaaaggcaccugacaccaaaccuaccgacuagggcaggaguguucacaggccucaauaagccugucuuccaagacaaguuccuaguggggcaaggagaccaggcaggacacugaccuaucacagggaggaguacuuaguccaggagcagaguaugggaggagacugcgcacuccuguggcugcugaccuagugaagccagccccgagucuugccugcuucacucaagggugugucgaugcuaagagacuguggggaggcacacagagcacugacuuaucacucuguuauuacuuugggcuuuuuggaauguaauaggguaggcaacaaagggucugucuggcccugcaugucagaauuccagguaggggagguucugggaucaagcuagcuguaccgauauguuccaaggugaaccaaaugagccccacccuccuuugcccauguguguauuuucugccuaggcagaggucagcaugaccguucccuuggacaaacccuuacacuguagcaaugauggcgagucucuccaagucagggaggaacaaacaagggagcuggcuacaaaauccagcuguguagaaaggaagcugcuugcagugaggugaaaagggauuccugaaauaggacagcacuauguggcugugugaaagaaaaggccaguucugagguccgaggagaaggucagaagaaguuguuuguauggucaagcgggaugugcuauguaugggacgacccugcugaagggacuaaggacagcccugccaggcagaacagcagccacugaugucuuaaaaugaacuccaaugaaggaauggaggcuccagaauggcagugagacccaagaaccaugccaggugaaggugggaacggggagggagacaaggcagcugagggccuuucauugugaaagaggagaaaaagagccagcaggaaaagugcagagaccacuggggugggaggaggguguacauaacgaagggcuagcuagaggaacugacccucaaacaggacaagaaugucacugccuccugaccacacugcucucugcucguuauugcccugcugccgggugcuuguggagacagagcccauggcacucaccacagggaugugcagcuugcugaggggcuugccguccaggagguaggaccccguguaggugacauacuccgcguagcacuggggugccugcggcgugaugcagcagaggaucuuucgcuucucuucgaucuucuuccggauuugaagguacucaaaguagggauuggaccugucacugugguagggcucaauggcauccagcuuuauggcauccacaauggcugccagcgucugcuggauaaccucccgggucugcuguguggauguguucagcugcugcugcagcugcugacuagaccgcuggaagcgccgcuugcggggauguugggccugggcaucuuccuccucagaggcucgacccuuggcucuagaggcuggggugggcauuggguccuucucugcugcagguaugcccugcuugcucuggcuugccagcaucugggcacgguuccuggucauacgcugaggaacuucuuccaccuugggggccuuagggaccucagauguaggcuugggcucuggaucuguagcuucugcuugaacguugccugggggccccucggccgcagccacaacacaggaggccucugcacuguugugugccugugccaagccaucugugguggguccaucaggugcacagcagggaguggcagaaggaucuucaguuucagcuucuucaucgccaccucccggaggcugcuguugagggggacugggugcuggcaccgaauuggagauugaggcuucaggggcacugucgucugcuaggaccucuguuuccacuguagcuucuagaaccacauccagcuuuggcuccucugagggcucgggcucuguggagagcugaggcgaugcuuccugaggcgguggggcugguggcuccucagcugcuggggcagggacauccccuccgccgagaacccccguggggccuggagggcucuccgccggaggaacaggacuggccuuugcggcuucugccucaacaucugaagcaucuuuggccuggagaggaagcucuggcagugagaagggccccaggucgaggucauccucagggcugguaaaggcuucaugccaugagacugguuccaccuggcugaggguagauaugcuaggauugcugucuaggaagcugcucuccaggggucccagagccucuaccugagccacagcaguaacacccguagguucaggggcuguguccaggggugcaucugggugugacuugcaguugcugaaaaacgacuccagccuagcaggagcagcauaaggagcagccccuucugcagcagagauggccacugggauugcuccugucccaccgucuuugacuucuucuagggcuggcucaggggccggcaaaggguaagauccuggagagacaggguaggugggcucugcagcacuguaggguccuggggugguggaauggagggauucuccagggcaaaaauguuuuggggauucugcaaaccucuguggagacuuuagcauaagcucagagccaacaggccagcugacaggguuuucagaggcacuggcaauaagggaggaggaagacaggcccugcucagcagcgguguguguccacucaacagguuccuccgugaugacuguggugaagggacccucauccagaggcuccagauagcugggcuccugggggaggauggcagcuguggccugcugguccucuguggcauccagagguaggccuagaucugggggcagggucccuucaauggcugggcucagcaguucaccucuaggggaaggggaagacuuuggugguagauuggagaagacgcugucugggggugguguggcacugaccacagcuguugguggacaguguaacguguccaccuugggcgaggggauaccauagucuggggaguaguagccaggggacaggcaggcaaacuuuucugcaggaacggguggcagaggagcuuucucuuccagcaagugcuguacuggggagucaaaacuagagggcgcagggacacucugcugccugaacagcuuguccccagcacugaacuccuccucggguguccuucugauauccacagauaucgagcgauaaagguuuguggagauaggccuggugggugucuggccugcugcguuuucugagaccacacuggaagccacagaaaaccugucaaaaaagggcggcgagcaggcgcugguggacgcgguggagacgggcaucgagugcugggagucggugcagucgaacaccaggucgggguaaucgucagcacugcaggacgggguucugggugugugcaucaccucuucguagcuggggcacgacacuacugaggugggcgugggcaccccagugggucggcucugcucagugcggggugaagcagggagaaccuccuucaggggcuguccagacagccagucuuuggacucuguacccgguccagaguguggcuugcuuucacccguggucagcgugggagccggcuccuugaccuuuuuguccagccccagagccuucuuggaaggaaaguccaggcucuucuugcgcccguccuccgugggcuucuucucuuugagcuuggggucuccagaccgaugccgcaucuucuccaucugcuucaugcgcuccuugugucgcuugugccgcuccucaaucucgaggucuuucugggacagcauccucucaaaacuugucaucaugaggucgccaucucccaggagcuucucccggggucugcugucuuucuugccggagucucuggauggcacaaguuugucguucccguugcucaucuuuauggagucgcccuuuucucgcucuguguucuccuugaacuuuuccuucagcuuagucucgcugaguuucaggcuuuccucccuggacuucuccuugaaggaguugggaggguuguccuugucuuuggcugcaggcuuuggcucguccuuguggugucucaggaagccguccacaugcuugucccugugucucuccuucuccucccuccaucucucccuguguuuuucucucuucuucuucuccuuuaagaugcugauggcacucgagccguacggcuuuaacuccuucucuauccucuuggcaggcucucguucaggaucacuccugucuuucuuuucugaggagaacaacucaauggccuuauccagcuccuccuccacgucagcuuuugugggguaagaaaccccguaagucucugcauccaggaagucuuucucgaacuggcuggcauccuuccugacgcugcugaugcuguccuuguagucuucgcucuucuccuucuuuucugccuuuuccuucuuggcucuuucacgcucguggcuuuucuuagaggaggaagaggaaugccgaugccucuccuucucccucaguuucucggagaggcaggcacugucccuggccuuguccucugcugggggcucagagaaggagacuuccaggagcgugcucaggcugggcuccuggccgugguccgcaaagcuguccgaggagaccucgcugaucuugucguuggaguccucccgguagucgugcagagccucuuccuccagcuucuccagcaggcucuucucgacaucggggccucgggaaggcuuccgcucccucucccgggagugcuccuucucuggcuucuccuuguguuuacucuucaccuuguccucagcgaagugcuucuucucuaccuuuucggggagcuucuguuuguuuuucuuuucuggggcagagucagccgaggcucgcucuuuccuguccuuguaucucucugcacacuccuugucuuucuuuucuuugugcuucucaaagaucuuuuccauuuuuuccuucuuguccuuuccuccuuccgaagcuccucuguccuucuucuuuuccuugggcucuuugucucuuggcuucucugugugcugccugucagaagaggacuuccggugccuguccgagggguguucucguccuuccuccuuuucugggaggccguccacucgcugggugucgcuggccucuguggccuugaagcugccggccacgcaaucguccuucucguccucgcucucaucugugaaaaugucugcaauguaccagcucuucuccuuccccuuccugucauccuuucucucugagaagucuucugagaugaugcuagagaacaccuucuccuucuucucucucaguuggucaaaggaugcuuuucugucuuugcuguguaugucuuuaugcuuuuccuugccgucuuucuucucuuuaaagcauuuuucaaauucuuugucuuucugacacuugucaaggguggacuugucacuucucucccucucgcuggacuucucuuuguacuugucugcccugcccuuuuccuuccuuuccuuuuccagggcauccuuuuucuccuuuucccgcgcugcauggggccguucccagggcuccagguucuuggggaagucacagucugacuuguccuugaagcugcucucgaacccacacuccuuuagguccucccugugcacuucuucagaccgaauccgcccaucccuccugucccggcccccuucugcagacucucgccuuuucuugucuuucucagaaagauagcuagggaugcuuuuaugcuuuuccguuuggucucuccuuuucucagaauucuugucuagacagucccugucucucuuucggaagaaagagucuuuaaaaucucgcuucucccggauuuuguugucgcgcuucuuuuccuuacugucuucuuugacaguuuccaggauaaguuuggccaccgagucauucuugaugucucuauagucuguuacugagucccagcuguccucuccuuugaaaucaaaagaggaaucagacaggucagaaaaccaccucucuuguuggucaucagagaggcugaacuugguguccucaugguccagaaacugacuuuuguuacaauagucaucaaaggcagcguccucccuguacagcuuuuccuuuuugaguuucucuuuguccucuuugaaggccuucuccuucuccuuggagagcuuguccucuuucaugucauucuuccuuucgagucuggaagcucggucuuuggacuuuuucuuccuuuccucuuuguacagucugagcuuuucuuccuucggggacuuguccuucguggcccucucccucucugcuuugcuggcacggucuuugucuucccggaaggcucugcucaugucuuuguuggcauccuugauucucuucagcaccuucucauccuuaaagagccaguccuuauccuccggcuucauccuaccgagcuuaucuucuuucuuaaggugcucucugucguguuucaauaccuucagcuuauucucaguggagaggucacucucuaaaaggauggccuuaucugacuuuugcuuggaguccucauauucguagguaaagcuuuucaguuuaaguucuuggcugacggaacacugucccuucuccuuguguuuguguuuguguuugguuuuguguuuuuugacuaccuucccuuccuuguccagcuuggggacagcgccauccguacagggguggaaggagcuccucuucucugacggcgcgcucugcaggacaccccuuuuucgguguuccugcuuccuucucguaggcuucagagauuccacacuagagcccucggaggagcagucagacucacuggucagucccguccuugaggagucugacaaagaacucaccucagaccaggcuggagaagaaauggcuuuccaauugucagugcgccagugcuucgugugcuggucgguguggccggagccgugcuucugggccacagcgcuaccaugagaugagguggaggaggcagacagugagcugaacagggaaggguccuucagcaccagcggggaccccuugaggcagccugagcuccccacagaguccccgucguccuccucgcucucugaggacucacuuucugacccagaggaacagaacuugucacuccucuuuccaaaccgaacuucuuuccccuucguuucuuucuuucgcuucuuuuucaauuuauucuuuucuuuuugcugccuagaacuagaagacucucgugccuuacuaccagggagcauugugugugcugacagccucaguuucucuccagccccuauggaaacacucacguccuccucgucggaugugucugacaggaugcgaugggccgccuucuuuggugcaagcguguuguuuuuugaguagcucuucacuuccaucuuggguauggaaaugaagcuguuggccuuagccuccuuccuguagucuuucuucagcaggugcuugucguccaccggggggacccuguccugcucgucguccucaucaaacucguacucauccuugacgggggucacagucuucuggggcucuggguucuuagccuuaagcuugaggccuuucucaaacucagagucuguguuauugccaucgacggagcuggaaggugcgaaugacggggcguccucuucuuccgagcucucuguuggaaacaggaagggagaugucaggcggaacagcaucauucuccuaccgucaguuaaagaugcucugcaccuguggugggagcauggugcccaggaagggaagccggacggcucugcuucugaagaagcacuugacuuagucacaucugaggccaaccacaggcagaaggaacccacaaggcuggggucucagcagacagaguacaggcaucuuggcagugagggacccuggcaggacuccugcaaguuccugaaggcgccagccagccaccugaggaggcuuguagacccugugcugcaaucugcaggggaauaccauauguagacacugcacggugcuggcgagggccaggcagcacagagccccgcccacccgcugcgguugcugggcuggcuuaccaguagagcucuccucacuggaaguguaugugccuuugccuaacaggagguucaccaucguuggcgaauuggcuacuuucaacggugucucuccuuuucuguugcuuuguugaggauuuccgccauaccguaacaacaacuucaccaccuacaaaacauuaacguugauauuaacagacuguuugagaaaucguguuacccugccaugccuguaggaggccccccuguugcgggggcuacguguagagccauaagugucuagcagggcucugugccuuugugagggacugcacagggcgggucccuuugacaagcaggucacguccaggucucuccugcucuuccccaaucuucucucgagcuccccuucccaagagagagcugggcagcagcacagcucccaaagaggggcacagaggggcugggggugggaaauagagaaaacaaagaccacauuucuguaagcugguuuauuuauuuucauuuacauuagaaaauaagagaacuccuuccuugcuugauuuuacaugcauaaaggugguuacaugggugacagaaacauucaaggugacauuucaacagcucuauucagucauuuaucagcauaugccugaaacaguaacucacucuauuccagugcaaacauccaguuucaaucuauccucaacuucaguucaagcuuuaacacauccucuugucacucacaaacuguuuccagcucaagguaucaucaccaugaagaguuuuuagcgcaugugagacucuacugcugcuguaacaaaucaccacagccugccucagagucgagggaaucagucucgcuggcuuggcuuacaucacggcgcagauaaagcuggcucguuccuucagugugugggcuguugucagaauuugguuccugcagugcugggaccaaagaccuauuccugaugucugucguuagcggucaguaccuucugugacuuucuccuaaggccagaaauacaggccauguuucuacccagccuacucuuucugucuccuuuaucugucuacuucuuccauccaggaagcugccuuuaggacuacaccauauaucucuccugagaggccacuguuguucuucagcuuacuguguuccuauaguugugacauuuuacauacuuaaagaaaaacgugaaaacucauggauguaugaagacuuagauaguggcucuucccucccaguuuuaucacuacccaccuuccaugguauucuuuuacaagucucagacauugcauagacccuuucagaacauuuuucuaaaagggcucuuaaaaaccagcaagcaaaugaaccaucaugucauuaucuccauauuaaaucuaaaaauguaauguauguauguauguauguauauguguguaugcugugcaccacuggguucuugagagcuguagguucuggcacaaccaggcaggaccugcuugcugcacuauuaacuugggcagauguucccauucuuaccaagcuuacuguucuucaguuuguagcuaauaaauccacuucugcaacccauucucuuguaagaagagcuaugucuggcauaucuuaggguuuccuucccuaccggaagcccuuucccuaagagaggaagucuuacccagcacaguaaucuaaucuugacuaugcugccucucuccccgagacucugaccuucugggcaggcucaguacccgagaacaggggcucaguagccacucaugcagucagaagagccagcacuacacagucacugcagugcuguuugcgaguuaucaaaacucagguuaucuggguacuggccuagggcagaagcaacagcuaggucuuaaggcuugaaaagggauuggguggggugagaggcaacaggggacagcaacgaugacaacacaaagcucacuucccagucucagaaaaugugaaaacuagcuaggacagagaaacaugaagcuguagaauaguccagaaguuaaggagagagcagccacuggagggcugcagggagaugccaaccuuguagugcccguuguuggcggcaucaugcaaaggugugucaucauccaggcccuuaguguucaccucugcaccagcggcuaacaguugcuuggcgaugucguaauagccccgguuacacgccucgugcagugcaguccagccugcagacagaaacuugggguauuuguuauguaaucccugaaagcuucacccugccuaaacuggggggaagcacagaggaugugcgcugcucucccuaaggagcggccagcugggcaauuguuaccuuacacccugagacggcgucccuuuaaaacaauuguggcgcuuugcauaaugaacaucuagccugcuaaguuugcagauuuaaaacuuuuugaaauaauuauacuugggcagaaaauuugugcacagguuaacagucagaaaaugaaaacuguuuuaaacuaaugugcuauaucagacagaaucaaacaaucaugaacuaggcagcagggaaguugaguuugacugaguccuccucacucuccucucugagacagaauuucagacauguguaugaugaauucuggucacauccccagcccuucggccuccaguggucacugcacugugaauacaugguucuccuggugugcugcaccauggugggggagcacauuucaaaaggcagccaagugcccuaaucacaaaaaccacucaauguuaagagccuugcacuauaucacaucuagggaggcggcuccagccucuguaggaagcagcaagugugcuuagucugcagcagaguggcaguggccucugcuggacacuuagaucacuagcccaaggccucccgauguggaaggaaauaguuaaagcguacuccauuaccccccccgcccccaauaagaaaaagauccugaaauacuuuuccagagacuaauuuagcggcaaaucaaacuguguuguguggcugucagucagcacagaaacaagcauacuccacaaacacacuucuuccaauguucuggggcccacccucgcacggggcucggcccagaccuaccugcaaaguccuugacguucacguccgcgcccucacugaugaguuccuugaugcgccgggcauccccucggauagcugcucggugcaggcgggucucuccgcguucauuucucuuguucaccuuaucuuugguuuuugaggcagaguuggggguccccuucugacacacuguagacugggaagggugcuuugguguugugucuacugcaggccaaggaggaaacaggcaggacauuacagaaggcagcuuuguuucaugggaaccucaagacccaaccauuuucauuauggaaaggggauccauacaggaccacugccaaguagagccacucucuccccauccaaggaaccaaccagugaagugcccaugcucacccggacuauuugcagacuccucagcagucaucugcaugagcagagccaccugcugacgcucagagagaggguauccagcucggaucccagacagccccaugccgaacaacagcccggacuuccgggcaacaggcuccuucuugauccucuuccgcucgggacccugcuucucuguguggcaggugagggagaaagggaggggagacuucaugcccaauccucaaagcuggauuuguaacuaacguuacagagccccuucauuccacccaacacuuacagagcaacaaggaaggccuaugaggggaagugaccgugcugcgagcacuggcagcaccccacucugugagcaguagcugugagagacacaguguaauacccuguugucagcccaucagauaagucuccaucuccaucaaccacuugcuccuacaggcgccacacacaaaggcaguaggaugguucaacaucacuggccuggcccacaugggacaggucacuauuauuagucgugucugcaguuaaacuccuucccagcccuccuccaaacaaacagugcacauauaaaauggcagacacaguuuaauauauguaaauaaaucaaggccaacuugucaguacuguaccuuucuucuugcuucuaggaaccuccauuucaugccauggugcuucgaggaccguaccagccuugcaguaccacaacauggacugagcuggaggcaucuaaaggcaucaacacagagcacuaacaagaacgauguaacagcucagcuguuccaucuuaaccgcuccuaacaggcagguccugggcgccucugaccacugacaaauggccugccaaccucuacugaaggccgugcugcugcucguuagaggugggguauggagaaagacgcccccagaguccaugaccugggaacacaaaggcucucgcuuugaauccugccucacugcaccugucuuguggguggagaucuggagucagccccggagcagggcuaagcgggauucaagguuccccaggccacaggguacaaguuacauagccuggggaugguaccuguaggacuugucuuccuuuccagucaagaaacccucugcaggaaugggcuggcuucugaaaacagugucugccugccucuagagcaggugacaacucuaagaaagcagccuaggugaccacaugauggagacuuccucagcuuugucaguacuugucccucucuuccaauugggugucuucaggccccaaccuccaacaccuuacuaccaaguguucugacagacuguuagcucuuuacaagcaugucaagacugccuucuuaaaaacuaaauccauggcuuggugacuuagaagauuuuuaauguuauaagccuguaggcggugacacgcgccuguuuaacaauucaugguaaaacucccccaaaacacuuuaggccacagcagcuaauuuuaaauaagccaugauauauaaauaugagaaaauuaaaaaaaaauuaaugagaacugaaucucagaaaccaugccacccucagaaagacugcgcacaguaugugugacacacuccugcaaauuacauuugcuacgugcacuaacaauuccaagagacagccaagggucagcucugcuucugugcgguugugguuggcacagugcggguuagugugucuucacagcagagagcacaguuuauuuuuauaaaguuuggcacuguauugagucucuaacccugccaacuaaguuagagguggcaucuuuguuuuguuuguuuaaaacaguuucauagagcccaggcuguaacgccuacacccugccucugcccccacaagggccagcauuauacacacguaugacauaccaacaugcuugguuuuuguuugagacagcgucuuaccauguagcccugacuaaccuugaacuaaagaaaugggccugccucugccuccugagauuaaaggaguuugcugccaugccaggccacauacuuguuauuuuaaagauaacaaaggacccucaggcagucggaggcacauguacuuuagcagucacucagaggcucaaggcugagccauuaccuugagcagcacacaagaccggcuugcucauccugcagaacagcugcugcugggcucgggcucaaccagggaggacguuaccuccucuuaaagaugcucagggacaggcaacaccacaaaaaccgcucugcuccccucccacugaacagcaacuucucagccgaacagcuuaaauauuaucagccuugucuaaaugggaguggguggcaacaguuaugaaaugggcuucuccucaagucucuucacugcaacaacuggcacgcacaacuguccaauuucacuccccagucucaaaguccggcaaaccugagugcuuagcagacugagguacuauaucaggcuucuggguaaaagaaggacaccaaaggacacugaaaguucuguguccaaaacugucugagcugccugacaugggccugcaccccugaaaagagggugacccagcuccacacccacugucacaguuacauauugucugcuacaccgcgaaguagaccacugagagcuccaaggugacaguugaauaaguggcagguggaguccacagcagggagagcuguccaacuggauccaacagucccccuuuaaaacugugcuguuuagucuuugcuuuggguaccgcccaaggucugagaacaggagggauggacacccagagacagggaaugugcugcacucugcuucucugcaggaucuuccuccucacccacacgucucaugccaggccucugagguaagacaguuguguuuuaucacucagcacugcccuucaccuggacugcugguguggcuugcacuggcagccuguucugacggcauccauggaggaaaggcagcaaggacagagcaugcuuucccagggacagaguccuugauggaaagggcaacaaacccagcuccuggcugcuggggugccaggggccuaggacucugccagugcucuucaauaaugucuuucugcucacacuacagcaaaugcucccugaggcucugacaagauccauuuauauuuauauauauauauaugucucugucucucuuuuauuuucuacuucagucauggcuccguccaggagaugucuucagcuacaaugaauucacugaucguuuugucagugugcgugcaggcgugcaucaguaugucaaaggucaaccuuggggucuuuuggggcugggggaacagggccucucacuggccugagauuuugccaagcagguuaggcuggcuagccaguggguuccagauauccacgugucucuacuuuuccagcucugggauuguacacaugccacccaggaucuguacacaggcucuggggcaugaauucaagcccucaaacuuguuuagugaguguuuucucacagugauacuuuuuuuuuuuuuuuuuuuuuuuuugguuuuucgagacaggguuucucuauauagcccugguuguccuggaacucagaaauccgccuccugagugcugggauuaaaggcgugcgccauuauguccagcuuuuuuuuuuguuuuuuuaaaaauauacacuguagcugucucuagacacaccaagagaaggcaucagaucucauuacagaugguugugagccaccaugugguugcugggaauugaacucagaaccucuggaagagcagucagugcucuuaacugcugagucaucucuccagcccuggccacugaauuuuuaauuuuacugauaauuuucauuuccagauguuugaucucaauucuuucuccuaguucauuuuacuaguuuucacucuguccagaucagagugggguucuaagguuaucccuugcagaaccuuuuggaacagcuuuguccccuguagucugcaauccugacgaaggaguucuggcauccagagccuuacuuuugcucuucuugggggccagaaacccucgguccugccaguguauauggaagcacauauccaacccuacuagaggaggaacagguuucugccuucugaauuguuuuagaaucuaccagcaauccuggagucuuucaauagcgacugccuucuuuuauagacaauggguccuaaagacaggcacugugcagugucugaggccugacuccagggccugucaccugacugagacaaugcacuuguguccacgucgcagugugggcuuauucuuggcuuuuaauucuagguuuuuucaacaagaccacuuuuuacaaguaugggccuucagaauccagaagcagguguggucuugauucauggugguauuuuaaacagcaguaaauuccuugcaggugccagugaaacucuccagagcaguuugccaucauuccuaccaggaacaaguucagugaacaccguaacagaucccaaaacaaccuccccaucaaauaucugagcaagucguggaaucuagaguaacuuagcuacaguauuucuggucaccaagucccaauccuaacacagcagguagaggguucaacagaguguucucagcagcccaacacgcagcacaaccucauugaguaacaguggugacugcaaaccgcacuccugacuuagugguaucuuuuuguuucauuuuuagggcagccauaauuaagaaagccugugcugagaugcgugacccucuuagcuaugcgcgguggccuucuagaccuuguuccuccuucugagaaauggacuagucaccuguagcguggcagugaggccagacucaagaaaacaauaacuuggcuucuaugaccucugcaggucguuucccaauuucuaacugaggggaacacugguucucacugcaccgcaugaguccagaagaacacaagugaugugagcgucucgacccagacaacaggcaggcagcacgaucuacaagcugccccuuacuaugcuaaaugcaugcuaaagauugaaaaauacagaaauacaaauccaggcaugcacugagaccuggauaccagcagcugggagcagaagccccuccuaauacuaagauccuaacagaugaggcagaaguagcacaggcaagggcucacggcccucaguguggagcugggagcacacuaccuggcuccuauacucacaugucugucacuccuccucuugucuuccuuaaggaucucugcugugcucuaaccccaaacaccuuucacauuggcuaauuuugaugucucauugcuauaaaugcuaaauaacaguccugagccuucguaucaaguagauauauuacuuuguucugguuugcccaccagaccaucugccucugaauuauggaaaauacacaauuugaaacugaaauuacuuucuuugcuaguccacagucuucucugugaagaaaaaaauggaaagggcaaauggcugagaaauauaccagaccaaccaccaaguccaugaagcauuuuauuuggcucugguuguucacaagcagucacacugugguuauuagggcaaucagcagguucuccacgccacgcccuuucccugccaagcccuagccugugagucagugaccuggcagacagaugcacucugcuuucucacuugccauggucuagcaucugccaauaugcagcccagaguuacaccaucuagugagcaagaggacagaaaagccucauuagcgugugugcacauguacacacacacagccucuuacaccaagcauuccgaguuccauauagccaauggcaagagaaucccucaguuuuuccucucccacagaagaacugagggaucaagccccgaggaaugaacgcuucagugggugucuaagacucaugagucgaccgaacgcuguacagacccgaaaagaggcucaaaggcacagcgguggaaaaaguuaauucucucccuucuuccaaggaagcacuguacugggaagccaguuuugacuucauacgcaauggggcagguggauucugugugagcccuagaaagguagguaggguaauuuauagauuuuuaaauuaguggaaaaauuuucaacagagaccaaauuuuaagcaaaucacguaauuccauaacgaagguuuuuuuuuuuuuuuuuuuuuuaaaguagcccuagguggccugcaggucauagaaucuacuugcuucccaugcuccaggaucaaaagguugugaugucacaccaggccucgggaacucuacagagaccagaccgagagugggaggaagagccuuuccucaccaggugauguauguggucaacaccaaagaccuggucuggaagaggcccugagggaguggagauggucuuacagucugagaugaggguaccggcucagacaaccaggucuguuaugucccagucucgccagugucacagggggucaggacaugcuccuguccacagcuccugggcaucaugaucgcaggcauguuccaucuugaggucuaucugaacaccuacagcaucuagcugcggcauaagcaucacaacacugauagacagccuugggagggcaagcuuuuucaucaggcugacucacaacagacaaaacuguacuguucuuggcaggaugcccucaguccugacuaagcacuggggaagccgcaccuccagugggcugggccauuggcagcagggucugggaaacaggaaaaguuuguacgguuuggucauuuaaggccagccagcuucuugccacuugagggcacaguaaaggacgcucacuauuugcuacuaggaacccugacuggaaugagggugggaggguaccccuuguguuacugggguagaccgcauuugucaucaaggaugagugcuaaacuguacauuaucagcagagggcgcuggaggaacacuggucaggaaaggauaagcuauuggccuagggcacugcaagcauuugucuguaaaaaccuuucaaaacuaggaggugccuuaguaugacugagucacacaccuccagggaggucugacaacccuaucaagaugaccagagagauccuaucuuggucacuauuucaucgaguuaaaaauaucagcacuuuuccagcuuccagaacucugagccaaaauaaaccucuuuauuacacagggggaaaauaucaaucccacaauucuuugcgcacccauucugaguauucuccauccugaaugagguggugggugccacugcagaagccccugcagacaagaugccauccacuccaucauaccccguuuguaagccagcacugcaucucuggguaggagaauaauacccaguacuuccugaggcauccagcucaccaauguauagaagagaaagauuauaaaguguguguguguuugugugugcgcgagcgcgcgcagaacccaauggaugaagacaaaccaauacuuccaguacuuaggagaugaaugcaaaaggauccagagguggaaaccagccugagaaaacugacaaaccccaucuccaaguauagagaugccuaaggcuggacgucuuaaacaacaccaacaguagcgaguuugcacauaggcuucggguuccauuuccaacgaaggaaggaguaggaaaggaguggauccagucuucacuggagcugcgagacccgacucacaaacguuauaaagaagucagccacggauaggacaguagacacagcgcuggccagucacccaucucuagcuaggucuacaguucagucuuccugaaaacgcuaccugccaaagcugagccugugccugccucaggucaggugugaacaugaacaguuugacagcacaccaacagcgaaggcugaaggacaaucuagagugcaguggugcagagccucacagaggccuccacagauggacagacuucccuccacaaccacaacaggagucagagcacucuccugagcaaugcaaggaccgccacuugccuuaugaaucccuacaaacaauguuaaaacacacgcgcgcgcacagacacacacagacauucagguuugauguggucuucugguuauguccugaugagcucacggggcugucaucccuccacuccagcacuacggcagaacagagguguagggaagccugcuauccacaugucuaccauaaguacccacauacuucugcuuuuccuuacaaguaucugugacagagggugcgacauccaugcaagccuuuauaaaccucccaccccgagacaucagcagccucaucucaacguccucagugcuaggagaugacagacaugaaacccaaugcuucaccccaggcuuccucugccauuuguguucuacugccccagaggccuuaaaaaaggggggaggagaaaagaccaguagaguggaguccugccugcaucaucaaauucagaaggauaugcaagccaguagcagaccccaggguucuccuugagcaagacagaauccgacugggaacguacacaaugaaaggugcuaaccccaacccguauaugcuccuguucugcauucuuagaccuauccauucuuaggaagacuacaccagcugccucgauuucagguucucccuggguucugccacaaauccaugugccuugggagcuguggggagccaucaccuagaggccugcugucucuugcccuuacuguuauuacucugggcugcacuguacagacuggugcaauagcuauggcaagacuccuccagggauacaguguuaaacccagucugguaccuguguccgaguccuucugcucuccauuggcccccacggugaagggcagcuuccgcuugguggcucguucucucaccuccuucccgccaucacugcgguccagcuugggagucuugguuagagaaacuuuaucuuuauccuacaagagagagagagcaaugcuuucaguuauuguuuccggguuaaauccucaagucacgacuuuggcuucaugugccaaagaaagcaaacauuuuacuggggcgaucaacagccccuccuguucuaggacauauaugcuucuaggacuaaaaggcuugacugugacugcuccuccuuuagcuaggguugcucucugccuuagccucccaccacgaggacggcacuguugaugaggagcacugaacucucccuacaagucagaaucaaacuccacaacauaacucgcauagagugcuggcagaguuaaaggugcaaaucauacuguccaaggguuaaggccccgaacaaccacaaccccccugcccaccaagacugggaaaguugcagcuuuguucugauucagaacaugggcccacuggcugcuccuggugauagauagccccgcugccugugcauucuauuccauccgaggccugagauauggugagguggcaugucuguagguaagagaaaugagggucucucucuuaggggguaauaaccuaaguuaaaaaaaaaagugaaauggaaguugcaugugugucacuaaaaaaguuucacauuuuaaaaacauacauaaaacucgcagcgugguggcacaugccuuuagucccagcacucgggaggcagaggcagguggauuucugaguucuaggccagccuggucuacaaagugaguuccaguacagccagggcuacacagagaaaaacccugucucgaaaaacaaaaaccaaaaaacaaaaaaaaaaaacaaaaaaaacaaaaaaaccaaaaaacaaaccucgcagcuccuugccuagguaacuaagcacagcguguaguuuggcuaaaauagcguacgaaggcccagugcuuuguucagcugaggagugugcuagcagcagguggccauggugauccucugaaagugacauugaugccuccaugcaaacaaaaccagauggggggagaggagcacaccaaccucuuuaucuagaacacauuagaguucaacacagaacuguaugagugcuuaagcaggccguggugugugccugccuuuaaucccagugcuuaggaggcacaaacaagcagaucucugaguucaaggccggccuggacuacaaaacugaguuccggggcagucaggacuguucaggacaaagaaacccugucuugacugccauucuuccacccccaauacaaagauguucuugaaagugaauguggacacaaaacuuuguucugcaacugggaaaagacagcaugguucaagcucucuccacuguaaaaugauaacugaagugagaccaacuguaaacgcuacagaaugaccacuucguaaauuagaauaccuugagcauuaaguuaagccaagcuuaaucaacacaugccauaaagauggucaagguggaaacgccaugguaccuaaggcaguccuggccccaugcaccugugcguacaugguacacagagcaaagcuugccuuaacucaugaucuacagagagcagagaggagaaacaaagcugcaacucccauccaccagggacucuguaagggcaaacaacucuacuagacaccagcaacccagacguaugaaccaagcagcucacccucuccaagauaaaccauccuggcgccuuccuuggagacucaaugugccacacuccuguccccaccucaucuuuauaguaaauauuccaaucagagagcacauaacuucuccaguugcaaagcaaccugaguuacaacagguuccuugaguguucauguaagcucaaggaucaguucuuaccaaagaccuguaaggauuucaguggcaguaugucaaauuuauauauaccuaaagacaauuuccugauggaugcaguuauuuaggucuuccuaauugcucaggaauuuucacauccuuuaacaaaugacuuguugagaucugucuaccccuuccuuuugagugugucuccaagccugacaaaauuauuuuauuuuuaguucuguguguaugcauacagucaagugugccucugccucugaguguaugcaugugugcgugugugaauguguggcuuuaauaugcaggugcucucagaggccuuaagagaaaggugaauucccuggagauguuuuuguuugagaaauggucuuacuguagcacugccugauccugaauccuaccagaggugggauuacagauguuuguaaucaucacacccagcuauauauuuuaaauuucaaucugaaaaaucccugauuuuucauuaauuacauuuagaaguaaauuuuauuuacauuugacaccuugcccgaaccauuaauucuuguagcuuuugugcaacuguugauauccuggaguaaaguuuauucugcccuuuccaaucucuuguggcuuuuauuuugcuacugugcuagccaacgccugcauaaaacugccagagguggggacuuugguguccuucugcugcuuuguauccaaccuuauauagaauucagcccucauuauuaaaugauggcacacaggaauuuuuguugaauaaauuguaauaaauguuaaauuuggucaaaagucuuugcuaugucaacugaugucauaaacuuaggggaaaaauauaagcaaaaguucugugaccuugcaugugacuauggcugggggaaaugguuucguuuguugcagaaucauguguucagaucuccagcaccuauauaaaaagccaggaguagcaguauuaauuuauaaucccuacauauaagaagcuugcuggccagacaaauuggugaguuccagguucaguaagagaccauguuucgaaaaaugaagcuucagaugagaugucucacugcacacaagugucugcugacaaacccaauggucccgggacccaugugguaggagagaucuucugcccacaaacugcccucugacauagcugaggaagcauguccaugggaaccucccccaaucaaagacuuccacaugcuugagaaagaacacgugugaguccugucuucaaucaaucaauuggucaaaauaaauuggaacgcaagagacagacauguuaacaguuuuucuggcuuccacacacacuugugcgcgcaaauuaauaauaauaaacuaauguaaaaaaaguuccacaauaguuagaaggaaacuagagcaaccucaacgggagccacaguggcacugugggauucagcccaccaggaaggucuuacguagccauuuucuagguaguaggaauauuuuauauacuuauuauuaaaaucaauguaauauuacauuauuaaacauuaaaucaaauauuacauuauuaaaaucaggaaguugaauauagggaaugaaggccaacuggggaacuuguguuugaggauccucuaugcucaagaaugcucuguuuuauagucaugacguguguuacuguuggagaaauggggacugaacaggaaaugguaacacccaaggagcugugaagcuaagaaugcugaugagcagcaagugucagagggggugcuucaggcgcugacuuuugugaauggggguaggagcugcacacuggagaagccaucgagguuucagugguuugcuacccuuggcagccccagcaacaguucugugagagaaacccugcacagccaugcuagacucuucucuccugcuauagcaaagggaaggaaagaacagaaagcccagaggacaauacucacaaaguagacaucagccucucugccacugccaucacuaacuccugugugguguccugaguuaaggcgacacccagcuaaggaugggggagagugaaucaggcuccauaucaaucuuucuagcauccugcucuuggccacagccuccuguaccuccugucugucagggguagucuacauuucauacacagaccucaagaacacucccggaaaaaaaaaaaaaucacaggacccaacagccugacuguaagcuauugcccuguugguggcacucgcgcagccgccucuuaagguaggcuucaaccccagggagcagccaucagauucaguuaaggggugaauuuguguuuguccuggagaaacauuggaugcucugguacuguaaagagccaauagguauuauggcacacaggguacacauaguuugcaaauuaggggaugugcuauccuuccuugagggaccuaauuagacagaggcaggugcccacccuuagagccaccuccugcucaccagucugcaugagggaugcccgcggucuagaaacccucugagaagugcagaagaggcuucugcugagacagauugccaucugucacaggagaaugagaaugagccugaacuggacgaaagaucucacuuccugcugaggggccuuggauaacacagcggccaucuagcucuguggacagagcaugaccauaagaguaggagauuugcuggucucuacuaaggcuaucucaguaugcaguauauagauguuccagacauuuuuggcacuuucuucucuacaugucagcuugugucacuaaugggucuguagcaagauaugugacagaagaguaugucacauaguguaugauucauuugggagaaaaaauuuaaaauuauguugcuuuugauaacaugugccuuacgugaggaaguaaguucacauuguauagccagagccagucaguguucugucacuagcaggcccuccuucaugaacuuuuacucaacauugccaccugggauccucuguagucccugaagaauagacaccuacguacuccaucuuggacugcuuucuacagagugaccagguaagauaggaaagauccaccacggccaagcacugcagcgucacacagcaauuucacggguccugucaagcuccagaaaaggccagauuuaagcaaguaaucaaacaaacccaaaucaagucaggguaccuugcugggacacacacacacacacacaccccuaccuuaaaucgaauucauguacaccacccacauacauagcccagguccuguagucucaggaauaacucagcucauuacaacuuaugucuucuccagaguuaacaacaacccuaaccaaccugaaacauguccauguuccuaggaggcugauauaacccaaccucuagagcuuucaucauggcucacuguagccugcuacucucuagagaccagccugucuccuggaucccgacuuaagacuuucuugcccuuuuacccauuccugucaagccaugugacauacaccugaaaggcaccgcuucuuucaugacaacuucugggacccacacugaagaacuaauucugggaagagcuuguucagcuuugucaguguagccaaauggcaggaccuucucucccaucccccaccccucccucucucucugggaguuggagcccucuggagaauucuuuaacagacaagagcagcagucagccaggauggagagcaucuauaaaccgaagacucagaaggcagugaggaaaacucagggaagggagggggagacuuggauaguuaagugcaaggugcuccacacugucacacagcugaggugaagaguaggcaggagcugcacuaagacaggaauggcugagucugagcaaggcuccaacacaaggcagugggaguagggugcuucucugaccugaaugcccacagacucagcaguaugugauguuucugaagccagccuagugagagucuuuuuuaaaaagucuaggaaacgacagugcagccuuuccccuuguuccugcucuacaacuaucugacuuuguugcauggaaacuucuaugaauauaccugaaaaccaugccuuugcaucuauucggugugaaacuguccccaaaaguaaguucaugcuacauggauacucaagggucccagaggccccuuuaucuguucuuuuuaaacagcagcuacauaugucauguucacaaaccacuucacagugaaccgaaugagcagaucaugugacucugcagugucugccuguauaccacagcacuugcuagugauuacagggggaguauuagcaacaugcagaaagaaucaaaaugaaggcucacuuacagcaagccagagcugggacccucucacagacacagccaaggugccaagacaaucaggagggcggaccagaaaugacagcaauaaaacuugaggaaaaucaccuuauaaaaacaugaggucaagccgggcaugguggcgcacaccuuuaaucccagcacucagaaggcagaggcaagcggauuucugaguucaaggccagccuggucuacagagugaguuccaggacaaccagggcuacacagagaaacccugucuugaaaaaaccaaaaccaaacaaaacaacaaaaacaaacaaacaugagaucaguucugagagugugucagacuucaucucacuggcucagaugcugucguaccacagcaagaaacccagucccaggacaacucaugggcuuggacauagucacgcaaacauaaacaagcaacuaaacauauauuuuaaggcaaagccuuacucugaucuguccaguucuaacuucuugauuuuggagucuuuccuuuacgccaggaaguauguaccccagaaucugaugucaacagcacugacugacucuggcaacuuagaguuacauuguauaaucuuauuauucuuuuauucugcuuugccaccaccacccaaaucuauuauuguuuugaauuaacaacauuugaaagcaaacgucuaagacuauuuuacagucaguauaacugugacacauaguuaaccgucuuucauugaacacaugacacuguaucuuaggguucugagggcacaggagggugaauucuauauacaagucugcuggaggcuugucuaugacaaacuuaauuaaguagggccuguucagugaaugaauggauccuugcaaacccaaucacaagcgaacuggacacuccugguagcaaaggccucacggagccagccaaggucagaauaaugauccggcucuggaaguacaaggugugagcacugucuucaguucuuacccuggaucuuaaugacccaggagaggcaggggagguuagggcaagccagguuaccuuuuucccaguuuguuucuccaccaugucguugcugagagcaaagucuucuugcugugguguuuuagaacacccacccuugggcaucguucuccuccccuuacuugaucuucauuuaugcugcuauugcuucaucaucaacugucuguuucaaaagaaaaaacagaaaagguuaaagccauuguacccaaaacauaaaaccugcccaacuucauagggaaccacacagacugaccaaccaagaugugcaguugcucggaccuaaggccaauagccucacucuagguaggggcugagccugggaggagaaaggaaugaccugugaggauccucaaaguccauucuggugaccagccaccagugcccgauaccuggacacaugacacagacccccucuaaaucacgaugggaggggucugagugggccuagaacucgguucucccccucauacagucauccucacaagcaaggucaggugaacacccagagcagagaaugaaaugcccuggcccuuucauuccaagagaucuuaucucuuccaccagcauagcuucuaacauucacuccucaacuucaaaauucucuugcuauucauacuccuauguagaaaguagggugagaaauaaucuacuuuaauagagcagcagguaucugguaaagucuauaagauucccucaugaaaccugagugguagacacacagguauauuaugacuaugaaggagucccuagaggaugcucaggcugcuucaggccccacuucacauccauggacccagauucuucauuugggcucaagguucugaccuguuucugaaaauaccuuaagacacaugcugcauuaaucgcauacuuuacaaucuaacuaauuuauuaacuugacauccugaaaggcuugcuggacagagaccuaauuuuagagauagccaagagcuuaugcaagccaacuaccaucucaucaugcacaagccacagacccugccuuuuaaccacucaggagagacagacaccaagcagccagagucccuccucagagguucuucaaaccagcugauccugauugcucuguccugccuuccuccucugcugggccuuccaaccguccaacguggaauagaccacuuucucucucaggcuucacucugguuuugucuguuccaugcuuugcccuaccacagguuucaguuacucugacaggaagggggaggggguggagagggagagcgagagagggaaauggagagaaugagggagugcuauguggagacugaggcuggaggauucucaaguucaaggucagucccaacaggguaauaaaaccuuaugucaaaauuuaaaaagcaguguuuaacacaaagguuaacuugcauaugaaaguccaaguacuacaaaaacaacaguaacacaacacaacacaacaaaauaaaacccuuuucucagccagccaaggcacaagcaguguuuuggacgaucuucccuuauauagucaaagcccuuucugacugacagacaucggggccuacagccucguccuagcucucccugucuucaaucaugcuugaucuaccccuguaggaagaacugcuucuaaaccucaaggcuccggggacuggaaagauggcucgguggggcagagcacgagcucugcaagucugaggagcugagugucaaucuccagcaccagguaaaagucaggcugugcaagcugcugcccagcaugagggacgggauggagacccugagggaucccuggcuacaaagccgagccaaagauguugagugagacgcccugucuaaaggcaacacaacagugaacagugcuggggcaccccuguccugcuuuagccuccacaugcacagcugcacauucacuccuguguaccccacacccacaaacucuuuuguacaaccucaugaucuuaucuuacuuuucuguaauaaaugauaaaaacucccaaguaguuucucaguguuuaacuggccuaagagcauuauuuggaggaggcaggcaggcaggcaggcaggcacucugguccuugcccagaauagcaacauuaaggaugcugagguaggaggagacucccuucucuggggccaguauaaggccacauggcaaugagccugggcugaagagacugcccuacuuguuuuuuuguugcugugauaaacauucuaaucaaaaacagcuugaagaggaaaggagcuuuguggugagaaucugguuuuguuaaaaaccagguuauguuacguauguuuguguuuuaaucuaggcgugggguauggggcugcuucaaauuguccacagccacuacugacggcugccuccugcucugggcggggcgugauaucgucugcauucuggggauucuguggaggaggccauggcuauagccacuccugcugcugcugcugcugcuuucagcauugcggauguguugguuuggagauagccugacuguguaaacuggacuugccccaagggacccaaugccccuuguagucacgaaauagucuguccccuuuccccucuaaccuuucucuccuacuuaguguugaggggucgaaagggugguaaauaauagaacccaauaaagugguccaaacccaggccaacagcuuauuucaucucauacuucacaguccaucaucucgggcugcuaagcagaccucaagugcagaaaccaggaaggaacacuucuuccauggcuugcuuaacuugcuuucuuauauauaacccagggguggcacugcccacaguggaucaagccuuuccacauuaagcauuggucaagacaauggccccacagacaugcccacaagccaaucugcugggggcaauucgauuccuuuucccaagugacuaguuugugcacugaaacccugucucaaacaacaaaaacccaauuuuacuuugaaguaaaaacgacgacaggccaggccauccuuacgagaacccucugccagcaggaacaggugcccccauccaaguuacuacagugccugaggccaagcauggcaccucuguucucacaugcagcugugguuucucuauucuggcugaggccaggcacaaaaaucucugaucucacuugcagcuaugguuucucuacucugaauuuucgacucuaaaagugagaugucuuggucuggccugguggccuuuaauccuagcacuugggaagcagaggcaagcaagucucugaguucaaggcuagucagauuuacaaagcaaauccaggacagcaggcagaucauuuugagauugagccagcuuggguuaaauagugagacuauuuuuagugagaucuuuugguugucucacuaaauagccaagcuaacuuggaauucacuaugcagaacaacucauggagaucugccugccucugccuccuaagugaugggaugaaaggugugugccaccaggcccggcacucacuuaagugcuaaagaacaaacccgagcuuagcaaaguuaggcaaguacucuacuacaaagcuaaagguuucaaccaaaaaggcuccgcaguaauagcaucagagaagagaauaacaccccuaucaucccuaggggcucugacaagauagagcacagggcauccuuucauucuggccugugaaaggcaaagacacccucuaucaucagcauacuauugcaguuucuuccccugaaacaaugacagaauccacaaaacuguagguggcuuucugacagaaaaagaaccccucgcccccaacuagugguuugugacgaagugaacaaagcacagcccguggaaguucucauggggcugggaacccaugggcacaagacaggggaggcucuggccaagccccacugucuuggaagcaagcccagauauaacgggucuaaauccgguaccccggacuauauccacauccaccaucagccaaggauagauaggcugucagccauucugaacaccuuauucauaggagcugcagccauacaaaaaagcagagcucuuaaggggcacacaaagccaggacagugugcagaaaacucaggacgucaaacuccaaaaugaugcucaugccuaggaaucccugggauuacagacacaagagaagagccauagaaaagcaagaacagaaacaaguccaagugcacagucuagcaagucagugagaagcuacaaaauucauaaauuaacaacagccuggccgagauggugagcaccuuuaauaccagcgcuccagaggcagaagcaggaggaucccucugaguccaaagcaaguccagucuacagaacaaguuucaggacaguuacacauagaagcugucaacaacaaaauuaacaaaugcuaggaaaagaccugaguauuggaagucacccucuacuacagacaacagaacaucaacaaauaggacugucugacugggggcuacaaaggacgaaugagccacagccaaaacacuugcaggagccagguccucuguauagggagacccgauuacacuggaauucucacagacaccagaaagguuaauaagcuauuuuuccagaauugggggguggggugggggugggggagucaagacugaaauguucaauaugcuacacaaccauggagacuuaucaaugaauaaacauauuuucaugaaugcaaaaacuacugggggccccugucucuaucuuuuuaaguuuuacuaauauagguccccaggaucagaucagccuguuuccugugucugcaugagagcuaagaauggguuuuguacauucaugcaugaagggaaaggaucaaaagguuauuccuuugcaacacuuggcuggagagauagcgaaguuuaagggcacugguugcuccugcagggaaaguagguucaauucuuagcaccuauaugguggcucauaaucaucuauaacucauguuguaagggauccaaaaugcuuucugacuucugcaggugcuaggcacaaaagguacacacacauacaugugggcaaaacauucacacacacacacacacacacacacacacucuuaaaagccuaaaaaauuauuuuaaaaauugugauguuuaaaaacuauuuguaauuacacuuucagagccauuccauuuuccugaaugcagcuaacaucuccguuugcuuucuuguuacaggauaaaacugggggucucuagcgugcacuaagcagagcuauauccuaucuccauggccucugucaggcuguugucauggcaacugccauccggaccacuugcagccucucuggccuuuaggaaucugcuaacagcaguucuuacaguuuugacaauagucaaaauuugaccauuuugccuuuucagggucugugagaucgacaucuuuucuucguacuguuaaggugcucagugcgcugugcgucccaugguagugacaguguacugggaggugaggcuuucacacucacuccuggauuuucuguugcugugguaaguacuaugacuaaagaggacucaggaaaagcaaaugaaagcaggacaaacucaggcaggagacagaucaguggcucucaaccuuccugguaugacccuguaaaacagcuccucaugcuauggugacucccaaucauaaaauuauuugcauugcuacugcagaacuguaauuuugcuauuguuaugaguuguaauguaaguacuuuuggagauagagguuugucaaagaggucgagacccaaaggcugagaaucacucccagggaggaccauggcucugauuugcccauagcuucugcuuaauuggcuuucugauacaguauaggacauucugccuaaagacagaacuggucacaucagggugggcaguaagaaaaugucccacagacaugccuacaggccaaucugauuaaagcccuuagucuuaaauacucacugagaaacggagacaugcaugaagcaccccuguuacacagcacagugaauucggcaucaggaaaagcaucucacugugagcggacaggugaacuggauucuuuuucauggaacucaaguuuuacuuaaaauuaguaagaaguagacaucuagcagucacagacauuccucagugacuugaggcuuggguccuaggucccugcagagagcagauccuuggugcugcagcgacagcacaguaucugaagagccuugucccacucuuccugccacaucuggguaacucugguaccuaacaacacugccaugcuguacagucguuaugugcuguacagucgcugugugcucagugucuggcccauuuuauuuuuauacuuuuuuuuuucuacacaugugaaaccacaguuacaaagagucaauaguauuuugucaaaagugaguaauaggagacaauuauuucaaugaaaacggauugcaguuguugccaauaauaaacucuggaaacguggucuacucucugcaaagccucccaaagugucucccaacuuaaagggaccaugcugugaucaagguagaaugaaaguggcuguuuuuagccacuguagaauaagaaauccccacaacucaauggacuaaaauuuccaagauaaccaagcucacaaugcucacacucagcacacugggcaggagcaaacuuaagaggcugagcauaggcucuaccccagucauggccaaggaagacauggcaauccugggagccucauuccugcucugugugucuguaaugagucaggcuuucuucguaccucuagcaaaacagcuacaucaaaagcaggcccuccccaccccagccagucagccagagacggcagaugcagaaagcaaugcuacuuuuucacuacaauuuuauuacugauauuuuguaaaguaauuaauuuguaaauaaagauccuuugcuauucaaguguaauacuuuccuaucuucaaguagacuaaauacuuuaauagauuuucccauauaaacuaagcucucuggggucucccuggcugugagaaaguagugaacaucaaggagccuguaauauaaccaagucugucugucgucaccaccacccuagaccuccaaagaacuguaaaacagaaaggguuucacuuaagaaaacacgcacagauaguuuuuuaaccuccaaggauggcggugcauaccuauauuaguagcuuuuagacagcagagggaagggaacagcugcaauuugaggagacuuucaaauuacagaaaugacuauuccuaaaauuaaagaaaaaaaaugagaaguuugguaaagugauuaaccacaguaugacgcuggacagaacuaaccaaaaugaggaagacagaaaagagaaagagcuaaggccaugcuagugcucacacaggacuaagaaagacuuugggaagcuacggauagauggcccuaacccucuguagcaacagcaaauugaauaccuccaugcaaauggaaccuggcuuccaccucacuagguuauaaccucauuagguuauaaugacugcuaaaacaaagguuaugcaaguguuuggaguggaaaaaaaaagauuuucacuuuauagaacuguguuucacuuaauuaacaaacaugauaaaagcuagcuagcuaaucacacuucacuguaaacaugcaugaaagaacagaaaguauggagugcuggaagguggcacacagcacacuggacgccugagaguagaggagcugaggguacugacccugcagccagaccuccccccccccccgccccagugccugugcugguuaccucguguuuguacugggaaccagagucacauggaaacaauaugagcccaauucaagacugcaugacauucagagugagucaagccuguacaaagcaugcaacgggccacugugacuguggaacaaaacaggucccuuucagccuugauaagacagaaagacagcucugcaaagagcuagaggacuggggaauaaaacgaagagcagaaagaaccugaaaagauuaugugaaaagacagaaauacaggcauguguguuaaaggugugaugcaaugacuaaaaauaguaaucucaggaaagcacagaaaacagaccaagggcagugagugagucagcagacagcacuggagcaaggagcaccuggaacugagggggggggggggcuggaaggaggcaguggaucugaagccccacugcgcugaaggcaaaggacagaccgcccuaaggagauaucacuucacagccacccuuuaacucacugccuacaaacacaucaacaaggacauuaagguugugugcaggggaaacucgggcagaacacugcuccugagcacuaugggauucugaggucggaugcaccaugggguaaugucucuaauaccaagggaagcagcaaguucggaaagacgggugcaguccauagucugaguuacucagagauguggaggacuacuuacaguaacaggaaacccagacauaagagggacgcucaccacagcccuguaauccacuugcuauagaacaaaagccacauaacaguaaaauccauacagaaacucaccugacaagagucaguguucaugaagaaacccccagcaaaauagcccuaagaguagccuagauugucuguggaacacuuucaaggacaaccacacucgagacaaccaccacuagugagagcuaaccaguuucuuucugcaguuggugaggcagcaaagacauccuccuccuccaucucccuauucccugccuccaucgcacuucgaagauaauacuauucugaacuguauacaugaagaacaauuaaaacaaauuacuauuuacagacaacucaacugccuauguagaaaaaaaaaaucacaaggaauccaucaaaaaguccuggaaauaacaguuuagcaggacaguagcauacaaguccacggcagaaaaucccacuguuucuacauaccuaucaguaucaggggagcagaaaaaaaaggguccaaccaaaaugaaaacacaagauuuaagugcagaaagacuuuuuugucugauuaguuuguuuucuggggcaagguuugcaauguaccuuagacuagccucaaaccuacaaucuuucugccuugguuucacaaguacugagauuuaaaaaaaaaaaaauguagccgggugugguggcgcacgccuuuaaucccagcauuugggaggcagaggcaggagaauuucugaguucgaggccagccuggucuacaaagugagcuccaggacagccagggcuacacagagaaacccugucucaaaaacaaaacaaaacaaaacaaaauaaaaaauguaaaaggagaaaauccuuuucucagaggaaaacuggagguaaggaaaauucuuaauuagauuaauuaauuagacacccaaagcagaaucuaaagagaaaaaaaaaaagcucacuuccauuuucaaccuacugcucuauggaauacuugguguaagggugaaaagauaaagugugaacaaggcaggccauguccagagccagggucagagagcaggccuauaagcacagugaaaaacaaacaguaaaagcaauccgaugaggggacaggaacacagauggcuaguuuaauuucaacuugacaccagcuagagggaacuuaaacugagaaaaugccucuauaaaauccaguuguauauauagcauuuucuuaauuagugauagauagcagaggcccuagcccugugagggagagcccagaccacacuggguucucuaagaaagcagguggaagaagcuaugagaaggaagccagcacccuccacgaucuggcugucaguuucugcuuccaggacccugcccuacuugagcuccugggaagaaagcucagucuacaaagugcuuguccucugagcaccaagauuugggguugauccucauggcauaugcuuagacagacagacagauaagcaaacagggaugcacagguuucuggggcuuguuagcuagucggucuaguugacuuguucaguuccaggucaaugagagaccuuucuuuaaaaaggaagaaaaggaugggcugugcuggaguagcaaauacccaauguuucccucaggccucuagaugcaucugaacacagacacacauaugcacagacacacacacacacacagacacacacacagacacacacacagacacacacacaaaaccaugccccugugagacuagcagcgugggcacagcacugcacucagcuguauuccugagcaagaccuaugacacaaagcucacgaccauuaaagcaggggaacuccaacagcuaucccaaccacgcccuuccaggcaguucacaccucccuucucuucaugaauacaaaggaaugaaccaacucucacaugcuauguggauaagaagaggggaaaaaaacccaaaaccuaaaauagcacauguacguauguacacaugugcgugcgugagcauuagagcgcacaaauuccucuuugcaggaaugguaguguuccugguugcauuacaauuauuauucugaaacuucuaaguaugucacgugacaucaagcaaaugaaugcccuuuagagcccugauaugguaaacuuaggaaugacaagguagagaugagaggacagcagauaggaacugccaucugccucagcugagguuaucagucucagagcuugguauguucuuuaggaauccuggcaugcuaaggucuggacauuccaggguggacccaagagcagaagacuucaaagccccucccuacaaagccacuuggcauuuuccuuguuuagugacagaaaacagaguguguucuuaguaccacuuacaagaagauucuuuuuucuaaucaaauuuguuuauaaacuuuguacugugacaauucacagaaaaaaaugacagugucacacuuccugaccuaugaccuacuaaggcaccuccuccuauacaucacagcaucucuuguuuagacuuuggaaaggcuggacagcucucuaguggagaaccaagucucagagaacgucauucuacacuccacagacagcccugggacaauaauggugugugcuuuccaggagugagcagccuuacaggcauccucaucucuaacuuguuuauuuauuuauguauaagagcacucugccugcaugugugccugcgugacagaagagggcgccaugucccacugcugcgagcuaccaaguggugcugggcauggagcucgggaccuccagagcagcagcagcugguguccuuuuauuuauuuaauguacgucagugcgcugucacugucuccagacacaucagaagagggcacuggauuccauuacagaugguugugagccaccaugugguugcugggaauugaacucaggaccucugggagggcaguuucucuagcccggcuuuuaaucuuuacauaaagacaggaucauggucucuuggagugacacauaauaaagagguacuccauaaaccauaaaguacaaugacucuggagagguugugguacagaaagcauggcaggcaggcaaacagaagagucauggcugaguugcgugucugagcacagugcucccaaaggcgaugacccaacauggaggccuuagccacuaguggucacgacaccuggcuuuguucgugcugcuuuccugguggagucuaugauauacaacagagaccagugcugccuucccugcuugcuuauaaacaaaguaacugcugaagaagcuccaguuucuuccuacucucaucuucucuggcagaacucuagcacuguuuuguuuacacaacagguucuaaaaagucugaacaugauguugucuagaagagaaucccugcccuuucccacacaacacuacuagaggucaucuggggcuguuucacaaagauaaagggccacccaccacgguggaguuguccaaacucuaguuguugcugggcuuuaguucaguauuauuuuuagcauauuaaccauccauuaguuagagcagccuuaaguuuccaggaauauugaauauaaaagagaguugucacauaccuuuaccucaaagguacacagccucuacaugguccagcaaucacuacuaaugcccaguguucauuauuuacaacagguucacacugagugcuaaacguccuguaauucucaaaugcagucauuuauauccacuauuauaacacaccauauagcccaguuucacugcucuaaacauccucuguggucuggccaucugcucugcguccuccuggccuggcagccguggaccuguuuugcuuuucucaggauuuacagaacuagaacccuauaucauguugccuuuucaagacagcuuauuuauuuauuuauuuauuuauuuauuuaaggaaggaaggaaggaaggaaggcaggcaggcaggcaggcaggcaggugagagagagagagagagagagagagagagagagagagaaaggaagaaagaaggaaauuuuuuucuuuguaaaugucuuguguuucuguuggagguguacacacgugccacuccacacacguagggucagcaguccuuccuucugcuguggguacuggagauccaaugugggucaucagcuuccaucacaagugcacuuaacugcagagucauggcaucagagcccccacgauggguuucuuuagcuuuguaaugcacaggugugguuccucugugauuaaagcuggguuguuuuuagcaaugaaauaauauccuauugucuggccacaucacuguuuauccauucaccugcugaaucuuggcugcuuccaauuuuggcaauuaugaagaaagaagcuuucucaagucaauuaucagaacagaaaauacuggaaggcauauauccaucaucacaugaagaaugucauucuguuaacuugccugugugaaccucugcccauguuuucaaaaacaauggcugguuugcugccagaaauguuuaguucucucuaggaucagaaccacaccccuaccuuguguggugcucaucagugagccuucccgcagucucucaggcaggaauaagacaggagcugacccuagugugcgaguuaccgaugcugcuggauugcuggccucaacuucauucaggcucuaagacagaaggggaaguuuaaaaugucuguccugaggugacuuuuacuuccuauuccauacagaagccuuguuucuaugcugauccagucuccccagucacuucuaacauggucaaaaacugacucacccacggcaacggcucagcaacagcacacaaggacucacuacaacacauuagauucuaaagaagacgguggguucugugggcugccacauauaccagauugcuguagugaagucaggcagacagggcuggucgagaguucugcaucuucaaggaguguucucacacuuuagcaguuugguuuuggacagaaguuaacaacacuaggcuaggaaugaauacagacccaagaaugugacuuuuacaaagacaggcuuauuugaauaucuguauuuucacuaaacauaucaguucauauaaucugauuugauuauagaaaauaaguucugugguuucaaaugcauuaaccauaucuuacuuauacaauguuuuaugcuuacauuuuuuuccccagaugauguggauagaacuacuucauagagagaaaugagacucccagaggaaaacuggcauacccacauccagcagccaaaaccaggacuggaggccucagcaugcacaauagccacacaguccauuucugccuacuggaagcuccuucacacgccacaguccaaugccauacuaagaaccaaaacaacucugaggcaaacaaaucccaaagaucuaaagucugaggugccaaaaccacaugauauuuguaaguaugaaagcauggauuuuuacaacuauuucagaaaucuagaggguaccugaaggaauuauaucuugugauuuccacaaaagaacugugacagcuauucuugguugucagccugacuacaucuggaaugaacuaaaacugaaugugaaggauuuuccccucuaauucaaucauuugaugugggaagaccuacuucuaauccagaucuuugaggugggaagaugcaccuuuaaucugggccacaccuucugcuggcagccgguauaaaagacaacacagaggcagaggcuugcuuucugugccggcuugcucuugcucucacuagccaggccacuccuucguggacaucacagcuuugugggcauuacuucuucaggauuuacuucaggguauacagccuauacugaacacuugcugagacacucagaguucucuaagggaucacaauuuauagaaggggcaugcuccccacuaccaccagaaaaaagauauagaauggaugcuccacuuuaucauauucugcuaaacagggucucucauugaagcuggggcugggcaagucccaggcacccuccucugccccuacacugcugcagucacaacaagucucagcuugcugcaugguuuuuagagccaaccaaauccucaugauuguacagcaagugcucuuaacuauugagcacucaaaccccucuaauguacgacccguaagagcuaacauauggcugaggcucagcacacacacucaucuacuauuguuucuucuccccuaaaccaauuuuccuacuuugacucucgucuuuccaaggcuaaauauuauacagacuuaacuaugggugcuuuguaauaacuguggugagauguguaaugucugaaaauuacccauucucuuguuaacuaacaacuguuucuucacaaguuuuguuacuacaaaugaauguauuugugcacuucugguguguguuuuguguguguguguacacauauacguguggagaucagaauccaacuuccaguguauuccccuacugcucucgaccuuauuuugaagacaccuuucaaugaaccuacucagcuacacugcccagucagugagacuguuuugacuuaccaccaugccugguuuuuccacuucagaccagaacaaaugucuuuugcuaucaauuuaccaaaagauaggaagcuuguaaucccagcacucaagagggugagauaagagcaccacagccauucuggaaacagccugggcuacagaguucuaaggcugccucaggaacacuguaaaccugaagacagaagguguuaggcuaaucaacaggaaagggaacucugcaaacagagucaguggaaugugaccaagaaaacaauagugaacaacuuuaaauaagaguuacaaauucaagugaagcucucuccaugguaaaaauaacuaaaaugagggguaaaucagaguccagaguucugaaaacacccaaauuauauaggauaccaaaagcuggauguggcagcacaugacuuuauucccaacacuaaaaagggagaggcaggugggugucugaguucgaggccagcuuugcucugcauagugaguuuaaggauggccaggguuacauagagaugggggcagggggaggaagggaccaauccggagauuuuuaaaaaaagagaagauacccacaaaugcaaagccuuucaggauggacccagagcgcuuacccaauucucagggaguucacaaccaacaaaguuuuaaaaagucauuuuguauguagucaagugggaguugcuagaugacagccaaaugacgcauggaaagaacaauuuacuuuucaaauccaauuucauauagauuauaauuuuauuacuguauauacagaugaagauaguuauaauacagaaaugacaccaaauuucuuuaauacauauaaccaaggaguuauaacccauagucaagcaacuugaagaaaauguuguuuauaugaaauauugcuccuaaauuugagguuuccaugguaaagggcucaaauccaguuuuccaacgauggcuggacggcaccaacuaacaaauggcccuguuucugcugcaugugugggaaggagaggagcagaaacagacagucucaagguucuacuucucauugcacuaaacacacagcucggcaucuugaccaggugaaguaagcaggcaaccacacaagaaagcagaggcuuuaagaaacauagcaacugacagauccucccaggucagagggauguguguccuccuguaacagaugcuacaagcagcacccaggccuuccagaaggacugugugggcugccaggcuugucguuauagcaacaguucuaagcauaugugcagugacaccagcugauuucugaaagcugcaaauagaagauaauggcauuaaaauaaaaaagauuuccagaguaaaguaaagaucaucacccacccccuccucucuccagccuacacuuuuucucuagacaucauuguucagcagagcaauagcaugaaggcaaaugcagucugcagccccacauaugccaagucaucugcauaaggacacaccuacaaaucauaacacaguggauccauaauccuguacuggcauguuacaggcaagaaauggccaagccugacaagagucauccaccuggagggcuuccugggcccagucucaacaguuugcucuucccuggccucccgcacacaguuccuuccuuccuucagagccuuucaagcuuucagaagcugggcuauggcucaagagaguugcugacagcuaagucuacacaagcgagcaacaacugcaaagaaaaggcaggaaguugccuaagcaaaggguccagcagaaaaugauuagguuucugggaaagcagagcaaccaaucacgguuuggaauuaaaaaucuauuucuaucauuucuucugcuuugugggaaggggcuguaaaaaugugaaguccccuggaaauagggaagcaugcaaaagggugcagaaaugacugcacgcagacaggagcuaucccugugaccacuuccucauggcaauaccuaucuuacuaucuuucucuucuuucaccccacaaugcuaagaaugcuuuuauuauacuucuaucacauguuucaggcuucacccagaaacugggcugauaaacccucaagcacaagcugacacuaagaacacuuguuggccucuacaccuuuauuugacagacagggagugggcccccaugugugcugguggugagaagacaacuccaggccacaaguugucuacuuucaucguguggguuuuagaauucacucgagaugugcggcugaaguggcaaaggcucucugcugagccuucucacucacccugaacugauauccuuaagacaaaauuaaacuugguauuucaugcuguaaaguacauuuauuggucugaacagaugcauuauucauuauaaccaaaauuaauacuauuccaagaaacauacaauuucauguuaacaaacugagaaaagacagaauuugcugguuaguuuugucagcuaacacaagcaagaguccccugggaagacaggaucaacaagaauugucuagauuaauuuuuggcccaugagcauacugguauuuaaaggcaacaacaauaaaaugugucucugugucugcuguauaugugcacauguguguggauacccaaggaagccaauagaagguguugaguguccuggagcuguaguuacaggcagcugugaacugucagaugugggugcuaggaacugcaagaggaacgagcacucuguaaccugagcgacacacuuccuggagaacagcugagccaacagcagguaugcagcagaugcagguaguacagccaguucucugauggacuguaaaugauguacuaaaucuuugcccuccaaguugcuuuuaucgggguacuuuaucacaacaaaagaaacaaaacucaaacaagaaaaaccaaaauuuuauuuacucauugugauggcuauuccugguugucaccuugacuacaucuggaaugaacuacaauccagaaauggagggcacaccugugauccagaucuuaaggcuguaagacacaggcuucugaccuggacuguugacaugggaugacacauacuccugauccagaucuugaagugcaguguccaugaaaaguuuaggcccaggcaagguaguacacaccauuaaucccaggagauuuaaucccuugaaucuccugaauucaaggccagcccccgacagaacaugaugguacacagcuuuaaugggccacaccuucugcuggaagccuccauagggacaauggaugaaaguaggccuauuugucugcuugcuaauacuuagcacugcuggaaccuaccagauucuuggacuucccauucacaguugcccauuguuaggucaguuggacugcagacuguaagucauucuaauaauuuccuuuaauauagagaaauugcauaaauucuguggcuuuagagaacccugacuaacacacucauagugucuuucugcagugagucauccccaaaugggaaguuagagaagaggaaaaaacaaacugggcuccuuccuaacaagugccucaaagguuuacagccuaugugcaaaugauaucuaugagccccuaaaguaauagacacuguuucaaagauccagcuauguacacugcacuuuuggcaaauuauuucagaggggaaaaauaaucucaaauuugcguuuuuaauaaguaauauauuccacagauuguguguguguguguguguguguguguguguguguguguaugcccaagaguacaagagaauaaaacagaaagauuaugguugauuggagagaaaagguaaauacgaaagcaucucucaacuuggucugacuguggaauuucacucuagucagaaaacacggagcugcagcaauuucugaucagugagugccagagaagcauucauaacgacaaacucccaucacagacaaaggucaaagugcauucugaaggauccacaguuucuaguuaaagaaaccugcagugaaaugucuccauagucuucucugcauuugcucuggcuugcacuaugcuuugcuagcaauaaaggauucccuucucuucaacuaaaugugguaaacuaacaaaaggaggcaauacaggcacucuggaaacuacaggcuaccuccaaaucugcaacacacagcccaaggagagccuguaaacauaaauuuuagcuccacuagcccuucacagggggcacagaugagcuaucauucaaugaccaaaauagugagcaagaaaauuaauacaucugucuuuuuaucuauggggaaaacauuggggagagggaggauaugcgaucacuguguuccaaaccuuuaggaagguuauaagucugugcucuguggaaagcaagcagaauacuguaagugcaaagcauacaguggcaacuauaauaaaugacagcuucccaaccccuuuaggucaaugacugagguuuaaugauccauuucaaauuacauuuacauggcgcuuuauuuuguauguuauuuuauucagagccucuaaguagccucaucugaacagauggcauuauuuccucauuacaaaugaaagaccuggagcugaaacaaugcacacaccaucacccacuggaggccacugcugucagcauacaccuugcugacucccaugugucugucuaaacagaaaagggacaagaagcuauucagguaagucugaagggauuacugagccaucaucugcagcccaugcuuaaaucugccucaguguuuuaacaacaucacugaacaauguaggcaaaucccaauaacucaaguauacauacaacuuccaaauuuguaggcaggaaaauaaucuuaaaaaaggaauaaagaacuguguggcaguggcacacgccuuuaaucccagcauucaggaggcagaggcagugggaucuuuaugaguuugaggucagccugcuugugaguuccagaacagccggggcuacacagagaaaccgugugucucaggcaggggcaagaggugggaaagaaaagaaaaagaccuccauuaguuucaggugaaccuuggcuacauacauacauaccuugucuccaaaugaacgugaacauaugagugaacaaacacaagagacugcagagacagacacauuuuugucugaguauauaccuggccccuguccuaauucagugcugggauaugaagccuucagaucaaaaaggccaaagucucaccaaaagacgagugugagcgauccuucuagucuuccagcauggacaaacagguggaaacagcucuacugccaaagucacugauuuggacuuccuaauuuccagaaacaugagaaaaaugucugcuucuaaauucucuagugccugguagcacugggggaaaaaaaaaaaaaagauaagcaggcuaagaaauccacuuuaaguauuaaaaauguaaacagucacuaggcugagugaguguggagcgcugucuggagguggaugaagacagauaauucaaguaggcacugugcuggguguggagaagcaggguggacacuguaacucaugcugaguaaguuucaagacaaaaauaccucaaaugauaaaaaggaacccauagaaugccacauaaaauuccuuucaugggaaauaaaacauuucuaugcauuuaugcacauaaugaaaaucaaagagccucaguagaaaaaauuagagccauagucgugggacagacauuacaauauuuccagaaaaugaugaagugagagaaucucuaccacaaacuucuaaacagauugggaaacaacacaacugacccacuggcauauaugaaauaaucugaccaguaaugacaggguucaaaacaugggaaacagauuaucacuaauaccugaccacauacuaacucuaaaaauuuuaaaagaacugauaggagagggaggaacuaagugcagaaugggagaggaggagagagaguuggugaugucuugugucuuaucgcuauugauuuuccccuaucuugcuaaaauauagagaaauaaagauauaagaacaagagagacugagaauuggucuaugauuaauggggaagaaaaagcauucuuugcucuuuuaacuuaaaagaacaacaacaacaacaucaaaaaccucaagugugggcauagugggccuuuaaucccaggacccuggagauuggggcaggcagagcuauacagugagacucuuucucaaaaacaacaauaauugaaauaauuuuauuuuaaaucaucuuuuaacacugaguaugauguauuuugguucuaggccuuucuuuaaaauguaaaggaaacuccuuuuuguuuguagaccuuucccucacccauauugucaaacacgauuuuuagguccuguugaggccagagguugacagugacuguguuccuugaucuguucucuauuuauugagguaggaucucucucugaacuugaguuugccaaucugacuagcuggcaagccugccuuuggggaaccccugucaccacguccugaguaaggguuauauagggugaagcaggcccauccacugguacgcacacuuguauaguaagcacuucagcaucccggcuugauaccuaguuuuuaaaaauggacaaaugauaccacaggcaagaugccucaguaaagaagauaaauagcugagccugcauuucuccagauagguucaugacaaaugaucaguaucaucugcuaacaggaaaaugaaaauuauugccauuaucacuauaaagccuaaguuggccucaagcaggcaggaauccucuuguccccaccucccaaguacaccagagugucacacaacgagccaggaucauaccugucaucucugcaaugaggagguuagagcagaaagaccacaggguggaagucagucuaugcuaugggcggaguuaaaucacaacaggaugcucuaaauauccagcagacuggauaaaaucagaaagacuggguaaauauagaacggcauacaggaugcucaaagucaacugacccugaacuucucaaaccaaacaugacccacccacugcacacucugcuucuaaaugcaccacugaacugugggccaaaacaaccccuuccaugcagugcuuuuugucagguguuugucucccugacaucuuaaaccaacacagguguagcaugacaggcaguuugucaagacacugggccacagggcagcucagcacucccauacccuucacugcccaaagcauaaaggucagaaucaugggagcuaaacauccagaccaaaaauauaccuucccaugagcagcccauggagacugccagcagcagauggccauggugaguacuucuuuucugaagcuaucgggguguuuguuuaaauaugagggacagagacaggcucauuuaugaaaagaggagccuuaauauccaaagcugcuagcacuacaaugaaaguggcucaacagacacaagaaggggaacaaaacaagcccucauuccuucuagguuauuccacauacagcucucucucuucccucaagccaagacccacacaacugcacucaugcuuacagacagauucuuagcaagcacaaugugacugacaaagggaaagcaaugucuuaccugcucuauuucucaggaacaaagcccuaugaccaucugguacgaaucuacccaauuaaccagcuggguacuaaaggcucugucuaggugcgugcugacagucuugagcacagcagacucccaagcaugccuucuggacacugguacaugucaccacggcacugaacuaacaaagcaugggcauccuucuuugcuucauucacagggauaagagugguugguuuguguuuuuuuguuuuuuaaaucuuguuucucaugguuuauuuauugauggcauauugguggggggggggugcauuaaacagaaaugggaguuuaaggaagaguauaugauucacaucuuacuuuauaacguaagcagaaagagcccuucugucucugcagagacucaaaggaagagccagagccuggucugucacggcagcugaacacaaagacgacaacaggaaggaccuagucacacagucacaggagcagcccaggcugcuuuaccauucucagucuccucccccagccucagugcugacauuagagauacagagcaccaacccaggaaucuaguauuaaugacggucaacagcaucucaggauacaccacccaacaggaccaagauauccaaacucaacaaagucuuuguauuugccagcaaagaguuaccacugcccuggcuaagaggaggacagagcagcaaauacugagacaaggcuggcuucugguaguaguaaugaauccaaaguuugcauaagcaagggaaggcuuaucucagguuguaccccuaaauaacaaauggaauguggagcugaaaucuacacuuuuauucacucaacuauuccaagauaaacaucuuuaaaaauuaaaacuuacaugcaauaagcuuuacauuaaaugcugaaaacagucucuuggcccagaaucuaaagauccucccuuucuuccuuaccucgaauuucaaagaaaagaaaacugaaaaacugccucugugaacacgacacggaucucuccugcauccuccacggaccaagcacugccuuacgccagcccuguccuuggugaggccggggaagagcucaacaccacagcacacaagcaccugugacccugcucauaaggagggcauaagggcucugcaggccaucucagagauggcacuugcuccccucacccaaccucccucucccucccuccccuucccucccuugguguucucagaaaaaccuguuaacacaguuguuaagaaaggauacugaaguaguauguaucaucacaaaaaaaaaaaaaaaaaaaaaaaaaaaaaaaaaa

SEQ ID NO: 4867 - RNA, 158966 nt, Mus musculus
gccauguacaaagaacauuuuaauuaauuuauuuauuucuuuacacauaacugaaagugauguuacaguacauaaguuauuuacaacugugcaguaauguguugcaaaauaaauuaucuagaaggcagcaaaaguacauugugaauguauauaaaacuguacagguuugcggauacacucuauaggauuauuggcucuguaguguuucaaguuaccuucucagaaagagaaacaaaaugcccaagauuagagggaaauauacaaaccacguggauuugacuccauuaaaaacacuaucgaagaguccuggcugcgucccuguguccaggcaggcagcagccggacccuugccggcaccaguguccaagccugucccggggaccauggcgggacagcacuuuccugcuucucugaccuggaggucacugcuuaugaagguggacgccuuagucuauuuuccauuaguugaucagaauggaacgaggaauuaaaaacacucugcucugcgacuccucaagugcccugucaucagcuggaagaaaacccagagggcauggcugacacagagccaccuugucuguggccacggucuccuugucccaaggccuggcaaagcucugcagugucugggccuugugcucccacagcaacugguaaaaggagaugcuuucuaccucacugcaucuggaggggagacacacggccaggugcagucucugggcuccucccacuugauggacgcggugcucccuccuccgcugccgggacucaucggcagcacugggcgaccuauguggcccuuguuuguguccugugaccuuccuccgagugucaugcuggcaacaauacgaagucaucguugacgucaaccaugggcacguagaaggauggcaccucauuuacacacagggacuugugcccagcgggguccagcuccugggccuucagcugccacuccauucuuugcacggcauugagggcugcagccucauguugcugccgcaucagcaaacaugucuguggaacauacaaggugagagggacggccaggcccuggcuuccaccacugccuucaggcuucacccacaggaccccaccccgcuucuuagcccagaaccugguuuauccccugaugaagcccagguccucuggguaucagcugugugaggacagggcuagacuugcacccagcagauggaccucccccauucugaccaucagauuggaguaacuguucugugagccuggggugugcgugcgugcgugcgugcgugcgugcgugcgugcgugcgugcguguguguguguguguguguaguaaugacauuuaaaaguguacacagggacuuggauggagugggacauguuuaggacccagugaaucguuugaaacauggcgcagagaguccacccagcucaggguuuuucacguuauaagacugauccugagugaggaagggcaguuauggguacccagcaggcuagacuaugccagugaacacacugcucauaucuaucuguauaaaauaucuauaucuauaaaaugauaaaauugcugggcuaggugcgugacuucugagauugaacccugugagccuccccagcgcggccuugcagagacuucugaauggagaaccccguucaccuuuugcuucuagaagaaacacugaggaucuaucauuucacuaagauuuggccauuuuaucgccuuccuuucaggacuguuuucuuuguuaucaaauauggucaaacuuuaaugucuugucauagucugucucuccuagccggcauuaugcauaaccucaccugggcugaggugugacugagaggugacuccaggaccaaguaagagaaugggaaaacagagaaccaccucagcucugagcccgccugugacaagcacaagagcuucugauucucccaaggucuguagcaccucugaauggaugcagcucuaugcucauuaacgggcuaacucugacaucuuacugucuacggcauguauucgaugacagcuaucaggagauucuggguugauuucccugcaugagaagagaaacugggaccggcgugcuggagucugaugcuacccuacguuuggcuuuagcagcugcaggcguugauuuguguccuccuuaaugaucuaucgcuuucccauccucuguguaaacaccagacaauacucuaagugugggagguagguugugaccucucggggaggcucaggcugggucccgccaggagcugcucccuauaccuggacaaaagggaagacacuauagaccuagugugggaaccuccacagagcaccugaggcgagcgagcacucaccuucaugcggucguacuugucgucgacguccugaagccaggagaugaacuggcgggcauugaagcggucucgcacagacuuguucucaucccccugcggggucaauagggaccgugagggugagaccuuugaugagcgguucuguccuuuguccaucagagaacacuagggcgaccucauccuagcaacacgugcuucaacccucuguucuugcccuugcggauuccuagguacuggaggccguagacucagccucugacccaccaagagaugaggcuguugauaguuugcauggcaggacugcgugggaggccacuuuccuaugcauagaauguggccuccauuuuaccggugugcuuuaauguauuuuuucugcuuugaaaagcacaguugagaagucugugguggaaacaggggucuugugucaacuggggucaguuuccuuacuaucucccucuucauggagugagguuugauuuucaucacaggaagccuugaaccaaguuuaauguugccucacaaaggggagaacuuggagcugggauggacgcaucugacaaugccggcugacaugccugcauacugggggcaaggcaugguagaaacguuguguaguuguuggcccagaaccuguggucaauaucuaguguauuccaggagggaugaggaugcaggcaggaaucccuugccuuuuccuuuaaaaacaacucaggaaacugcuugaaaauuauagaccuuacaaacaaucacuuaucugcaucgguuugcugauguagaagaguaucuuaugugcuagcauguuaguauacaucuguauaaaccagcacuuaggagugggaggcagaauuaagaguucaaagcuggcccaggguacaugagacugucucuaaaaagaauaccuguuauuaaccugugaaaaauggggaaaguacguguguccuuuucccccauguguaagaaugcuaauggacugaaagagauuuuaauccaaguuuacucaauuaugcuguacauggcaaggggccuauagagcucccauggucucaacagccaggauggaacagguuauaagcagcuacaugcucaacagggacacagcccaggaauaagucuaagugcuaugagguuucuacagaggacagagagagaauaguguguaaagaacgugauggccugugugugacauccuggcagagucagggagauggugggacugugcucagugacaggauggggcaggaaugcaguucaggcacuggaacgcuguucuggcauuuggcuccaacuguacuacauaaaaccaacuucccaacagaaugaagcuaagagccucugcagccucccucacaggaacacugguccuguggcccuaaugucuuguugcuacaauuauugaccaaucauggucacuaacauagcagcucugguuaccuguagcucacgauggggcugccaucagaccugcagccagggagaggagggaggaugcuauccauccuacuugcaugcacaguugucucagagacucuguaggcuugagggcuuuguccgugacauuacugugccuucugaggcacauuggggcuagguccccacagcagucaugagcagggugggcagaguuuggauacaugggagcagauguacuggugggggucacugaccuggcuuuccagaggcauguuguagaccucggaguccaagagcauugugcaugcacugaauggcacugccugguuggcaaugguccuggcugcccggcaaugaacccgaagaaucucuugcucacaggacacaaucagcuucuccugaaggaggagaggaacagguaagcuuaagauccuugccagcaugcccccuacccgaggcuccacuuacccucucgaugcugugcugcaggcgcagcuuaccccgcacagccucuuguugcuugaacagcuccuucaggggcucagcuagagagggagggggugcaaucugcaaauauaaggcaaaagggguaagccaugauaaacauauuaaaaacugugaacauguuaaccccacaccuagaaacuuguguuagucugacgguuaccuggaaccaccacagagcagagcugcacgugaacccuacaaguaaauaauggcaggaaaggcacaagcagcugggucagguguacgcaccuaugccaaaggagcacugugggagcguggggaucuugagugaacagggugcauucaguggagaugugcauguagaauccugaaccaaggcuggaugucuuggggugagggugcaggcuaaacaaccaugauugguuaaagcaaugaggggaaccuucccaucauaucccuauggcccuguggaagugucucccagggcaaguaaauacaccagagacaaugaggagaggacaugucugcggugguccguauggagucagacuuccaaggcagacacagagagguggguugaacuguguaaaucauuuuuguugucucuaucacuaugcaucggaggaggagcaugcagcggcggggaugggcagcacauguagcucccugugaggcucaaagagaagugacaacacacacacacacacacacacacacacacacagaggaaacuccauccuuagaggugcuggggacaaagcaggaaagccugggcagcaggcagugcuacagagugacuguggcaggcaggacccaccugagguuugaauagcucacaggcuuuucacuaaggcucagcaggaaggccuggagagcagccucccucccaguggcccacauggcagaacucucacccuacauggcaggcaaggaugaugccugagaggcuugggaggcucugaggcucaucccuaacagcucacauagacuagcaagauggcuccgcaaguaaaggcaccugacaccaaaccuaccgacuagggcaggaguguucacaggccucaauaagccugucuuccaagacaaguuccuaguggggcaaggagaccaggcaggacacugaccuaucacagggaggaguacuuaguccaggagcagaguaugggaggagacugcgcacuccuguggcugcugaccuagugaagccagccccgagucuugccugcuucacucaagggugugucgaugcuaagagacuguggggaggcacacagagcacugacuuaucacucuguuauuacuuugggcuuuuuggaauguaauaggguaggcaacaaagggucugucuggcccugcaugucagaauuccagguaggggagguucugggaucaagcuagcuguaccgauauguuccaaggugaaccaaaugagccccacccuccuuugcccauguguguauuuucugccuaggcagaggucagcaugaccguucccuuggacaaacccuuacacuguagcaaugauggcgagucucuccaagucagggaggaacaaacaagggagcuggcuacaaaauccagcuguguagaaaggaagcugcuugcagugaggugaaaagggauuccugaaauaggacagcacuauguggcugugugaaagaaaaggccaguucugagguccgaggagaaggucagaagaaguuguuuguauggucaagcgggaugugcuauguaugggacgacccugcugaagggacuaaggacagcccugccaggcagaacagcagccacugaugucuuaaaaugaacuccaaugaaggaauggaggcuccagaauggcagugagacccaagaaccaugccaggugaaggugggaacggggagggagacaaggcagcugagggccuuucauugugaaagaggagaaaaagagccagcaggaaaagugcagagaccacuggggugggaggaggguguacauaacgaagggcuagcuagaggaacugacccucaaacaggacaagaaugucacugccuccugaccacacugcucucugcucguuauugcccugcugccgggugcuuguggagacagagcccauggcacucaccacagggaugugcagcuugcugaggggcuugccguccaggagguaggaccccguguaggugacauacuccgcguagcacuggggugccugcggcgugaugcagcagaggaucuuucgcuucucuucgaucuucuuccggauuugaagguacucaaaguagggauuggaccugucacugugguagggcucaauggcauccagcuuuauggcauccacaauggcugccagcgucugcuggauaaccucccgggucugcuguguggauguguucagcugcugcugcagcugcugacuagaccgcuggaagcgccgcuugcggggauguugggccugggcaucuuccuccucagaggcucgacccuuggcucuagaggcuggggugggcauuggguccuucucugcugcagguaugcccugcuugcucuggcuugccagcaucugggcacgguuccuggucauacgcugaggaacuucuuccaccuugggggccuuagggaccucagauguaggcuugggcucuggaucuguagcuucugcuugaacguugccugggggccccucggccgcagccacaacacaggaggccucugcacuguugugugccugugccaagccaucugugguggguccaucaggugcacagcagggaguggcagaaggaucuucaguuucagcuucuucaucgccaccucccggaggcugcuguugagggggacugggugcuggcaccgaauuggagauugaggcuucaggggcacugucgucugcuaggaccucuguuuccacuguagcuucuagaaccacauccagcuuuggcuccucugagggcucgggcucuguggagagcugaggcgaugcuuccugaggcgguggggcugguggcuccucagcugcuggggcagggacauccccuccgccgagaacccccguggggccuggagggcucuccgccggaggaacaggacuggccuuugcggcuucugccucaacaucugaagcaucuuuggccuggagaggaagcucuggcagugagaagggccccaggucgaggucauccucagggcugguaaaggcuucaugccaugagacugguuccaccuggcugaggguagauaugcuaggauugcugucuaggaagcugcucuccaggggucccagagccucuaccugagccacagcaguaacacccguagguucaggggcuguguccaggggugcaucugggugugacuugcaguugcugaaaaacgacuccagccuagcaggagcagcauaaggagcagccccuucugcagcagagauggccacugggauugcuccugucccaccgucuuugacuucuucuagggcuggcucaggggccggcaaaggguaagauccuggagagacaggguaggugggcucugcagcacuguaggguccuggggugguggaauggagggauucuccagggcaaaaauguuuuggggauucugcaaaccucuguggagacuuuagcauaagcucagagccaacaggccagcugacaggguuuucagaggcacuggcaauaagggaggaggaagacaggcccugcucagcagcgguguguguccacucaacagguuccuccgugaugacuguggugaagggacccucauccagaggcuccagauagcugggcuccugggggaggauggcagcuguggccugcugguccucuguggcauccagagguaggccuagaucugggggcagggucccuucaauggcugggcucagcaguucaccucuaggggaaggggaagacuuuggugguagauuggagaagacgcugucugggggugguguggcacugaccacagcuguugguggacaguguaacguguccaccuugggcgaggggauaccauagucuggggaguaguagccaggggacaggcaggcaaacuuuucugcaggaacggguggcagaggagcuuucucuuccagcaagugcuguacuggggagucaaaacuagagggcgcagggacacucugcugccugaacagcuuguccccagcacugaacuccuccucggguguccuucugauauccacagauaucgagcgauaaagguuuguggagauaggccuggugggugucuggccugcugcguuuucugagaccacacuggaagccacagaaaaccugucaaaaaagggcggcgagcaggcgcugguggacgcgguggagacgggcaucgagugcugggagucggugcagucgaacaccaggucgggguaaucgucagcacugcaggacgggguucugggugugugcaucaccucuucguagcuggggcacgacacuacugaggugggcgugggcaccccagugggucggcucugcucagugcggggugaagcagggagaaccuccuucaggggcuguccagacagccagucuuuggacucuguacccgguccagaguguggcuugcuuucacccguggucagcgugggagccggcuccuugaccuuuuuguccagccccagagccuucuuggaaggaaaguccaggcucuucuugcgcccguccuccgugggcuucuucucuuugagcuuggggucuccagaccgaugccgcaucuucuccaucugcuucaugcgcuccuugugucgcuugugccgcuccucaaucucgaggucuuucugggacagcauccucucaaaacuugucaucaugaggucgccaucucccaggagcuucucccggggucugcugucuuucuugccggagucucuggauggcacaaguuugucguucccguugcucaucuuuauggagucgcccuuuucucgcucuguguucuccuugaacuuuuccuucagcuuagucucgcugaguuucaggcuuuccucccuggacuucuccuugaaggaguugggaggguuguccuugucuuuggcugcaggcuuuggcucguccuuguggugucucaggaagccguccacaugcuugucccugugucucuccuucuccucccuccaucucucccuguguuuuucucucuucuucuucuccuuuaagaugcugauggcacucgagccguacggcuuuaacuccuucucuauccucuuggcaggcucucguucaggaucacuccugucuuucuuuucugaggagaacaacucaauggccuuauccagcuccuccuccacgucagcuuuugugggguaagaaaccccguaagucucugcauccaggaagucuuucucgaacuggcuggcauccuuccugacgcugcugaugcuguccuuguagucuucgcucuucuccuucuuuucugccuuuuccuucuuggcucuuucacgcucguggcuuuucuuagaggaggaagaggaaugccgaugccucuccuucucccucaguuucucggagaggcaggcacugucccuggccuuguccucugcugggggcucagagaaggagacuuccaggagcgugcucaggcugggcuccuggccgugguccgcaaagcuguccgaggagaccucgcugaucuugucguuggaguccucccgguagucgugcagagccucuuccuccagcuucuccagcaggcucuucucgacaucggggccucgggaaggcuuccgcucccucucccgggagugcuccuucucuggcuucuccuuguguuuacucuucaccuuguccucagcgaagugcuucuucucuaccuuuucggggagcuucuguuuguuuuucuuuucuggggcagagucagccgaggcucgcucuuuccuguccuuguaucucucugcacacuccuugucuuucuuuucuuugugcuucucaaagaucuuuuccauuuuuuccuucuuguccuuuccuccuuccgaagcuccucuguccuucuucuuuuccuugggcucuuugucucuuggcuucucugugugcugccugucagaagaggacuuccggugccuguccgagggguguucucguccuuccuccuuuucugggaggccguccacucgcugggugucgcuggccucuguggccuugaagcugccggccacgcaaucguccuucucguccucgcucucaucugugaaaaugucugcaauguaccagcucuucuccuuccccuuccugucauccuuucucucugagaagucuucugagaugaugcuagagaacaccuucuccuucuucucucucaguuggucaaaggaugcuuuucugucuuugcuguguaugucuuuaugcuuuuccuugccgucuuucuucucuuuaaagcauuuuucaaauucuuugucuuucugacacuugucaaggguggacuugucacuucucucccucucgcuggacuucucuuuguacuugucugcccugcccuuuuccuuccuuuccuuuuccagggcauccuuuuucuccuuuucccgcgcugcauggggccguucccagggcuccagguucuuggggaagucacagucugacuuguccuugaagcugcucucgaacccacacuccuuuagguccucccugugcacuucuucagaccgaauccgcccaucccuccugucccggcccccuucugcagacucucgccuuuucuugucuuucucagaaagauagcuagggaugcuuuuaugcuuuuccguuuggucucuccuuuucucagaauucuugucuagacagucccugucucucuuucggaagaaagagucuuuaaaaucucgcuucucccggauuuuguugucgcgcuucuuuuccuuacugucuucuuugacaguuuccaggauaaguuuggccaccgagucauucuugaugucucuauagucuguuacugagucccagcuguccucuccuuugaaaucaaaagaggaaucagacaggucagaaaaccaccucucuuguuggucaucagagaggcugaacuugguguccucaugguccagaaacugacuuuuguuacaauagucaucaaaggcagcguccucccuguacagcuuuuccuuuuugaguuucucuuuguccucuuugaaggccuucuccuucuccuuggagagcuuguccucuuucaugucauucuuccuuucgagucuggaagcucggucuuuggacuuuuucuuccuuuccucuuuguacagucugagcuuuucuuccuucggggacuuguccuucguggcccucucccucucugcuuugcuggcacggucuuugucuucccggaaggcucugcucaugucuuuguuggcauccuugauucucuucagcaccuucucauccuuaaagagccaguccuuauccuccggcuucauccuaccgagcuuaucuucuuucuuaaggugcucucugucguguuucaauaccuucagcuuauucucaguggagaggucacucucuaaaaggauggccuuaucugacuuuugcuuggaguccucauauucguagguaaagcuuuucaguuuaaguucuuggcugacggaacacugucccuucuccuuguguuuguguuuguguuugguuuuguguuuuuugacuaccuucccuuccuuguccagcuuggggacagcgccauccguacagggguggaaggagcuccucuucucugacggcgcgcucugcaggacaccccuuuuucgguguuccugcuuccuucucguaggcuucagagauuccacacuagagcccucggaggagcagucagacucacuggucagucccguccuugaggagucugacaaagaacucaccucagaccaggcuggagaagaaauggcuuuccaauugucagugcgccagugcuucgugugcuggucgguguggccggagccgugcuucugggccacagcgcuaccaugagaugagguggaggaggcagacagugagcugaacagggaaggguccuucagcaccagcggggaccccuugaggcagccugagcuccccacagaguccccgucguccuccucgcucucugaggacucacuuucugacccagaggaacagaacuugucacuccucuuuccaaaccgaacuucuuuccccuucguuucuuucuuucgcuucuuuuucaauuuauucuuuucuuuuugcugccuagaacuagaagacucucgugccuuacuaccagggagcauugugugugcugacagccucaguuucucuccagccccuauggaaacacucacguccuccucgucggaugugucugacaggaugcgaugggccgccuucuuuggugcaagcguguuguuuuuugaguagcucuucacuuccaucuuggguauggaaaugaagcuguuggccuuagccuccuuccuguagucuuucuucagcaggugcuugucguccaccggggggacccuguccugcucgucguccucaucaaacucguacucauccuugacgggggucacagucuucuggggcucuggguucuuagccuuaagcuugaggccuuucucaaacucagagucuguguuauugccaucgacggagcuggaaggugcgaaugacggggcguccucuucuuccgagcucucuguuggaaacaggaagggagaugucaggcggaacagcaucauucuccuaccgucaguuaaagaugcucugcaccuguggugggagcauggugcccaggaagggaagccggacggcucugcuucugaagaagcacuugacuuagucacaucugaggccaaccacaggcagaaggaacccacaaggcuggggucucagcagacagaguacaggcaucuuggcagugagggacccuggcaggacuccugcaaguuccugaaggcgccagccagccaccugaggaggcuuguagacccugugcugcaaucugcaggggaauaccauauguagacacugcacggugcuggcgagggccaggcagcacagagccccgcccacccgcugcgguugcugggcuggcuuaccaguagagcucuccucacuggaaguguaugugccuuugccuaacaggagguucaccaucguuggcgaauuggcuacuuucaacggugucucuccuuuucuguugcuuuguugaggauuuccgccauaccguaacaacaacuucaccaccuacaaaacauuaacguugauauuaacagacuguuugagaaaucguguuacccugccaugccuguaggaggccccccuguugcgggggcuacguguagagccauaagugucuagcagggcucugugccuuugugagggacugcacagggcgggucccuuugacaagcaggucacguccaggucucuccugcucuuccccaaucuucucucgagcuccccuucccaagagagagcugggcagcagcacagcucccaaagaggggcacagaggggcugggggugggaaauagagaaaacaaagaccacauuucuguaagcugguuuauuuauuuucauuuacauuagaaaauaagagaacuccuuccuugcuugauuuuacaugcauaaaggugguuacaugggugacagaaacauucaaggugacauuucaacagcucuauucagucauuuaucagcauaugccugaaacaguaacucacucuauuccagugcaaacauccaguuucaaucuauccucaacuucaguucaagcuuuaacacauccucuugucacucacaaacuguuuccagcucaagguaucaucaccaugaagaguuuuuagcgcaugugagacucuacugcugcuguaacaaaucaccacagccugccucagagucgagggaaucagucucgcuggcuuggcuuacaucacggcgcagauaaagcuggcucguuccuucagugugugggcuguugucagaauuugguuccugcagugcugggaccaaagaccuauuccugaugucugucguuagcggucaguaccuucugugacuuucuccuaaggccagaaauacaggccauguuucuacccagccuacucuuucugucuccuuuaucugucuacuucuuccauccaggaagcugccuuuaggacuacaccauauaucucuccugagaggccacuguuguucuucagcuuacuguguuccuauaguugugacauuuuacauacuuaaagaaaaacgugaaaacucauggauguaugaagacuuagauaguggcucuucccucccaguuuuaucacuacccaccuuccaugguauucuuuuacaagucucagacauugcauagacccuuucagaacauuuuucuaaaagggcucuuaaaaaccagcaagcaaaugaaccaucaugucauuaucuccauauuaaaucuaaaaauguaauguauguauguauguauguauauguguguaugcugugcaccacuggguucuugagagcuguagguucuggcacaaccaggcaggaccugcuugcugcacuauuaacuugggcagauguucccauucuuaccaagcuuacuguucuucaguuuguagcuaauaaauccacuucugcaacccauucucuuguaagaagagcuaugucuggcauaucuuaggguuuccuucccuaccggaagcccuuucccuaagagaggaagucuuacccagcacaguaaucuaaucuugacuaugcugccucucuccccgagacucugaccuucugggcaggcucaguacccgagaacaggggcucaguagccacucaugcagucagaagagccagcacuacacagucacugcagugcuguuugcgaguuaucaaaacucagguuaucuggguacuggccuagggcagaagcaacagcuaggucuuaaggcuugaaaagggauuggguggggugagaggcaacaggggacagcaacgaugacaacacaaagcucacuucccagucucagaaaaugugaaaacuagcuaggacagagaaacaugaagcuguagaauaguccagaaguuaaggagagagcagccacuggagggcugcagggagaugccaaccuuguagugcccguuguuggcggcaucaugcaaaggugugucaucauccaggcccuuaguguucaccucugcaccagcggcuaacaguugcuuggcgaugucguaauagccccgguuacacgccucgugcagugcaguccagccugcagacagaaacuugggguauuuguuauguaaucccugaaagcuucacccugccuaaacuggggggaagcacagaggaugugcgcugcucucccuaaggagcggccagcugggcaauuguuaccuuacacccugagacggcgucccuuuaaaacaauuguggcgcuuugcauaaugaacaucuagccugcuaaguuugcagauuuaaaacuuuuugaaauaauuauacuugggcagaaaauuugugcacagguuaacagucagaaaaugaaaacuguuuuaaacuaaugugcuauaucagacagaaucaaacaaucaugaacuaggcagcagggaaguugaguuugacugaguccuccucacucuccucucugagacagaauuucagacauguguaugaugaauucuggucacauccccagcccuucggccuccaguggucacugcacugugaauacaugguucuccuggugugcugcaccauggugggggagcacauuucaaaaggcagccaagugcccuaaucacaaaaaccacucaauguuaagagccuugcacuauaucacaucuagggaggcggcuccagccucuguaggaagcagcaagugugcuuagucugcagcagaguggcaguggccucugcuggacacuuagaucacuagcccaaggccucccgauguggaaggaaauaguuaaagcguacuccauuaccccccccgcccccaauaagaaaaagauccugaaauacuuuuccagagacuaauuuagcggcaaaucaaacuguguuguguggcugucagucagcacagaaacaagcauacuccacaaacacacuucuuccaauguucuggggcccacccucgcacggggcucggcccagaccuaccugcaaaguccuugacguucacguccgcgcccucacugaugaguuccuugaugcgccgggcauccccucggauagcugcucggugcaggcgggucucuccgcguucauuucucuuguucaccuuaucuuugguuuuugaggcagaguuggggguccccuucugacacacuguagacugggaagggugcuuugguguugugucuacugcaggccaaggaggaaacaggcaggacauuacagaaggcagcuuuguuucaugggaaccucaagacccaaccauuuucauuauggaaaggggauccauacaggaccacugccaaguagagccacucucuccccauccaaggaaccaaccagugaagugcccaugcucacccggacuauuugcagacuccucagcagucaucugcaugagcagagccaccugcugacgcucagagagaggguauccagcucggaucccagacagccccaugccgaacaacagcccggacuuccgggcaacaggcuccuucuugauccucuuccgcucgggacccugcuucucuguguggcaggugagggagaaagggaggggagacuucaugcccaauccucaaagcuggauuuguaacuaacguuacagagccccuucauuccacccaacacuuacagagcaacaaggaaggccuaugaggggaagugaccgugcugcgagcacuggcagcaccccacucugugagcaguagcugugagagacacaguguaauacccuguugucagcccaucagauaagucuccaucuccaucaaccacuugcuccuacaggcgccacacacaaaggcaguaggaugguucaacaucacuggccuggcccacaugggacaggucacuauuauuagucgugucugcaguuaaacuccuucccagcccuccuccaaacaaacagugcacauauaaaauggcagacacaguuuaauauauguaaauaaaucaaggccaacuugucaguacuguaccuuucuucuugcuucuaggaaccuccauuucaugccauggugcuucgaggaccguaccagccuugcaguaccacaacauggacugagcuggaggcaucuaaaggcaucaacacagagcacuaacaagaacgauguaacagcucagcuguuccaucuuaaccgcuccuaacaggcagguccugggcgccucugaccacugacaaauggccugccaaccucuacugaaggccgugcugcugcucguuagaggugggguauggagaaagacgcccccagaguccaugaccugggaacacaaaggcucucgcuuugaauccugccucacugcaccugucuuguggguggagaucuggagucagccccggagcagggcuaagcgggauucaagguuccccaggccacaggguacaaguuacauagccuggggaugguaccuguaggacuugucuuccuuuccagucaagaaacccucugcaggaaugggcuggcuucugaaaacagugucugccugccucuagagcaggugacaacucuaagaaagcagccuaggugaccacaugauggagacuuccucagcuuugucaguacuugucccucucuuccaauugggugucuucaggccccaaccuccaacaccuuacuaccaaguguucugacagacuguuagcucuuuacaagcaugucaagacugccuucuuaaaaacuaaauccauggcuuggugacuuagaagauuuuuaauguuauaagccuguaggcggugacacgcgccuguuuaacaauucaugguaaaacucccccaaaacacuuuaggccacagcagcuaauuuuaaauaagccaugauauauaaauaugagaaaauuaaaaaaaaauuaaugagaacugaaucucagaaaccaugccacccucagaaagacugcgcacaguaugugugacacacuccugcaaauuacauuugcuacgugcacuaacaauuccaagagacagccaagggucagcucugcuucugugcgguugugguuggcacagugcggguuagugugucuucacagcagagagcacaguuuauuuuuauaaaguuuggcacuguauugagucucuaacccugccaacuaaguuagagguggcaucuuuguuuuguuuguuuaaaacaguuucauagagcccaggcuguaacgccuacacccugccucugcccccacaagggccagcauuauacacacguaugacauaccaacaugcuugguuuuuguuugagacagcgucuuaccauguagcccugacuaaccuugaacuaaagaaaugggccugccucugccuccugagauuaaaggaguuugcugccaugccaggccacauacuuguuauuuuaaagauaacaaaggacccucaggcagucggaggcacauguacuuuagcagucacucagaggcucaaggcugagccauuaccuugagcagcacacaagaccggcuugcucauccugcagaacagcugcugcugggcucgggcucaaccagggaggacguuaccuccucuuaaagaugcucagggacaggcaacaccacaaaaaccgcucugcuccccucccacugaacagcaacuucucagccgaacagcuuaaauauuaucagccuugucuaaaugggaguggguggcaacaguuaugaaaugggcuucuccucaagucucuucacugcaacaacuggcacgcacaacuguccaauuucacuccccagucucaaaguccggcaaaccugagugcuuagcagacugagguacuauaucaggcuucuggguaaaagaaggacaccaaaggacacugaaaguucuguguccaaaacugucugagcugccugacaugggccugcaccccugaaaagagggugacccagcuccacacccacugucacaguuacauauugucugcuacaccgcgaaguagaccacugagagcuccaaggugacaguugaauaaguggcagguggaguccacagcagggagagcuguccaacuggauccaacagucccccuuuaaaacugugcuguuuagucuuugcuuuggguaccgcccaaggucugagaacaggagggauggacacccagagacagggaaugugcugcacucugcuucucugcaggaucuuccuccucacccacacgucucaugccaggccucugagguaagacaguuguguuuuaucacucagcacugcccuucaccuggacugcugguguggcuugcacuggcagccuguucugacggcauccauggaggaaaggcagcaaggacagagcaugcuuucccagggacagaguccuugauggaaagggcaacaaacccagcuccuggcugcuggggugccaggggccuaggacucugccagugcucuucaauaaugucuuucugcucacacuacagcaaaugcucccugaggcucugacaagauccauuuauauuuauauauauauauaugucucugucucucuuuuauuuucuacuucagucauggcuccguccaggagaugucuucagcuacaaugaauucacugaucguuuugucagugugcgugcaggcgugcaucaguaugucaaaggucaaccuuggggucuuuuggggcugggggaacagggccucucacuggccugagauuuugccaagcagguuaggcuggcuagccaguggguuccagauauccacgugucucuacuuuuccagcucugggauuguacacaugccacccaggaucuguacacaggcucuggggcaugaauucaagcccucaaacuuguuuagugaguguuuucucacagugauacuuuuuuuuuuuuuuuuuuuuuuuuugguuuuucgagacaggguuucucuauauagcccugguuguccuggaacucagaaauccgccuccugagugcugggauuaaaggcgugcgccauuauguccagcuuuuuuuuuuguuuuuuuaaaaauauacacuguagcugucucuagacacaccaagagaaggcaucagaucucauuacagaugguugugagccaccaugugguugcugggaauugaacucagaaccucuggaagagcagucagugcucuuaacugcugagucaucucuccagcccuggccacugaauuuuuaauuuuacugauaauuuucauuuccagauguuugaucucaauucuuucuccuaguucauuuuacuaguuuucacucuguccagaucagagugggguucuaagguuaucccuugcagaaccuuuuggaacagcuuuguccccuguagucugcaauccugacgaaggaguucuggcauccagagccuuacuuuugcucuucuugggggccagaaacccucgguccugccaguguauauggaagcacauauccaacccuacuagaggaggaacagguuucugccuucugaauuguuuuagaaucuaccagcaauccuggagucuuucaauagcgacugccuucuuuuauagacaauggguccuaaagacaggcacugugcagugucugaggccugacuccagggccugucaccugacugagacaaugcacuuguguccacgucgcagugugggcuuauucuuggcuuuuaauucuagguuuuuucaacaagaccacuuuuuacaaguaugggccuucagaauccagaagcagguguggucuugauucauggugguauuuuaaacagcaguaaauuccuugcaggugccagugaaacucuccagagcaguuugccaucauuccuaccaggaacaaguucagugaacaccguaacagaucccaaaacaaccuccccaucaaauaucugagcaagucguggaaucuagaguaacuuagcuacaguauuucuggucaccaagucccaauccuaacacagcagguagaggguucaacagaguguucucagcagcccaacacgcagcacaaccucauugaguaacaguggugacugcaaaccgcacuccugacuuagugguaucuuuuuguuucauuuuuagggcagccauaauuaagaaagccugugcugagaugcgugacccucuuagcuaugcgcgguggccuucuagaccuuguuccuccuucugagaaauggacuagucaccuguagcguggcagugaggccagacucaagaaaacaauaacuuggcuucuaugaccucugcaggucguuucccaauuucuaacugaggggaacacugguucucacugcaccgcaugaguccagaagaacacaagugaugugagcgucucgacccagacaacaggcaggcagcacgaucuacaagcugccccuuacuaugcuaaaugcaugcuaaagauugaaaaauacagaaauacaaauccaggcaugcacugagaccuggauaccagcagcugggagcagaagccccuccuaauacuaagauccuaacagaugaggcagaaguagcacaggcaagggcucacggcccucaguguggagcugggagcacacuaccuggcuccuauacucacaugucugucacuccuccucuugucuuccuuaaggaucucugcugugcucuaaccccaaacaccuuucacauuggcuaauuuugaugucucauugcuauaaaugcuaaauaacaguccugagccuucguaucaaguagauauauuacuuuguucugguuugcccaccagaccaucugccucugaauuauggaaaauacacaauuugaaacugaaauuacuuucuuugcuaguccacagucuucucugugaagaaaaaaauggaaagggcaaauggcugagaaauauaccagaccaaccaccaaguccaugaagcauuuuauuuggcucugguuguucacaagcagucacacugugguuauuagggcaaucagcagguucuccacgccacgcccuuucccugccaagcccuagccugugagucagugaccuggcagacagaugcacucugcuuucucacuugccauggucuagcaucugccaauaugcagcccagaguuacaccaucuagugagcaagaggacagaaaagccucauuagcgugugugcacauguacacacacacagccucuuacaccaagcauuccgaguuccauauagccaauggcaagagaaucccucaguuuuuccucucccacagaagaacugagggaucaagccccgaggaaugaacgcuucagugggugucuaagacucaugagucgaccgaacgcuguacagacccgaaaagaggcucaaaggcacagcgguggaaaaaguuaauucucucccuucuuccaaggaagcacuguacugggaagccaguuuugacuucauacgcaauggggcagguggauucugugugagcccuagaaagguagguaggguaauuuauagauuuuuaaauuaguggaaaaauuuucaacagagaccaaauuuuaagcaaaucacguaauuccauaacgaagguuuuuuuuuuuuuuuuuuuuuuaaaguagcccuagguggccugcaggucauagaaucuacuugcuucccaugcuccaggaucaaaagguugugaugucacaccaggccucgggaacucuacagagaccagaccgagagugggaggaagagccuuuccucaccaggugauguauguggucaacaccaaagaccuggucuggaagaggcccugagggaguggagauggucuuacagucugagaugaggguaccggcucagacaaccaggucuguuaugucccagucucgccagugucacagggggucaggacaugcuccuguccacagcuccugggcaucaugaucgcaggcauguuccaucuugaggucuaucugaacaccuacagcaucuagcugcggcauaagcaucacaacacugauagacagccuugggagggcaagcuuuuucaucaggcugacucacaacagacaaaacuguacuguucuuggcaggaugcccucaguccugacuaagcacuggggaagccgcaccuccagugggcugggccauuggcagcagggucugggaaacaggaaaaguuuguacgguuuggucauuuaaggccagccagcuucuugccacuugagggcacaguaaaggacgcucacuauuugcuacuaggaacccugacuggaaugagggugggaggguaccccuuguguuacugggguagaccgcauuugucaucaaggaugagugcuaaacuguacauuaucagcagagggcgcuggaggaacacuggucaggaaaggauaagcuauuggccuagggcacugcaagcauuugucuguaaaaaccuuucaaaacuaggaggugccuuaguaugacugagucacacaccuccagggaggucugacaacccuaucaagaugaccagagagauccuaucuuggucacuauuucaucgaguuaaaaauaucagcacuuuuccagcuuccagaacucugagccaaaauaaaccucuuuauuacacagggggaaaauaucaaucccacaauucuuugcgcacccauucugaguauucuccauccugaaugagguggugggugccacugcagaagccccugcagacaagaugccauccacuccaucauaccccguuuguaagccagcacugcaucucuggguaggagaauaauacccaguacuuccugaggcauccagcucaccaauguauagaagagaaagauuauaaaguguguguguguuugugugugcgcgagcgcgcgcagaacccaauggaugaagacaaaccaauacuuccaguacuuaggagaugaaugcaaaaggauccagagguggaaaccagccugagaaaacugacaaaccccaucuccaaguauagagaugccuaaggcuggacgucuuaaacaacaccaacaguagcgaguuugcacauaggcuucggguuccauuuccaacgaaggaaggaguaggaaaggaguggauccagucuucacuggagcugcgagacccgacucacaaacguuauaaagaagucagccacggauaggacaguagacacagcgcuggccagucacccaucucuagcuaggucuacaguucagucuuccugaaaacgcuaccugccaaagcugagccugugccugccucaggucaggugugaacaugaacaguuugacagcacaccaacagcgaaggcugaaggacaaucuagagugcaguggugcagagccucacagaggccuccacagauggacagacuucccuccacaaccacaacaggagucagagcacucuccugagcaaugcaaggaccgccacuugccuuaugaaucccuacaaacaauguuaaaacacacgcgcgcgcacagacacacacagacauucagguuugauguggucuucugguuauguccugaugagcucacggggcugucaucccuccacuccagcacuacggcagaacagagguguagggaagccugcuauccacaugucuaccauaaguacccacauacuucugcuuuuccuuacaaguaucugugacagagggugcgacauccaugcaagccuuuauaaaccucccaccccgagacaucagcagccucaucucaacguccucagugcuaggagaugacagacaugaaacccaaugcuucaccccaggcuuccucugccauuuguguucuacugccccagaggccuuaaaaaaggggggaggagaaaagaccaguagaguggaguccugccugcaucaucaaauucagaaggauaugcaagccaguagcagaccccaggguucuccuugagcaagacagaauccgacugggaacguacacaaugaaaggugcuaaccccaacccguauaugcuccuguucugcauucuuagaccuauccauucuuaggaagacuacaccagcugccucgauuucagguucucccuggguucugccacaaauccaugugccuugggagcuguggggagccaucaccuagaggccugcugucucuugcccuuacuguuauuacucugggcugcacuguacagacuggugcaauagcuauggcaagacuccuccagggauacaguguuaaacccagucugguaccuguguccgaguccuucugcucuccauuggcccccacggugaagggcagcuuccgcuugguggcucguucucucaccuccuucccgccaucacugcgguccagcuugggagucuugguuagagaaacuuuaucuuuauccuacaagagagagagagcaaugcuuucaguuauuguuuccggguuaaauccucaagucacgacuuuggcuucaugugccaaagaaagcaaacauuuuacuggggcgaucaacagccccuccuguucuaggacauauaugcuucuaggacuaaaaggcuugacugugacugcuccuccuuuagcuaggguugcucucugccuuagccucccaccacgaggacggcacuguugaugaggagcacugaacucucccuacaagucagaaucaaacuccacaacauaacucgcauagagugcuggcagaguuaaaggugcaaaucauacuguccaaggguuaaggccccgaacaaccacaaccccccugcccaccaagacugggaaaguugcagcuuuguucugauucagaacaugggcccacuggcugcuccuggugauagauagccccgcugccugugcauucuauuccauccgaggccugagauauggugagguggcaugucuguagguaagagaaaugagggucucucucuuaggggguaauaaccuaaguuaaaaaaaaaagugaaauggaaguugcaugugugucacuaaaaaaguuucacauuuuaaaaacauacauaaaacucgcagcgugguggcacaugccuuuagucccagcacucgggaggcagaggcagguggauuucugaguucuaggccagccuggucuacaaagugaguuccaguacagccagggcuacacagagaaaaacccugucucgaaaaacaaaaaccaaaaaacaaaaaaaaaaaacaaaaaaaacaaaaaaaccaaaaaacaaaccucgcagcuccuugccuagguaacuaagcacagcguguaguuuggcuaaaauagcguacgaaggcccagugcuuuguucagcugaggagugugcuagcagcagguggccauggugauccucugaaagugacauugaugccuccaugcaaacaaaaccagauggggggagaggagcacaccaaccucuuuaucuagaacacauuagaguucaacacagaacuguaugagugcuuaagcaggccguggugugugccugccuuuaaucccagugcuuaggaggcacaaacaagcagaucucugaguucaaggccggccuggacuacaaaacugaguuccggggcagucaggacuguucaggacaaagaaacccugucuugacugccauucuuccacccccaauacaaagauguucuugaaagugaauguggacacaaaacuuuguucugcaacugggaaaagacagcaugguucaagcucucuccacuguaaaaugauaacugaagugagaccaacuguaaacgcuacagaaugaccacuucguaaauuagaauaccuugagcauuaaguuaagccaagcuuaaucaacacaugccauaaagauggucaagguggaaacgccaugguaccuaaggcaguccuggccccaugcaccugugcguacaugguacacagagcaaagcuugccuuaacucaugaucuacagagagcagagaggagaaacaaagcugcaacucccauccaccagggacucuguaagggcaaacaacucuacuagacaccagcaacccagacguaugaaccaagcagcucacccucuccaagauaaaccauccuggcgccuuccuuggagacucaaugugccacacuccuguccccaccucaucuuuauaguaaauauuccaaucagagagcacauaacuucuccaguugcaaagcaaccugaguuacaacagguuccuugaguguucauguaagcucaaggaucaguucuuaccaaagaccuguaaggauuucaguggcaguaugucaaauuuauauauaccuaaagacaauuuccugauggaugcaguuauuuaggucuuccuaauugcucaggaauuuucacauccuuuaacaaaugacuuguugagaucugucuaccccuuccuuuugagugugucuccaagccugacaaaauuauuuuauuuuuaguucuguguguaugcauacagucaagugugccucugccucugaguguaugcaugugugcgugugugaauguguggcuuuaauaugcaggugcucucagaggccuuaagagaaaggugaauucccuggagauguuuuuguuugagaaauggucuuacuguagcacugccugauccugaauccuaccagaggugggauuacagauguuuguaaucaucacacccagcuauauauuuuaaauuucaaucugaaaaaucccugauuuuucauuaauuacauuuagaaguaaauuuuauuuacauuugacaccuugcccgaaccauuaauucuuguagcuuuugugcaacuguugauauccuggaguaaaguuuauucugcccuuuccaaucucuuguggcuuuuauuuugcuacugugcuagccaacgccugcauaaaacugccagagguggggacuuugguguccuucugcugcuuuguauccaaccuuauauagaauucagcccucauuauuaaaugauggcacacaggaauuuuuguugaauaaauuguaauaaauguuaaauuuggucaaaagucuuugcuaugucaacugaugucauaaacuuaggggaaaaauauaagcaaaaguucugugaccuugcaugugacuauggcugggggaaaugguuucguuuguugcagaaucauguguucagaucuccagcaccuauauaaaaagccaggaguagcaguauuaauuuauaaucccuacauauaagaagcuugcuggccagacaaauuggugaguuccagguucaguaagagaccauguuucgaaaaaugaagcuucagaugagaugucucacugcacacaagugucugcugacaaacccaauggucccgggacccaugugguaggagagaucuucugcccacaaacugcccucugacauagcugaggaagcauguccaugggaaccucccccaaucaaagacuuccacaugcuugagaaagaacacgugugaguccugucuucaaucaaucaauuggucaaaauaaauuggaacgcaagagacagacauguuaacaguuuuucuggcuuccacacacacuugugcgcgcaaauuaauaauaauaaacuaauguaaaaaaaguuccacaauaguuagaaggaaacuagagcaaccucaacgggagccacaguggcacugugggauucagcccaccaggaaggucuuacguagccauuuucuagguaguaggaauauuuuauauacuuauuauuaaaaucaauguaauauuacauuauuaaacauuaaaucaaauauuacauuauuaaaaucaggaaguugaauauagggaaugaaggccaacuggggaacuuguguuugaggauccucuaugcucaagaaugcucuguuuuauagucaugacguguguuacuguuggagaaauggggacugaacaggaaaugguaacacccaaggagcugugaagcuaagaaugcugaugagcagcaagugucagagggggugcuucaggcgcugacuuuugugaauggggguaggagcugcacacuggagaagccaucgagguuucagugguuugcuacccuuggcagccccagcaacaguucugugagagaaacccugcacagccaugcuagacucuucucuccugcuauagcaaagggaaggaaagaacagaaagcccagaggacaauacucacaaaguagacaucagccucucugccacugccaucacuaacuccugugugguguccugaguuaaggcgacacccagcuaaggaugggggagagugaaucaggcuccauaucaaucuuucuagcauccugcucuuggccacagccuccuguaccuccugucugucagggguagucuacauuucauacacagaccucaagaacacucccggaaaaaaaaaaaaaucacaggacccaacagccugacuguaagcuauugcccuguugguggcacucgcgcagccgccucuuaagguaggcuucaaccccagggagcagccaucagauucaguuaaggggugaauuuguguuuguccuggagaaacauuggaugcucugguacuguaaagagccaauagguauuauggcacacaggguacacauaguuugcaaauuaggggaugugcuauccuuccuugagggaccuaauuagacagaggcaggugcccacccuuagagccaccuccugcucaccagucugcaugagggaugcccgcggucuagaaacccucugagaagugcagaagaggcuucugcugagacagauugccaucugucacaggagaaugagaaugagccugaacuggacgaaagaucucacuuccugcugaggggccuuggauaacacagcggccaucuagcucuguggacagagcaugaccauaagaguaggagauuugcuggucucuacuaaggcuaucucaguaugcaguauauagauguuccagacauuuuuggcacuuucuucucuacaugucagcuugugucacuaaugggucuguagcaagauaugugacagaagaguaugucacauaguguaugauucauuugggagaaaaaauuuaaaauuauguugcuuuugauaacaugugccuuacgugaggaaguaaguucacauuguauagccagagccagucaguguucugucacuagcaggcccuccuucaugaacuuuuacucaacauugccaccugggauccucuguagucccugaagaauagacaccuacguacuccaucuuggacugcuuucuacagagugaccagguaagauaggaaagauccaccacggccaagcacugcagcgucacacagcaauuucacggguccugucaagcuccagaaaaggccagauuuaagcaaguaaucaaacaaacccaaaucaagucaggguaccuugcugggacacacacacacacacacaccccuaccuuaaaucgaauucauguacaccacccacauacauagcccagguccuguagucucaggaauaacucagcucauuacaacuuaugucuucuccagaguuaacaacaacccuaaccaaccugaaacauguccauguuccuaggaggcugauauaacccaaccucuagagcuuucaucauggcucacuguagccugcuacucucuagagaccagccugucuccuggaucccgacuuaagacuuucuugcccuuuuacccauuccugucaagccaugugacauacaccugaaaggcaccgcuucuuucaugacaacuucugggacccacacugaagaacuaauucugggaagagcuuguucagcuuugucaguguagccaaauggcaggaccuucucucccaucccccaccccucccucucucucugggaguuggagcccucuggagaauucuuuaacagacaagagcagcagucagccaggauggagagcaucuauaaaccgaagacucagaaggcagugaggaaaacucagggaagggagggggagacuuggauaguuaagugcaaggugcuccacacugucacacagcugaggugaagaguaggcaggagcugcacuaagacaggaauggcugagucugagcaaggcuccaacacaaggcagugggaguagggugcuucucugaccugaaugcccacagacucagcaguaugugauguuucugaagccagccuagugagagucuuuuuuaaaaagucuaggaaacgacagugcagccuuuccccuuguuccugcucuacaacuaucugacuuuguugcauggaaacuucuaugaauauaccugaaaaccaugccuuugcaucuauucggugugaaacuguccccaaaaguaaguucaugcuacauggauacucaagggucccagaggccccuuuaucuguucuuuuuaaacagcagcuacauaugucauguucacaaaccacuucacagugaaccgaaugagcagaucaugugacucugcagugucugccuguauaccacagcacuugcuagugauuacagggggaguauuagcaacaugcagaaagaaucaaaaugaaggcucacuuacagcaagccagagcugggacccucucacagacacagccaaggugccaagacaaucaggagggcggaccagaaaugacagcaauaaaacuugaggaaaaucaccuuauaaaaacaugaggucaagccgggcaugguggcgcacaccuuuaaucccagcacucagaaggcagaggcaagcggauuucugaguucaaggccagccuggucuacagagugaguuccaggacaaccagggcuacacagagaaacccugucuugaaaaaaccaaaaccaaacaaaacaacaaaaacaaacaaacaugagaucaguucugagagugugucagacuucaucucacuggcucagaugcugucguaccacagcaagaaacccagucccaggacaacucaugggcuuggacauagucacgcaaacauaaacaagcaacuaaacauauauuuuaaggcaaagccuuacucugaucuguccaguucuaacuucuugauuuuggagucuuuccuuuacgccaggaaguauguaccccagaaucugaugucaacagcacugacugacucuggcaacuuagaguuacauuguauaaucuuauuauucuuuuauucugcuuugccaccaccacccaaaucuauuauuguuuugaauuaacaacauuugaaagcaaacgucuaagacuauuuuacagucaguauaacugugacacauaguuaaccgucuuucauugaacacaugacacuguaucuuaggguucugagggcacaggagggugaauucuauauacaagucugcuggaggcuugucuaugacaaacuuaauuaaguagggccuguucagugaaugaauggauccuugcaaacccaaucacaagcgaacuggacacuccugguagcaaaggccucacggagccagccaaggucagaauaaugauccggcucuggaaguacaaggugugagcacugucuucaguucuuacccuggaucuuaaugacccaggagaggcaggggagguuagggcaagccagguuaccuuuuucccaguuuguuucuccaccaugucguugcugagagcaaagucuucuugcugugguguuuuagaacacccacccuugggcaucguucuccuccccuuacuugaucuucauuuaugcugcuauugcuucaucaucaacugucuguuucaaaagaaaaaacagaaaagguuaaagccauuguacccaaaacauaaaaccugcccaacuucauagggaaccacacagacugaccaaccaagaugugcaguugcucggaccuaaggccaauagccucacucuagguaggggcugagccugggaggagaaaggaaugaccugugaggauccucaaaguccauucuggugaccagccaccagugcccgauaccuggacacaugacacagacccccucuaaaucacgaugggaggggucugagugggccuagaacucgguucucccccucauacagucauccucacaagcaaggucaggugaacacccagagcagagaaugaaaugcccuggcccuuucauuccaagagaucuuaucucuuccaccagcauagcuucuaacauucacuccucaacuucaaaauucucuugcuauucauacuccuauguagaaaguagggugagaaauaaucuacuuuaauagagcagcagguaucugguaaagucuauaagauucccucaugaaaccugagugguagacacacagguauauuaugacuaugaaggagucccuagaggaugcucaggcugcuucaggccccacuucacauccauggacccagauucuucauuugggcucaagguucugaccuguuucugaaaauaccuuaagacacaugcugcauuaaucgcauacuuuacaaucuaacuaauuuauuaacuugacauccugaaaggcuugcuggacagagaccuaauuuuagagauagccaagagcuuaugcaagccaacuaccaucucaucaugcacaagccacagacccugccuuuuaaccacucaggagagacagacaccaagcagccagagucccuccucagagguucuucaaaccagcugauccugauugcucuguccugccuuccuccucugcugggccuuccaaccguccaacguggaauagaccacuuucucucucaggcuucacucugguuuugucuguuccaugcuuugcccuaccacagguuucaguuacucugacaggaagggggaggggguggagagggagagcgagagagggaaauggagagaaugagggagugcuauguggagacugaggcuggaggauucucaaguucaaggucagucccaacaggguaauaaaaccuuaugucaaaauuuaaaaagcaguguuuaacacaaagguuaacuugcauaugaaaguccaaguacuacaaaaacaacaguaacacaacacaacacaacaaaauaaaacccuuuucucagccagccaaggcacaagcaguguuuuggacgaucuucccuuauauagucaaagcccuuucugacugacagacaucggggccuacagccucguccuagcucucccugucuucaaucaugcuugaucuaccccuguaggaagaacugcuucuaaaccucaaggcuccggggacuggaaagauggcucgguggggcagagcacgagcucugcaagucugaggagcugagugucaaucuccagcaccagguaaaagucaggcugugcaagcugcugcccagcaugagggacgggauggagacccugagggaucccuggcuacaaagccgagccaaagauguugagugagacgcccugucuaaaggcaacacaacagugaacagugcuggggcaccccuguccugcuuuagccuccacaugcacagcugcacauucacuccuguguaccccacacccacaaacucuuuuguacaaccucaugaucuuaucuuacuuuucuguaauaaaugauaaaaacucccaaguaguuucucaguguuuaacuggccuaagagcauuauuuggaggaggcaggcaggcaggcaggcaggcacucugguccuugcccagaauagcaacauuaaggaugcugagguaggaggagacucccuucucuggggccaguauaaggccacauggcaaugagccugggcugaagagacugcccuacuuguuuuuuuguugcugugauaaacauucuaaucaaaaacagcuugaagaggaaaggagcuuuguggugagaaucugguuuuguuaaaaaccagguuauguuacguauguuuguguuuuaaucuaggcgugggguauggggcugcuucaaauuguccacagccacuacugacggcugccuccugcucugggcggggcgugauaucgucugcauucuggggauucuguggaggaggccauggcuauagccacuccugcugcugcugcugcugcuuucagcauugcggauguguugguuuggagauagccugacuguguaaacuggacuugccccaagggacccaaugccccuuguagucacgaaauagucuguccccuuuccccucuaaccuuucucuccuacuuaguguugaggggucgaaagggugguaaauaauagaacccaauaaagugguccaaacccaggccaacagcuuauuucaucucauacuucacaguccaucaucucgggcugcuaagcagaccucaagugcagaaaccaggaaggaacacuucuuccauggcuugcuuaacuugcuuucuuauauauaacccagggguggcacugcccacaguggaucaagccuuuccacauuaagcauuggucaagacaauggccccacagacaugcccacaagccaaucugcugggggcaauucgauuccuuuucccaagugacuaguuugugcacugaaacccugucucaaacaacaaaaacccaauuuuacuuugaaguaaaaacgacgacaggccaggccauccuuacgagaacccucugccagcaggaacaggugcccccauccaaguuacuacagugccugaggccaagcauggcaccucuguucucacaugcagcugugguuucucuauucuggcugaggccaggcacaaaaaucucugaucucacuugcagcuaugguuucucuacucugaauuuucgacucuaaaagugagaugucuuggucuggccugguggccuuuaauccuagcacuugggaagcagaggcaagcaagucucugaguucaaggcuagucagauuuacaaagcaaauccaggacagcaggcagaucauuuugagauugagccagcuuggguuaaauagugagacuauuuuuagugagaucuuuugguugucucacuaaauagccaagcuaacuuggaauucacuaugcagaacaacucauggagaucugccugccucugccuccuaagugaugggaugaaaggugugugccaccaggcccggcacucacuuaagugcuaaagaacaaacccgagcuuagcaaaguuaggcaaguacucuacuacaaagcuaaagguuucaaccaaaaaggcuccgcaguaauagcaucagagaagagaauaacaccccuaucaucccuaggggcucugacaagauagagcacagggcauccuuucauucuggccugugaaaggcaaagacacccucuaucaucagcauacuauugcaguuucuuccccugaaacaaugacagaauccacaaaacuguagguggcuuucugacagaaaaagaaccccucgcccccaacuagugguuugugacgaagugaacaaagcacagcccguggaaguucucauggggcugggaacccaugggcacaagacaggggaggcucuggccaagccccacugucuuggaagcaagcccagauauaacgggucuaaauccgguaccccggacuauauccacauccaccaucagccaaggauagauaggcugucagccauucugaacaccuuauucauaggagcugcagccauacaaaaaagcagagcucuuaaggggcacacaaagccaggacagugugcagaaaacucaggacgucaaacuccaaaaugaugcucaugccuaggaaucccugggauuacagacacaagagaagagccauagaaaagcaagaacagaaacaaguccaagugcacagucuagcaagucagugagaagcuacaaaauucauaaauuaacaacagccuggccgagauggugagcaccuuuaauaccagcgcuccagaggcagaagcaggaggaucccucugaguccaaagcaaguccagucuacagaacaaguuucaggacaguuacacauagaagcugucaacaacaaaauuaacaaaugcuaggaaaagaccugaguauuggaagucacccucuacuacagacaacagaacaucaacaaauaggacugucugacugggggcuacaaaggacgaaugagccacagccaaaacacuugcaggagccagguccucuguauagggagacccgauuacacuggaauucucacagacaccagaaagguuaauaagcuauuuuuccagaauugggggguggggugggggugggggagucaagacugaaauguucaauaugcuacacaaccauggagacuuaucaaugaauaaacauauuuucaugaaugcaaaaacuacugggggccccugucucuaucuuuuuaaguuuuacuaauauagguccccaggaucagaucagccuguuuccugugucugcaugagagcuaagaauggguuuuguacauucaugcaugaagggaaaggaucaaaagguuauuccuuugcaacacuuggcuggagagauagcgaaguuuaagggcacugguugcuccugcagggaaaguagguucaauucuuagcaccuauaugguggcucauaaucaucuauaacucauguuguaagggauccaaaaugcuuucugacuucugcaggugcuaggcacaaaagguacacacacauacaugugggcaaaacauucacacacacacacacacacacacacacacucuuaaaagccuaaaaaauuauuuuaaaaauugugauguuuaaaaacuauuuguaauuacacuuucagagccauuccauuuuccugaaugcagcuaacaucuccguuugcuuucuuguuacaggauaaaacugggggucucuagcgugcacuaagcagagcuauauccuaucuccauggccucugucaggcuguugucauggcaacugccauccggaccacuugcagccucucuggccuuuaggaaucugcuaacagcaguucuuacaguuuugacaauagucaaaauuugaccauuuugccuuuucagggucugugagaucgacaucuuuucuucguacuguuaaggugcucagugcgcugugcgucccaugguagugacaguguacugggaggugaggcuuucacacucacuccuggauuuucuguugcugugguaaguacuaugacuaaagaggacucaggaaaagcaaaugaaagcaggacaaacucaggcaggagacagaucaguggcucucaaccuuccugguaugacccuguaaaacagcuccucaugcuauggugacucccaaucauaaaauuauuugcauugcuacugcagaacuguaauuuugcuauuguuaugaguuguaauguaaguacuuuuggagauagagguuugucaaagaggucgagacccaaaggcugagaaucacucccagggaggaccauggcucugauuugcccauagcuucugcuuaauuggcuuucugauacaguauaggacauucugccuaaagacagaacuggucacaucagggugggcaguaagaaaaugucccacagacaugccuacaggccaaucugauuaaagcccuuagucuuaaauacucacugagaaacggagacaugcaugaagcaccccuguuacacagcacagugaauucggcaucaggaaaagcaucucacugugagcggacaggugaacuggauucuuuuucauggaacucaaguuuuacuuaaaauuaguaagaaguagacaucuagcagucacagacauuccucagugacuugaggcuuggguccuaggucccugcagagagcagauccuuggugcugcagcgacagcacaguaucugaagagccuugucccacucuuccugccacaucuggguaacucugguaccuaacaacacugccaugcuguacagucguuaugugcuguacagucgcugugugcucagugucuggcccauuuuauuuuuauacuuuuuuuuuucuacacaugugaaaccacaguuacaaagagucaauaguauuuugucaaaagugaguaauaggagacaauuauuucaaugaaaacggauugcaguuguugccaauaauaaacucuggaaacguggucuacucucugcaaagccucccaaagugucucccaacuuaaagggaccaugcugugaucaagguagaaugaaaguggcuguuuuuagccacuguagaauaagaaauccccacaacucaauggacuaaaauuuccaagauaaccaagcucacaaugcucacacucagcacacugggcaggagcaaacuuaagaggcugagcauaggcucuaccccagucauggccaaggaagacauggcaauccugggagccucauuccugcucugugugucuguaaugagucaggcuuucuucguaccucuagcaaaacagcuacaucaaaagcaggcccuccccaccccagccagucagccagagacggcagaugcagaaagcaaugcuacuuuuucacuacaauuuuauuacugauauuuuguaaaguaauuaauuuguaaauaaagauccuuugcuauucaaguguaauacuuuccuaucuucaaguagacuaaauacuuuaauagauuuucccauauaaacuaagcucucuggggucucccuggcugugagaaaguagugaacaucaaggagccuguaauauaaccaagucugucugucgucaccaccacccuagaccuccaaagaacuguaaaacagaaaggguuucacuuaagaaaacacgcacagauaguuuuuuaaccuccaaggauggcggugcauaccuauauuaguagcuuuuagacagcagagggaagggaacagcugcaauuugaggagacuuucaaauuacagaaaugacuauuccuaaaauuaaagaaaaaaaaugagaaguuugguaaagugauuaaccacaguaugacgcuggacagaacuaaccaaaaugaggaagacagaaaagagaaagagcuaaggccaugcuagugcucacacaggacuaagaaagacuuugggaagcuacggauagauggcccuaacccucuguagcaacagcaaauugaauaccuccaugcaaauggaaccuggcuuccaccucacuagguuauaaccucauuagguuauaaugacugcuaaaacaaagguuaugcaaguguuuggaguggaaaaaaaaagauuuucacuuuauagaacuguguuucacuuaauuaacaaacaugauaaaagcuagcuagcuaaucacacuucacuguaaacaugcaugaaagaacagaaaguauggagugcuggaagguggcacacagcacacuggacgccugagaguagaggagcugaggguacugacccugcagccagaccuccccccccccccgccccagugccugugcugguuaccucguguuuguacugggaaccagagucacauggaaacaauaugagcccaauucaagacugcaugacauucagagugagucaagccuguacaaagcaugcaacgggccacugugacuguggaacaaaacaggucccuuucagccuugauaagacagaaagacagcucugcaaagagcuagaggacuggggaauaaaacgaagagcagaaagaaccugaaaagauuaugugaaaagacagaaauacaggcauguguguuaaaggugugaugcaaugacuaaaaauaguaaucucaggaaagcacagaaaacagaccaagggcagugagugagucagcagacagcacuggagcaaggagcaccuggaacugagggggggggggggcuggaaggaggcaguggaucugaagccccacugcgcugaaggcaaaggacagaccgcccuaaggagauaucacuucacagccacccuuuaacucacugccuacaaacacaucaacaaggacauuaagguugugugcaggggaaacucgggcagaacacugcuccugagcacuaugggauucugaggucggaugcaccaugggguaaugucucuaauaccaagggaagcagcaaguucggaaagacgggugcaguccauagucugaguuacucagagauguggaggacuacuuacaguaacaggaaacccagacauaagagggacgcucaccacagcccuguaauccacuugcuauagaacaaaagccacauaacaguaaaauccauacagaaacucaccugacaagagucaguguucaugaagaaacccccagcaaaauagcccuaagaguagccuagauugucuguggaacacuuucaaggacaaccacacucgagacaaccaccacuagugagagcuaaccaguuucuuucugcaguuggugaggcagcaaagacauccuccuccuccaucucccuauucccugccuccaucgcacuucgaagauaauacuauucugaacuguauacaugaagaacaauuaaaacaaauuacuauuuacagacaacucaacugccuauguagaaaaaaaaaaucacaaggaauccaucaaaaaguccuggaaauaacaguuuagcaggacaguagcauacaaguccacggcagaaaaucccacuguuucuacauaccuaucaguaucaggggagcagaaaaaaaaggguccaaccaaaaugaaaacacaagauuuaagugcagaaagacuuuuuugucugauuaguuuguuuucuggggcaagguuugcaauguaccuuagacuagccucaaaccuacaaucuuucugccuugguuucacaaguacugagauuuaaaaaaaaaaaaauguagccgggugugguggcgcacgccuuuaaucccagcauuugggaggcagaggcaggagaauuucugaguucgaggccagccuggucuacaaagugagcuccaggacagccagggcuacacagagaaacccugucucaaaaacaaaacaaaacaaaacaaaauaaaaaauguaaaaggagaaaauccuuuucucagaggaaaacuggagguaaggaaaauucuuaauuagauuaauuaauuagacacccaaagcagaaucuaaagagaaaaaaaaaaagcucacuuccauuuucaaccuacugcucuauggaauacuugguguaagggugaaaagauaaagugugaacaaggcaggccauguccagagccagggucagagagcaggccuauaagcacagugaaaaacaaacaguaaaagcaauccgaugaggggacaggaacacagauggcuaguuuaauuucaacuugacaccagcuagagggaacuuaaacugagaaaaugccucuauaaaauccaguuguauauauagcauuuucuuaauuagugauagauagcagaggcccuagcccugugagggagagcccagaccacacuggguucucuaagaaagcagguggaagaagcuaugagaaggaagccagcacccuccacgaucuggcugucaguuucugcuuccaggacccugcccuacuugagcuccugggaagaaagcucagucuacaaagugcuuguccucugagcaccaagauuugggguugauccucauggcauaugcuuagacagacagacagauaagcaaacagggaugcacagguuucuggggcuuguuagcuagucggucuaguugacuuguucaguuccaggucaaugagagaccuuucuuuaaaaaggaagaaaaggaugggcugugcuggaguagcaaauacccaauguuucccucaggccucuagaugcaucugaacacagacacacauaugcacagacacacacacacacacagacacacacacagacacacacacagacacacacacaaaaccaugccccugugagacuagcagcgugggcacagcacugcacucagcuguauuccugagcaagaccuaugacacaaagcucacgaccauuaaagcaggggaacuccaacagcuaucccaaccacgcccuuccaggcaguucacaccucccuucucuucaugaauacaaaggaaugaaccaacucucacaugcuauguggauaagaagaggggaaaaaaacccaaaaccuaaaauagcacauguacguauguacacaugugcgugcgugagcauuagagcgcacaaauuccucuuugcaggaaugguaguguuccugguugcauuacaauuauuauucugaaacuucuaaguaugucacgugacaucaagcaaaugaaugcccuuuagagcccugauaugguaaacuuaggaaugacaagguagagaugagaggacagcagauaggaacugccaucugccucagcugagguuaucagucucagagcuugguauguucuuuaggaauccuggcaugcuaaggucuggacauuccaggguggacccaagagcagaagacuucaaagccccucccuacaaagccacuuggcauuuuccuuguuuagugacagaaaacagaguguguucuuaguaccacuuacaagaagauucuuuuuucuaaucaaauuuguuuauaaacuuuguacugugacaauucacagaaaaaaaugacagugucacacuuccugaccuaugaccuacuaaggcaccuccuccuauacaucacagcaucucuuguuuagacuuuggaaaggcuggacagcucucuaguggagaaccaagucucagagaacgucauucuacacuccacagacagcccugggacaauaauggugugugcuuuccaggagugagcagccuuacaggcauccucaucucuaacuuguuuauuuauuuauguauaagagcacucugccugcaugugugccugcgugacagaagagggcgccaugucccacugcugcgagcuaccaaguggugcugggcauggagcucgggaccuccagagcagcagcagcugguguccuuuuauuuauuuaauguacgucagugcgcugucacugucuccagacacaucagaagagggcacuggauuccauuacagaugguugugagccaccaugugguugcugggaauugaacucaggaccucugggagggcaguuucucuagcccggcuuuuaaucuuuacauaaagacaggaucauggucucuuggagugacacauaauaaagagguacuccauaaaccauaaaguacaaugacucuggagagguugugguacagaaagcauggcaggcaggcaaacagaagagucauggcugaguugcgugucugagcacagugcucccaaaggcgaugacccaacauggaggccuuagccacuaguggucacgacaccuggcuuuguucgugcugcuuuccugguggagucuaugauauacaacagagaccagugcugccuucccugcuugcuuauaaacaaaguaacugcugaagaagcuccaguuucuuccuacucucaucuucucuggcagaacucuagcacuguuuuguuuacacaacagguucuaaaaagucugaacaugauguugucuagaagagaaucccugcccuuucccacacaacacuacuagaggucaucuggggcuguuucacaaagauaaagggccacccaccacgguggaguuguccaaacucuaguuguugcugggcuuuaguucaguauuauuuuuagcauauuaaccauccauuaguuagagcagccuuaaguuuccaggaauauugaauauaaaagagaguugucacauaccuuuaccucaaagguacacagccucuacaugguccagcaaucacuacuaaugcccaguguucauuauuuacaacagguucacacugagugcuaaacguccuguaauucucaaaugcagucauuuauauccacuauuauaacacaccauauagcccaguuucacugcucuaaacauccucuguggucuggccaucugcucugcguccuccuggccuggcagccguggaccuguuuugcuuuucucaggauuuacagaacuagaacccuauaucauguugccuuuucaagacagcuuauuuauuuauuuauuuauuuauuuauuuaaggaaggaaggaaggaaggaaggcaggcaggcaggcaggcaggcaggugagagagagagagagagagagagagagagagagagagaaaggaagaaagaaggaaauuuuuuucuuuguaaaugucuuguguuucuguuggagguguacacacgugccacuccacacacguagggucagcaguccuuccuucugcuguggguacuggagauccaaugugggucaucagcuuccaucacaagugcacuuaacugcagagucauggcaucagagcccccacgauggguuucuuuagcuuuguaaugcacaggugugguuccucugugauuaaagcuggguuguuuuuagcaaugaaauaauauccuauugucuggccacaucacuguuuauccauucaccugcugaaucuuggcugcuuccaauuuuggcaauuaugaagaaagaagcuuucucaagucaauuaucagaacagaaaauacuggaaggcauauauccaucaucacaugaagaaugucauucuguuaacuugccugugugaaccucugcccauguuuucaaaaacaauggcugguuugcugccagaaauguuuaguucucucuaggaucagaaccacaccccuaccuuguguggugcucaucagugagccuucccgcagucucucaggcaggaauaagacaggagcugacccuagugugcgaguuaccgaugcugcuggauugcuggccucaacuucauucaggcucuaagacagaaggggaaguuuaaaaugucuguccugaggugacuuuuacuuccuauuccauacagaagccuuguuucuaugcugauccagucuccccagucacuucuaacauggucaaaaacugacucacccacggcaacggcucagcaacagcacacaaggacucacuacaacacauuagauucuaaagaagacgguggguucugugggcugccacauauaccagauugcuguagugaagucaggcagacagggcuggucgagaguucugcaucuucaaggaguguucucacacuuuagcaguuugguuuuggacagaaguuaacaacacuaggcuaggaaugaauacagacccaagaaugugacuuuuacaaagacaggcuuauuugaauaucuguauuuucacuaaacauaucaguucauauaaucugauuugauuauagaaaauaaguucugugguuucaaaugcauuaaccauaucuuacuuauacaauguuuuaugcuuacauuuuuuuccccagaugauguggauagaacuacuucauagagagaaaugagacucccagaggaaaacuggcauacccacauccagcagccaaaaccaggacuggaggccucagcaugcacaauagccacacaguccauuucugccuacuggaagcuccuucacacgccacaguccaaugccauacuaagaaccaaaacaacucugaggcaaacaaaucccaaagaucuaaagucugaggugccaaaaccacaugauauuuguaaguaugaaagcauggauuuuuacaacuauuucagaaaucuagaggguaccugaaggaauuauaucuugugauuuccacaaaagaacugugacagcuauucuugguugucagccugacuacaucuggaaugaacuaaaacugaaugugaaggauuuuccccucuaauucaaucauuugaugugggaagaccuacuucuaauccagaucuuugaggugggaagaugcaccuuuaaucugggccacaccuucugcuggcagccgguauaaaagacaacacagaggcagaggcuugcuuucugugccggcuugcucuugcucucacuagccaggccacuccuucguggacaucacagcuuugugggcauuacuucuucaggauuuacuucaggguauacagccuauacugaacacuugcugagacacucagaguucucuaagggaucacaauuuauagaaggggcaugcuccccacuaccaccagaaaaaagauauagaauggaugcuccacuuuaucauauucugcuaaacagggucucucauugaagcuggggcugggcaagucccaggcacccuccucugccccuacacugcugcagucacaacaagucucagcuugcugcaugguuuuuagagccaaccaaauccucaugauuguacagcaagugcucuuaacuauugagcacucaaaccccucuaauguacgacccguaagagcuaacauauggcugaggcucagcacacacacucaucuacuauuguuucuucuccccuaaaccaauuuuccuacuuugacucucgucuuuccaaggcuaaauauuauacagacuuaacuaugggugcuuuguaauaacuguggugagauguguaaugucugaaaauuacccauucucuuguuaacuaacaacuguuucuucacaaguuuuguuacuacaaaugaauguauuugugcacuucugguguguguuuuguguguguguguacacauauacguguggagaucagaauccaacuuccaguguauuccccuacugcucucgaccuuauuuugaagacaccuuucaaugaaccuacucagcuacacugcccagucagugagacuguuuugacuuaccaccaugccugguuuuuccacuucagaccagaacaaaugucuuuugcuaucaauuuaccaaaagauaggaagcuuguaaucccagcacucaagagggugagauaagagcaccacagccauucuggaaacagccugggcuacagaguucuaaggcugccucaggaacacuguaaaccugaagacagaagguguuaggcuaaucaacaggaaagggaacucugcaaacagagucaguggaaugugaccaagaaaacaauagugaacaacuuuaaauaagaguuacaaauucaagugaagcucucuccaugguaaaaauaacuaaaaugagggguaaaucagaguccagaguucugaaaacacccaaauuauauaggauaccaaaagcuggauguggcagcacaugacuuuauucccaacacuaaaaagggagaggcaggugggugucugaguucgaggccagcuuugcucugcauagugaguuuaaggauggccaggguuacauagagaugggggcagggggaggaagggaccaauccggagauuuuuaaaaaaagagaagauacccacaaaugcaaagccuuucaggauggacccagagcgcuuacccaauucucagggaguucacaaccaacaaaguuuuaaaaagucauuuuguauguagucaagugggaguugcuagaugacagccaaaugacgcauggaaagaacaauuuacuuuucaaauccaauuucauauagauuauaauuuuauuacuguauauacagaugaagauaguuauaauacagaaaugacaccaaauuucuuuaauacauauaaccaaggaguuauaacccauagucaagcaacuugaagaaaauguuguuuauaugaaauauugcuccuaaauuugagguuuccaugguaaagggcucaaauccaguuuuccaacgauggcuggacggcaccaacuaacaaauggcccuguuucugcugcaugugugggaaggagaggagcagaaacagacagucucaagguucuacuucucauugcacuaaacacacagcucggcaucuugaccaggugaaguaagcaggcaaccacacaagaaagcagaggcuuuaagaaacauagcaacugacagauccucccaggucagagggauguguguccuccuguaacagaugcuacaagcagcacccaggccuuccagaaggacugugugggcugccaggcuugucguuauagcaacaguucuaagcauaugugcagugacaccagcugauuucugaaagcugcaaauagaagauaauggcauuaaaauaaaaaagauuuccagaguaaaguaaagaucaucacccacccccuccucucuccagccuacacuuuuucucuagacaucauuguucagcagagcaauagcaugaaggcaaaugcagucugcagccccacauaugccaagucaucugcauaaggacacaccuacaaaucauaacacaguggauccauaauccuguacuggcauguuacaggcaagaaauggccaagccugacaagagucauccaccuggagggcuuccugggcccagucucaacaguuugcucuucccuggccucccgcacacaguuccuuccuuccuucagagccuuucaagcuuucagaagcugggcuauggcucaagagaguugcugacagcuaagucuacacaagcgagcaacaacugcaaagaaaaggcaggaaguugccuaagcaaaggguccagcagaaaaugauuagguuucugggaaagcagagcaaccaaucacgguuuggaauuaaaaaucuauuucuaucauuucuucugcuuugugggaaggggcuguaaaaaugugaaguccccuggaaauagggaagcaugcaaaagggugcagaaaugacugcacgcagacaggagcuaucccugugaccacuuccucauggcaauaccuaucuuacuaucuuucucuucuuucaccccacaaugcuaagaaugcuuuuauuauacuucuaucacauguuucaggcuucacccagaaacugggcugauaaacccucaagcacaagcugacacuaagaacacuuguuggccucuacaccuuuauuugacagacagggagugggcccccaugugugcugguggugagaagacaacuccaggccacaaguugucuacuuucaucguguggguuuuagaauucacucgagaugugcggcugaaguggcaaaggcucucugcugagccuucucacucacccugaacugauauccuuaagacaaaauuaaacuugguauuucaugcuguaaaguacauuuauuggucugaacagaugcauuauucauuauaaccaaaauuaauacuauuccaagaaacauacaauuucauguuaacaaacugagaaaagacagaauuugcugguuaguuuugucagcuaacacaagcaagaguccccugggaagacaggaucaacaagaauugucuagauuaauuuuuggcccaugagcauacugguauuuaaaggcaacaacaauaaaaugugucucugugucugcuguauaugugcacauguguguggauacccaaggaagccaauagaagguguugaguguccuggagcuguaguuacaggcagcugugaacugucagaugugggugcuaggaacugcaagaggaacgagcacucuguaaccugagcgacacacuuccuggagaacagcugagccaacagcagguaugcagcagaugcagguaguacagccaguucucugauggacuguaaaugauguacuaaaucuuugcccuccaaguugcuuuuaucgggguacuuuaucacaacaaaagaaacaaaacucaaacaagaaaaaccaaaauuuuauuuacucauugugauggcuauuccugguugucaccuugacuacaucuggaaugaacuacaauccagaaauggagggcacaccugugauccagaucuuaaggcuguaagacacaggcuucugaccuggacuguugacaugggaugacacauacuccugauccagaucuugaagugcaguguccaugaaaaguuuaggcccaggcaagguaguacacaccauuaaucccaggagauuuaaucccuugaaucuccugaauucaaggccagcccccgacagaacaugaugguacacagcuuuaaugggccacaccuucugcuggaagccuccauagggacaauggaugaaaguaggccuauuugucugcuugcuaauacuuagcacugcuggaaccuaccagauucuuggacuucccauucacaguugcccauuguuaggucaguuggacugcagacuguaagucauucuaauaauuuccuuuaauauagagaaauugcauaaauucuguggcuuuagagaacccugacuaacacacucauagugucuuucugcagugagucauccccaaaugggaaguuagagaagaggaaaaaacaaacugggcuccuuccuaacaagugccucaaagguuuacagccuaugugcaaaugauaucuaugagccccuaaaguaauagacacuguuucaaagauccagcuauguacacugcacuuuuggcaaauuauuucagaggggaaaaauaaucucaaauuugcguuuuuaauaaguaauauauuccacagauuguguguguguguguguguguguguguguguguguguguaugcccaagaguacaagagaauaaaacagaaagauuaugguugauuggagagaaaagguaaauacgaaagcaucucucaacuuggucugacuguggaauuucacucuagucagaaaacacggagcugcagcaauuucugaucagugagugccagagaagcauucauaacgacaaacucccaucacagacaaaggucaaagugcauucugaaggauccacaguuucuaguuaaagaaaccugcagugaaaugucuccauagucuucucugcauuugcucuggcuugcacuaugcuuugcuagcaauaaaggauucccuucucuucaacuaaaugugguaaacuaacaaaaggaggcaauacaggcacucuggaaacuacaggcuaccuccaaaucugcaacacacagcccaaggagagccuguaaacauaaauuuuagcuccacuagcccuucacagggggcacagaugagcuaucauucaaugaccaaaauagugagcaagaaaauuaauacaucugucuuuuuaucuauggggaaaacauuggggagagggaggauaugcgaucacuguguuccaaaccuuuaggaagguuauaagucugugcucuguggaaagcaagcagaauacuguaagugcaaagcauacaguggcaacuauaauaaaugacagcuucccaaccccuuuaggucaaugacugagguuuaaugauccauuucaaauuacauuuacauggcgcuuuauuuuguauguuauuuuauucagagccucuaaguagccucaucugaacagauggcauuauuuccucauuacaaaugaaagaccuggagcugaaacaaugcacacaccaucacccacuggaggccacugcugucagcauacaccuugcugacucccaugugucugucuaaacagaaaagggacaagaagcuauucagguaagucugaagggauuacugagccaucaucugcagcccaugcuuaaaucugccucaguguuuuaacaacaucacugaacaauguaggcaaaucccaauaacucaaguauacauacaacuuccaaauuuguaggcaggaaaauaaucuuaaaaaaggaauaaagaacuguguggcaguggcacacgccuuuaaucccagcauucaggaggcagaggcagugggaucuuuaugaguuugaggucagccugcuugugaguuccagaacagccggggcuacacagagaaaccgugugucucaggcaggggcaagaggugggaaagaaaagaaaaagaccuccauuaguuucaggugaaccuuggcuacauacauacauaccuugucuccaaaugaacgugaacauaugagugaacaaacacaagagacugcagagacagacacauuuuugucugaguauauaccuggccccuguccuaauucagugcugggauaugaagccuucagaucaaaaaggccaaagucucaccaaaagacgagugugagcgauccuucuagucuuccagcauggacaaacagguggaaacagcucuacugccaaagucacugauuuggacuuccuaauuuccagaaacaugagaaaaaugucugcuucuaaauucucuagugccugguagcacugggggaaaaaaaaaaaaaagauaagcaggcuaagaaauccacuuuaaguauuaaaaauguaaacagucacuaggcugagugaguguggagcgcugucuggagguggaugaagacagauaauucaaguaggcacugugcuggguguggagaagcaggguggacacuguaacucaugcugaguaaguuucaagacaaaaauaccucaaaugauaaaaaggaacccauagaaugccacauaaaauuccuuucaugggaaauaaaacauuucuaugcauuuaugcacauaaugaaaaucaaagagccucaguagaaaaaauuagagccauagucgugggacagacauuacaauauuuccagaaaaugaugaagugagagaaucucuaccacaaacuucuaaacagauugggaaacaacacaacugacccacuggcauauaugaaauaaucugaccaguaaugacaggguucaaaacaugggaaacagauuaucacuaauaccugaccacauacuaacucuaaaaauuuuaaaagaacugauaggagagggaggaacuaagugcagaaugggagaggaggagagagaguuggugaugucuugugucuuaucgcuauugauuuuccccuaucuugcuaaaauauagagaaauaaagauauaagaacaagagagacugagaauuggucuaugauuaauggggaagaaaaagcauucuuugcucuuuuaacuuaaaagaacaacaacaacaacaucaaaaaccucaagugugggcauagugggccuuuaaucccaggacccuggagauuggggcaggcagagcuauacagugagacucuuucucaaaaacaacaauaauugaaauaauuuuauuuuaaaucaucuuuuaacacugaguaugauguauuuugguucuaggccuuucuuuaaaauguaaaggaaacuccuuuuuguuuguagaccuuucccucacccauauugucaaacacgauuuuuagguccuguugaggccagagguugacagugacuguguuccuugaucuguucucuauuuauugagguaggaucucucucugaacuugaguuugccaaucugacuagcuggcaagccugccuuuggggaaccccugucaccacguccugaguaaggguuauauagggugaagcaggcccauccacugguacgcacacuuguauaguaagcacuucagcaucccggcuugauaccuaguuuuuaaaaauggacaaaugauaccacaggcaagaugccucaguaaagaagauaaauagcugagccugcauuucuccagauagguucaugacaaaugaucaguaucaucugcuaacaggaaaaugaaaauuauugccauuaucacuauaaagccuaaguuggccucaagcaggcaggaauccucuuguccccaccucccaaguacaccagagugucacacaacgagccaggaucauaccugucaucucugcaaugaggagguuagagcagaaagaccacaggguggaagucagucuaugcuaugggcggaguuaaaucacaacaggaugcucuaaauauccagcagacuggauaaaaucagaaagacuggguaaauauagaacggcauacaggaugcucaaagucaacugacccugaacuucucaaaccaaacaugacccacccacugcacacucugcuucuaaaugcaccacugaacugugggccaaaacaaccccuuccaugcagugcuuuuugucagguguuugucucccugacaucuuaaaccaacacagguguagcaugacaggcaguuugucaagacacugggccacagggcagcucagcacucccauacccuucacugcccaaagcauaaaggucagaaucaugggagcuaaacauccagaccaaaaauauaccuucccaugagcagcccauggagacugccagcagcagauggccauggugaguacuucuuuucugaagcuaucgggguguuuguuuaaauaugagggacagagacaggcucauuuaugaaaagaggagccuuaauauccaaagcugcuagcacuacaaugaaaguggcucaacagacacaagaaggggaacaaaacaagcccucauuccuucuagguuauuccacauacagcucucucucuucccucaagccaagacccacacaacugcacucaugcuuacagacagauucuuagcaagcacaaugugacugacaaagggaaagcaaugucuuaccugcucuauuucucaggaacaaagcccuaugaccaucugguacgaaucuacccaauuaaccagcuggguacuaaaggcucugucuaggugcgugcugacagucuugagcacagcagacucccaagcaugccuucuggacacugguacaugucaccacggcacugaacuaacaaagcaugggcauccuucuuugcuucauucacagggauaagagugguugguuuguguuuuuuuguuuuuuaaaucuuguuucucaugguuuauuuauugauggcauauugguggggggggggugcauuaaacagaaaugggaguuuaaggaagaguauaugauucacaucuuacuuuauaacguaagcagaaagagcccuucugucucugcagagacucaaaggaagagccagagccuggucugucacggcagcugaacacaaagacgacaacaggaaggaccuagucacacagucacaggagcagcccaggcugcuuuaccauucucagucuccucccccagccucagugcugacauuagagauacagagcaccaacccaggaaucuaguauuaaugacggucaacagcaucucaggauacaccacccaacaggaccaagauauccaaacucaacaaagucuuuguauuugccagcaaagaguuaccacugcccuggcuaagaggaggacagagcagcaaauacugagacaaggcuggcuucugguaguaguaaugaauccaaaguuugcauaagcaagggaaggcuuaucucagguuguaccccuaaauaacaaauggaauguggagcugaaaucuacacuuuuauucacucaacuauuccaagauaaacaucuuuaaaaauuaaaacuuacaugcaauaagcuuuacauuaaaugcugaaaacagucucuuggcccagaaucuaaagauccucccuuucuuccuuaccucgaauuucaaagaaaagaaaacugaaaaacugccucugugaacacgacacggaucucuccugcauccuccacggaccaagcacugccuuacgccagcccuguccuuggugaggccggggaagagcucaacaccacagcacacaagcaccugugacccugcucauaaggagggcauaagggcucugcaggccaucucagagauggcacuugcuccccucacccaaccucccucucccucccuccccuucccucccuugguguucucagaaaaaccuguuaacacaguuguuaagaaaggauacugaaguaguauguaucaucacaaaaaaaaaaaaaaaaaaaaaaaaaaaaaaaaaaccagaauacaaacaaacuaccccuccccaaacaaauagagguggccaugcaaaaaacugcuacaugaccuucaugcccuuagaagguucggacaucccaucuaagggcaugaaguguccaaugaaugaaguuuccauuuaguugcucauuugugccucgaauuaaagcugaccuauacuguuccaggcaugguggcgugcgcgcacacgcacauauauacacacacacauucacacacacacacacacuguuaacucucuguguguguacacuguuccuacgugaaugacaaucuagguugguaaggacucaguaagaaacauucccauuaccaccuggguguccuuugacaacuccugacugccuaaagguuauuucugaguuugaacuaucaacaaggcacugaaaccaaccuagaacuugacccccagagauauagcagcaguacugugaaacaaauucauuaugauaagucaacagggcugggacaguggcucacauccauaauccuaguguuaggaggcuaaggcaggggcuguuacaagauaaaggucagccuagguuagacuauuugggucccaauucagucugcacaacaggguaaggcccugucucagacauguguguuuggugguggaauggcauggcaauacuccauugagaaacaaaauauaaaaauguggguaaagaugccucgucauuuaauaagcacacguggauccuuuguguaugaguaggcauggcuauagugacagcuaccuaucaguaguguccaacucagcccuaucauucacagggggaaaccaauuccaugaagcuagguauucaauaguucauauaguucaauaaaaggaccaagcagaaagaacgacuguccuugcuccaaagguaugacaauggugcucaagaaaugcuaacugacuugcccaagaucacaaaaacaaaacaaaaaccaauguucaaaacacugagagugcucugccuuuagcuguuccuauuuucucuauacccaaaugagcacugcuggcaaguguauggccagagaggaaagagaacugugaucagaaaaagacuaauagguucaagaagggcccagccaggagccaggcccaaagugagaccugguaaauguaggcacucauuaugggccugccugcaugacugcugugcagggcagacuacaggagucuaacaagcauacagcauuguuuuuauccucaaacaucuggucacuaucuuuguuuaaauugcauuauagauuguaagcaauaaauagucuaugauauaaaguugaaauuucugcuuucuuuggagacuuauaaugauguuuugcugagguacacaggugaaagaauguuuugcuaaagcagacacacagaaggaugcaugauguuuagaaggaauaaauaugacgcccaccaacagugggaggucacuggagcucacaaaagcacuuguaucaauucacucuacacagaguuggugagcuuugcuuguggugucuccauagagagaaacucaccaaagaccuucucaugagacuccuguggcguucuugcugcuuccccagacucaggccugcuggugaguuucaguuucuucuggauugaacuucccuugcugauuugcguuugguguuugcuaguggacuggacuaagaacaacaaagacuggaauugccccaaagagcccaaagaaccauuauuaaacaggucuacuucccccauguccuaaaaaccuuuccuuuccauuaccuaaaaauauaugccuacaaugguacgacuuuuuuuuuaaauuauuaaugaggaggcuagagaaaugacccagugguuaagagcauuugcuguggaaguucauaaccaccuauaauucuaguuccagagacuauagugcccuuauuugccuccaugucagacacaggccuacaugcaggcaaaauaccauacacauaaaauuaaacuaaaaaguguaauugaauccuagcacauuaaaaggcaguaucuuuuccuaggaaguaaaugcaaagccccacguauaggcaaaguuccuuggugacuuuaggcuucuucaggcccaggcaagcacaggacuaggagcugaaagaaguaggguacacuaagaaaaguauuucuaccacacacuauuauucaaauacuuguucaaaaagcaagagugcuaccaucuuauaccacaacccuuucuaguccaaaggacagugcauauaaugaaagccugucuguggggcagcagacuacaagaggguaggagacucaagucugaggccagucaggacccaugcuaacaaagguuaugcugagagauuggcgggcugguuugucagcauuuacaguuagcucagcauccaggcuugaugucuucuuuccuuagaacacaccacaaaacaaccaaagagcacggggggcagggagggagagacagagacagagacagaaagcaaaagcuggggacacugcugagaaaggagcccagacccaggaguauaccugcagaagucaggugaugggcauaaacagacauuccuuaauuguuaaauaugcauugguauuuugucugguugaauggcugugugagggugccacaucuuacaggcaguaaguuacaggcuguugugagcugguuacuggaauugaacucaggaccucuggaagagcagucauugcucuuaaccacugagccaucucuccaaccccagacauucuuuaauagagagcuauucaccuuuuaucugccauaucugccaacaaagaucacauuuaccaaaaaaacaaaaaaaacaaaaaaaaaaaaaacaaaaaaaacagguuauaacugucuugaguguauccuuacuggcucugggauguuugcacugagagagcccuuuuaaguugcuaguagaaauauaaacugguauggcuggugcagaaaacaaugcagagaggcagcaguacucuccuuuaaucccagaagacagaucucuguuaagugcaacacaccaaccugguuuauagauguauacagugggaaccucgccuuaaaaaaaaaaauguauuuuuuacagcccuauaguuuagcaauucuacuuuguagcauuaugaugguuaaucuugacugucaagcuaaguggauugagaaacaucuccaagguuaaaccccuggaugucugagagggcauuuccaggaaaaugccuaugggcaucaccauuccucaggcuuggaguuuggaugaaaugagccacggggggacggggggagaugacuggauagguggcuuagugguuagagcacuugcugcucuuccagaggaccugaguuccugcucugcacccaggccagguggcucauggcaucugugaagccuggucaggagcucuugcgcccucuuccggccacccuggccagcuguacagguggcauaugcucaacacaaacacggacacagaaggaaacauaaaaucuaaaauugaagaaaagcaaggaaaagguagagcccuaaaguacagacacucucugcuuccuaucuaucaugucuuuccuaacacgcauuuaggggguggggagagaucccugucugaaacuauaagccaaaaauaaauuuucccagaaauuugucagaugguugucauagcaaugaaaagcuaacagagguauauacucaaaagaacugaaagcaaggucucaaaaagagauauuuaaaaucucacauuuccagcucacauuaaauaauuuccaaccucacagaugagcaaacuguguaugauguguccaacaaaggacuaguguucaucccuaaaaaugaagggagugcggcacgguggccugucucuuuaauaugcagcacuguguauguuaauaguaugcagaggagaucaucugggcacagaagggagccccgcucuguggugcaccucaaacccacccuugucugaauagcaccaugacugcuccuuuaugaaaguaacuucccuuguuuuucuuuuccuuccuuccucccucccucccucccucccucccucccucagucauuguuuacacagacauggucucauuauauaacccagacuggccugaaauucaugauccuaccuuuuuagcuuuauaaaugcuaggauuucuaguguauaguaccauaaauaccugaaucuccuuuuuaaaaauguuaucuuuuauuuuccacuuacauuuuaucuaccuuucuuuuuaaaaagcuaagagaggagccgggugugguggcacacgccuuuaaucccagcacucgggaggcagaggcagguggaucucugaguucgaggccagccuggucuacagagggaguuccaggacagccagggcuauacagagaaacccugucuaaaaaaaaaaaaaaaaagcuaagagagagcuggagagauggcucagugguuaagagcauugacuguucuuccagaggucccgaguucaauucccagcaaccacaugguggcucacaaccaucugcaguaggaucugaugcccucuucuggugugucugaagacagcuauauuguacucauauacuuaaaauaaauaaauauuuaaaacaagacaaaacaaaaaccuuaaaaaaaaaaaaaagcuaagagaacaacaaaaaagagauuagugaauacuucuagauacaaccaaauccaagucuuauucuuggugcuuuaaaguggcccuagaggugaccuguaucgcacuugaucccaggaaggauuugcugcuuucaacaacagagaaacugacaagccaaagaaacgaugaacccaggguuacaguaaaacuacacuuguguuggcaggugcagauggcagagucccacgggaaacucagcaucagucauuucucaccucuuuccagcacacaguggacaagucucccgcagcacucacagaguauccacaacugugggcauguauguaugacgaaaaagccagaggaaaguaagguccccacaucacccugcugcuggucaugcuuugcucaacuagcaccaucuaucuagacauccaagccagugguccagugugccuaacuuaaaacagguauucagaaaggggaaacaauacaaaaucaagccuaacuuauuucuuucuauuuuccacuaggacauguacacgggcauucccuaaacuucauucuccuuaagagugagcagccugcuccaggcuucucugguggaaggcccacagcagaaagucagcacugugaagacaaagcuguacaaagaaggcuucagacacaaaaugcuuucuuuucauaaucacugagauuucaacuguggugauccagguaguacugcgugugcgcagcaaacuguaacaagaaauugaaaggugccggccauggccccgagcauaugaagacagggugcuguacuccggauuagacaacauuaaacacugccuucauguuuuuugaaaccuaagauccugaaacauaguguuuuuuaacuuaguaaaggugagacaaccuacuccaauguaaauacacggacauuaagccaaguauaauggaacaugcuguaguucuagcuacucggaaggcugaggcaggagaucacugguaaccaggggauaggggauagcuuagggaaccuaguaagacccugacucauaaaagaaaaauaaacagauauuauuaugcauguuuugauguuuuucacaaacugcuuuucugaaauacuacagagaaucaaacacaacacuccaaaaaccaauguguacauaagcaaaggagacaccuuucuaguacugaagaauucccauuugagugggccacaggcagguuuuagaggcagcauccaccaaucaucaugccucgcuuauuugguaagcaguauaucacugauuagcaaauaaagaacuggucaccaauaguccaaauccuuuacucacuauaacaauaguguauugcuguguguguaagcaacuuugcucugauguuuacacacccagugucugcaugcugguugcgcacuacuuguaggacagucuuuaagucaggaccagagcaugccaucugcaugccacacccugucuuuauuaugagaauacacaugcuggaugcagacugcuuaaguauccuuucucagcugcagugaagaacagauaaauuuccuauaaucaccauuuuccauauaaccaaucacagacacaaaggguagagauucccaaugacaugggagucugcuuccagggacccagauguauaauucuuaggccgcagaaugaugguggccauguugugaccuccauacucauucugucugcugccucaguguugauuggucaggcaggacugggggaccuuugaccuuauuagccuuaauacguagacuccaguugcccuucugagagucagcaguacuacaaaacuaggaaguuguuaucugggucaaugaccauuucaucauuacaacuuuguaacuaagggcuugugauaauacauauuacauuguuuugaguuccacaguuacaucuuacaaaaagaaacaaguuguauuuucuuucauuauuuaaaaaaaaaaagcaaucuggcacaguucacacaucacuuguaccuucuuccuugucgacuaaaaagcauacuccagggaagacaaacacugguacaccgauuacccagacaucaccacucaaaaacacugcuucuaaauucaggaucaaaggcuaucaagccagguaaguaaggaugacagagaaaaagauaaacacauaacuaggggguggccauauuaaaucaagaagaguuuaguuuugcaaaaacaccuucaaaauugccauggcucuucaaauggacaaagaguuuauauuucgcagggaaaagaugggcauucagagagaaacagcaagaccuucagccugagucguaugagagccagcagaaaggaugagucaaaaaaaaaaaaaaaaaaaaaaucacaaugaagugcaccaaaaguuuuguuaaacaagaucuaauucuuuacccaaauuaagagguaaauuaacaaaugagagcugaggaauuucuguuguagcauucugaaaugcccaaucccuugguucccuacuauaauaaccacaaagaagacaaaugcacagcacaccuguuuuuucacaccagagucacucugcuugucccugugaaccugcaugugcuacagagccagcuuagccuggcugucuaaaaacaaaccaaaaagccgagccagguaaaauacaggagguaccauuuguguuggagccuaaaauauacugugacacaaugaauugaacaagucgaagcaugaacgaaucagaaucaauacuugauaaacgcagcccaaauccaguaagaaaauaugaccacuagguuuuuuguuuuuguuuuuuaaauuauacaagaacuuaaggcauggcucagugguagagucguugccuagugugguggugagcucagugguccagaguuguaaaugaguagugggaggguggugaaaggcugguguuccagagcaccuacuucuuucucuuccagagaccuagacucacuuccugcacccaccuaguacuucauuagcucugcaggggguaugauguccucuccuaacuuccacuggcuccugcacaugcauauacuugggugcacacauauacacauaaaauaguuuuaaaauaauuuaugaauucacccugaaccuuacuauuauacauaaauuuacuacuugugcuuaaaugucaggaaacagauuuugagauuuauugcugcaaaguuguggacaacuaauaguaaauggcgcauuagcugacuaaugugugucuagaacucagagaaagcagcccacauuuuauuagcagucuaaaugcaagugaacucucuaugcaaaaucuaagucuaagucacuauuaugugcaccaagcauacuuacacauauugcuccuguuauuauguguugccccaauccaaccuuuaaaaccccccacacucccuucacacaggcaaccuuggcaaccggauggagauggcucuuuuacuagcccuccagccuuuaugggccaccauuacaggaccugcccuucaccuguccccuauaacaguguccaauuggcaguugauuauggucuguugggugacacggguaaaucaguagaaacaccucccagagaaaguaagcuuaugagaaacaucacuguaaucuuggaagauuaugcuccagugugguuuaggaacucccaugggcuagagagaugauuuagucuauaaaauaccuaccaugauccucugcucagaucccuagcacccauacaagagcugugccacuaggcacaguggcaaguuccagcaaucccagcaugggggagacaguacagagggcuggaaugauaucucaguggcuaagaauugcucuuuaagaaugaggaccaguauucagagaucucauuuuugaggggaggggaggggagacauggcucagugguuaagagugcacagcacucauacguaggcuucccauccagcagcucacagcuaaccugaaccccagcuccaagagacucaaaaaccucuucuauccuccauaggcaacuaaguucacacauaaacacaagcagguagccacaaggguacaugcauauaauuugaaaaagaacuuucugaaacacagaauauauuuaagaugcuacuuaaacacuuaauuaccauggaucaucaacacagagaaggcaaggaguuauuguuuuaaaguacugugcgcucccaaugagauaucaacuaagagggugguggugacacacggcuguaaucccagcacuaaggaggcagaggcagguggaucucagaguuccaggacagccagaacuacacagagaaaccuuguuuagggugggagugcagacaggaacagacacaagacacacacaaaagucaacuucuugaagagucacagggcccuuuugagcuccauccaggaagucagguacuaguuugccaacaauugccuaucuauucagacugacagguggacacccaggacaagagaagcacacuuuggucauggguagcaaagucaacaacacuauguuaggcuucaaacuuuagcaugaaaaucguauuccaagauauuuuucccacuuauuugaagauacuaaggggggggggaggggcgcggacacacagagucuggaagugcaaacgucuguaaacggaaauuuaguaucaaaugguuucagaugcugcugacaggccuucuuccucauggaguuaacaugaccguaaucuggcuaguuguagagguaaauucucuaaguggcugaaagaagggaaguuaccagagaagaaaauaauuucuggagaaaaacaaaacaauauguaaaugaauuuugaaauccuaggauccacucacuuccuuuuuacuugaacaugaauauccuaacuggacuugaacucaacucagaauucucuuuucauucuccuaagcagccagcauuauaaggcgguaaguaccaccacguaugacuuucagacuccauuccacagaacacacacuuaugauaccugagacacuuaacaucaugcacacaaauguaacuuguacuaccugcuugauacuuucauccuaacucagacaauucauggaggaccgauggcaggguuccaacguuaccauaaccuugaauuauuuacugggauggaagugagggggagagagcagcucucagagcagaagccuuuaggagcuccccagggagcugccaagcgggaagcaagagcugcaucgcugcgcuccuuagagaggcccucgucagaagugcuuccgggacuaucuccaccugcuugcauuucuauuuuguuugccuuuacaacaaugucguagauguacuccuagacaccagaggcucacaggcacugcugguggugcccaugcuaacaggacauggagaaaggaugagaacgggaacaggcagcaaucagaagcacagacugaaaccagcagguaccuuuuagaacuacagaaguucucuccucccuaauccaagaacuuacuccuggugcuaaauuugugcugaaauccgcucccacugggguauagcuauccacaaaaugcaaucaaugagcuuuaacagagcggcucugcaagguuagcuuccagggugccuaaggcaggggugucagacaacaauuucuggagagcucucagcccauggauggaucaucuucacugcuacuaugaacagccccuuaaucaacggggaaacuauccccagcaccuucuugugccaacggagacugcgggcugauuaacugcuggcuucaguccuccacucugacaagccaagguaccccugaaggacuucuucccugcugcccuuggguaaggugguacagaacaaggacagucagagaagcccuguuuucaucuagcaaagauaucucacccacacggaaaccaaauacaguguaaacuauguguuuuugaagggacagagaaucuagcaccaaaaauaacuguuucaggguccugcugacauuuagaucagugcagccagugccacaacuuucucugugaaguaagguaaccaugccugagcccagcaaucucagugacacuguccugagaaagcgggugcagccuagaauuuccaggugacccuuguaaacaagcugccaagaucugacuccaucucagucuuaauuccagucucuucaaucccugacucagcccuucuucuguuuggaggccuucagacaucuuaaaauucuccacagcauaaaaucuuucuucagcaaaguucucaaaggugauuucaucuaacaauagcuauggauuccuuacacacugguaugucaagccccaaacaucucauuaugucaacauaugcaggauacugcuacccugaacuauaaaacucuaaauccagauggaaggucacugccaugcacaagugccaugcacugugcacagccuacaucacuggacaaaacaaauacccagggaugagucaguguaaagugcauucaaggcacgcaugcacacucacgcacaagguuuauacuuccuuuuuuuauuucuaaauugaaaagaaaauaaauuuaccaccuuauugaucuucacuuugucugcuauuguugcuccuccuugggaaccuguuggaaacaugguacuugcagcaaacuuguauuuauucaagagaccucaccuaucuguuucuaguuuuguucacaauacuaauguuugaacauuagguccuaaagcaaagcagauuccaaacaaagcauguuuucaagguacuuuuuugguacacuuggaaggaggcacaggcaagcagauugugaguuccagcccagccacagguacauagugagacucuggcaaaaaagaaagucacuugguaggaaaaauaaugaaauuaauaaaauccaccccuccauccuguaccaccaaucuuaucaggauugagcucgaaggagaugcagaacauucuagaaggggcaacauacuagaaaucaaccuacgagugauacugaagacacccaggccaaacugcacacugucucccauaccaucaaaucccagagcaaaauccugguccaguauagauucagcaaauuagagagacccugagaaaccucuaugcuacaacacucuagacaaagaauagggaguggggaaacagcacgcacagaucaccuucuaaguucugggcuccagacucuuguccucacagcugcacaguacagugagcucuucauccacugaguaucuccagccccaaugcauccauuguuuuauugcuguguugguuuugguuucuuaaggcaggcuuucccugugcuguccugaauucaaucuguauaccaggcaucuggaauucagagauccaccaccugccucugccucugccucacaagcacugcaaguggccauugaacucuaaugcacauaaacugcuauuccaacuagaacaugucgaugagaagcguaaggacucauguagccacccaagaugccuucaaaaggaaaauucuuucccuuaagcagcaaaugcucacucugcgccccucccccucaagauaccaagaaguguuaguccuaaaaaaaacagauaaaacauaguuacacuaacacagacuaacauugcucuuugcugugguuuugcuugguuuagaucaagcccaugccucccccuccccgaugcagaggaagacugaaauggggccauucccgaaaggaacaauagcaguuucucuguggucauggaauaguagagguagaaguaugaaaauaggauagguacacugacccaguaacagacuaaaugacagggucaacucagaucccacuguuguacuguggcccaggcaggacaggacucugaauccaccuuaugucacaggaaggaaagcaugcaggaucaagaacauaaaguuaaagacaccagaugugugccuucaccugcacucaccugguauggcuagacccaaagaccugaucguaccaaggccauguccugugcccagaacaggaagaguugucacuucaggaggacaggggagacaugguuuaucccacuaacauucaugagcauugccugggccccacaagaaggggcugggggcaguacuggugaaaggagguuagugacaguugagaaaggugaagacagugugggagacugcacucuaacccccaacaccaaccgggauggcuagucuggguuaucacuugauuccugcaacuaagugagaccccaaauggaaaggcgcaccuaugcaggaguuuugcucaauuugaagugaaaagaucuacuucucauguggaucugugagacagaaaaacacgucuuuaaucccgacguuuugagcugugaacuccacuuugaaucuggggucuaccuucugagggaagccuacauaaggacauggaagaaggggauauuugcucuuugccugcuugcuaucaucuugauaguaacuccauuccuucaaugguauuagagcccacuucuuuggaauucugauguauaccuuaaagacuagcugagacauccagccucguggacuaaaacaacugauucuuggcagccauuguaggauuaacugaacuauaggcugucauucuaguaauauuguguguguguguguguguguguguguguguguguguguguucauccuacaaguuuggauauucuagagaacccugacuaacauaccaagaacccaaagaacagagaugagggucuaggggacacuugccuacaugagcaaagaccucaguuccaucaccagcaguacauaaaaacaagaggaguagggcaggggacuaccaaugacaagauccaccuccaguuauagauuuauacacuaggguucuauggacaaccaucacugaaguuaaugucaaaaggaaggcuguuguugugaaauagacuuaaauauucauucaugcacacacuaggaaaaaagaaaccaucuuuuauauuuuuaguuucucaguuccugacaagaugagaacaugcaagaacauuggccacaguaguacugucucugucgcccagagaggcuacaggaaacccucccugcccuguguacuucuuuaagaacgugguuggggaucaccaaguuggcucaguggguaaaggagaaaaacaaugccucaacucccacaagcugguuucugcugcaacugaacacaccacacggcacaucaaccucaauagcacgugcucuaagacagagacugucaagucauggcgagucugucuaccucuaagacagagacugccaggucaucucgagucugucuaccucuaacucaucaacuuuaaaacaaaagaaccacuuuucuccuaucucagaucaguaguaucacaucuaaaaaacccuauuagaaaauuauucuauaaaaauaaggaaguaauggagaaggcuucagagguuacgccaaacagccaagaccagugacucccucaagacccuaaggcacuuuaauaauggaacuggacaggaaaauguauuucuaaaauaaaggauauagccacaggcaaaaaacaauaccaaccauaucaacacuggagcuuggaccagcuuacacuacacacugcugucccuuuaagaugaucaauuccaaagccaguaucuucaacaaguaaaagaguuuauaaagggagcacugcugaccucagcaccaacacuacagagcacagcaacagcucccagaaaagagaagaggcuauccuacccacuacaaaagugaggcucccaagcaucauggugcaugccucugaugccagcauucaggaggacuagugggcugcagagcaaggccguguguguguguguguguguguguguguguguguguguguguguguguguguguguguguaagaaggggcauggacuccugcagagcagcugucugaagugagaaguaaagccugagggauacuagaaaccaacuauuugagagaggaaacaagcaacugacuagacagacaucaacuuaccuuuuccaggcucaucagcugcuuugcaucccaaaaucaagccuguauggcacaacacuauauccccaagaccacgggaaggucaugacaacagcuuugcucugagcacaugaacucacacagcuucuguaccuacccaauaccaccccagugcccuuguacacacaugcagauagauuauaagucacacgagugacugcuaaaugucacuuaugguuaggguugcuguuaucacacaggucucagaaacuaaccuccaagacacaaaaaacagaucugagucuagacaaauagugcaugcuacacagcaucaaaguggggcugccaagcaggaaaguaaggcagcuucaucucccuuuucaaucccuaggaaaagaaauaaucaccuuucaucuaagacgacuccucacucaacagcagaaacugccaagcugggcaugagccugcuugucuccacuagcacccaagacacagccuugcuucuucaccagaucuagcaacuguuuccaaccccccccaacacaccuacuuccugucuccacccacucuguucuaccuacuagggauggcaccauaggauugauucucugugcuuuagaaauaggcagauugucuccaaguaagaauuggggaagcauuuaagugaauggcaagaaaaagagguguugucaaagaaaaauuccaaauaacauauucaugacaauuauuuaaagcaaagaaaaaaaaacccacuggacuaguaaaacagaaauucacuaaaaucucugcuuauuaaucuuugcaguucucuucauauauaagguauaaagagaagggucaacaaucuauauuauuuuuaaaaagauuuuacuacuuaaccuuauuuaaauguacauaaaauagcaucguaugcuuugccugcauguauaugcauauacauuaugugcugcauacaucagcacauaaugcgugaugccagagcgggcugggaaggcagcauuguauugucuaaagcugaacuuacagaugguugugaacugucugucauguggggacugaaaauagaaugugagaccucuggaagagcagucagugcucuuaaccacugagccgucacucuaacuccaucaucuaguuacacaauuaucauuucuuuauuugcauaccauuuuuacuaucuuuacucaguauguuacagagaauguauguuguguuaauaaaaacuguaaucuguucaacugaauagcugaaacucaaacuagacacaaaacuggaacaacaccagcucacacaacuauggcccuaucuagucaguacaggcauuacaguggaguugacugaagagagucaagacugauaugaaagacaagggaaaaugugagcagcaucuucaguguucuaauuuuuucaagaauauacucauuaauuuucccaaaaauaugauuaaucuaaauaauuuaaauaaugaaaucuuagaaacaacuucuaaagaaauuuaucauuugcauaacacuauuuucugucuucaaacuaccaagguuacuauucaaacccaaauucacucuagaaagcaauuauuucuuaaacauacuugcaaaacagugaugucccuuuuaacuccuuugacccuuaggcaggcagugcuccuggggcuucagcuguucuggaaacaagcucuucuagacuaugacuccgaguggcacagcuccaucacuaacagaugauaacaggucccgaugaggagcugugggcaucacacagcacaucagagagaggugcuagccuaugaugagucuacaucuuugccauaagaucaagucuuugaugaaagacaaaaaccaaggaggcaugcaaucugcagagcaucuagagauuguggagccuggcaaaugcuugcuuucccagaaggaaaagcagugcaaggaggcggcgucucaguaagcuggcacagccagacugugugagucucuagggcuagggcucccagaaggucuaacugggaugaugaggccaacacagcuaacaaggcauuccugaggcuaagaacauagagacaguugcagccacagaacagaucaagcacaucugcuucccagagaggguccagugcucaagacucaaagauaauaaccccaaaagaggguguggcagcugagauggcucaguaguagaauccuugccuagcguggcuucuucauaucuagcacugaaaaaaagguaaagugggaaaagauuaacacagcccagagaaauucuggaagacagaacccaucuacuuagggcuacugugcaaagugcaaaggagcuuuagugugacaacuccaaacaaacucaacaauggaaaagccaaaucaagaccaggcaugauggauccaaucuuuaccccagaacuugaaagauaggcagacaaacaucucuuaauuugagggcagccuauuucugccuacucgcagagggaacacauaaaaaaugacuugcagaguccucacaaacuuugguggaagaugaauccuaccaccucgcucaaccacuaaucaaaaaggcuaguucugucacuaucuguccaauacaugugcaaagaaagaaggcgaacccaccaggccagacagagcaggcacgguccaggcaugucagagaggccugagacuaaaggaaaggguagagucugggugcacagggugagaagcaccaaguauaacgccaagaaccuaagccaaauucuaacaggaccaggugggcaacaggugugugugggccucaaagaacagccccagugcucccuuccucaagcaaggccacuaaaagucaaaacagacaucuagcuccucagccuacuacacucacuacaguccucagagacucuucaugccugucuacucagcagucccugaaaucaaccuuguaacagagugaaaagcaagauacagaaaucuaaaacauccuuccucucagaccuccuccaucuucgucccccgcccccaacucuccucagaaaagagaauagucuuucaggcucgcucguucuacaugucaaacuccuauccugagagcgcacacgcuauagacaaagccauuccagcaggugcucccacaaaccucauucuagacugaacaaaaccuaguuuguuugugaggcccauggugucacccacaacaggacuacagagcccaaggcuguuucuguuuauggggaacagagguccaaacauccccugaaaagaagcuaaccuugccagggaacauacuuuccuuuucuauacaagcagccacucgcugugagguuauucugagcaaauaagaucaagguaugagucaaauagucaccuagguaucaaaauagaacugaauucagaauaauacacccaccuccaugcccuacuaagagacaaaaagugaacuucagagauuagccauuccauaguaugaaggggagugcaggggagugcaaagaaguagaugugaugagguacaccagaugacagagaggggacauuaggaaaugccugagaaauucugaaacgucuauagcuaauacucaaaugucaaugcuggcuucuuaguucagaccaagguuguccguaagacgguagcaauaagggaaagcuaggugggaauuauauaagacuuuuguuacuuaugcacauuuuccccaaauccauguuuuuucagaaauaagaaguauaauuuuacaaauuaucaggccuguaaauaaaguacaccuuaauaauuccacucccauaaucaaaucauaacuagcaacaagagauaugaagaaaaaauagacugaaaugaaccucagagauggacacuacacuguaucuuaagaaaaacuauacacauggcagucacacuugacaaugaagcucuugcacuauagcaagcuuaaguaacacugugcacuaugugugcacaacgcauggacaaguaaagcaaacgcaagucuccugagccauuucuucaagauuuaccugauuuacuuuaugucugcgcccaucccgccugcauucaugcaugugcaccacagguacacuuggugcugcgaccaucuaaccugcaugcauacaugugcaccacagguacacuuggugcugugaccaucuaaccugcaugcauacaugugcaccacagguacacuuggugcugcgaccauccugccugcaugcaugcaugugcaccacagguacacuuggugcugcgaccauccugccugcaugcaugcaugugcaccacagguacacuuggugcugugaccaucuaaccugcaugcaugcaugugcaccacagguacacuuggugccuaagacgcuaagaagagcguacuggacgccccuagaacuggaguuauggauggcugugaggcaccaaguggauuuugggaauccaacuugguuccucuguaagagcugcaaagacucaaccucagacauuucuuuaacccacucagauauuuuaaaggcaacagguuucagaacuguuugaaaacacugagguccccauacaggucagagauaacaauuccuccaagacguauagaaaaucacccaaauaaaacacaucuccaagugugacacuacauuuuaagacauuauaauccagaucauaauuuuaucugaaaaaaaaaaaauuaaaacaaagacaaauuucuaaagcaaaugccaggcuaagaauagggcaauaucuucaaguagguaccaacacagaaauaacuaaagaauccuugucuacaaauugaagugcaauuauuuucgaggccaucuucuaaacaaaaagaauuauguaagcaaagaaaacggaugagacacaaggaagggcuauagggugccugaguaguggacuccauaguccugggaagaaaggucauguaaagaagggcuaaugguggguauuacauaagaaagccauccaguacuacagcgacacacggucuacuccuaguauacaaaaacaccgagaucaaacacagaaaaguagcucuagugccaguacacaguugagcauaugcauagucagucucugaaaaccagaccaguuccacaacaaggcugaucuuucuacuuccaugagccuuuuagaagacaacucuguccagggccugcccacagcaggaagaagcugcugaaacugcgcacacugagagagguugacacacagauucuuuuaacagugucaauuuuuuguuguauuuuuuggaagcuggaugacaaucuguagaugucagucagcacacuccuugcaccagcuuuggagaacugaccucccauguucaggcuuggcaucaagugucuucuuuaccugcuuagccaucuggacagcacagguauggaauuuuaaacaaauugucaguaagcauacagacugagaggcucaaaauagcagucuuuaaagugugguccaaggacccuagaggagccucuaaaccuauccgggaggucgacagguuugagaaauucacugaggugacaccuaaacagauaauccaauccauucaaagauagccagucugaugacaacccaaacuacauaaagagacccauuggaaagaaagggggagggaagaaaagaugaagagaagaacagaaagaaagggaagggaaagaagguaaaaagacccacuggcauaagccaaugacuuuccugaauguacaauucccguccuccauuugugucaucccgagucccugcacugccuggcaugcaccgaccacucaaggcagaaccucuucuccuugggaaacacccuccuuccaucagagagcgacuggcuagaaauuucacuuguuaaagcaucgggacuggcagaggcuucauggaaagcacacagaugacucuccucccagaaacauucgaccagucuaauauacuaaaaugaaaaauuuggggaaagacgggaguuugggaaaccaccccaaugagcagacaguaccuagcaauuuucuggauugcauuauccuacaaaaaagugcagcggcauuuggguauguaacggacucugcugaccuuauucccaaagaccaguaugugaugaugcugcagugcauaggaugaaagacccggaagacaaacucugaaaugcaagcagggaaccaguauuugucagaaaaccuccaaaaauauauucaaauuacuaaaauaugcuucuauuguauuuuccagguauacuucauacaaaacuggcucacaaguuaauauaaggcacaauuuguaaaauuuuaacacaauagaucucuuaucacuaacuuuuuacugggaaacuaguuauuuuaaauaagaauacaaaguguuuuccagggcagaguuuggagucacaagaauuacaauauugggucagcuccuaaaggcaauuagcaguuuaugcuguuccaaaguccuguuuacauagccaaacagcaucuggugaucuaaaacacgaaugacggccugguuucagcaucaccccgcauaagucucuuugaggcaugcuccaccuugggacacaccugcaaucucaccauaccaguguuuauauugaaacccuaagucuuaagguucacaaauaaaccuacucaagcccagcauugacuucaacggccucucccuauucuaaacugaaaacuaauggcccccgacaagugaacucauuccuuuuuuauagaaaaugagguaacuacaaaaucuugucaguuauuuuaugauuaccauauuugaggagcugagcacuguagcacaccuguaaucccagcacccaggaagcuaaagcaaaaguucaagguuagcaugagcuacacggcgagauguaauccccccaucaauauuaaucacauguggguguagggugugcuguguguuguccacagugaaggcaugcaugugguggucagaggacaaucugaagaaggcaguuuccaccuuccaccaugugguccugggcaccagagcucuggggucaggcuucacaacaggcaccuuuacccacugagccuauuaucuuaccagcacuuuguuuuguuugagacagggucuuauguaaucuaagccagccuuguaggagauagggugugucucugggagucuuugagguuucaaauacccaggccacucccagucagcacuagugcacugucuccuaucucccucccaucccccuagguccgucugucuguugcuugcuuguggaucagacaaagaucucaacuacuguuacaauagcaugccugcuugcugccauacccaacaugaacuaaccuaacuuucuggaacuguggcccccaaauugaaugcuuccuuuuauaagaugcuuuggucgugguguuuugucauggcaacagacaaguaagacacauacuuucuuuuuuauacuuacuuuuauugcuggugugacaagucaaacuauguaaccaagaauaaccauggaaauccaccaugugacuacuuggacuacuuggaaacagaucuuugcagguaccuaaaccuaguauggcuguuuuccuaaaaaacagaaacuuaggauacagauaggagagccaaauauagacagaugcaaagacaggaaggggacgcaggaagcuguauaucauucaaacaaccccgaagacugcugccaacuuucagaagcuccagacagaccuagagcauaugacccuggaucuggccucuagccucucucuagggguuauacacuugagccccuagacuauuguguugucacaagccaauguuuacaaauuuaaacaaaguuuuguucaagcuccacaaacaguuuuaguaaaaacaaagcaucaaauuuucuaaggcaguaaaugaguauaacaucuuagaauacaggucauuuuagcucauagcacaaaagaucugcccuuccaacauaaccaaguacugucuggacaccuauguuuuacuuuaaccagcucuuuggagaaagucugagguaaacuguauugcuuuucugugugugcuaaacuccuguccccccccccccuuuucuuuuugcuucucaagugcuagaauucuaagcaugcacaaucaugacugacuguaaacauuaauucucaaccuaaauaagucaugguaagauacuugggucugggaaaggguuuuaacagguucuguaggguaaaaagauagaacucacucaucauucuugguacugagacuaguucuagacaaccacacuucucuuugccacagaccacaaacuucccaguaacagccaaaauguuggugcuuauuugacuauaauuacaauucuucagaacgagcagacagcagucuguagaggcaugaaacacucuuagcuugggagaaguaaaggcuggcgaggaguaacagaaggaaagggucgggggccucuccagagacgugacaguggcgacugaaugaagggaagggacauuuguuuuggaagagcccauggcuuaagaacauugaggugcaguauagcugggacaaaugaaaaggucaacaaaccuuuuucauggguaagaaaucaacaggaggggguggggagaaaaaaagaaaagaaaaagaaaaaaaaaagaaaucaacaagaaaggacaaucaaaauuaacaauuacagcaaguuaagaagaucaauauucucccaaacugggaaggucuuaaaaaccacuuuuaaaaauacuacagccuccccaagaaagaguuucagaacaucaugccacaaaggacaacaagaccauacagucaacauagccaaaguacaccaaauccaaaagccaacuaacuugugacugaaauccacauggaaagacucugagaacaaacacugggugaugagacgggcaguggugagccaucaugcugccauuaugagcucugcacucaaacuagggaucccuuggacaucagcaaccagccccagucagggaguuacccacagugcugcaaagcaggguuugcugggaugcaacuggagagcugugcagaaaugaaaagccccugcuguccuuucagagaaugcagguuagugcccagcgccuucauguggcucacagccaucaauacccccaacucagaggauucaaacagccucuuaugacugagcaaacaccagguuugcacacgguaaacgaacacacacacacacgcgcgcgacaaauacucauacacaugaaauauaaauagauagaugauccuaauucaccaaacgcuagaagcaauggauuugguaaaucuguauauaaaacuucuaacaauuugugggaaaagaaagggaaacaacuaugguugguuugcuccuugcaucucuggauaaauugacaaaggaaaauauguaccccauaauaaaauuucuagcaucucagacaauggcaaaagaccacaaugagaucagugauaaagcuggcuggccuugggaugcucauaaacagucuaaacuuuggacucuaaagaucgcugccuguguccuguuaaagaaucuuuucucuagcagccacagagaucagguugaaagaucaaacaaagaaaaucaaauaguaauuauauccuuauuguaagguuagcugaacugccagguaguggcgacacacaccuuuaaucccagcacucaggaggcagaagcaggugugucugugaguucaaggcuaggcuggucuacagagcaaguccaggacagcggggacuguucaggaaaacccugugugaguauuggggugugugugugugugcgugugccagggcaggguuggggagagaugauuuaagacuggcuaaauuauuaagaaaaauucaagcccuggucacgaacaguguuggcaguuaaagugagggcauuaacugccaaagacugagauccuguaacuuggaaaguggauauggaggacccuaaagauucucaagugaugugauaauaaucccugcauuuugauaggagauuucguuauugcuauaggcucaguauguggagauucuggguuuaauauggaaccucauacaguuacaaaaaaauguaucagaaguuuguuaggaugguuggcuaaagcauuugccaaaagauggucuacugaacaggagugggaagugcaugauaucccucgguuuaguguugauaaagggaacuggcaugccaguggguacacugugcaggaucuaaucuucaucaugagaaggauggcaugcccuucacaaauccuguaagauacaaaguggugagagggguaccauuugaaaagguucauugucccccuuuuucuuaugccagaaucugggauuggagaugcugcuguugaguuagaugaauuaaaugcaauagguuuaauuggucccuggaagaaccagaggccagguggcaccacuaagucaaaauucuucaacaugcccaggcuccucuaccauuuagaccauaugauccagcagacuaaaaucuacuaaaugucaauggcagguaaggaugcuguuagggccucuggcaguggaauguuguagcaggguucuaccaacaucugcacacaucuuuuccccauuuggaagacagcgcguggccugcuacugggucauacuggaaauauaauguuugccaaugagcaaccaaguuaccuugcaaccugagcuggccaucaugagcaggguguugugugacccacggagucauaaagcagaacacgcacagagcgauccguuauuagauggaagcaacacauaugucauccagcucaaggaccugaagcuuuguaaaaaccaaguuauguaaaggaguugcccaaugccuauccuauuccuguuacaaugccgccugcucccaagcaugccccuauagcuucccggggugugcccuaugaucaguagacugaggaagauaagaacuauggccucgcuuacugauggcucugcacauuacucaggcaccacccagaaauggacagacagcauuacaaccccuuggugaggcaacccuaaaagacacagaggcaaaggaaucgucacucaaacuucaggcaguacacuaagucauacauauuuuguggaaggaaaacuggucagaugugugaguuuucauugauucaugggcuauagccaauggacuggcuggaugguaaaggacuuacaaagagcaugauuggaaauuuggugaggaaaaacaucugggcaggaaguauauggauagaucucuccaaauggacuaagaaugugaagauguuuaugucccgugcucaucaaaagcuuacuuuugaugaggauaaauauggaggauaagcugggcgugguggcgcacgccuuuaaucccagcacucaggaggcagagacaggcagauuucugaguucgaggccagccuggucuacaaagugagcuccaggacagccagggcuauacagagaaacccugucucaaaaaaacaaaaacaaaaacaaaaacaaaaaaaaaaaaacaaaaacaaaaaacaaaacaaaaccaaauguggaggauaaguucaauaaucaacuagauagaaugacccauucuguggacugucagccucuuucuccagccaucccuugucauuucccaaugggugggcacaggaagacaugggcauggcggcagagauggggauuauguuugggcguaacaacauggacuuccauucccugaggcugaccuggcuacagccacuggugaaugccaacagcaaagacugauacugagccccaaaauauggcaccauuccuuguggugaccagccaacaauaugauggcagguugauuauacuggaccauuuccuccauggaaaggauaacacucuguccuuacuggaguagacacuuauucuagauauagacuugcccuuccuguucaucuuguuuaugccaaaaccaccaucuguggacauauagaacgccacugucuguggacauauagaacgucaccgucuguggacauauagaacgucacugucuguggacauauagaacgucaccgucuguggacauauagaacgucagcgucuguggacauauagaacgucacugucuguggacauauagaacgucacugucuguggacauauagagcgucacugucauggcauuccagacaguauugcuucugaccaaggaucucacuuaauaaccauagaaguguuaaagugggcccaugaccauggaauccacgggucuuaccauguuccucaccauucugaaacagcuagcccaauagaaagauagaacgggauuuaaagacacaguuacagcgccaauuagugguagcaacaugaagggcugggagaugauucuccaaacagagguauaugcuuugaaucagcaagauucauggguccaugaaaucaagggauagaaaagggaauauucccacuuaauaucacaccaaugagccacugggauaauguuuugcuuccuguucugcuggccuagaagcuuugguuacaggagccacaacaagcuucccacugcacuggaggcucaggcuccccuggcaacugagcuucugaugccaauaggccaacaggcuaagaaaggaauaacaguguuagaagggguaaaugauccagauuaccaaagggaaauuggauugcuucuccaccauggagguaaaagaagauuaugugugggugcaagagauuuauaggcugucuuuugguaucaccauguccugagaugaaauucaaugguaaacuacaacagucuaauucaggcaggaugacaaagaacacagacccucgggaaugaaaauaggggucauuccuccaaaaagagacaugacaugcucaaggugcaugcugaggaaagaggaaauacagaacaggaagcagagaaagacaguuguaaguaucucccuacagcaguugcagaaacgaggauuaaaacuggcaucaguguuuauaucauauuuuguuaagaaugcuuguagaaauauuugguuuuucuuuccucaaauccuuuaucaugaaauguaacauuaauuaaucaguggcugcuguacuaaauauugauuccucaagggagauuguacacgcaauuguuauaucauauuaggcuacaaugaugaccugguuauuguuuucauuuggaaaucaagcaggacauaagaggcuguaauugugugucaagaugacaaggggcggacuugugaugguuauucuuuuuuuuaaaagauuauuuuauguauaugaguaugugguagcuguacagaugguugugagcuaucaugugguugcugggaauugaacucaggaccucugcucgcucuagaccaaaaauuuauaaaguaagcuauagcugucuucagauacaucagaagaucucauugcagacgguugugagccagugaugguuauucuugguugucaacuuaauauauccggaauuaacuaaaacccaaacaucuagguauagcagugaagaacuuuuuuaguuaaaucauuugaagugggaagacacaccuuuaaucuuagccacagguucuggucguggccuauauauacagggguacaaaagaaggacgcuugugcucuuugccucuugcccucacuuuugcuguuaaguucauuuccucacuggcauuauagccacuuccucacauucuagcauauacucaagaccagccaaggcauauagccucauggacugaacaacuauuagauucuuggacuuucuguugcuagacagccauuaauguaacauacuuuaauaaaucauagacagacagaugauagagucuucaaaagcuguuccucuagacaacucuaagacaaaaguaaugccuuuaguuaaaacauuuaaaaucuagaaaacuacugggaggcagaggaaagcagaucucugugaguucaaggcuagccuggucuacaaaguaaguuccagaacagcugggacuaaacagaaaaacccugucuugacacaaacacacacacaaacacacacacacacacacacacacacacacacaccccaaaacaaaaagggggggggggagaucuaagaaauaggggcugagccgggcacacaccuuuaagcucagcacuugggaggcagaggcaggcagauuucuaaguuugaggccagccuggucuacagaguguuccaggacaaccagggcuacacagagaaacccugucuugaaaaaccaaaaaggaaaaggaaaaggaaaaagaaaaggaaggaaaaggaaaaagaggagaggaaaaggaaaaagaagaggagaggaaaaggaaaaagaaggggagggaaggggaggggaggagaggggaggaaaaagaagaagaaaggaaaugggaaaggggaaggaagaaagaacggccagaaagaugacucagcaguuaagagcauaugcuacuuucccagaggaccugggcgcgagucccagcacccauaugguggcucacaaccaucuguaacuccaguuucaggagauccaauuccauuuucuagcuucuaugggcaucagggcacacauaugguuaagugcauagaaauauaugcaggcaaacacacacacaauaaauaacaacaaugacaauaacaucuagacacucauugggcuucccauucuugaacuuguaaaagauuaacaggcacggacuuaucuagauguucuaauaucccucagaaguuaggcauuacaguagagucuuggaccaagccuauagaacggaggcugcaaugaagaaagcugccaacacuguaucaagcaggcaauaggaccuuuccuccucuggccugauaccaaugccucacaauucgggauccuaaacauauugcugucaauaaaacauguacccaguuagcaaaccacagaggcucagucuaaagaacaaaccauauccagacagauauggccaucagcuuaccuauaucugcauuuugaagaauaaauaucaugcaccaaguuucacuuagguuuccaaauaugaaauuaucacaauuacacugcugacuucuagacugagaaauaugaaagaaccugucuuuaacagcagaaccacaggccacuuuacacuacauuuuguuuguuuguuuguuuuuucucuguauugcccuggcuguccuggaacucacucuguagaccaggcuggacuugaacucagaaaucugccugccucugccuccuaagugcugggauuaaaggcgugugccaucacgcccggccacacugcauuuuuauuuaaaacucaaaaaggucuugguauguagcuuaguaguagagugcucaucaaauaauaguaaggcccuagguccaaucucucucaacacacauacucacauauguacacaauuucugaaaagaagggcucucuaaguucuucccuuucuguacccuacccuagcaaauaaggugaaaugugcagccuaaaacauaguccugagcucagaugcagccagaggaugcaagcaggaggauggagcguggacacuuuauccuagcugcuucugauugagcuucaguucuucucccaggagugcuccaaaagauguccucagcagcagcagcagcaacaaaagcaccaugcacuuguuaaacaucgcaaguuaaacaucucacccugccucaaagcacacugcaguuaccaaaauacaugccacuggcaugcaagagccugaagaucacccacuccagaaggcgacgcuugcaccuaauccaacaacagggcuuccuuccccucagagcuccuugaugagacacagaacagauaaucccacugauuuccaguaacaguguagccagagcacaucauuguccuaagucugugugugcccugccuuguuucuuaaguguaaaaagcagagcaguggauucacuucacuggcaaaugucuuuccuguccuuagauucugaauuacaaacaccuguaaccauuuccagaacagaugcaccucaugccagcagcucaaucacaggagauaugucccccagguauguuugcagacaaggcacaggcgugaacacuaccugcucuucagaacaccugcugcaaggacagagauacuacaaccuuccauguaugcucuagacccuacauccagggcuaauuaacucacaggcccaguaaaaugugcuucuuggaggaacugcauuacuggagacaaguuugagaguucaaagcuucauccugcuucuaguuccaaugcaguugaagauucaaucucucaguauccugcuuuggcauccugucugacaugccuccccaacacaaugauggauucuugucacucugaaacugaaagccaaaucaaacuauuccauaaauugcuuuuaauuaugguauugugccauaccagcauaacaguaaccaauacagaggcuaagaagaaaucuuauuuaacacuuaagacaaagguuaagaggugacacaacacuaucaaguuucuacagacauugaacaggggaagccccaaaacacuggacugcuuuccccagcauacugccuacauuccccauacuaacccacauaaacagcuagaaaacgaacgcuuuuauuuaacagucaaacuaauaaaucaccggauaaagaagccaggccugauuacuaguaugccuauaguucuagcaauacacagacaggugacugcccuaaguucaaggccagcacaggcuacagaaagaaaacuaugucaaacaaacagacaaguaaacaaacaaaccucuguaaguuaauacugcuauaauuaaauguuccugaucuuuuuuuuaaaguuaccuuaugugcaugaguguuuuguucacaagucugugagaccugagagaccugagaggggauuaaaugcccuaaaacuauuaauaauuaagucauugugagacaguacuugagugcugggaauuaaacccagguccuccaggagaguaguagucaaugcucuuaacugcucaacuaucuuuccagacccgcuaugcacacuguguaaugaaacaaaaugugcuuuguugccuauaaugugucuugucuugaggaaccacaggucaucucugguaagauguaggguuaggaggcugggacucagugguuaagagcacaaguuacucaccagaggucccaagugugauucccagcaaccacaugguggcucauaaccacuuauagugagauccaaugcucucucuagcacacaaguuuacaugcagauagagaacucauacacauaaaauaaauaaaucuuuaaaagaaaaaaauguagggucccugggacaaccaaagcuccugguucccuuccuccagccgugcugcucuaagcagguaccucccaugaacuuaguacauugugccaggcagaguaccuaucucugcuguucuugaggauagaguacugugcaguaucaaguacauguggcuugcuuguagacaguacuuacagggguaccaagaaagcaugucacgcgcuuucacaugacuuauauauauauauaucaauauuacaggaaaaugaaacaauuuugcuggguacaaugaugggugccucuaugcuagucuaaagugggaggaucuagagccuagaauucagagauagccugggcaacacaauguaucauagccccagcaggcuggaggugaaacuagacuucacacauacaaagcaguuguccuuugaucauugcacaaugguccuagucucauauuuuucuauuuuauuuauuucaacuuaaauuuuauuucucuagucaacaccucacugaacuggcuaguuuugugucaacuugacacagcuggaguuaucacagagaaaggagcuucaguugaggaaaugccuucaugagauccaacuguaaggcauuuucucaauaagugaucaaggaggaaaggccccuuguggguggggaccaucucugggcuguagucuuggguucuauaagagagcaggcuaagcaagccaggggaagcaagccaguaaggaacaucccuccauggccucugcaucagcuccugcuucuugaccugcucgaguuccaguccugacuuccuuuggugauaaacagcaguauggaaguguaagcuggauaaacccuuuccuccccaacuugcauccuggucaugauguuugugcaggaauagaaacccugacuaagacacucacuaaguuggccucuaauuucugagcuuccuguuucuucuuuucuauuuugaauaugcauguuaaaaauauaaaauacaaggggcuagagagauggcucaauaauuaagaggacugucugcucuuccagaggacauuccuagcauccacauggcagcugacaacuguaacuucagcuccaggggauacaacacccucuucuagccucucuaagcaacaggcacacacaugauguacagauacaggcaagccuaacaccaaguaaaauaauaaaugauguacaaauacaaaugaaacuccaagauuucuuucauauaaguaacacuuuaucaugccauaucacuuucagaagccaaaaugaugcuggguguggugccuuaugccuguauugacaggaaagcagggcaguuaugaacuggaggccacucugagcuauaucaucaagagucuuuaaaaaaaaaaauaauugacaugcuauaaaacuuucagggauggagaaauggcuccacaguaaagagcaccuuuuauugcaaaagagcuggguuuaauucucaacacacauauggcagcucuucacugugcuuaacucuaguuccaggggaucuaauacuuuucugaccuucuugacagcccagcaaacaaauggcgcacaauauacaguaagcaaaacauucauauagaaauaugggggggggggguuugaaaagauagcgguuaaaagcacugacugcucuuccgaagguccugaguucaaaucccagcaaccacaugguggcucacaaccauccguaaugagaucugauguacuuuuccggggugucugaagacagcuacaguguacuuacauauaauaaaugaagaaaucuuuuuuaaaaaaauaguaauaauuuuuuucacacuaacucuaccagaaccuagaccaaguaggcaaaugcuauagucucuucguauacgauccaaaaauuuuauucuaguuggagaaauacaucucuagaaucaugaaauacuaacaauuaauuuuugccaaaaagauaaauagcauuuugcuuuuccuuguuacucauuaagauccacgaauagagccgcaaucccagguguguggcuggcuuccguguugccacucucuuuuuccuuuucuucauuuugaacaguggccuacugcacagacaagcuggaucuaccuucaaacauaaaaaaacuucuucaauugggaagugggguaggcacacaggaccacucccaccgccaggauagcuucuaccuauugcuaaugcuuuguaauaguuuaaagccuauaaccaguuucuuuucuuuugaacuucuuacuaaucccuucccccgcucuguuuuuucaagacaaggucuuacccuggccaugcuggaacucacuguguguaucaggcuggccuggaacucagauacugcacgccucugcaucccagggcuaggauuaaaaggaugcgccacaacacccugcuuuucuucuucuucuucuucuucuucuucuauuaauuauuuauuuacauuacaucccuauagcuuucccccuucugauagugccccccucaccuagucccucccucugccuucuuuuucuuuuuugaaaauguguauauguguauguguguguguauauacauauacacauacacauacauauauaugcgcgcacacacacacacagucugcauguauacaggagcaucacaugagaacuugucaugcaaaaaaacaaaacaacauacucccuuggaacuggaguuauagauggcuguaugucaucaugugaguucugaaaacugaacccagguccucuagaaaggcaagugcuuuuagccaagagccacuucuccagccccuauaguuucccuuccuucaagcaacucaagagaaagacaagucagauccauuucaaaggggccaaaguaauggugaccaagauuuaaaaaaaaaaaaaagaguaaggaaauuuauuaaagagguagaggggaggucuguuaacaacacagaaagauaacauuugggggcuacuaacuugaaaacauuaagaacuggacaagacaugaacaucuuaaaacaugccaagacuuuuucuugccaguuaucaaaucuuccuuuagaaaagacaauauggcagcuaccuacaauggugagacccaagggcagauaggccuuuauagagagagaugucccuauucucagaauacaugccagucacucucaggagguuugggacauaucagccaaagaucccauuccucccaacugaccacacucagaaaaucauaaaguccccaaaaccagcagcauaggaugccaggucccaagccacagaccuguccugcccauuuccaacucuauucuucaugauaacaguuaauacaacaugcacacaauacuaaacaaacagcaacugcugggccuccagaugcagcuuuagagaugguggaagaaacaagugaucuucuagacaggaucauccaucuacuauuuuuucaacaaaaucucucucacaaggacacaagagaugcuacuuauggaccccaggagauuucaugguaggcacuccacaaccauccucucuaaauaaaauccaggacagcagucacuacccugagcaaaccucaaucaggcccaagaacaaaugcaagaagcaguacucacggauuccauggcaaaaaccaguguugcucaggaauggguaugaacuccagcagggcaguaugcucugaaaggagaaaggaagaauagauuaagucagggcuaauccauuuucuuguaucucucuaccuggaccaacuauaauauaacaaguaaaauguuaaaaagguuccucucuagcuggucuggguuuauaaagagcuccuaucuggugguuugccuugcagcaaguguuuauucucaauacuacaaagcaaggcuucacaggacaggaugagggaaagcuccaacaugauuaacugauggccuggcuuggugugucuuccuuuccuccccuaggcaaggacucagcacuaggcucguuucaccuuaagacaagcuuagauggaguucaacagaaauccaaacaacauaaucaucaaacccuuacuuaucaaagucuuacauuuuuguauccucuaagagauuuuuguugaaacuucuacaguauaucauauuuccaaccaacuuacaacugccuccuuccugaccauccuccccucuccacugucccuugcaugauccccaaaacaaggcgaugcuugagguccaguacagaauauuccugggcguucauuggucagcuaucacccagcauguacaccccauugcauguacuuucaugcucaaaaucugaagaggaauccauucucaaagacacaacaauguauuucaagagccagcuguacaugccuccaguaguugggagguggagccaagagaaucaagaguuuaaggucauccuuggcuacaucacaaacucaagacucacguggauggaccuacaugaagucuuuucuuaaaauugaaaaauuccaauucagaaaggaugaguucaggagcuggaguaauggaucagguguuacuuuuucagaaccugaguuacaucuccagcacccacaaguugguuuauuguuuguaaugcuaggucauggaaucuaaugcccucuaauggccucugcaggcaccagacaugcacaugguacacagauauacauguaggcaaaacacccauauacagaaagagaagaaaaggcaggaaggggacaacuccagcaaccuuccaaaguuaaguugguguucuuccuacuacuugagagugccugcauacuuucuauggggucaaauguggcugggaugugccugugcucucuacaagguaagcccauggugguauaagcccaagaggcucagcaaagcuguucacagagcaaauucuucugggagaaguuauagggaugucccuaacccacaaccagugccuuauccugcuucacuuuacacagaagacagguuuccucuacauuuuaaaauuauguauuacuauguuauauguaaaugagugucuugccuguaugugcaccauguacaugcguggugucucuggagagcagaggggcauccaaucccuuugaacuggaguuacagacagcugugcucgagccaucaugugggcgcuaggaacugcacuuggaaccucuguaagaguagcaaguacucuuaacugcugagucauuucucuaggcccaacuccaacuuacuaacuauuaaacuaaaaaaagucuuaucaacauuagugacucucaaaaaucugaacaacgagcaaaaaaagaacaggucuuaaaggaguggaccauccuuaggaaccuguggagacuggauccaagauucccuagagacaucuaacucuagaauguuccugucccuuauaugaaggaggaggagaaagaaaauguggaagagcagaauuauuugcauaaaaccuagaaguaccccuccucaaacaauuaaaaugcuucuauaauuaucauguaaucaacuauuauacaauauuguguaggcuaccaugaugaggaaagguuucugugugcaauuuuucuugaguauuuucaauucaaaagguuaauuacaaacacuauaaauaucagacaaugaauuugucagaaccaugaucuugaauuuccuagucuucugggcuugaagauuuuuuuuuuuuuaauuuaaaaagaguggggggggggggaagcaguugaguauccauaguuaucuuucaaaccuauauggaauuuaauagauagaauuuacuguguacaauaagagcucaaaauagcaacaaaacauuacaagauucaaaacaauaguuccuguggaacaugagaagaaagcccagaacccuuuauggccgggaagagccagugggacucaguaugcacacagcgaucacagcagcuccagcacuguagagugcuggccggggcggccaggagcugguaccuucgucucccuccuaauaacugcagaggggagagaagaacaacagccuaaagcaacagcaugcugccccccaccccacuguaggaguaaucacacuucuguuugugacugaacuaaaauaguuuauuucuguauuucacaacuagggcuuuaauuaaagguauaaagacaacuuuucauucagcaaaugauuuuauagaagaauguauucgucuaaagguaaaaucaaaguccaguaucaaaaccaaggaauaucuuguauccagucuugcaaaagucacuuuaaaacacagaugacaaaguguccacacuuccuguacauaggagaaauuggguaaagugggucauaugcugugaagaugguaagauugccaauacaauuauuuuuaaaggcaauuucaaacuuaagaaacauuacguuuuacacauaaaaaguauaggaaaauggugaaguaacuuucaaaaugauggaacaaacuacacaaucuccccggaauggcucuuacucucuuacucuuccuucucugucccuucucuccucuuucccuucccccauuucucuccacguguccauggcuggucagucugucccuaccccccacuccaacuccccucuucaugaccuaaauaaaaaaaccucuauugcauacuuaaaaaccucccugcaaugccuugagaccugggguggggugggguggggggauagaacagggaaaacacaacagaccucaccuacucauaagccacgaccccauuuacgaugagauccagcucugagcgugagcagggcugagccaggcaaccuuagcgccuggggcaggagaggcucugaggacaagcaauguccgcaagcacaaucuccaacuuuugcuccccaacauaguaaaaaaaaaaaaaaaaaaucuagcuugguuuugcuguaccaagcaagauguuccacgugaauguuacaaagauaaagugagcuuucuuggucuguccuuaaaucucuuuauaggcuacgaauuaaagccuuaaagcuauuaaaaacaaguauaaguaaguugaacuagaguacuagcugcucuuacagaagacgcagguucaauuccuaccacccacaugguggcucacaaauuguccuaacuccaguuucagaggagaugacaaccauaagagcaggacuacugguacaggcacuggaguagccccuaagauaguauuucucaaucugugggcugugacccuuucacaggggguugcaugugagauauuugcauuacgauucacaacaguaacaacauuacaguuaugaaauagcaacaaaaaguaauuuuaugauugggggucaccacagcaugaggaacuguauuaaagggugguguaugaggaacguugagaaccacuguccgaagggaaggaagcuaacccaaaagguggggaccaaucucauggguaauaugguugucccuucccauaccaucaugggaaacccaagcuuacauccccacgugucugacacugagaaaaaguccuagaauggccuuaaacucccaguucuccugacuccacuuccuggaugauaaaguuagacaugcaccacucugccuggucccuuggguuacaaugucuauuauccuguuucuaugaccuuuuguaugauaacgucuuagaaaugaaagaugcaugaguagcucucaaaaauuaaagaaaagauguggaaaugcucucuguaaccccagacaguaacaaaugaacaaaagucaaucuccuuccuuacagaugucugagcacaaggaaaacaagcaagcugaccaaggcuaguaaguucaaucaaugccaugauccuggcugugauggcaguuuuauaaaacaaaaaccauugguagagcugaacaguuaaguacagggagugcuaaaucauucuccaagugcaagcucggagucaaaauguacguguauaaauacacaugacuaucuaauguugacgcguuucauuucaauaacucuacagacuaugccaucaugauuauccuucuuuacagaugagaaaacugaaccaugggucuaugaaaaauauacagcaggucacacagucagucagugcuggaggggcugggacucaaauccagcuagauccagagacucccuuuuuucuggaaacucaauauuugcacaugaaagcuauucuuauggcuuuagggaguccacgagaacucggagaaacccuguauggccggaaguucucggacagaaauccacaggcaagugaguuuccuucccuuccugacaacacuagaguccaacaagcugugcugggucaugccuaggacugacccuggccuccuccuagagaagcaagacggucucagucuaaccccuccccuuucccacccacccuccugggaggauaaagaaguuaaaagaagaaaauuccucacacaccuuuaaauuuaauguuuccuucaccuaaagggaggaaaaaaaaaaaaggcaaaacuaaauguuucaauacaauucaaacucaagcuaaagaaagugacucagcgcagcccaagcaucuuacguggaggaagcuugcaagguuauggaagcuacaaaggacagcccagacaccacaaggucugaaucugcaccaagugucaaucaagaaauccaccacaaacuccuuccaaagcaacucucuaggcuggaaggaggaagaauaggaaaucucuccuccuuucugacacuucacucacacauucuaacaauaaagacauaaaaccaacuuuucagacagccuagagacggccacuaucacaaacucuucucaaaccuacacaaucccacagccguauaccuagcagagcuuugccuugguuccuucccaccgaagcucagguugaagcucaguuaacucacacagcaaugcuggggaaggagccugguacauuugugaaucacaaaggugcagcucucaggaauguagccaacagauccugacuucauagaguuagguccccuuuuaguccuuuucccccaccacgugaaucuguacacuuccucuugucccagcagcgugggcccuacaucaaaagccagaggcugaggcaaugaucuaggacuuucagaacuguaagcacaaauacaugucuccuugaucauuugcccacguguguuuucuuugcuguucacugccaacuucauuacuucuugaguagugucguggguauaguaacguggcaagaguccaugcugggguuguucccggugucaaugugaggagcuguuccguguguugggcacagccucuuccaucagacaggaaauaguaccaugcagagcucuguaaggacucucauuuuacaaagcgucauccgcagagcuccuuacaaauccccucucuuggugcuccagaaagacagauuaagaagcaauauaacaaaccacauaaggaagcacccacaggaaaacaaaaccuacuaccagugaggcuccauuaaaacuugaacaagggggcugaagagauggcucagugauaaaguggaaaacugacugcucuugcaaaggacccaaguuuacuaauuggcaccaacgugacgcgauuaacaacuaccuccaggguaaugucuagcuuccauagacauucacacacaucucacacaaauucacucacucacacacgcacgcgcgcgcgcgcgcgcacacacacacacacacacacacacacacacacauuuaaauauuuaaaaaaugauugaaaugaguaaauaaauaaucaaacaaaagcuugaaccucaguggacuaccuagcuagaaacuucauuuuggagaaagaaaugaaaaacugaagaauucaaagagaaaagcacauaccagagacaguacagaacccgaagaaaacuaacaaaaguuauaaaaugacuccagucaaguuacaagauacaaguuuguugccaucugcuaccaauucaaagaaaaauuaaagaaacagaugcuuauaucacagucacaaagaguaaaacagcaauaaagcaaaaaaaaaaaaaaagucugacuuaaauuucuugagaguagagaaagauggaaaaugguugguaugucuaaggaaauaggaguucuaaucuauaaacucugcuuaucccuaaaacaacuuuaaaauuuuaagauucuccuuuaugugacaaaacuauuuuccccuuuaaaaaaagauccuuugggggcuagagagaugguucaggacuaagagcacauguuacucuugcaaaggaccugaguucagauccuagcacccacaccaggaauaaaggcaagguggucucguguauaacuaugcauacuacgugucugcauucauugugcuuacuacaacggacuugguuacugacacacccaaaguauggagcacucagguaccaggaaaacuugagagcaagcuggugaguggcagguccucauaucugccacgaggucucucacacgacaucuuaaccggaguacccucuuccuccuccucguaagaaagcuccgaguguacgaguaaucugccuaaacucaaagcuuagcucugaaacaugcauguaacuagucacacaccaccucccauccacaccaggcuccccugaaaucucucccaguuuccuucaggugugugcuucaucuccucuccuacaugaucuucugaacuaugucccauugccaccguucugcuuagcaaccucaucagcuacugugauccaaccaugcugcuuaacuccgcucugaauaacuauguccauguccagcacugucaacgcaugcuucccauccuccucgcauacacaccacacgugagugugggcacacugcucuauccagccucuucuuuuccugaacuuccugucugugcaauccuacaagccagaagccaacagcugugccuucuuacugccaaaagugagauuguaaaaccugccaauucuauugcaaggaaaagaaauuuaaaaaaaaaaaaaaaaaaaaaaaaacuuuccuacuucuaccauuacuacccuaauuucuaacucucaguaaaaucaauauuuacucaccuacauuaucauaacuuaguucuccgccuucaaccacacacccaaucaauuuauccuccauacugcuuagaagugacucuaccacaucuaacacucaucuauaccauauauccaucuggccuauaaaacaggucacuggacuaacaaggacuauauuuugguuuucaaauuucacgaccacaaugagaagaaagaguacauuaugcagaacuagauaaacacacaugugagcaaugccaugguggcacacccuauaaaucccaggacuuggaagccggggcaggaagauccagagcgacaucaaccugcauuauauggcaggacccuaagauucaagcagaggaagggucaaagagaagagaaagaggguagaggaagagaauaaauauuaucuaagcauaucuguauaccuucgugaaaauguuacaaugaaacccauuauuuuguacaaauaauauauuaauauuuuuaaucuuuuuuauuagauauuuucuuuauuuacauuucaaaugcuaucccaaaaguucccuauaaccuccccccgcccugcuccccuacgcacccacucccaccucuuggcccuggcauuccccuguacugggacauauaaaauuuguaagaccaaggggccucucuucccaaugauggccaacuaggccaucuucugcuauauaugcagcuagagacacgagcucuggggguacugguuaguucauauuguuguuccaccuauaggauugcagaccccuacagcuccuuggguacuuuaaaaauauggaacgcuucacaaauuugcgcgucauccuugcacaggggccaugcuaaucuucucuguaucguuccaauuuuaguauaugugcugccaaagcgagcacuauauuaauauuuuuuaaagauaucacaagguuggacauagugagugugugccuuuaaucauaggaaacagaaguggguggaucuccuguaaguuuaagggcagccuggccugcacagccagcuccagagcagccagacaacacagaaagaccuuaccuaaagaacagaaugaaaaacacaaaggguucuauuccacucugcucaccuggcaaacuacugaucuuucaaaaucaaaacuaagucuugacuuacuuccaaaaggucuuugauauuuuuuaacaucucuaaaaggacauguagacuuuuuauuuuuaccuuacaucaccacaagagauaggagcugggcaauauaaccuggucaaguggaacgaaagaacgaacgaacacgaauacgcgcgcgcgcacucacgagcacacgcgucagaacaaggaaaugcaaguagcaaacucagcugacacauuaacaaguaauuauguaaacauuaccacggaaauuacaaucucuaucuauccagcacuuugcccuuuugguccauucaauuuacauucuuugaaauaugaaaguuugacugggaaugaauauagcuuacacaugaaauuaagaaaaaaaagggggcuagagagauggcuuagugguuaagaguaccgauugcuucaaaucccagcaaccacauggggggaaaaaagcuaaagaauaaaaaaagaagaauaagaaaagcaggaacuccuccaagcccuaucucaguagccuguaaagagaggcucugacucuagaacucuggccuuuggagggcggcaaacuccuuuccuccugcaugcaugaccuagcacaccaacacauucaccaccuccaacagcacaacaaccucucuaccgugauagcuuuaaaaaugcuuucuugcugggcagugguggcgcacgccuuuaaucccagcaguugggagguagaggcaggagaauuucugaguucgaggccagccuggucuacagagugaguuccaggacagccagggcuacacagagaaacccugucucaaaaaaaaaaaaaaaaaagaagaagaagaagaagaagaagaagaagaagaagaagaagaagaagaagaagaagaaagaagaagaagaaagaagaaggaggaggaggaagaggaagaagaaggaggaggaggaagaggaagaggaagaggaagaagaagaagaagaagaagaagaagaagaagaagaagaagaagaagaagaagaagaagaagaagaagaagaagaagcagcagcagcagcagcagcagcagcagcuuucuccuccugagacucaaaaagcauccggaauacauuacuucaaaacagaaauacacacuguucacuagucccaacucaagcaagaccagacucucagucagagccuccccacagaguguggugggccacgucuuuagugccagcacuugaggagcagaggaaggugcaccucuuggguuugaggccagccuggccauagugaguucuaggccagcuagaacuaccaugugagaccuuaucccaaucauuagaaaaaucaguaaauaaaagagugaaagugagucugacauaugcuuugacaaggagcuguaguuuggagagaagagacagacgccuuugccugaaaaguagcugcaucaaggcuagacuaguaacauuuaguucuuuucuuucaacagacauauaagaaugaacauggugugucauauacguauaauucaagacccucuacuuaaaccacugauuagucuuuccacucacuggauaucaacggcgacaaggagcuccacagaacaggcacuuaccuacuucagagaccgccauagcuucucucaacaugccucuuagcaagcccaccuccugacaucaguacauucuucucuguauggacugaggacugcaaagugaguucucaccuccccugaucuccccucuucacaaauaaaucuaauaaguaaacacuggcuuaguucuuccuucucccucuuccaaaauaaccuuguguaauaaucauguaauaaucaccuaagaaaauuuuucucuaaacugagaaaacucugcccccgcccgacaacacuguuggagaggacugguuugggggugggauuagcuuuuaaaugcaaagacccaacagcccuuccauacauauuccaaaacagaggucucauagaccccgcacuugcucugugggaugagaucaauaugacauguggcaagaccagucucuuacaggaacacgacacucaauuucaaacacaucaaggccugucagucaggaacaguggcuccucucuauaaucccugcccucaggaggcuaaggaagaaggaccugaaggcugaggccaaacugggcuacaaagugagaucucuucucaaacaaagccuucugaugccagucaccuaacagcucaugagcauccaaggacaagagcagcagagaacaaguaggagaaaugaaacugcggagauucugggagcugagcagacugguguccuaaagaauuuaugcugacuuauaagacugaauaacuggguaaaaccaacauugcccuaaaauauuaggcaagaaaagugaagcagggacccaugagacugugguuacucaguggugugguaauuaacuuucagaugucgucugcuaggaagccaggaauguagccaucaacacacauccacugucacuuuacucacagacuugaucauaacuggucagcauacagaauaaaggaugcauguguaugccaccugggugcagauacccaaauaagccagagaagaggauccguacuuggagcugagguuacaggcagcugugagauguccaaugugggugccaggggaacagcaaguugucugugcuccagaaugucucuuuuuuaaaaacuucuauuuauuuaauucaaaaugcuggcaaucaauguucuucaucucuaaacuuucacaauuucuagaaggacaauuuguacugguuuagugacuauguuaaaccauccauuagccuggaaggugauacuacgagcagaagguuuuguacauaguccugaagauccuccagcaauccugacauccccaggaaaaagacagguucuucaucaugaauaugaagcaaaauucucuuguuccaacauacggaugaaacucagaggaguaacaacaagaauggcaucaacuuccuaaaaagcgucccgagaggcugcaagagcuacagcauguaacagcacaaaaggcugaaggaagguaggcuccgagucaagcuguguguacacugggagcucaacccuucuuucuggccaugcauacagccccgucucagcuguuuauucagagugaagaagaaucuucugggcccaggaaaacaaguaaaaagugggucacacgcuugcuguacaagcacaaggaccugagcucugaucuauggcacucacuggccagucaagcuagccuacaguaaggcugcguucgacuccaggucuaggggaccugaagccuccuucugaccuccuugggcaccaagcaccuaagagguacacagacauauaaaacaauauuaacaaguaaacgacagaagccaggcaugguaaugcacauuuuguaccaugcuguggagacagaagcaaacucccagggaccaccgcucauccagacugacugacaagcuccaggucaaggggacuuagaggagagggaugugccucuggccuccgcaaacaucaacagguaauaaaaugugggaggggagagggagggagggaaggaucaaaccagguauuguuucacaaauacaaaccuaacacuuuagaguguugaggcaggagaacugccaaaaguucaaggccaaccugggcuacaccuugaacuaccagcucaggugacagaaaacaaaaaggcauccaaaaaaaaaaaaaaaaaaaccacacacacacacacacacaaacugcgaauaucaaccugcaagaauuuucacaacaggaaacuaaacuaaguuucuuugagggcagccccaaaauggaaagcggaaagcaagcacaguggcgcggggcagagcuggucccauccagaggcugagguaacagcacugagccuuggucuuaguaacaaaaucaagcacagggaagaggaagagagagaaauaaaaacugcacuucaguucaugcuaaacuaaaaccaacacaaagcccaucucgcaauagcaggucuuuccuuccaagaaacaaagaugacagaaaucuugugaugacaaagauaauucacuccaagucgaacuucuacaccuuucaaucuauuuuuuuaaaaaauggaaaaaaaaauacuuccugcucaucuccuucacacaugcuccuaagccagcagaucaaccuaccaaucccucuucucacuuuccucugaguauuuucucuccccucaccucuuccuucccuugucugguggacaagucacccuaaaucuugcaggccaaaucuaaucucuuugcugagagucccacugguggcucuaugacuagccugugcccacaggaacagugaagcaggaucccucccucccuggccucuaagcagacucuccugacugaccguccuagcaaccaggcugcagugugcugcuccucuggcaacgcuuccucuuugcuucucuaguuuaguaugacuuaaaugucaugaauaccagcuucuagugcuucacauuauaaugugguuaauuuccauacacaacacuguuggguagugaagucuggaaagccucuagcauuccuaguauucucauagguagacagaaaaauucccaauauacaaacaaagauauacagguccacugcauuucuauacaccagcgauaaucaauacaucuacuaaagucagauaaaugacaguauucaaggacagaggcuaaccaacuacugguauauagaauaaguuuacauacaacauugcacacacacacguagaaggaacuuggaaaugggccagcaagcacaacaauaagcaauuauacaaaaauuuuuaaaaauuauuuugggaauuaaaaaaaauugagaaaaggcuuuuuugcucccaagcugucuugucugucauuaugucaccucaccacagaaucaucauuuccagaggucuggccugaucauauacagugcauacagauguugcagcuacuucugggccccuaggaaaaccucucugaccucuucagguuugcuguggccgagaccaggcuuugaaagguggaugaugcagugauucaggaggagaaacagacuugccccaacaucagcccuaaacaucagccugguuucuggcugaaccaaguuccacagaugagacuuuuaugaacuuggcccaaggacuauguagaaucuauaagauuggucauauugaaaaguuaaaguguuauuuuucuaggcuaagggcugugaguauagcaucugaggucaaaaccaaacaccagccucgguacuacaaaguccuuaaacccaauuucuaagcgccaggugugguagcccagacuuuaaucccagcagucaggaagcaaagacaagcaucucugaguuccggaacagucaggacuauacagagaaaccuugucucaaaaaaauacaauaaaaacaaucaaagaagaaugacauucuaccuuugaggccuuuagaccucuagagaccuucagagguagaggguguguguguguguguguguguguguguguguguguguguguguguguguaaagaugguaaaaacgccaaauuuacaaaggccuaagaagucaucuuauuguggucuugauuugagaagaaaucuacuucuuuuuuucuuccuuuuuuugggggagaguggaggaugaggguguggggggugagggugugggggugaggggaguauacuguaggaauggggagugcagucucucacucuguaggccagacuggccucagacucccugagaucugccugccucugccucccaagugcugggauuaaaggcaggcaacaccaccaaggcauaagagauuuuuaagacaugauccacaaucugaaagaccaugcaaagaaccuagaaaaucuucuaaaucaaaggacccgauugccaguuaucaauguuaacggcuuccugcuugcuuccccuuuaaggauuaaagauuuacuucaguucacagcuuuaagaggguuauaguccaccacagcaggaagacauggcauaucugcucaguacaggguaagaucaacgugucagagguugccaaagcagaaccaacugcaugcauucuacuuaucucaaagguaaugagcacaguggacaguuauggcuaucacaagggcaugacucauggugaucaaaacucaaguguaagccaggcacagccauacaccugucaccugagcacacaggaggaagaggcaggaggacuaaauguugagguagugaugguguuuuaaaagcaauuauauauccaacuaugauaaaguuuguuuuccucccaacaccauaaaagcucuaguagauuacaucuuuauuaauaaacaggaagguuuuggugggagauaccgguuugguuugauguccuuuugcuuuguuuuuucagacagccucauuauguagccucauuauguacuggcuucaaacucacggcuuagccacccauccacacaaaggggugagcaggugacacauagugccagagaccaccauaccgaaacacucgcucagcuucagacucacaggacugagcagauccacaccacaagcagcagcacugcaaacuauauaaagcuguucuagacugaacccugcaaagucuuaaaaucuuuaacaauguuuccauuccaaauugccaagcguaaucccgcuaagagcugaacucaacacggacaagacacaccacaguaugaacagcaucgucaccacugcaugaacuucaaggauauccacuuuuuuugagacaggguuucucuguguagcccuggcuguccuggaacucacucuguagaccaggcuggccucaagcucagagauccgccugccucugccucccaagugcugcugggauucuugggaaccaggucacagccuacuguuuaaccccccacagucuaugacuuacucccaucaagacaaacacagacauagagcaaaguaugacauuuuaggauuaugccaaaacacagaauguagacccaugcccacauccuguccggaaguuaagaagacaaugggaugagucauaagcugccuccagaggaauccacugugcugcuguuaaacaacacacagcuuacauauauuaggaugaagugggaaugcucccauuaugccagggacaaacaacuuuaaaaaaccgucauauaauuacuuggaaaaauucaagcuacaaaaguucccacaaucuaugacaggguccugguuaggcucuagaagcuacccaagccucacagcaggccuacacagaugagaacucaccuuucuccagacuuuccagacccaagaaaaacaggacgaauggagagacagucuguaucucugucugugucugucugucugucugcccccccacccagccuacaauguagaauuagcucaccaguuaagagagacaagcuuccuccaaaggaaucuacuuugcuguuauuaaacaauaagcaccuuacacacauuaauaugaaguaaaaaugcuccuauaaugccagggucaaacaacaguacaacuuuuuuuuaaaaugucauaugccacaucuaauucauacauauuuuuguuuuaagaucuugaaaguacaauagcagaauauauucuacuacccaguaauuagaguaagagcacugaaaacguauuucagauauacaagccuaaagcuaugaaauuuaaauauaauuaaacagugaucacagguaagcaaaucaagaggcuaaccaaugaugcuuacuaccuaaaaagguauuuuacuauagugucuuugugaaagacuuuucuggaaucauucaagaccuuagacuaacaguguauuuaucagaauuuaucaaaauaauuuacuauaauguaaacuucaaguucagucuagaagguaacgaucuuuguacugggagcagaauccuguacacaauuaagacugacaguguauucacaagauuuuuucaauaugaguuauuauaaaguagggguuggcgcuauggcugaguagguuaagaacacuuguucugcaagcgugguuugaauagguuugcccucccccuccccauucauguguuugaauguuugguccuugugguguggcauuagggaguguggccuuguugggaggagugugucacugugagggugggcuuuaaggucuccuccuaugcucaggcugcacccaguacauacagucuccuccuaguugccuucugaucaagauguagaacucucagcuccuucuccagcaccaugucugccugcaugcugucaugcuuccugccauaauaauggacuaaaccuccaaaacuguaagccagcccaaauuaaauguucuccuuucuaagagcuaccuugcucauggugccucuucacugcaauaaaacccuuagagcugggcaugcaugaguaugcguguaacccgagcacugaagcagagacaaguagaucacaagagccugcuggucaaacaaccuagccaggguggugagcuuccaauccagcacgagacccugucuccaggcagaaaacaaggaaggaagaagacacucaacguccugcucugaccgccaugugccuacacaaucauguccaugcaaaauccacacaugugcucaccugugcaaguguuacaguuagaauaucccagaaauacacauucuuuaaaaguaauaaacacuaagagcuggagguggcucaucagcuaaagcaauugucccaaaagcuugauugccagaaucuacauaaaagccagccgcagcagccuaaguaucagugaucccuguacuccuacaggaaauggaagggguagacacuaggagcuuuagcucauaggccagcugaacuggcuuaugcuaugguuuucaaaccauagaaaguugaggcaggacacuaagaguauccucugacuuccacacaagggccaugucacucucacaaauagaauaaauauggaucaccaauuuaagaagaguuaggucuaaccucucaugaaauacaacuuacaggccaaagagcauaggagugugaaagagcagaggcugcugaaggaaugagaagcagcagcagcacggcagguugcuggcgccuuuagauucaggcaagauggcaacccaagcauguuggugccuugaaaaagaucccaauuaaugucuguguucucaccaaggauucaguuccaauaguuagccauauucugagaggucuacagucaccacuagaaacuguuuggauaugauggagaggcagaaaagucuacaauguuucuuacagaccaccuccaaaaacccaggaucagaugaaaaggacaguggcucagcaguuccagagucagcaggcucaaccuuagaaaguucccagacagcugcacacuugaaacaucccgucugcauaaggaaugcucaggcugacccucugcuggcuggagggucuucacgcacaaaucacuucagacuccuuuucauagucuagcauucagagacuucuuaaaucacuuucaugaaccagugaauauccaagagcuuccuaccaugugugcuuccuaccauacauaauacacuugucaguccuuaacaucuaccucugaauuuucauggauuucugguucacaagauuauaacuauuuauacagaauauaauuuuuuuauuuguuuaaaaaaaaagccauggcugccagaagaccauuucacuuuuucuucccaaaccugaugcugagaaagaauauuuucuagauauguuucuguaagcacuuuucucuagacauaguuuuugucugucacugucugucucaauacuucaaaguuuuaagccaaaagaaaaaaaaauuuuaaacaaacuagacuguguaaggcagaaacuauuuuacacauucaagauucacucccaaaagaagcugcaagaggggcuggagauggcuuagugguuaagagcacuggcuguuccuccaaaggacccggguucaauuuucagcacccauauagcaacuccaguugcagagaauccgacuuucucuuguggcccucuaagggcaccaggcacauaugugaugcacacacaugcaaaaaguuacaaaagcuuuagagaggaagcuguugucccacaaagggcagaugcuaguuuaacccucuccugcccaccauccauccaccaggaacuccagagaacuagaacuaucacagaagagcucuggugcuucccugguaggagggaagucagucuuucuuaggcucgcucucuccuccaacccugcacuuauggucugcaauuccaaucucuacagcaaggcccuccuccccuaacugugcagcuaagaauaaaugucuuauugcaguacugccucugccuccuccauuacagauaaguacaaagguuucuucuaaggaagaaaaaaauuuaaugggaaacaucucaaauuaaacuuacuuagaaucaauacaacgauacauaggaacccagggcaccaguacccuacaaucagucaguccccaauucuccagaaaaccauuaucuucaccaaaaagacauaaacaccaccucacacccaccugucugccauacagggaaaagucucuaggcaauauuuuaaaagucuuuaaccagacuuguaaggacacauuuuugauaaaauacacaaauagauaaaauaugcaaaagucugaaauagcaaggcacauaaaaaaugagguuugcauggguaggguggugcaaaaaccacguagcugcagagaaauguccuugagucagaggcuggucccagauuauauuuauggugaagauaaccgugcaaaccagaacaacagugcagaagucaaacgcucgucugucacacucaagcacuugccuaucaucccagcacuggggaggccacacagcaugggaucuugcagugauuaauuuucaugacuagauuuaaaauacaggggaaagugcauuucgagaaagacugaacugagggaagacucacuuucaaaugggaagugugguauugugcaucuaagccccugccuaauugaauaaacagaaagcaagguuagcaccagcuucccucucucggcuccuuaacugagggcccaccucgaucagcuaccucccuucuuaaacaagaaaccaaaauaaacucuuccuuaaauugcuuccuaucauauauucugucacagaugagaaaaucaaguauacagaaaacaaguauguuaaaaaccaccuagcaucacaccuagccagagaagaucacccaagcuaaggucaaguauguggccucuaaggcacacaaacucaccauggcuagacaaaacuugggaagaucucaauuccuuugccaagaaauaugguauauaauuuuugugcuucugaauaaaaauagcaacaauacacaaacaguuaagugcugaucuuuucauuacaagcagaauaagcaauguuccauauugaaagcuuucacauugaaaagcaaugaacagaagauuuucuccccaaagugagcaggcuucugcgucuacacucuggguuggugauaauuucucccugaaugaaugcuuucaacagacugaaaacauugcacgaaguugcucgcccacauaucuuuucugggaagagcgaagaguaucgaauauucuucccuugggcucuauaaagugccacugggauuaguuggggguagggggagauaaauggugacaguggcugucaguauuauuagcaucuuaguaaccucugaggcuuagaccucggccuccccuggacuacaccaaacccaagcaacagagaaagaauaccaaaacccauugauugccauauuguuuuuccacugccccuucuucaacaguaauuauccugaaccauuuuaggucuggccaguguguggagcuacccaaacaauagaacaaauagaaaaacugggcuguugagauggcuuaguguguaagaacacuuacugccaaggcucaaggccugaaucuucauauuaauccauauguggauauuacauaugcacaaauuuccauguaugacacguguuauauucauacacacguuuacauaguacaacacacccuucacauucuucuacagguagaaaagaucuauguuaaaaucacucagggugacaugugauccccaauaacagacccagcuuaccuagucaugaaacugaaaugaagggcacgcagcauguucaaaaguagacaaggcagggacaacacuucacagggcagaccuccugguccucccauugucuuguacugucuauaggaccccugacacaggauuuguuuuugacuaaaagagacauuucucagagagacguuucacugaagagcauccugagauuguaaauauccauguguuugcaaaauguugucagaaaggccucuaaacaauuuaaaaaaauucucaccuuaucuucugcauucucuuaacaucccaucauagcuaccuagcuaacuugauaacuuggaaaucacaccauccaucuacaugauaugccacacaucacuuuuauuuaaaauccaaauaccuaugaaacucgcccagaaaucucuuaacuuauccuuuuuaaaccuaaauuuuuauauauaacacaggguaaguguaucagcacuuaugaaguauuuuuaacuaaauuaaauaaauaacuuuugccagcaguagugggguacaccuuuaaccccagcacucagaaggcagaggcaggcagaucucucugaauucaagaccagccugaucuacagagcuagaacauuacaaagaaacccugucuguuaaaaaaaaaaaaaaaaaaauuaaauccuuccauuacaguauuuuuuucuuuuugguuuuucgagacaggguuucucuguguagcccuggcuguccuggaacucacucuguagaccaggcuggccucgaauucagaaauccgccugccucugccucccaagugcuaggauuaaaggugugcgcucccauuacuguauuuuuauucaauguuuuaaccccugauuucugauaaacaacauuaaauaagauauugccaccuaagggcugaagaugggucuuaacuugguagcaagggcuggucuagaauucaagagaagaacuaagaauguccucaaacuccugauuuuccugagcacugaaauuauaaccuugcaccaccaugccaggcugguugccaccaccuuacuuuguuggcaggaucacaaaucaccccaaguaccuuucugucuuucucacaagagcucccucuauuccuagagcaggcagaaugaacaaaggugcccagaacggccacucacgugcucucagagacagucgggacuugaugcaaugugaucacauuaauaaaaauaucaccaucuuggaguuccuuuacaucuuagagauaacaagucaacaagagggggaaauuacaaucuuuaaacuauaccaaaauagcacuguccccaagaaguaccagaaaauuccaaagcgugcucaauucuacaauaaugaccaacugcccuaaaaccauaaaauagccaaacugcaucaaaaaaaauaaagucagacagaaagcacugaauuugguaaccauucacacuccccaguauugcuaacauaagucugcuuguagucuuaaguaccaaaggcauagaagucauagccagaauuaaaacaacaggaauggggcagggaaugaaaccccaaaggcuugggcugacccugggauucgaucucaccccacucuagucuuucaccuaaaacuucuuuauagggucucucugcuguaugcccugcuggacagaacugcaaaacaccucucuuaaccuggcaaugucaaaagcacugccauuuucuauaauauucaggcuucagaauccuccaagugagagggcaagaaucacagggccagagcuacugugaucuccugaaaguaccccagccuuuguccaugaacacuggcuagcuacauaccuuaacacauauucaccuccuuaaggcaugcuagacuuaagcgagcaggauccagcucugggguucaagcuaagugaugacaguggggugagccugggagacagcauggauaggcacaagucuguacagugcugugaccucugaaacuccaguacaggggaacacagaagaaucaacccaaguagcacccuguaucaagaaaaaagauccagugauggcuuagcagguaaaagcuacuccuaacccucacagcuucaauuaagaaucccgauuacccauggugaaguucacaaagcacacagcaaaacacaaaauguuuuuuaaaaaauuaauuuuguuccuaaugcuauccaggaaacuuguauauccuuucucagauuccaacugaauaucuagcuacucaaaauaggguagaaacacaacugaggaaggagucuuagaagaaaauauaagccuccgcauacaaauguauugacacguugacugggaaaaacaguagguaugguguguuucuauucccacucaaauaagaauuacauuuuaacauccaugcacacauacuuucacacaggcaucacaauaaugagaauccccuaauacagagcaaggggaaaauauaaagaggugaccuugucucacuaaaugcauacaagaacaaguguguauaaucccagcacucagagggagaggcaggaucauuauaaaccccaggugaggcugggcuacacgaaaauaugcacacacgcgcauucacauaaaaguuaauauuaauuauaaugaugauaauaauaggcuugggguauagaugauuuggcacaaugcucauugaacauguacagaaaaaccccagggaauguuagcuaacauacuccugucaccccagagguagacguaagaccacaaauucaaggucauccccagcucagcuacucaccugaacacugacugaugauaaauguguauacccuaagaacucaagucccuuccuaugauuuuuuauucucaaaagaucauacgauuuaaagcaacuugaaugugcacucccccaguuccuaccuuguucaaacugugccaacauuccaaacugcugaauucuacuucagcaaucacaaagaccagcaggggcaggaaaaugccucagagguuaaaagcauuggcugccccacuaguccucucagagucaauucccagcauucguauuguggcuuccaacaaucacuaaugccagucccagaagaucuaacgcccucuaucagccuccuucacaaacuguuaagccuggacuacucaauccagcgucuguagaaaacaguucuccugaaggccuccuccauagucuuagacacacacuuaaacauuagcuccaagucuacuacuacauacaacuucuucucagaaagaaaagaucacaagauaacuugcacaugccacauugugggcugaaucucaaaauccugugucagaugaagaccaagucaugaaaauucuaugcuuccaaaagggcaaugaaaaaaaucagcagaaucuauuuagaaaucagcaucuucagaauucggggaucuaauaaacgcuuacaaugaacaggaaucaacuaaugaagaagauaccaauuugagguggcagagcacuguuggaagucaccuuacaugcucaguguacacaccaugaaaaacaacagcaucaucaaagcagacagcagacaagagagcacaaauaaucauucucggccggguuugguaguccacgccuuuaaucccagcacucaggaggcagaggcaggcggauuucugaguuugaggccagccuggucuacagagugaguuccaggacagccagggcuacacagagaaacccugucucauaaaaaaacaaaaaaaacaaaaacaaaagaaucauucucaaauaauuguuauuguucuuuggaccugucuuaguaggaaggacauaugguauggccauuguagaaaaacaaucugacgauuacucaaaauauaagaacugccauccuacccagcaauuucacuccuaggagcacacccaaaagguguuuaaaugaaaacuuguacauagacuuccacagcagcaguacuauuucuaauagcuaagugucaaucaagauaaauaaacacaggcuggagagacagagaacuagguccugaguuuaauucccagcaacacaugguggcucacaaccaucuguaaugggaucugaugcccucuuuuggugugucugaagacagcgacaauguauucacauacauaaaagaaauaacuaaaucuuuaaaaaaagauaaacacacuugggaggcagaggcaggccuggucugguuucugaguucgaggccagccuggucuacagagugaguuacaggacagccagggcuacacagagaaacccugucucgaaaaaccaaaaaccaaaaauaaauaaauagauagauagauagauagauagauagauagauagauagauagauagauacaacuccauacaauauauaacuuugucauaagaaacauggugcacacagguuaaacccugaaaacacuaaccuaagcaaaacaagacaauacaaaaguccacagcuaugauucuguuugcccaaaauauaauaaauuuacaaauaaauaggguuuaugcuuauaaaaguuuaaagagaagcaagacugauaaaugaccauuucccuuuaggguauaaaaugcuaaaaauguacaaaugacaaaguauugucugcuuuaaaauggucccaucaggaggcuggagagcucccucaguuguuaaggagcacaaacugcucuucgagagaacccaaguucagugccuaaccccauggcagcucauaacugccuguaacuccugcucuacagacucaugcucucucccagcaucaggcgugugguguacagagacauaugcacaagcuaagcagcaauauacagagagcaaagucaugaauuuuguuaaaaauaaauaaacugaucacauuucaguuugcuuuuaauguuuauuuucauuucaaauuguguguaaguaugguguuugcaugugggcaugugcucauguaaaaaguguccucaaaggccaggaguucagauccucugggaccagaguuacauacagaugguugugaacuacauguguaugcugggaacaaaucuugagucuucuagaagaauaaaauacucuuaaccaucucaccaggcaccaugaauuauuuucaauuacuccacaaaaacaaugucagacacaagagacuauaacuugcauaacucuaguuaugggaaaguaugacacagccaaauuacccugaaaaagaacauagagcagguugccuggagcagaggagauguuaaaggguuuaaaaaaaaaaaaaaacaaaaucugugguaugauguaauguucucagucacuaguauucaucacauagcuaaagcaacugucuaaggcugaucacaccguuuguucuuauuaucugaaguauaucuauguaaaagucacuaaaaaauaaccacagagacaucaggaaauugugguuaacauaagcacacaaaacaggagccagaugggccgugugagccaauauacaacaagacuccacuucaagaugagcuauuccccaggaggcaccaggagccugaaagauuuuuguuguuguuguuguuuguuuuuguuuugggaggggggaugugcgguucgagacaagauuucucuguauagcccuggcuguccuggaauucagaaauccaccugccucugcauucugagugcugggcuuaaaggcgugcgccaccacugaccggcuggaagaugguuuuauauacagaaaccuacugcucuguccuuagaggggcaccucuaaggcaaggaaagaagacaguaaugcuuacgagagaaaguuuuuucuaaaggggggggaggaggaggaggaggaggaggaggaggagaggaaggaggagggaagaggaaggaggaggggaggggaggagaggagaggagaggaggggagggggaggagaggagaggggaggggagggggagggggaggaggggaggggagaggaggggaggggagggaaggggaggaggaagaggaggggagggggaggaggagaagaagaggaggaggagaagaaaggaaagaagaaagaaagaugaagaaaaagaaaaaaagaaaaagaaaaagaaaaaacuggcucuaugcccuaacaccagcaccacauuuucuuucucgaaaacacacucgguucuuguuuaacuucagcaguugauucagauaaugaagggguguaggugguuuuuuuaaaaagcauaucuucuuuccuuuaaagaauuuuuuuucggugcuuuuauuucauguaguuggaaaacuaagugcuauguucagggauauuccaguaucacaaaacucuuaaaaccaguucuuuguuccuuucuuucauggcaggggcuaauggagcccaggauggccaugaugaacugaaguccugcuucugccucucaagcgcuaggacuccagcugugagccacuauguccaacucaauagcauuccucaaacaaaauccaaacuucuucgaagcaagauuauaguguauccucuacacacuaaauauaccagcccucagaguucauccacuacaguaacuuucaaaauaaaaguuaaaaagaaaaaauuuagaaugguauuauuuauucccuguacuaugagaucaaaaccaucaccauaauacacuaagacuuguuuguuguuguuuuucucacuauguagacccaugugggcuggaacucauuauguagaaaaggcuguucuugaacucagauucaucaucuucucuucuuccaaaguaaugggauuaaaggcaugcaccacugacugcagcuacuaagacuuugacuccacuuagcucacaucuccaaggagauagaagugccagccccucagcagagauuagagcaguggcuccagacuguaacgugaggcaccuaauucuucaucaccacauaacuucaauuaaaauuaccacugcggggccaacaagguggcucagccggugaagaugcuugccaugccugaagucaauaaccagaacccacauaaaggugaaggucgagaaucagugacacacaauuguccucuauccucaacccggguguggggauaacacacaacaacacauaagauggcugacuuucccugguguggaggcacauaucuuuaaucccaguaucagagaggcagaagcaagcagaucagaguucgaggccagcuuugaucuauaaauugaguuuuccaguuuggcaaggaauacugucucaaaauaaaauaagauaaaauaaaauaacgccaacuuuaauugugacacaggaaccuguuaucuuuuucuacucugaaacaaaacaaacugcauaaaacacaacuguuuaagaagaaagcacuuaggacuggaaaaauagcucaacaguuaagaauacuuguugcucuugauugaagaggauccagguuugguucccaggacccacacagcugcuaacaaccaucuauaacuccuccucccucuucugacuuuaugcacacaugguacacuuacauucaugcaagcaaaauauucauacacauaaauaaaucuuuuuuuuuuuaaaucacaacuaaguaggggaugggccauggggaugaccgggaggaaggcagggagcagauauaaacugaguaagaaaacucauaaaaaauuuaaaagaaacaaacaaacaaacuagaccuaagauacaaaaggcaaauacuacagacaaaguucuguauuuccaagcuacagacugagcaugccaaaagguguuggggggagaggggaaugcacaaauacagcuuuccuuuuuuaaauuucuuuaauuauuguuuuuucaaaacagaguuuuucuauguagcccuggcuguccuggaauuuguucuguagacgaggcuggccucaaacucagagaaauccaccugcuucugcuuccuguguacugggauuaaaggccugcccacaaugccuggcuacaacuugcaugauaaacaugaagucaagaacauuagauuuugcagagaagaaggaggaggaggaggaggaggaggaggaggaggaggaggaggaggaagagacauaaauuuuggacccagaaagaaaaguuaacaucucuucucucaaucuacuggugaauaacaaaugaagaguuaccacuggguaucccagguacacuauuugagauuccagcacuugagagacagaggaagccugaucuaaaccaggaguucuaugacagccagaaguacauggugagacuuuggaaaaauuaggaaaagaggccuaggagcguaucucaauugggagaauguuugccuagcacgauguaaggccuagguucaacccccagagccccccauaacccagaccuggugaaacagagcucuauucccagugcuugggagguggaagcagaaggaccagaaacaaaaagaacaagugcccacagaggguaaaaagggugucaaaaaguuaucuggcucuggaguuccagaggauugucagccaccauguagguacuggauacucaacuccggucucugcaagaaaagcaagugcucucuaccacugagucaugucucuagucccauauaaaugcuagaugcagucuuuaaaaaaauaaugaauaaauaaaaaauaaaaauuagaaaauuucuuucaauagguaauggcagccagaccagaugcacagaccuauaauccaacuacuuaggagaccaagucaggagaauugcaaauucaaggccuguuggaacuacagagugaguucaaggccagucuagacaacuuacugaugaaaccuugccuuacaaugaaaaucugaaaaaacacaaaagauguacccaauaguagagcacuugccuagcgggcccuaggacuauucaucagaaggaaaaccggaagggguggggguggaggaguaacaaucauuucucccagagaggagucaucgccuauacugcugacgggugggggagccucaagacaaagacaggagaacugacuaauaaaucaggagaaaugaauuuacuugucgugaugugacacuuucaauuaaagcuuucauucaaaaaggaaggaggccagcaagcuggucgguagguaacacgaacucugguguucugccucccuccuguggucccaucagaccuacucugagaugggugguggcacgagguaucagaagaagucuggcagcucacccagcccauccauaggaauaaugagacucgucuuacaugguagaaguaaagaaccaaccuaagagcugacagcuguccucugaccuccacgcaugugucccauggcagcaagcaaaccugcacucacacauacaugaggaaugagaacaggacaguggcuggugugggccaggaguccagagcccacauacgggaggaguaaagaaacaacugcucugaccuucacaaauucaagugcauauacaaacacuaauaguaagaagcacauuuuaauugaaaauaaaaaagcagaacuagagaaacggcucagucaguaacaaguacuuuccaugcaggcauggauuucugaacucagcccacucauuuaaaagccaggugcagcugaaggagcgaaacccaaagaaucccaggaacuugccagccagauccuagucuggcucaguggugagccccagauccaauuacaggccgugucuccuguaaccacaucauacacccacaauacgcacacauacaccuaacacacacacacacacacacacacacacacacacacgggcuuuuuuaaagcaaagaaaaauaaacauguucugaaacaaaagcugaaggcauuuaucacuggaauguccuugagacauacugggcgggggguccuacaagauggcuauccagguaaagggugcugcaagccaggaccacacuggaggaucaaguuguccucugaccucuacacaaaggucaucacaaaauucuauccguaagcauuuuacuaagagacaugcacaaaaauaaauauauguaauaaaaauauuauuuuaaagagacuuuaaaggaagcccucagccagaaggaaaaugaaaguaggcugaaaucuggaugugcaaaagggaaugcagaagacuaacaauggagucaguuccugucacugccauugcaucccaagcuacauuggcuacuaucugaaccaugugguuauagguuaccuaacuucuucaagucaggguuuagaguaaauuaacuugugaaaugcacacaucaucuuagacuaaaacuguuaauacaaauucuagaagcauaaaacuacacuuugaggaaacuauuaaaccaaguaagugauuacaaaaacacugacguggcuugugauauaguccuccagacacugacaggcaauccuuuuuuaggaguaacuagcacaaaugacauggguggcucagugauugaauucuugcccacccuggccccugcagaguccagucccuuugccaggugguagugacacacacuucuaaucacagcacucaggcaaaggcaggcagaucucugaguuccagggagcaucgugguaaacagaaggaguuccaagagagccaaagcuacagaguggggcgggggacccugcacuucuccuucaagucuaaguaacagacagauagacuugugaucccaucuacucaagaggcucaguaagaagaacgaaguccacggccagucucugcaacuuucaugugcaagccucaaauaaaauaauaaagcuguaugauaaaacaugccugcaauccccguuccaaaugcccaagcuagcuuuauuccuauaaccaguuccacuacgacacuaaguuuagagucuagggcucucaucugagccucauugcccuuauguuccacuacgacacuaagucuagagucucuuauuacccuuauuaacuuuccuccucgaucaugggugaugcacucauggaguacacagcaacaggccugcccagcacauagguaauuacauuucugguugucacagcaauauuuuacaaguuccuuaacuagccagaacuggcucaauuaugaauacuucaucucagcauacuuaguaauucuaaggccaacgauuuuauguggaagagacuuugggcugauuuuaauacacaucaagacaauuacuacauuuccugcucccacagcuuuccauguaagagaaggcagcuuccuucuauacagaucaaaacuccacagggagauagaugcucccuauucgauucuguuuacaagccaaagaaagaccaagcaugucucagauauaacacaacuuuuaaaaagaaucugucuaucugccuauaccuauacuugaaaagaagaugacaguaggagccaguaccugaccagagucaggccccuaaacuacaaaaugugaauauaaaguggacaaagaacauaaugugaaaacaacuauaucccaaauuaaacauuagaaagaagagcaccaguuguggcacacagugugguagaagacgcucaagaggcagucaggaaagaaagaaaaaaaaaaaaaucacacaucuuaaggcuagccuugguuauauaggcgcucuaggacagccauggcacucagugagaccuuacuccaaaaacaggaaagaaguaaagucaccauugucaaagagcuaccagaaagugucagggacaaaccuucagcaaacccaagccauuccauuucaccaaugugacaagagucugagaucuuauuuggggcccuaaggucaaauauauucuaaaaaauaaaauaacagucuauuaucuaggaagaguuuacaucuguauguuaacugaaacaaaauguuuuugugauucgagcucuuccagaggaccuggauucaacucccugcagccucauggcagcucaacugucuguaaccccaccuccacacccucucuggcuucuaggggcaccaggcaugcaugugguacacagacacacgugugagcaaaacaccagguagauuaaauuuuuuuaauuaauuaaaaagagaacaauuugugacagauaaaaauuacauugauuucuuuugagacagugucuccuguaguccaugcuggccucaaacucaguguguaacccuugcaauucugauccuccugccucuacagaauuccaaggaccacacccaguuuaugugauguuggaaaucaaacccagaguuuuuacauuauaggcaaccacauucuuaacuacuaagacguauccacagcuccaaaacuguaauuucaguguuaacaaaacuugacugacagguaucaggcucauuuagcacaucugugcucauuuucugcaacaagaacagagcugaagggcugcaaacaaagccucaacuacucacucucuggcucuuuguagaacacuugagagugaguaggaagccauauuaaagggaaggguaaagcuaacaaaaaguggugaaacaaaacccuaaaaggucuaucaauaaauaauaaaccaaacuauaaauucucucuuuucaacacaaaacaccacaugauauagaauauaaaucagcaaacauuuguuaaugacaguggaucugugacuagucagacacaccuccugggcccuuccaaccacaggggacuucuggccuaaccuguagacaaaaccugcuuugcuaguacuauaccacugaaagaaagaaaaagaaaaaacucccucuucuaauguccugugagcacaguacucagacccaucacaccagaucuuccgucucucuacucacuguucaaauaccaacacggcgaucgcaaagggggcaagagaguaaguacgcaauacauuggcauaacuucagagggauaaaggaaagaugcaucaggagccagguuguggcacuucuuucuaaucucagcaacuaggggguugaggcaagaccagagauuccaggcuagccuuggcugcacaugaguuccaggcuagccuaggcugcacaugaguuccagaccauaaauagggugcuacaaaauaaaaccuugccuuuaaaacauaaaaauaaagucaggucaaagucaacuaagaaguuguaccaggcuuuuagaaaauuaacugcaagcuaucuauugccauuuuagagaugauggcggacagaagugggaggggaggggaggagaggggaggcaaaaaaaaaaaguccauccguguuucacagguccuuugcuuuaugugucuuggcuuucuguuuguucguuguuuguauuugacaguaugaagccaaggacaauuucugauccaugaugagugaguguugggauggcaaguguguaccaacacuacaccuaguuuaugcuaaacugaaccuaggacucauguaugcuaggugagcaguauguggaccagcaaguuuacuauuugaauguuuuaagacucauguagcuaauuuaaaacugaagugaccuuaggccuugcuuggugacucgugccuuuggucaguccucacagccagccuuggguacucacucacuaagucccagucucaaaaacugggcaagaaccucaauacuagggacuaagcuucacuggcuaucuaucagaccaacagaugguuacucacccaagguuuuuauuauacuguauacaguucaagaaacuaagauauauagagguuaguacacagucccuuauaacaaaggcaaaauuucaguuauguguggcuguacgaaugagacuaaggccacgguacaaacuccuguccaccuauccugcaauaugacugcuacuccuccauucgagguacaagaaaagagugcauuucacaccucuuaauaaaagcugagcugacuugaaccaguaaaaugagaucagaaggaagcccugaagcuccagauuuccaaaugcccugcugcucgugggggcgcagaggaauaguauucuacucaauuuccaacgaggaaccaugcuacauuaccagcaaaccuggaaacaugcuaggucagcaauguaucauuauuuaguggcucuuccuuauuuuggaggcagaguaucacaauucggcuccagcuagccugggauucccuuuauaaacuaagcuggcccacaacucacugagaucuaugagaauuuugguuucuuuuuaaaaacauaaauaguauggggauguuuucacuuaaacucaggugugggauaugggacugcuucagauuacccaaagcaguguagugugauuugccucaugcucuagcagauaguucugcaauugugugauacuuggaauucuggggacuucucagggguuauauaaaugcuagggccccaguucgaguggguugcugauuguugcuguuggucucgguauguuaaguagucuugugcaaagaagaaaagaauaagauauccugacggcaaagaucaaacuugccccaaucagcaggaaguagucuaauaauaaacuaucuaguacgaggaguaggagguugaaagggucaaaaaaagaagugaagaagaguggaagaagaaggacccacaaaguagcaaaugcuggcuacagagauccacaggccucuacuuccaaagugcugggauuaaaggcaagagucacaacaggcccaccuggguuuucaaauucugcguggugucacaccucuguaauccuaucaccugggaaguacaggcaguuuaagauucuaccuccaaggaccguugaggaggcucaguaguuaagaauacuucugggaggcagaggcaggcagauuucugaguucaggaacagccuggucuacagagugaguuccaggacagccagggcugcacagagaaacccugucucgaaacaaaaaaaaaacaaaaaccaaagccucagauauccacagccaugacugcaaagaacugcaccagguuuugagcaacacauucauaccaaaagaugggaaauaaaagguacucaaauuacaaagggagagguaaaauugauaguccuuuauaucuacauaucgaucaagugaaggccaggcaaaggagcaguggaccucugucccuacagcauucaugaugcagagauacaaggaucuggaguucaagaccaaccugaacuacacgguuagaagggguagggagggggucgggggagugagugacgacaugaaauguuuaaaguaccagcaagauaguugguaaggaugugugccuccaagacaauuacccuaacacacaugcuaggagagaaucaauucccacaagcugucuucugacuuccaggacugaaaaucaaugaaaagauacacacuauucaagggucguaagacucaaucuuagggugccuauuucaggcuggagagaagauuggugcuuaagagugccuacugcucuuacugaauaagcaaguuuaguuuccauuacccaagucaggcaaccuacaacugccuacaauuccagcucggagguuagaugcacuugcugcuguuggagaagauccagguucaguucacagcaccuacauggcagcucacaaccaccaguaacuacaguuccaaggacccaaaccuagccucuggacucagagcacuaagcccauauguggugcaugaauacacucuacacauucaugcacacauacaucaacauacauacuauacacacacacacacaagcaagcaaaacucauauacauaaaaucuguuuuaaaugagauggcucacuggaaaaauggcucuugcuggauggaguucagauaccaaaaccccacauagaaaccaggcaguggccacucccgaggcagagucaaggaaaaccuggguuaggcaagcaggcuaucuggcagaguuagcucauguuuaguaagaggcccugucucaauaaaguggagcccauacacaugcaaacacucauauacgcuuacauaaaauggacagcaucuugcaaaucaucaucaaagauugaaugucaucagagccaagggacuaaacugucaccaauuccacaaauuccugaaaagugcagugucguuguuugcuuuucaggcugaacugaggccaguguucaaauucuguguaagacaucauaaaguccuuuaugcuaacaaaaaaaugugccagaacuugacaaaaagcuagcagcuuaaacaaauuuggugguuuuaguggauuuaacucucauuuaagugaguuaaaaaugccccuccaauuugaaaaacaacauuucuacuagcaguauucuaaagaaaacuggaauucuggaaaguucgaauuaagguaaacaauuuuacaaauuauaaaaccuauuaacagugaaaaaucuguagcuuuguuuuucuuuuuuauauuuauuuuuuaauuguguauuugugugagucagacagacagacaagacagagacagaaacagacagucaggaaaaccuguaguaguccuucucucaucccagcacacaggcucuaggaaucuaaccuggccaccuggccuaggagaaggguguuaucacugauccuggcuucauucucacugugcuacaagagcuccucagcagaugucaagauuucuacaagauaguauuuugguauauuugcaacuccaucucagucagcauguuaccuacccauuuguaaaugcaaugcaaagaacugcaauuugauauuccacuuaaaggaaacacuuuggucauaucuauucaacuuuuaagguccuauauuucccgggaacaaauacccucugcuuuguaaucaugcaauggggcuucuggcaacaauguauccuucaaggaagaaacagaguaaaauuagaaccaaaacaucucguaagauuauuaagaacucccugggcggugguggugguggugcucgccuuuaaucccagcacuccggaggccgaggcaggcggauuucugaguucgaggccagccuggucuacagagugaguuccaggacagccaggacuacacagagaaaccaugucucgaaagugcccccccccccaaaauauuauuaggaacuugauacuuccauccagacauaccuguuugguugguugguugguuggcugguugguuuugguuucucugugcagcucuggcuauuuaagcucuguauagacuaggcuggccucaacucagaaauccaucugucuuugaaucccaagugcugggauuaaaaguguggaccaccacugccuggcuugacacacacugauuuaucaaacacaaaugucaauagcucauuaguuucacauuacccucuuuuaauuuuauaauuacaaaaugucuuaaaaaacaagucuuguuucuuuuuuuuuuuuuuuuuuuuaaggauauauuuuuaugaacugaacagaguucucagcaguuaacaugcacuggcugcucuuccgaggauccugguuucaugcaaagcaccugcaaggugacuuacaaccaucugucuguagcucuaggcccggagaauccuccucuugcuuuccugggcaccaagcacagaauugcacauacauacaggcuggcaaaacauucuuaaggucaaaaaaucauuuucaaagauguauuuguauuauuuuagcauguauggguguguguauuauuuuagcauguaugggugugugcauuuuagcauguauggguguguguauuauuuuagcauguauggguguguguauuacuuuagcauguauggguguguguguuacuuuagcauguauggguguauguguuauuuuagcauguauggguauguguauuauuuuagcauguauggguguguguauuauuuuagcauguauggguguguauauuauuuuagcauguauggguguguauauuauuuuagcauguauggguguguauauuauuuuagcauguauggguauguguauuauuuuagcauguauggguguguguauuauuuuaguauguauguguguguauauuauuuuaguauguauggguguguauauuauuuuagcacguauguguguguguuauuuuaguauguauggguguguauauuauuuuagcauguauggauguguguauuauuuuagcauguauggguguauuauuuuagcauguauggguguguauauuauuuuagcauguauggguauguguauuauuuuagcauguauggguguguauauuauuuuaguauguauggguguguagcuauacagcacauggguguauacacaaugacagcaaguaugggaagaugccagggagcuccgagcccgagccaacugaggugggugcugagaaccaaccuuggguugucuaagaacagcaagugcucuuaacugcugagccaucucccagacccaauuuauuuuuauguguauuguuaucuucguguauauguggaggccaaaagaguuugucagauccucuuaaacucgaguuacagauacuugugaacagugcugugaacuuaacccaggucaucagaaagagcagcuaguacucuuagccacugaguucucucucuccaauccauguugauuuucuuuauuacugaucaccuggaagcuguccaaugauauuaaaauuauuuuucccaacaaggcauugcuuaaucuugacugcuauguaagguauauuuuguguuuaucuguagcucuaaugagacagaacggggaaggaugaaguguguaucauaguccaucuuccuggugagccugacugaacugaccagcacuaaguuagugcacacuucugggugucuaugaggauguuuucagaaaaagaucguuaaugaagaaacccccacccugaauaugggcagcaccaacucaaaggcuuugaguagacuagaaaggaaaagguggacugucggcccacuggaguggacagucgugcagacgcuguucucccccggccucuuccucucucucaugcucuacccccaggccaccauaaaaugagcuucucugcucugccaacaccuccccuaccaugacagacugaaacugagagccaaaaccuuuacugucucaagguguuucagccaggcaaucugugacaacaaaaaacacaagaccgagagggaugauuaugaagggaucaaagggaaaucagaaguggggauaauauucauucuuguuuguuuuuugagaugcaggucucucugcauagcccuggguguccugaaacucacuggagacaaagcuggucuuaaacucaugggauaagaucugccucccaagugccaggauuaaagucaccauccccugcuaguauucauucuuuacugugaauuacaaagaggcaaaacuuuccaaacuguacauauguucauaaguauaguuucaauaauacuggaacaaaaagaaaaaccugguaagagaaaaaauagcaguaaccagacaucaaaauaggaagaaauaaauaaacauuaccauuuucguagugauuagcucauuucauuaccacaggcccgaacacacgcacacaugagaagacuuuaaaaguagauacaaaggacuggccucgaagcugagcuguuuaccuggcauguauaaacacgaguauucccuuagcaugcacaaaaccuggguccaauccaaagcacuucaucaucuggguaugguggcacacgccuggaggaaguaggccaggguguccucagcucauagcaagugugaggccaacaccagaggcguuaaaaaccuucucaaagaaaaacaauguagcaaauguguagccaauccucugagcuuacaaaugaguaagggucccagccuggaaguaagauugaaaugcuaucuacagauccugucugcagaaagggggcugaagggcauuuggccccccacaaaacacaaucaggaaagcaaaauuguguacaauaagguaaaaacauguuauucuaaggauagacugaaguaccccacuuaauaagguaaaaacauguuauucuaaggauagaaugaagugccccacuuaagaacagacagcuacaggugccacaugucacggaacuguaaaaacauacuaaccuaagaagacucacaaaagagaaaaguaaaauauucuccuccaagaaaucucaugaacgaaagcacagaaacuaaugcccuccuuccucuccacaggcucaacaaaaaaagcacgauucaaucucuacagagucacuaucuggaaauguuaacaacuuccuuugaacagcugcaugcaaaauguaaaagcaggcuaacuugaggcccuacaucaugaaaugaacucacacuccuaaaaaauucuaaucugaaaaagaugaguuucacaagacagcaagaauuacccacuuccugaaggagccuaaggggggggggggggaggguugucaagugcucgcccugagaaaaaccugcagcucacaaaaagcaaaggcugaaggugagaucugauucacuauccaacucaggaugauaccucagucacagggaacacagagggagaggggacaacaaaacagcuagggguaccugcugcuccuuuuuuuguuuuguuuuuguuuuuuuucuugagacaggguuucucuguguagcccuggcuguccuaaaacucacucuguagaccaggcucaaacucagaaaucuuuuuuuuuuucuauuuuaugugcaugguuauuuugccugccuguauguuugugcacaugugugucugguacccuaaaagacaggagaggacuucagguccucuagaauuagaguuauagggguguaugaguugcuaugugggugcuggaaucaaaucucaguccuuugagaaagagccaguguucuuaccugcugagcugccucuugaccccacacugcugccuugcagagaaccaaaguucaguucucagcacccauaacuggcaguucacaacacccauaccaggagcuacagcuccaggggaucugacaaccucuucuaacuuacaucaacaccaaccauacaaauguugcacauacauacauguuugcacucacauauacacaaaguuuuuuuaaaaaaagaaaaagaaaaaaagaaggccuuaggauggauggugggacacacuuaauggcagcacuuggaaggaggaggaaagccaaucucugaguucaagcccuugucaguagaacaagcuccaggccaaccagggcuccacagagagagggaaggaacacacauagccgccauguucuuucaaauacugcucucucuaguuaccagauucuauacccucucugguguacagcucaccacagcuaggaaugcagugacaggaaacacaccacaaacucauuuuaccaucacuuuuguaagcuguagucacuuucugcugaaagguaccuggguagaaagagugguauaaucagcaguguuuccaacuccccagacacagcguggcuuacauuacacaccgucaaggcuggcaaaagcugcucagucagccuccagcccugucggucaagcaccucuuaggaaagugcuccagaguggagauagcugagcuuggacagaugugcaauauggaaccacaauguuggguucugaauacaaaagcagaucacccauccuuuucugaggcucaagugucuauggacgcuggcaaauugaacacgcccagaauacaaaagccaaggaagguagccaagaacagaacacaaagaagcugugcauccuucaagcacucaacgagauuguaccuaugcuucugguucugcacagaaaugagagcgaccaacacaguaucucuaagcucaauacaaaauuaagagaccugagccuccauuaaauagaagagcuaucccaaacacagggaaauagaaagauguuccugcugagacucccagauaggaacuucugcucugucaacuucccacaagccaccuuucacugcugaaauuauuucuaaguaaaccuagagaugacuggaggcuuauaaaacugguuuuuacagaaagggcuggccucuuuggagucacacaauaaagccagcaaugacacaaggcuccugaaacuugaagcaauagaugcaguaagcaaacauuccagguccaauuaauggcuguguuguauaucuuuaaauguguaccaagaaggugacacauuuaucaauauucacgaagagcacguaagccgccuuguugucugcuguuuacccauacagugacacgcagaauccaguguaguaguacaugcuucauucccagcacgugaaaggcagauguaggacggccaugagcuuaaugccggccuggacacacuuguagacacuaucucaaaagggagcagagggccuagaauaucaaagaaagacauuagauaaaacacacaaaacagcaauuauuaccagaggacaaagaguaccaugaggcaagaaugauuaucuauccaccuggggccagaagucacaagcagacagagcuaaaccugaguucaggaagguucacuagucaguugagacccaaaggacaaagaaaaagugggagaagaaaaaagaccuagaaaagccacagccuucacuaagaaagggaaugaucaaaugagaucuuacauuuaauuaagaaaagccagcuuggugguauuuggaccaagguaaaggacaguuaagaauggaguagaggaagccgugcugugguggcgcacgccuuuaaucccaucacuugggaggcagaggcaguggauuucugaguucgagacccaacucuaucucgaaaaaccaaaaaaaaaggaaggagaagggggaggagaaggagaagaguggaguagggaagucaggcaauguaccugcaaccucaaauucagaagacaaagauauuaagugccaaguuggaggucaaccuggcuuacauagugaguucuagacuagcuugagauauauaaagagauccugacaagaaaggagagagggagagagggaauuggaggagggagggagguagauaaugggcaggagaaguggguaaaugauagaauccaaguacagagggcaggaaggcccaagaaacugagcaaacugauucuccuaccuguuugacuuucagagaaagccaaucugcuuccuagggguuggggagaaacacucagggcuacauuuccucaaucccuagacccuggucucaccggugacuucuccaacacuucuccagcacaaacacaggaggcaaauagcacaauucagaaugugaaacauagagguaaacauggcaagggcacuaacagugcagccagagugaccuuucccccgccauguggccaucuguuaggacucucucucucauccauacucaagaaacacuugaaguccacaugggagaauucagagaaaaaaguuuuaugcaagcagaaccccgggagucaaacagccacugggaacccagcaaugcaccacaugaugcuucucuggacaacgucccucaagugcagggcagcagcuggaccauuagaacaaggcacaggaaaugcuaauuuuucucccaagauuggaccagaacagcaaaguggcugcaauguuccucccaggacugcacugugugaguuaaagcucauucuuagcaaagagaauaaaagauugugcugcaggcuauacguaaacugcuguguugcaagcacacugguggcaaaaguacugaaaggcugaaaaagagucaaaagagaugcccacagggacagccaguaagaaaacaggaacuucaguccuacaaccaggagaugaauuugccagcaaccugagggagcuucagugcagccucucaugaaagccucuggugugaccugccagaccugggccaagugccugaaagaaugaggugcacucagccucucaacccacacagcugugugcucuuucaaacaaccgcauuuguaauucaucacacagcagcuaaaaacaaacagacccccacgcaacauauccuccugccaccuuccauacacaaacuacauuagcauagauggccaaaggggcaccagccaugcaggcacugguccaagggcagaaccugagagcacaguuugugcuuucaugaccuacugcucauccuaccaaaugucacuauaaacuaccccagaguuucaaacaauuacuauaguccaagaguuguucuuuuaauaaguuuaacacagugcagauuuacaaauuaaaauacgucaccagcuuuaacuuccaaaacauacauaauggcccaaaauucaucaacagaaauucaaaaaaacucuuaaaauuuaaagugcaguaauauggcugagcagguuaaagguguuugaccaccagaguucaaacucaagauggaagaacugauugcccaaauuugucuucugaccuccacauguguguacacacacacacacacacacacacacauacauacacacacuuauauacacaccauacacauacacacacacacacacacacacuuauauacacaccauacacaguaauaauaauaaaguaaaagcccagcagugguggaucacaccuuuaauugcagcacuugggaggcagaggcaggcggauuucugaguucgaggccagccuggacuacagagugaguuccaagacagccagggcuacacagagaaacccugucucaaaaacaagucaaucagagcacuguagggaugucucaguuguuaggagcacugacugcucuuccagaggaaccggguucaauucccagcacccacaggacaacacagaacuguuuguaauuccaguuccagggcuaucugacacagacauauaugcaggcaaaacaccaaugaccauaaaauaaaaauaaauuagaaaauaaauaaauaaaccuuugaaugagcauccaugaggauuucuaaaaaacaauauuaaaguuagccuuuaaacaagaauucaugcagaugaacucaacccuuacuaauuuucucucuccuuucuugaauagacacugaauaguacaccuggguaguacaggggggcaaauggcuuauugggaaacuucacaacuggggacuaauuuuacauguuauucaugaagucauuuuucaauagacucuccugauugcuuucucugcaggauuaucuuacagaagagaaaaaaccuacaacauucuugaauagccacuggagcuagacauacaaacuaacucccagguaagaagaaagccaugagcacuccacuggaggacaaagcugacaaacagcaccuagauaaggagagaaugugacuucucucuaauggagcagguucugauguucuugugaccgucaggugagauguucccucccucccuccagggaagugggaaguggaaaggcccacaacccagcacugcaucagcagucacuaacaccucagcuguuucuauagcaaccaggaagaaaacauaaaacucccagcuuuauauauuguucucuauuacaaugaaauauugaagucaggcaaggaauuuugacaaggaaccaaguagaccguaucuauaacauuaaugcuaauuuuuuauucaccacccacauggaacugauuuuaccuucaauucuaaaguaaaucauuauucacaucaggaauaugaaaauuacuuaugagcaauaaacauuucuaucuagaaaaaaaaucucgaagccaggcguggcagcacacagcaucaccccaaugccugggaagcggaggcgggaggaccagugcuccaaugccaguuccacagaauaaagacugagggcgcgaguuacacaagacuaggaguugguuuguucuuguuguucuuguuguuguugcugcuguugcuguuuuuaaagccgggcauagugucccaccauggguuuuaauuaauccaaucacuggagaaucagagagagguaggugggugaauccaugaguuugaggccagccuggucuacacagugaguccccggacagccaguuacauaaagcccuguuucaagagcaaaggaaaagaaaaaagaacuccaacucaguacuucaacuaaucacacaaacacauguacaaagaggcuggcaagauggcucagcaaggacauuuguaccuugaugucaacucccagagcacacauugugaaaggagagagcucacucuccccaguuguccucugaccuccacacacgagcuguggcauaugcacacccauacucaugcacacccauauucaugcauucauauucucuucuucugucaauaaaaaaacuguacaacacaaaucaaacccaaacacucuaugccauagccuuaauaauccacaagcaggauggucacucuuccucacacaggcagaaucacagcucuuacuacaagaauguuaguauuucuuacuauccucugguucuagacuauuuauagaacagaaaagugauugcuguguaacaauguaauucacaagccaacaggaaaaaaauacaaaccaaaaccuggcacaucaggagaggcaaauccaaccagcacaccugccucuaaccaguuggggcaggcaaguugcaacacuguccugacucagcuaggcguggcuccccagcccaguaguuacaaaagcacacacacaaagccuuuagggauaagucuccauaaaaggucuuuucacuggagcaacagugguuugguuccuaaguaaagaggcucuauguaccacugccuauaugaccagccacccaccagagcccaggccacagccaguaccaccaaaacacaaagcugcucuucucucccauccauuuggacuauccaagaaccacuuuucccuugcauccagacccacuucugaucuugagucuaagugcauuuacugguaguaaagcugacugaacucaaggauccuaugcacacuuaugcaaugcuuuauuucauguucccuucugccuuuucaggcacuguucuacacagaggcaaacccauucccuugauacacaugaauaucaggaacucaucagcacuuuuuaggcagagacagaagugcuaucaaauccaaguaaaacgcaauccccagccuugcaaaaccuuucacuuucagguuaccagguagucguggauuucaaacaucugacccacaaugaauucaagaaaagcagaacacacaggagauacauagagucuuuuaagcuggauuugaagaucuaguuccagggguucugucauuuucuagcuucuggggauaucuacacacauauaucaaauaaucauaaacacacaucauuuaaaaaaauaaaaauauaaaacugcccggcgagccagugcauucuuuuuuuuuuuuugggggggguuuuguuuugagacaggguuucucuguguagcccugccuguccuggaacucacucuguagaccaggcuggccucgaacucagaaauccaccugccucugccuccccagugcugggauuaaaggagugucccaccaccaccaggcuccaagacagguuuuuaaaaagcaauuacuguauaucuacaacucuguguguguuuguaugcacagaaaaaaaaaauccgucugcauacucuguaauuuaguaauuacuaauaaaaauauugacuaugaaaaccagaagugggaaaagauggcgggggggugagaaaccuguguuugaguggaguguacaugacccaacaagucaccgugugccuuaaggguggcugugaauguuccagaauguccagacugugugcaaaauacaugugugucucaaugggaaaaacaaacaaaaaagaaagaaaaaaagaaaaccagaaguaaauucucuaggauuuauagcaaguggauuuuugcucuuacguuauuuuuugugguacugggaacugaaucuggaaacuuacacaugcuaaacacuuaaguacucuaccaucaccccagccuagcaugcuuuuaccacagucuggaauucccuguagugucccgggccucuccuugcuccuuaagucugucugagucacuacaggagcugaggaguagaagucaugcucuuggcuccacauuaugcuggcauucaccuuacacuauuacaaagcaugugacaaacauucauaggccuguacagacuagaauauaagaugugguaaccugcugaaacacaugaggcuugaagaguggggguagcaggcagaagccucguccaucaacaucuacaaaguguuaggaaacaguaugagccaggguaugguagugcaugccacuacccagaacaugggaggcagaagagcucacaggcagccugagcuacagaccaaaauuccaggccaccuagggcuacaguguaagacccuuaucuccaaaaaaauguaaaaagacagacagacagacagagaagggagggaaagcuauaagaaggggauagaaacaaacaacagauggcuagggucagaacucaaugguugagcacuuaccugcuauauguaaggccccacguucaauucccaguaguacaaaaaggaaaaggaaaaaaaaggaaaaaagaagcaacaugauuuucuuuggucucaccauagucuuaugaacuuuuaaauaagaaaccaaaauaaggggcuggugagauggcucaguggguaagagcacccgacugcucuuccgaagguccaaaguucaaaucccagcaaccacaugguggcucacaaccaucuguaacaagaucugacucccucuucuggagugucugauaaaucuuuaaaaaaaaaaaaaaaaaaaaaaaaaaagaaaccaaaauaaaguaaaaaagcaccaaaaaauauuuuuccaauauuuuuauuacuaaaaggguaaaaaaaauaaauaaguaaaaguguguuuggcaagcaugagugcugcagccugacucuuguguuugcacugcacucuugcuguagcauuuaaaagcauauggccgccaucaaaaccucacuuuucagagcuagagagauagcucagcaacugguuaugcauaacaaccuaaagucaauccucaggauacacaagaugaaaacuaacuucugaaaguugaccucugaacucuauacaaacaagugagcaacgcuaaauguaacuuuuauaaguaauaaaaaaaaggaaaacacuuucuaaaaaauaccagcaaauuaacaauacucuaauaccuaguucauauauacauguacauacacacacacacacauauauguguacaagugaauguacuuaaugccaauaaacugaacacuuuuuuuuauaugugugacuaagacacaccagaggagagcauuagaucccauuacagaugguugugagccaccaugugguugcugggaauugaacucagguccucuggaagagcagucagugcucuuaauugcugcgccaucucuccagcccaacugaacaccuuuguuaaaaaaggguacaaagaguagcuggagggaacauucuaggcugucugagaaacaaccccgcuaacuguaucuaaagauccauuuucacugaaagacaggucuguacuuugggaaugaggaacuaguaugcuucaccaaggccaccaucaugcacucugcacuggaaauuugaccuugcugaaauguuagauugaugaagaaauuaugcagcaauaaaaccaacucaucaaucucugaccucaaaguacuuguguuuuuuagcuuuguuuguuuuucuuucuucaauuuuucagagugcuagugaugaacauaucuggauauaagagaaaguagguuacaauaaaaguucuugaaacagccgggcgugguggcgcacgccuuugaucccagcacucaggaggcagaggcaggcggauuucugaguucgaggccagccugggcuacacggagaaacccugucuuggaaaaaaaaaaaaaaaaaaguucuugaaacauuaaauagugcucacaaacauuaaaauuaaaccuaauacugcugcuugacaucuuuuguuuacuaaggcuuugaaauuaaaguuuuuaaaauaaaaaaaucuuguaacuuauuuuuuauuaaaaauuauuaauagacugauuuuguacuuccuguuuacaaggugaguuccuaaacagucuuccccuuuuuagcaaacaaaguccauccaggcagaagagagaggcagaagagggggcagaagagggggcagaagaggggacagaagaggggacagaagagggggcagaagagggggcagaagaggggacagaagaggggacagaagaggggacagaagagggggcagaagagggggcagaagagggggcagaagagggggcagaagagggggcagaagagagggcagaagaaggggcagaagagagggggcagaagagggggcagaagugggagaagaggaaucaggagaaggaaggagggaggcagaacaggcaggcauacauacaagcaccuccuugaaaucccagcacuuaagguucaaggccaaccucuaauacauaucaaguuaucaaauuccaaacuagacuaagguacaugaaaaccugucucaaaaagggaggaggggcccacaaagccccacaacaggacacaacaguuagagaacaugagaaacagucacacaggcaaguccuccagggacuucaggggggaccagaggaacauugugguuugggcuugggguuugugugagacuuguacagagaauggccuggaauaugcuaugcauucugggauggucuccaacucucaaucuuccugccugucucccuaaaacuuaggauuacagggccaucaccacccuguggucuuugaaacccagauucaaccaaggucugagaagugggaaugcacauacaagcuauaggcucuagcacacacccaaaugccagagugaagaggaaugcagaugaaaacuagaaggaaacuaaaaccauacuguaagacauccuauugcaaagaaaggaaauccuacucuccuaaugacaggacauuucuguaccacacuuggauacucucccccagcccaccuggguuaccccaaaauuccagaaagaaagucaccccaaaggaaucucccuccuaaacaaccucaaugucuuacaaaaacacgguacaaagguguccacugauggccaccaccacuguggaagagcucuucaccccacacuguccuucuaacuuccccacccuggugacaucacuuaaaacaacucuaaguucucccuguggcaaccacguuagaccucucauaaacaauucuuuguucuuauuaccauaacucuaacaucaaagaagcauauaacucaacaauagaagacgcuguuugguuuuugguuuuguuuuuuaacagaaagggucucagcccuguggugaauggcagcuguaaugcagcauuugaggaaaugguaagaacuggagcaagacuaaggacagccugggauguaugagaguucaaggccagccugaacuuugaggggaaacuguuggggaaaaacaagcaaaagcaaggacuggggguguagcucuggugauaguucugaccuagcaggcacgaagcccuagguucauuccgucuccagcgguauaaacuaggcauggaccugacagacugacaaccaugacagacuccugcagcccaagcacucgggaaaaucagaaacaaggcugccacugacuagcuacacacagagagugaggcuaguaugaaauacaguaagaccuugucucaaacauuguuaacuaucugucagacuuaaugcagcacacaccuuuaaucccagcacuagggaggcugagaccagccugguuccaguaccaggauugacaaagcuacacagagaaacccugucacaaaacaaauuaaauaagcuaaaggagccagaaagauggcucagagauuaagaguauuuauugcuuuugcagaggaccuggguucagaugaacacacguggugguucacaaccagguaucaggggauccgacauccucuucugacuuuuaggcaccagguacacauguggugcacauacauaaacgcaggcaaaacacuuauucccaaaaaaauaaaauaaauacaucuaaaaaaggccucacucuguagcccaaaguggucuagagucucccaagcacuggaaugaggugugugcuaccaaaccuggcacucagcagaacuaaaccuugaauacucaaaccauacaaaagcucuaguccagcugcauaagcacuaaacagccaugcagccuuugacaacuguauguacaguggauuccucugggucccccuuguucccagggcaacagucucaucacuggcaaguccccugaaaaccaguccucaaguuggcaguuaauugguucagaaaagggucacaucucuagaacauuaacugcuuuaccuacugcacagaucaaugaagucagauagaaaaacaucucaagcuuaaggacaacuuauauuaaaacugaagguuauuuuuaaaggccuaaaaaguuauuucccuagauuaaccagcccuggaugcuuucuauacagauuuuauugaucaacuguaaauccaagaacucaggaggcagaggcaggcugauuucugaguuccagaccaaccuagucuacagagugaauuccagggcagccaaggcuucaacagagaaauccugucuugaaaaaccaauuaacaaacaagcaagaauaaaauauacucagaaaccggaauuaguaucaggauagucauguuagugcaugccuauggcucacaaguucacggucucucugggcauuuuagguuaagacucuaauucaaaauaaaaggcugagccgggcgugauggcgcacgccuuugaucucagcgcuugggaggcagaggcaggcggauuucugaguuugaggccagccuggucuacagagugaguuccaggacagccagggauacacagagaaacccugucucaaaacaaaaacaaacaaacaaacaaaaauaaaaggcuggggauacauggcucaauacuaaagcaaaaaaccccaaaaguacuagaaaggaagaggaagaaggaauuaacacgagcaucaacuauucauagugagagacgucuacucugagucacaugcuaggcuugagucacaaugugaaugcggaaucugauccucaucaaugcguuucuguauuucucuuuuguuaaucacuggaagggggagagggcggcagagauaaggugcacaucuugcuaucagaggacaaaucugaagcagccaguucucuccuuccacccuguggagucgaggauuaaacucaggucaucaagguugcccgaaaagcccccgacccacugagccaucuaguucaugcugugugauugucuaucaccuccacauccuauuaagugacagcuacauccacaggaguacaugccacaggucacugguagccaccaaugacaaauauccacacagcaagucuacagaagugagaaagaauaugaguuccaggucuagcucuccaacaacucacuacaacaccuccgcacauagguuuuauuuacuggguuuuggggguggguauagagcauuuaaggaguugucuuacuauaaggcuggccccaaacuccuggcaucccugggauugccagcauagaccacuauauccaguuuggauuagucacuuuagcauaaaugugagcaggaaguaacacccacacaccagacuccauacaaaggaaacauaaaaaauuaaaaauuaauacaugggcuacaaaucucaccacucccauuucacacccacaaccuaccuucuaguuucccccauaaguaacagguuccauuuucaaaaguaaaguucaguaccacaauauuaaauauacaacucccugagucuguuauuuaaccuuccaugaguuuuaggucuuggacaccacuggccucagagucugcggauggaggcagguuggcucccuuucucuuaacagcccauggagaacugacuucagccccagcuacaaacacuucaaaaccaaacagcuuugauaggcccacuuguuuuuaaguuuuuuggucuuuuaauuucacucacugaaaacauaucccucaaaagcauucuugaacaagaaaaugagccagcauuguuuggguaaggcaccaaaaaaaaaaaaaaaaaaggccacaccaagcaggacagccugccucagggccuugucucuccaucccacuguaccacaguucugugugccaacagcaacaauccccugguccccuaaagagucaggacucaggauucugguccccuaaauccaucccaguccaguaagacagcagugcuagauuagcaacugugguagggaaauaaacaacaaaguaagcugugacacuguugaaaaggagacaguucugaaaaagcuuuccauaaaaaucaguaaagaccugagugugcaugcacagccuucggggugagugagugagcgugcacagccuucggggugagugagugugugcacagccuucgggaugagugagugcgugcucagccuucggggugagugagugugugcacagccuucagggugagugagugugugcacagccuucgggaugagugagugcgugcucagccuucggggugagugagugugugcacagccuucagggugaguagggugagugagugugugcacagccuucggggugagugagugagcgugcacagccuucggggugagugugugcacagccuucggggugagugagugugugcacagccuucagggugaguagggugagugagugugugcacagccuucggggugagugagugagcgugcacagccuucggggugagugagugugugcacagccuucgggggcaucuggcaccucugcagucaugccaagcugccauauuuagugcacugcccucuuacacucggaaagcuuacuuggacuuuuacagggaaaaagaaaaacccuguacauuuuuaaauguuuaaacugacucagcaguuaauacuugcuacucuugcagagaacuccgaguucaguuuucagcacccacaagaggcucgccaccagcccuaacuccaguaucaagggauccaauacccuuuucucaccuccuuggacaccagggacacacauccauacaugcaggaaaagccucagacucauaagguaaaauaauguuuuauuuuuaaaauaaaauauauacugcuggcccagcauaauagcucacgccuuuaaucccagcacuccacaaagaagcaagcaagccuggucuccaaaguggagacucugucucaaauauauauaauaauauugguguguguguguguguguguguguguguguguguguguguguacaagaaagaucauaaagauagcauacaauguaugcugcugucucuccuccugcccaccuaggagcugagucacccugggcccagcagucacugaggugucuacagcccagugaaccacagcuuguuucaaagcccuuacuuagccaggcaguugguggcgcaggccuuuaaucccagcacucgggaggcagaggcaggcggauuucugaguuccaggucagccuggucuucuacagagugaguuccaggacagccaggacggcacagagaaacccugucggggggggggggggggggggcccuuacuugguugcaaguggcaacagcacaugccuuugauuccaggcagagaaagguggauacacaugaguuugaggacagccuggucuacauacugaguuccagaccagcuacagcuacauagugagaagugucucugaaaagcacucuuacuuagcaagaugcaauccccuaagcaauguagccauaccagagagccaugaaguccuuuugguggagagggagaugagaaagcaaaaucgaacacagggcucaguacuauccagugucaaugcugcccaucaucuccuucccugugccucugcucaccuuuacccaucacugcagucacgcuaagggcucauugggguccugacaaaaacagccacugugagagcugcccgccacaccagacuccacagguaguucucacuuagcccugugccacaaaggacagcagauaaaaguucucaggggaagagcugcauccuacuagcccgagguaacucaaaaacacucacuauuaaauccugucuugaguaaauguauuaaauguuuguuagauaaaauauuauguccuacccaguauuaccauuuucucagacauauagaagcuucuguaaaggcagaugaccuucaaagaccaaucucuuucaguaaguauuaguuaccuauguacugacacaaauagaaagaaaauacagaaggcagaaaauaaaacuaaaccugaggugaauucaucauccaguucugaacacacacagggucucuacucuuccuuuauagggucucaggcuccugcaacuacugaaagccuaacucccucucaccugucuuggcuuacauuuuguacugacuuauuaaauaaaacuaugagagcaaauaccaaaagucucuuaacucccuaccaacugucugggacagaagagcuccuaauaugaacauuucugcugaaauacaugcaggcccugucugaccacuucgaggcuucucugaucugaaccugucacuuuccugaacacuguguccucucugaaguaagcugcccacaucucccucgaaaauguaaaccacaggacaccagagcuacccaaguccuuaugcagagucccguguggccuacaguaggcacaaaacaaacggcaccugauccuuuagcuuagguugaauaagaaaucaagguuacucgucaguuguacaggaguaacauggaguauacaguugggcccaaaaucaacaaacagugaauagcucacacaaaaaggguuugccacacaacccuaaugaccuuugaccuuaguagauucccuagaaccuacauuuggaggagaacugacucccaacucugaccuccccauccacgcaccucucacaaacgcacagaguaguaaagugacaggacagagaugagugcugcagacaugcuauagcuggcucuuaggauggaggacucuaaaccaucuggcaaaaaugaauauauagucuaaagagauguuuucacuaucaacguagugaaacaauagaccuuguggugguugaaaugugcuccugaguuugaacacucaguccucaguuggucaugcuguuuggggagggucuggaacguguaggucuaaccuugcuggaggaaguaugucacuaaagacuggcuuucagaaucuauaaucucacuggccccguuuucucccccaccccccaccuucuuauuguguguggauaaucucucugcucccugcuccugccauuaugccaugccuuagcugccauuauagacuaacuuucuggaaccauaggauaaaguaaaccuuuucuuccuuaaggaaggugaaucucugcaaguuugaggguagccuagucugcauagugagauccagggcagucagggcuuguagaagagacucaaaaaaaaaaaaaaaaaaaaaagaguuguguaagugaggcugggauguagcuuuaauucaucagcuggucaaguguuuuccuagcaugcaugggcccugaguucaauucccaguacugcauaaacuaggcaagguggugaauaccuauaaaacuagagccacagaaguggggauaggcaggaggauggaagaggucagggccaucuucaaucgcaguuugaagccagucugauauagacagagacaaugcuucaaaauacaaauaaacagaaaaaggcaaaaauagaggagggggccggggcacaccaggaguaacugcuuacccagcaugcucugaguccaacacacaauucaucccaccccauucucaaaaaaaaaaaaaaaaaaaaaaaaaaaaaaugugugauggcacaugccuuuagucccagcagucugaagagcaagacaugcaauaugaguuugaggccaaccuggucuacacaguuucaggacagucagggcucaaaaaaacaaagagaggaaguagguaccccagcugaagauauagcuaggaaguaaacagaacccuugccuagugaccacaaaccccacugcugagaaggggaaggauaaugcaaguuuaccagaagcaggaguaacuucuuuguauauaaaggcucucugcauguaaucucauuaauguuacuucugucuaaacuaauuaagcuguaagggaagguacagaccaauuaccuaagucucacaccaagggcuaaugagaugacucaaauggauaaaggugcuugccaucaugccuuaaguaucaauccccaggacccacagguuccucugaaguucacacauguacugcgauauacauacaccacacgacgggaggggaggggaggggaggggaggggaggggaagggaggggaggggaagggaggggaggggaggggaagggaggggaggggaggggaggggagggacugagugaagucuagugguacaggacuguaaccccauacucaggagacagaacugcaaaacccaaguccuggcacaaaaguuacccaaucuguguuuuguuuuguuuuaauuuuaaugucccaaaacuuuugaacccagaggcuagagagaugacugcacaccuuuaggaacacacacuuuucuccccaaggacuaagcucaaucucagcacacaugaagacagcucacuguucacaacacacacacaguuaacaaucaggggcccagaaccacaagcaaacaaacaaaaagcuuaucacuggcacauuaagcucuaaagggcauaagacagaaacaagcagaucuguggguucaaggccagccuggucuacaaaacaaguuucaagccagucagacccugucuuaagccacuucccacacuauauaccaaaaaagggaguaaggggaagaaaacauacaauccuucacaaaaaucuaaaaacuuaaaaucuaaaucaaucuugagguuguggaguaguaacaauacaaguuaucaauauauuuuucagucuccuaaaaguccaaguuucuucuguguaaccagaaagguuuccccccccccugcucugcauagccuuuagccauccaucuuagugacuuccuaugcauuaauagcaacaacuauucaacuaccaguacccacaugguggcucacaacugucuguaacaguagugccauagggucugguguguaaauguacauucagagaaaacacaaaaauaaaucuauauauaugcuguuuucuaccugcauguaagucucuguguaccaaguaggugccugguaccuagacacacaucuguggagggcccugaacuggcauuacagcugugagcuacuguguagggcuggaaucaaacucggguccuccacgagagcagcgaguauuuucacuuccaguaauaauuuuuuuuaaguuaauucuuucaaaacuguugcuuuggcgguuuuuuaggucuuauuuccuguucuacaggauguacaaaccacauuuagaaacauggugacgagggcuggggggcaacucaguggcagagcacuugcagagcacuacggggacucagaaagaaaggcaauggaaaacuacaaccuuuuccuuuuuguuucuuuucuuuuuuuccuuucucucucugucucccugucucucucucucucucucuuuuuuuuuuaaggcaguguuucucuggauaucugugguuguccuggaacucacccuguugacuaggccggcuucuaacuuagagauuccccuggcucugccuccuaagcacuguuauuaaaggugugcacccagcguaacuuuuauuaaaucaauuuuuacuuuuuguguauguauaccacuugugugucuggugcccuuggaggcaaucuccugacacugcaguuaacaauaccuguaagccaccaugcgaguccucugugagaacagccaagucucugaacuauugggccaucucuccaguccccaauguuaauaacuugcuaagacuaagcaauaaacuuccucaguauuucucuuccuguuucaggaggggaaaacgcagguguuugguguauuuuagaugaaaaucugcuaucacaguuauuaaacauuuacaaauuaaauuucaauuucacccuuuccuaacaagcaucagcuuuuggggaggaaauguggagugcagagguuagaacucuaucuaacugguucaaaccacagccaacuguucccuccucauacauagcccaaaugauuaaaccaaacaaccccagccuacuuaccaaagacaagaacucccagacaucauuuucuucucaaacuucuacccugucuuaguacacaucuguaaugcaagcauucagaaagcugcggcaagauaaucacaaguuugagaacagccuaauuauacagauacaagaucuuaaauaauaaaaaauuaaaaaaaaacaaaaacaaaaccaaaacucuuugccguugggugguggcggcgcacaccuuuuaaucccagcacuggggaugcagaggcaggugaauccuuugcguugcaagccagcuuggucuccagaccaaauuccaggacagccagggagggcuacauagagaaacccugucucggauggauggaaggauggaaggauggaaggauggaaggauggauggaaggaagguagguagguagguagguaaaauauuaaacauucucucaccacagugcguggaggagucaggauuugaugccagaacauggcaaacagguaagagaccucagagcuacaucccagacaaaaauuaaaauuuagaaaacauaggacuguaugcccagggguggaaugauggcuuugcaguuaagagcacuugcugcucuuacagaggacccaaguuuaguucccagcauccauguggugacuucuaacuguccaaauauauaacaugacacaccuucuucugacuuccauggccccaggaaugucagaaagugcacuuacauacaugcagacaaaaauguacauacagaugauagaaauaguuuaauuuuauauauacauauauggagcuacacuacacaaacacauacaaacugacuuaaggcuguacauggcagaauauaccuguaaucccaacauuccagaacuaaaggaucaggagccagaggccacccugagccauaugagaccuaguuucaaaaagaaagaaaacugaaggcuaugaggaaaaacaaaaacaugcaacugcacuuugguauauuucccucagaaaauaaaguagccucccgcuuccauaucugagucacgcccuaauccucagcuuaacacacuacaaagccaaguguguaugaaaacaaauggggaagcagccuaagagcauauaguacaauuucuagucagucaauuucccagaucaaaauuauucguauguucccauguauacaauuuaaacccgugguucucagccuuguuaauccugccuguaauacagccccucaugcuguggucacgggcugaaaacuacugcugcaaacaauuccacaacgacuucucgaaccaauucuguuacuguccuguaauacucggggcaaugugcugggucaauguuaccaguaaggucauucauucccuagcuucauuagggaaaagauaggaacaacagucaagcuaaguauuacauagcugauaaaaguuuauuuguguuaaguucuauguggcuguaacaaaguuggggggagauacuuugcuuaggagggccgauuaagaaauuucaguaacaacuagaccuaguaucucuccacuuguguaaauaagacagaaggauccaggggauucaagaauccuuggcuacgccgaguggugguagcgcucgccuuuaaucccagcacuugggaggcagaggcgggcggauuucugaguucgaggccagccuggucuacaaagugaguuccaggacagccagggcuacacagagaaacccugucucaggggaaagaaaaaaaaaaagaauccuuggcuacuacacaaauuuaauuuucaaaauaaaaagauaguccccaguuauguagucaguucaagcccagccugggcuguguaauaaagagccugcccagcugagcaguggcagcacaugucuuuaaucccaguuuugaguccagcguggacaaguuccaggacagccguagcuacacagagaaacccugugggaggagagaggaacccugucuuuagcaggagggcuaacagggcggggcuagggaucucaaucaagaagcugcuuccacagcuugcaaacagccccugaguaaacaagguguggcacuguaacagucacccuaguaguacccuacaagggaaagaucaaaaacccaaggucauucucugcuacacuuuaaagacuagugugauauacuuaagaucuugucaggggaggggaggggaggagaggggaggagaaagagaaaagaggguuagaaagauggcucagcaguaaagaacacaggccacuucuucuagaagaucaggguucaacucccagcacccagaggcagcucacaacuaucuaguucugguuccaaggaucugacacccccacacaguauaaugcaugcaggcaaaacaccagugcacauaaaauaauaaauaagucauuuuuauuuuaaaaacgaaaagaaaacgagcagggaaaggaggaggaaagaagcccccuaagaggagcugaacuaaaccgugcaggagauggcagagugaggcccaagugugcggcgcuuccgucagcacagcggcgaagccccaaguguacagccagauagccaaucuagaaaucaaaaggcacggucccuacugacaagaaucucaacagaggggcuggggugauguaauggcucaucaguuaagagcacucacugcacuggguggugguggcacacgccuuuaaucccagcacuugggaggcagaggcaggcggauuucugaguuccaggccagccuggucuacagagugaguuccaggacagccagggcuaaaacagagaaacccugccucgaaggaaaaaaaaaagcacucacugcucuucuagaggaccugaguucaaaucccagcaaccacaugguggcucacaaccaucuguaaagggaucugacgcccuuuucuggugugucugaagacaguaacaguguacucacguacauaaaauaaaucuuuaaaaaaaaaaaaaagaaucucgggcuggagagauggcgguuaagagcacugacugcucuuccagagguccugaguucaauucccagcaaccacaaaaccaucuguaaugggaucugaugcccucuucuggugugugucugaagacaacuaugauguacuccuauacauuaaauaaauaaauaaauaaauaaauacuauuuuuuuuuuaaaaaagaaucaucucaacagaaguuugucacagaaucagguugucuguuuuuuugcuguugcuggguuuguuuguuuguuuguuugugaggugguuguuaaaggcuuggguuuguugguugugggcuuuuuuucccuugaacauuuacauaucuaucuuguggcucugugccauucaaagcaugcaaaagucaaaggacaacuugagggaaucaguucuuguuaccguguaggacuuagggaucaaagucaggucaucaggcuuggcagcacgagagagcaaaugacuacaggaugagccauuucacaagcccuaguuuugguuuucugagacagaaucuugaguucacaacagccuauaacugcuauguagacaaccaugaccuugaacuccuucuccugacccaaccccucaagcacuaguauuguaagaauucaccagcucacaauaguaaauuugaugcuuaucauaaaaacaguauuuguaguucuaucauauuuuuuauuguuugagggcgcugguguucaggaaaccugggugguagugcauaccugcaacauccuagcauuggugaugaugagaggaagacuagaauuucaagguuauagucugcuaaauagaaguucaaggccagcaugggccacuugagacugucaaaaaaagaugguuuggguguguuuaaaaaugaacuacaagaaaaaaaugaacaggauaaauaauaauuuaaaaauacagaauagcaaaaacagcuuuguauuuaaauacaaagcugaauuucagucuagcguaagagguaccacaaauaucuaccaaacaaacaagccacuuaauaaaaauaucuauaggaauuaaugaaguagucauuaaaguggaucauuuucuaagccuaaaagauuuuccaugccaauuauccaacugccugaguuccggagcugaggacugacacucucuuucauauagcuuuaagacaaaacugaaaaagcugaauuggacagaaauuccauuugaaauucaaaugagaacacaaacugaaaacauuucaagacaauaacuccuagugaugugaguucauucgauuuuuguuuaaaguuaucaccagugccaugcuccgucuccgagcaccgccuaagcagcaguacuaagcggcccagugugcggguggacacgccacgcaucaucacugucaccuauuaacuagcaagugucucgcuauuacgaggagcucacccauuacacuugccaugugagggaugaagggacuuacaugggguaauggacagaucaaaacacuuauuuuggcaacaaaugcagauuauucucugaaccagcguuuacugaugcuuucuaauuauggcauuuaauugauggugggcucacugccaauaugcaaaacaacccuccucuuauaugugaugaacuuagguauccaaggcacacacacacacacacaaagcuucuagaaaaaaauguucuuacauacaugcagcauaguucaacucuacuuguagaaaguucuucuugucacugacccaacacugcauuauagcuaauaugacaggcacuagucaucagcagcccaucugguuuagugagaugaaagacugacagagcagcaggacugacauggcuaaccuagagaaaagcaucucacagaaacaugcagguucaaaggcugguagaaaguuagacuggucagagaggaauucuaaacuaggugacacuuuaagggaacuucuggcaaauuuugcuguguauuguuuaccacaggaggacaaagggaagacaagaaaaagaaacacuccuaaaagaaucaagcuaaggucaaauuuagcgguaucuuuuggguugcuuuucaaggaaugcacgaggcaagcacaaagaagagaaaaaugucauagcaacuuggccuuuguucccucccaucccauuccauucaggauggccagccuaucacgggagauccugcucuuaagcgugaaacuacagaaaggagaacaacagcugaauggagugugggggaggaaacaccagcuauauggagauccaauccaagggucacaaucaaaguuaagcaaggcauuuuuguuuuagguauagcugcaaagugacauuggaguauuugugcaaucauuucaaaagacacagacagaacucuagucuucagagcagcuagugcuccaaaaagaaauaaaggucucagggcaacaaguaccauucuccgagacucuaccauggaacuacccaaauuauaccacugacuaggacugcacacagcaaaacacaguaacuguuuccauagcuuucuccacaacccauuaucaccuacagucuuugcugaguuaagucuccuuaucccucauaggcaacccaacagccuaaguaaaauuuuacguacaaaugugcacuucuauucaguaguugaauggaagaacguguugaauggaaaguguucaaaggaccacagaaaacucaccaaauagguacaaaaaccaaauuuuucuaccggaaaauuuguaaaacugcccaguuuucucaaguggguguaaaacuucucacgacugcagaaaccacugugaaacaugagaacuauacacauguaacuagauuucggagcauacagccuuccugugaaccagcuuaaccuucaccagucuuccaaaccccagacgagcuuuccagaaacauaacaaaaacagaaaaaccuacaggagcaccagguaaagacaaggccuugagaaaaaaaaugagacuccacaccaagccacauacauaggaacugaaccgcacauccgucugugaaggggcuagauccauguggcagggccaacccugcacacacguacacacacacacgggcgcgcgcgcgcacacacacacacgcacacacacacacacacacacgcacacacacucucgcagcuaccgccuugccaggggaugaugaaaugaggaacggaaauuaacauuucaggcaacgucucacauuguuccuugaggccaaaggcugcuccugcagccgucgccuacaccgcuuuccucccacucucccccccgagucccgccuuccccucccccagacgccccccgccgccccgcauuccugcccccacucgggccugcgcgccuccgcaccccgcagcuccagguccccggcucgcccgcccccuccggcucggcucgcagcccgagggccgccugcucccauuucaaaacacgauaauaauagggacgcugggaauaacaacuaccaccagcccggcgacggagccccucccgagggucagaggucggcgccccgcgccacugaggaccccagggacucccgggagcccgccgucguccucacagcgucccgggacccacuaacgcaccaucgacccucgcucaaggcccgcccucgguccucacggccgccacagcccaccccggagcccuuccuuagccucucucggccgcccgacccccgggacgccccgaggccggccucggagcccgcccucggccccucauggucgcucgcaggacccccgcggcccaccgaccggccucucgcggcgcacggcccgccccggggcacccgcggcggcgggcagcggaggaggccugcaggccgcaaggccgcaggaacgcccgacgcccuccccgaccaccaccccccagguccccggcgccucucacccggcuccgagggcgacgcggcuccgcggcggaacggcggcggggcgcgggcgcugcccaugcagcccgcggccgcguuucccgggccgcgcggcccgggcgggaaggcggcgucggcgcgcgggcuggaggcugcggcgagugcggggccggcgggaugcaagcccgcccucggcgugcaggagcucacgcggggccgcggcgcucgcgcggacgcuacugcgggggcgucuggccgcggacuccgccgcggcgccuccccggcuggggcccucgguccaucgcgcucugucgcgggcggccucuggcuccaggacccagcgguggcugcggcggg

SEQ ID NO: 4868 - RNA, 442 nt, Mus musculus
gcccccugggccucggaggccaagcucugccuggcuggauuagugccucuccugcuccucauccaagcuaggccuggauggagggggugagaaggacuggaaggcuguucuuuccccugcugcugagaggaagugcaggcaggaaccugugacuaagugccuguaauuggugugggggcugaaaagcugucagacaagccccacgcagucuggccaaucacacaagagcugugagugaagcccauucccuucaccaccugguccuguccuguccugucugugcaggccccuuauggugggcaaccagccagcucuaggggugugucuucccugcucccuccccucucucuucuaacucucuuccccccucccuccuccucucaccagauccagugccuguacacgguggaguaucccucccuccucagaacucccuaagcca

SEQ ID NO: 4869 - RNA, 442 nt, Mus musculus
uggcuuagggaguucugaggagggagggauacuccaccguguacaggcacuggaucuggugagaggaggagggaggggggaagagaguuagaagagagaggggagggagcagggaagacacaccccuagagcuggcugguugcccaccauaaggggccugcacagacaggacaggacaggaccagguggugaagggaaugggcuucacucacagcucuugugugauuggccagacugcguggggcuugucugacagcuuuucagcccccacaccaauuacaggcacuuagucacagguuccugccugcacuuccucucagcagcaggggaaagaacagccuuccaguccuucucacccccuccauccaggccuagcuuggaugaggagcaggagaggcacuaauccagccaggcagagcuuggccuccgaggcccagggggc

SEQ ID NO: 4870 - RNA, 1168 nt, Mus musculus
gcucucuccucugaagcccucuuugccucuuccguguccccucuuugcuuuccuuuagccucucuaacuugucccuuuguucccaaugcuuuccuggaaacaguguuuuuucuggaaccagguugguucucucugagcuuggaauguucugucuuccuggcagaguagaccugcaacaguggugacacaaaacagcaucagacacauccaggggauagucuuugcgugaaguguaaagucauguccuccacugagucuucuuuugguauucuaagucuaaugcuaaggaccugaugcuugcagucaucuggacugguuccuugugaggagcaggugcggccgcugccccaagauggcgcccaggacggcugccaggucuuaugaccugagccugacuuccucauuaccucagacuuagccacaucccagcugccugcacugcgcagacgccaugccucgucagcucgccugaggugucgucacuugcugugaaccaauggacugcugugacgugacuggggugauugggaggagucaguaggguauuuaaggcacgccccagguuguuuggcggauuucguuccugcauugcaaugugaaguguuccugaagaaaccugcuugaagaaggacaacaugguguugcgucuuuccugcugguugggguggaugcgacaagugguggaacccgaacggagacuucugcuucacgagagcucugcggguccagaacuucaagaggucaggguagucggcuggaaagcucccagguaagugggacaauucaaguucucgguuagagacaauaagguucccggauuagggacgauuaagauaaaacaguuauggguaacacaacaucagggcaguccuucgccaggcauuaaaggauuuguugaaaguaaaaggaaucgggcugaaaaaggagucauuaggaaacuuaaaggccgauaaucagguggcuccgugguuccugugucagggcaucuuacagggccuaguugggagaaauuaggaaaggaucugaaguuugccgaggagcaagggguccucgucaagggggugcuugcgguauggaaguuaguacguaacuguauuaaggacagggagaagugcggggcugaguugcaaaaagggaaugagguuuugaaccaaguaagaggagagau

SEQ ID NO: 4871 - RNA, 8407 nt, Mus musculus
cggucagccccaggucuucucaguccauauggcaggccccuggaaaggaaagggggauuggagaaauggcucagaggggaaagugcacgugugcgugcaaguguggggcgugaguucggauccuaacacccauauaaauguuaggaggcucuggcagccugccuguaaucgcaggaguaguucuaggccgguuggcuagguagagcagaugaauugggucagcccuggguucaaaugaaagaugcugccgccauuuauaacacagaaagcaguugaugaagacacugaugucaaccucuuuaucuuuagacgaaugcaugcaaacauguacaccacauauauuuucauauauauacaauaagucugcugcaguacugucuuagcugugcaggacagagcgacagccacacuuuggaggcugccggugaccugcaggcaauauaacaaagcucuccaaccugugccucuggaccuccucuuagguuaaaugcaucaugcuacaggugcuucguggccuucaguaccugcacaggaacuucaucauccacaggugggcaggggcauccagaaggaagguguguuggagugucugaggggugggagggagcaggaacagcuguggugucccccagugucucauuccaaauauauucaagagagggcaaaccuccaguagaagucucugacugcucucaggcaaggcucuugcaggcaacaagucuaaucagcccucaccucucugggaaguagaagguggguggaugggaaggcagcagccagaagcuucaguagagagcgcccacccagagucuuaugccaggagcugcugucucuagagaugccugugagggcuggggcugcuguagcaagacaugggugaaggagaccuggccucuaugcaccuucuugauuuuagaaaaccccaguuaaaugcuuguggugacagccugguugcccuuugggaacuuucucagaaaaccauugcuuucuuucugacccagggaccugaagguguccaacuugcucaugacagacaagggcuguguaaagacaggugcgugcugggugcugacccugcauaugugcagguggguuucuuugagcaugccuuuugggguguggauguccgugugccucuggaaaccagagaugacuugucuguuuccuagccccaggccgccuuaguccaguucucuuuccagacagcagcuuguuuguccucacugagugacggaucaucuuuucuccucuccccccuguugcagcugauuuuggccuggcucgggccuaugguguuccaguaaagccaaugacucccaagguuguuacccucuggugaguuccguagagucacgguggccugcagggauuugugugucuucugugcuucagaagggccuuaaggaucugauagaagcuuuaaggggauguacaugcugcggaugccagggucuaggccaccugcucagaacagagcuaggcucaguggccucaaaacugcucugcucagaugaaaugccauccuaugcuggacagcaguugugccuuuaaucccagcucccaggaggcagagguaggcagauagcucugaguugaggccaggauggccagggcagcaugagaaacccugucuugaaaaaacaaaaacacccaaagaaagaaauggccauugcacacugaaauagccauaaacagccuggcucugucucaggaagcgaagguagcuuucugcaagguuuuuuaggggguaaggggagauaagguuggagagaggggugguauagggguuuugagacagaaguucucuguguagccugcucugaacucauucuguagaccaggauggccuugaacucauagagaucugcuugccucugccucccaagcugagauuaaagguguacgccaccaccgccuggccaccuugguuguuguuguuuuuuuuuuuuuuuaaagauuuauuuauuugcuuuauguaaguacacugucccugucuucagacacaccagaagagggcaucagaucccauuacagaugguugugagccaccaugugguugcugggaauagaacuuauuaccucuggaagagcagucagugcucuuaacagcugagccaucucuccaguccccaucuugguuguuuuuaaggcagaaugaggcugugguaagggcaggaccuugaugucccucacauccucaaggacccuuccauggucucagcugcgugcucucugaucgccaucugaaagcaagcugaugaccgcggaucugugcuuggauccguugguucuuaagagauagacacgguggcucucucgggcuuagggcagaggguaguccaagggccacuggggacccugagcgagcucaggcugaaggggcagagcugaccagagguaaaauggggccuuugucugcagguaccgagccccagagcugcugcuuggaacuaccacccagacuaccagcauugacaugugguaggcgugguuucugcucccagggccucaagucuucuggcccuggaggucagcccuggucagggggagcaggauuggugugguagagagccugacugcagcauccaaggagggggagcacgagaacauggcuggggugcucacuggcuccggccucagguucucacuuggcacugcagaccuugugggagagccuuauggccauuugccugcuucuucacguguguguugauucguugcuaaguggaggucggcugcuucuacagggcugucggcugcauccuggcagagcugcuggcccauaagccccuccucccuggcacuuccgagauccaccagaucgacuugauuguacagcuguuggggacaccgagugagaauaucuggccgguggguguuaccgacaacccucagucccuguccaugccugguggcccugucgcucuagccccugccucuuacaggguuucuccaagcugccgcuggccggccaguacagcuugaggaaacagcccuauaacaaccucaagcacaaguucccguggcucucagaggccggacuccgucugcucaacuuccucuucauguaugacccuaagaaaagguacagaccuugccuuuaggcagcccugccccucaggaggacagggcccuggcuucugcagagauggaaggacaccuuaaacccaaauccaugaugcacuuuuucuggucucgggaacggaagcuaaggccaacuucccugcacacacuaagugagcaauguagcacugagccaucucaauucaacaaaccuuuuaaagaugguuucucacaacacagaccauagauacccacuucccagacauacccagacacccauaggugccagaugucuaguuugaguggccuuaggucuuagagccauucugagcugccugucauugucuaggucucaguccccauuuguuggagauuagguugggcuguugagauuggcuaaguuugagugaaauaggccucucuaaggccaaggucacuaucauuccccagggcaaccucgggagacugccuggagagcuccuacuucaaggagaagccccugcguaaguucuugggauccccuuagguucucuuaggggcuuagcgagaagcccugcuuguccauauuggauucccagggaccacaggccccacaggggagaagaaagggagagacgggucagggccagcuuaagugaggaguccugucuagaccuggagcacgccccaccaggagccccuucuccagcuccaggccagcccugaagcugcccuucuccugcagccugugaaccggagcucaugccuaccuucccccaccaccgcaauaagcgugcugccccagcugccgcugaagggcagagcaaacgaugccggcccugagccuggauccagcccaccccuccacauccucacggaucaucagccgacgacugggaggccccagcaggccuuuggcuccuccaguuggcugacuccucccugauauuucccucuguccagaugcagaggggauuuguggacagggauguggcugagugggguacccaggauagacugggcaguuguagcaccaucugguggccugucuugucuaucauugaaggcccgcuucugggggaacagagcuagugcugagaggccuaaaggucccauucagugugugugagaacuggagcugggcacuagccuggaaugaguaggccugggagauaacucuucuuggagacuaggagcugcccaggacagaugggcuauagugaccccgggcaggagggagcaaggguugguuaacuggaguaggauacuuguaagacugucagaauggaagcccuugguggacgcggcuggcacuggugcccaaggagaggauugguggacugagagauaaaaagccuuuccagaagacaguuuggcaauccuuuaauguacugugggguuucgauccaugcaacauggacaguguccuccgagggcccugcaugaggagcaggaacaggcuuggcugagguggacccguguccucugagggccugcaugaggagcagggacaggcuuggcugaggaggugccacuagaggaaguguggcaaaguggugaucucugugccugggccuucgagugguugaugaaaauccagcccuucacuaucccuauccugaggauuggcaguuuagggacccuaaugagggguccuggucuacccgcaugggagaugaggguauaacuucuuccugguuagcugcaugcccagaaugagcuacguggaguggggcggugagcugcuuuuuggcaauagccugagaaguggcuuguacaugcucccuuccuuucuggcugguagguagcugauggcagagaaucacuccugcugggugggagugacagcuccucccacugccugggagugugccucacuaacagcagaggugaaccgggguccucacagcuaaguaagcucugcucuuucagacccucccacguggcccaaaucuaacucggggaucuuaacugugucaccugcaagccccugggugaggguuucucagcacguggaaagagggacauguccucagucauacuccacagggaucagguagggagcuucaggcaguucauaggguggggucuuucugaguuuggguacuguaacaggauaaccuggacuucucuacccagcacaucugggcaugaggcuagggaugagagggaaggaucuuuuugauugagcucggccugcugcaccagggcugagacugcaccaggugagagcguuccacgaaggcucuacccucuuucaacugcagguccugaauggccccuggggaguaggagggccaggguagccaguggccuagguccuuuuccaaaagaagcaccauggaaacuguccccaaaauuguugggguccaucugggccuagggaugggccccaggacugucauagagcagguuauccaccugugcucguugcagccacaggcgucucugguugucaccaagaagaaugcgcagugaaugagucgggcggcaggcagauagggcagugcaguggguagcauggagcuggcggcaggugucacagcagaggguggguagguugccagggcucaagcagcugugugccugguagcucagaggcucaacagcaggcccauaggccgaggaugcagcugcuucugccugccugugucgggggcuggcuugcccggggcuugaaggggacucagggggagcuaagucuccugagcgacucagcucacggcgcagagaaaggaaggagaaagcagaggguucuggcuccagcuccucuuccagagccccauauggugggcugcuggcccgaugcauaucaucagcuggcgguucccagggcugaccuccagaaccccauaguuuggcacucugcucccagagugguggccuguaagccagcuccacaggaggcgaguccagcccuggggaaggcucaccauacagacuggccucugagcucucaucuuccugcagguccugauacagguccacuggggccccauaaguggcaggugugccccgagggggcagaggugguggcuccucaucuugggccaggcguugcugcagccaggccacacaggaggcuacauccccacuagcccgucgagcucggagcagcuccucggcugguaguacgcuuguacccagcugagucaggaccucacuuaggaucucacacuccaaccgaagagcaaagcaaccuagggccaccugcaccagcuggcaggcagggggugggguggucaccauuaggcggugguugucccugcgcacguagcccaucuucuggaagcuucgagucaggagcuccucagagaguacacccuucagcacaugcacauagcccccugagaaggucuguaaggaaggguccuggucagacaugcacuuccauaaagguuccuagauguagccuauguggguugagccugccuugaccucggugcacuucugaagcuccuguccacccccugauacaguuucuaucugucuggagugagcuuggaugucagacauuguuuuccuccaagggagaaccuaaacccuuguguaugcuaagcaagcauuguggucgagacaagguccuuguuguauagcccagcuugaccccaaacucaccauccuccugccucagccuacaggaauauuccacuguaccucgcuggcagguagccucccacgacuguaguauuccagaaaguccaaugugcuuucuagauccaagcuaccaauggaaucaaagcuccaggguuuaagcuugggucuuucuaagugugaccgucuacaacagcucuaggcuuccuuggagcacuucugugcauagcacccuuagggagaggaugucuacacacaaggagcacuggccagaacacccuccuuagggcguugcaccucgacuuaagagaaaaggggcuuuucccuaaaaccacacagcuaggaggcucuauccuugccagcuccaccccaacacuauuucugaacuauucagugugaaggccacgccuggcugccucuguccucuggggcggaugggugggcuucuagcuugacagaacugaaugaaaguccugagaucucagguauucccguggagcagcaggcuggugggguguggagggggagacguuaccaugacaaccgguggagguuuaccucgcccacgugcauucugacgucauugccuucccacucaaaauuagcucagagcggcccuacccccucuaaguggucugccaucugaccuaaggacuaggccagcccuggaccuggccgccuaaccuggacccaggcaggaauaagaucccugcuguucugaucugcuguucucuucccagucuuagcagccuccuuuuacagauggggaccaguccacaucuuagaggaguuaggaugaccauaggacaucaaguaccucccucacccacccacgucuacccuagaauuuccauggcaacuagggcagugagacuacuuugaggacagccauauaaguucuaggugaaugacugguaggcaugcaucccaacacgcccacgagcccucaacgcagaacccuccccugaagaggaucugcagcccucaaacagccuggacaaggacgggagugaaggagcaccacugaugccauaccuugauaguggugaacuccuuucuccagggcagcagguacaggugcacagcggccagcucuaggagcucaaaggcgcgggccagaucuuggagggccggugccaggucagcccgcccccacaggccaucagugaacagggcuagcgcaucguccuguagcgccccgugcaggucaaagucuuccaccagaaucugccagagcaccgcgcgcagcgaggggucgccgcaaacgcccgcgcggccgcgccgcagcucgcgcuccaggcacuggcgauaguccucggacagugagcugcugcccauccugaucagguccgggaugaggugucaaacuagagaccaugucaucucagcugugugugcgacucucaaccccgcacccagcaagcccagggcucccuccaaccuggaaauagggaccuuggcagcuuagccaacucucggaaucuauggucccugagacguggacgcugacagcucagugaccacaguauuuguagccuccccuccccaggacaccuucagccccgcuugcugagcguccucguaucaacagcuccgcucccacuagcugaaccucuugcagccagagccccucucccacugacgguccccgugggcggcggugcuaccugcuagucgccagcuauuccagagagcuccgcuugggccugggucucuccucgcucuuccgcagaaagucaagcccgccccuuggccuuggucgugacguugg

SEQ ID NO: 4872 - RNA, 1825 nt, Mus musculus
cagaggcagggcucuguccugggccugggucagaggauggaccauggacauaugcacguugagguugugggccuuuucaaagcgucggccgcacuggucacaggcgaaguccagcucagucucugcuuuguguuuggucaugugguacuugagggaugcucguugccugcacuggaacccacagaccucacaccuggagggcagaggcaggugagguaagcugcacuugucccagucacaggcagugcccagcccacacuuacugcaguggcuuggcucccgaguggcgcaucugguggacgagaaggugcuuccgcugcuugaaggucugcccgcacucgucacagauguaauugcggaccucugcaagagcagagcggugugagcagcagccaccgccgaugcccagucugcuccaggagaggacggugaccacugcuuuacacagcaccggggaccuuuaagaacccaaccuuauuuaaaaccaaagacgauucugauaugaagaacuucacugauaaaaguuucuagcuagucgacgguggugcaccaaccacuaagucccaggacucgggaagcagagacaggugauucucuuaaguucaaagaucgucuggucuagagagcgaggucuagcacagccaggacuacagagaaaaaccacuuuccaauagacacuaguucauuaagagauuuccaaguuccucacagcgcuguuacacggcuaggucuuccccacagaaacuguuugcauuucagaccuuucuguuugcuuuugagacaagaucucacugcguagccauggcuggccuuccagaggacucagagagauccgugcaccaccaugcccagccugaccuuugcgggcacagaucucucucugggauucaccccaaagugagccccaaacagcgcagauaacgugguggaggggaagcgggcugaugcacugugggaaucagcuucucgagcuacucaacagaaacuacagccacaucaggcaugguggcacacgccugcagucucgguacucaauaguucaagaccagccucugcuguagaucagauuugaggccagccauuacaugaaaacucucaaaaacaaaacuguugagaaggcucagcagguagucacuugccaccaagacuaauaaccugauucaaaucucagaucucaugugguacgagagccgauagcuacaaguuccacaugcaugcugugugcacacaugugcuuucuuuuacaccguggccacugcagcacuaugcaccaacuguacuuguuccaaccgaugcugucuacacagcuauaaaacaccucugaccucucagcuaaagagucuguuucaccucuuuguuuuuugaagcaggauuucucuguguagaccaggcuggccucagacuuaagaacuccuccugugucugccucccaagugcuggggucaaaggcgugggcuaucacggccccacgaauguuucaccucugcagagagcugcugcuguguccacuagugacuggcuacacagcuugaagaucuggaccaaagguaguuagucaucaggagacaugcccaaaugcgcuuaucaaggaaaaucaauauauagcuggguuucaccauaaaaccaaguaaaugauccaucaauaaaaugccgaacgcuaauguaaaaagauuuuggucauuuauauaaaccccugaaaacuuuaacaaaucuaucugaaugaaugccacaauaauuuuuuucuacauucuaaauuuugggugguguguacaugccauguagaaagugugugagaucggaaggcaauguaggagucgguucuuca

SEQ ID NO: 4873 - RNA, 10594 nt, Mus musculus
cucggugccggugcugaugcugcagagccugccgcauugugcggcgcuccagcauuggcccgcagcgcuuacaucagccagcgagggcggggcagccucuuauaagagggcgcggcggaggcugccgauccuccgcagccugcuguccgccugccuuuucgucucuagccgcgugaagucagcaugagggagaucgugcacauccaggccggccagugcggcaaccagauaggggccaaggugaggcugagccguccggcguccugcguccccacaagcgccagccccagggcgguggguggagggagagaaaggcgacucugggagccgcuagcggaacaaagggaagagcccagccccuugccccgcuccugggaccccgggguccccaaucgguuccccucaaucacgccacucugcacugcgcccagguugcaggagaaggcuggggguaacccuucugacucgcauucccauccauucugcgcacccacacacaccaucagguacaggggaugugguuggggggcgccgacugggcguggccuucuuugagguugccacuuaagccuugaguaagaugggugugucgggcaacuuuggguggggcucuccccuaaaaccauaaugacuguacaugccuggauccccacuggagaacuagacagucuucagggagcaaggccgcccucauauccccaaccuuguucagcucacccaguuuccuugccccacccuguuccuuuguuggaggaguucggccugcacuccaaugaccuugauccagaacuggacucugaaaaucucccaucucuaacugugcgcucccaaggccucccagucgggauugagcacagaacaaagccgacugcaaggauugccucaauuuccccucuauuguuagcccgcauccagguguugaagccaaggcaaaagaaaaagaaaaagaaaaagaaaaaaacggggggggggcgcgggguuggugcagugacuccgcaauccuacuaucauuagugagguagcuguccuguuuccaaguccuuaggagacuguuccuuacccaaggucacacagcaaguggcagacagaacuacuugauuccugcagaagcccaaccuccacuuggguugcauuugaguggguggggucagcuaccucaaucuucucccuucugaacaacaugaaacgggagcuuuguccagaugaaugcuggacggggcuuagggaugcuaguucccaaaggaggagguuggguagacagguccugggagggaggggacgaagcaaagaguaccucuggaggcuguugccauagaaaccgggcaggaacaaaaaagcuaauuaccacgggcugggccagucacguggcugacauguaaauuacaaguuuggcucuuggguggagguuccucuaguuaaaggggaagggaagcggcaccacagagacucccuaaucacaggggagacagcugcuucugcccuacaagggaaauuugggcgggguuggggggguggcggguaggggggcauacagaggaagccuaaggcaaggggccucagaucaaaucaggacuccugggaugaucgcugacagcugcccuggccugaagggagggugagggcucauuaauguggucacaggugccaggcuuucccuggacgaacaucugcuccugaaagggccuggggugagugggggagggaagguuugccaucggaaggccuguuuggugagcuugcugcaucugugcuguucugugcucuccucugggucuccuguugaguaagggccuagaagucagguccaccacgcccaggcuccguguguugcgcuauggccacagaacauuucugagugcuggacccagcugaggucucuuaugcuccucagcacuguggcccauaggcuugcccauuuuuuuuaauauuuaggguuuuuauauauauauauaauuacgaguguuuaaauuuuuaaugccaauucuuuuuaacaaugcaaauaaugaguaaauuuucuuccauuuccaccggcucccuucuuaguaaucaguacaaggcguuuuuggcagguuccauccagcccucugcccuggaagaucucugagaccagacugaaggcccaggcccugugggacguuaccugcuuagugucugccccagggaaaauaaacuuccuugaccagauuuacuuccuauuuugguagcuggcccuugggucacugcugcgagcuacaauggagaaaguucucccuagccaccugcagcaacugagggagugggcacaaagagcugcuuuuuugcuuaucggucuuuggguggucccugucuuagcacaaaggacugcuggcuucagagaggugacuggguagaaguaugggcuggguggggacagggagagaagugugaagccaggagaauuucggggaagcagcagaaggggggccuuagcaauucauaaguuucucacccgcugugagcguguuaaagcaccaggcccaggcuggugcacuguuacaccuugugaaguguggcaugggugucacccucccuuaaggcugagaaagaugaggguuauggaagcugagucacucagcuucagaucacaccauggauuugggcaaggcaggaauuuuagucuaggugugugcagaugugucaaggcaggcggugacaugugcccccaccagcagcagaugugacuggucuacccuuugugugcucccuuuguuagggccugagcuccuagaugcauucuccuauaaaggggugcccuaguaagugucuuuacggagcuuuugucuaugacuccugucugugccccaucagcugccagaacacacccaccccaguagaagucucugaagggugugacccauuggagagccaaugggcccggugagaagggugcugagaguuuuaggggaauugaacaucuuacagggcuuuugcuccugucuuugggagccacacccaacucugcuucuguucaugucccacuacccugcugucguuggcgacccucgccccaagugggucagcaccucggacagcaaccccgcgguuugcagacuggagccuggaguuucaauuggguucacugcaccgggugguuuuauuuucuguagugaugcuacuucauuuauauaauuguauuaauuuacauauuaaauagucugcgguaauauguucuuauaaugucuuuugugugcuauucuauguuagugucuuaauguguagcucagacuggccaugaacucaugguccuccagccuccaccuucuaaguacugguauuauuacaauuguauucuacuggacugggaagauuuuauuuuugaaucauguuuuauuauuuguaauuuauauguugauauguuucucguguuaaaaucaaaacaccggauaguggagauguggcuaaagcacguguuuagcauguaagaagccauuaggugcacacucauaguuccaguuacuggagaggcugaggcaggaggauugacaagauugcuucuugauucuaaaaaaaaaaauaaugauaauaaaauaaaaggaacacugcagauaagguauccuacuauauauuaauuuuaaaauguauauauuuaauuuaaauaguguguguguguguguguguguguguguguguguguguguguguguacaugccuggcucaaauacugaucagaagaggcuaucagaccucugaaacuuacacacaguugugagccaccaugugggcagugcuuggaacugagcuugagucuucuauaacaacagccauguguccagcccauggugcacaccacauuugugcacacacacaugcacaugcccauacucacccaaacucagacacacucacacauaauugaaacuaaaauaaaaauuuuaaauuuauuuauuuuauguauaugaggacacuguagcugucuucagacacaccagaagagggcgucagaucccauuauagaugguuguaagccaucgugugguugcugggaauugaacuuaggaccucuggaagggcagucaguguucuuaaccgcugagccaucucucuaacccaaaauaaaaauuuaaaaauacacaaaagagaugaaauccaggggcuggugagauggcucaguggguaagagcacccgacugcucuuccgaaggucuagaguucaaaucccagcaaccacaugguggcucacaaccaucuguaacaagaucugacucccucuucuggugugucugaagacagcuacaguguacuuacauauaauaauaaauaaaucuuuaaaaaaaaaaaaaagagagaugaaauccagaccccuuugaugagggauggcuucugagauaggucccucagaaagaucccuguauguucuagagugaugaugaucuguuuggacuauuuuuaggcuuuuaaagaauuuuauuuuuuugaaagauaauucuaugagugugggugucuugccugugugaacaucuaugcauacuauguauguacaaggccagaacaggaguuggaugcccugacccuggagucacagaugauggcuugcugccuugggagauuuugugagauuugugaaccaauccugguccucuucaagagcaagaagugguuuuuuuguuuugucugcuuguuuuuuauuuuaaauuuuauuuaaugucugagugcucugcuacauauacaucugccugccugaagagggcaucaaaucccucuauagauggcugugagccaccaugugguuguugcugggaauugaacucaggaccucuggaagaguagucagugcucuuaagccugcaacaaguguuuugggguuuuguuuguuuguuuguuuguuugcuugguuuuuuuuuguuuuuuuuuuguuuuuuuuuuuuuuuuuuuugagacaggguuucucuguguagcccuggcuguccuggaacucacucuguagaccaggcuggccucgaacucagaaaucugccugccucuaccuccugagugcuggaaucaaaggcgugcgccacgacgcccggcucaacaguguucuuaacugaugagccaugucaccagcccacuuaaaaguauuuuuuacuaauuaaaaauccaauggcaccaaaauguagaaaaaaaaugugaaaagucuuucugucagcacaagccgaugccccaggacuggcacuugcugacuguuuucuguccugcuuucaccucugagcugucuucuccacaagacugccacagagaggcccuuugucucuagaccuuuguaucaacaacuuaucugccagucacuccccugccugaccagugaugagggaucucagagcccaaggaggcagccccccucccccccccuccccgcaggcaggcuggguagucugcauguccugauaaaaugucuuccugugugcagcccuuucauccccucccucccuggcccccagaacagaaggcuguguucucacaagagccuguugucaugcagucagcccauuguacagagugggaacaccaaaacuaaggcccuauggggcaacuaugcacccugcaucuccguacugucuugccccucugaaaugauggcagccccacgugaggagcauugcguucuugugcaaggggcugaguguagcagccagugagccaaccauccuggguguugccaggcuccuggauacgguggcaugugaccuccgacaagccauucugcugcuggaaacugugguccuucacagauccaccugugggucacacugccugaggcuaaugagcuaucaagauggacucugucagaggccaugacuugcccaggcucugagggucacauguaacagcuagagccccaugcuggaccugaucucucugcuuccugugcuuccagcugcucugggcagcuuucuaccuugugugugccucgagcuguguagaacccaccugugucuugaguccuaguccauucuagggaccugguuguuaguaccaagacacuccuagccccgccuaacuaugugacccuugagcugcauugccaggccaaugccccucaaucccacaauccacuuggcucaauucccacccucacuggugugacgucauuuucccuauaaauuaggagaucacccccuccucucucucucuuuuucucucucuuucuucucuccccccucuuucucucuuuuuccucuucucugcccuucuaccugcuucgccaccccucugccucugcacaauaaaccucucccacguggaaacaccuuagccuggucugcuguuugguuuaucugcucaaaauauauauguauuaauauugcuugauauuaauuaauucauaaaacugguaauguccuccagauagugcagagaacagguaugcauauuuacucuuuucuaaagccuuauguuagaucuagaaagaucucagaguuuuuuaauuuuacacugagagcuuuaagacuucagaagaagccgggcagugguggcgcacgccuuuaaucccagcacucaggaggcagaggugggcggauuucugaguucgaggccagccuggucuacagagugagucccaggacaaccagggcuacacagagaaacccugucucggaaacccagaccucaugagagcacagguucgguagagcgucgaugugugaugagcucuuucuuuccuucuguccucaguucugggaggucaucagcgaugagcacggcauagaccccagcggcaacuauguaggggacucagaccugcagcuggagcgcaucagcguauacuacaaugaggccuccugugaguaccgcuccacacccacccugaccccggcaaagagggcucccaugugaauagaguccuagcguccauauccccaccuuucuugauuuaccaagaggcuggcggguaugacuggaaacgaggcauccaaauugacaggauaaagagugguuaccgggcuggagagauggcucagugcuuaagagugguuacuauggugugagaugaaaauauauuuaaugguggugaugaccuuauguagucuagggacaggcaggagacucaaugauacauccuuagcaggggucacugggggcuugauugaggcuacuugauaauugauacagucuuuuaauuuuaauuagauauuuucuuuauuuacauuucaaaugucauccccuuuccugguuuccccuccaaacaccccguacauccccccuccucccccugcucaccaacccacccacucccgauuccuggcccuggcauuccccuacacuggggcagagagccuucacggaccaagggccucuccucccauugaugauugacuaggccguccuaauuggucuuaaccaguauaguagagcauaugacuugaacccaccugcccugggugugagccaucacaccauggucaggccagagcuucccauggguccaugucuaugauauaaguuccagcucuuagaguaacugcaggagauugaucccuugacucucuaacuccuaucacugaauccucuugccccucagcucacaaguaugugcccagggccauucugguggacuuggaaccuggaaccauggacaguguucggucuggcgccuuuggacaccuauucaggcccgacaacuuuaucuuugguaaguuccccugcuccaggcucugaugacagaaaccugguccuggagaagccagguugacauacagaggcagaaugucugaaggagauaaaagucaaguacuguccccugggacccucccugcacggugaaagggaccuucccguucuccaaagggcguuggugguccagagaaaggacugugcaggaaauaaucccucucccauaucuuacaaagaaugagguacaaaacgcagggaguguuacagauuuauguggacaaaucaggggucuccggagggaccugaguauaugagccuguguuuagaggcugugauggggcuggagagauggcucagcggcuaagagcacugacugcucuuccagagguccugaguucaauucccagcaagcauaugguggcucacagccauguguaauggaaucugacgcccucuucuggugugucugaagacagcuauaauuguacucauauacauaaaauaaaucuuuaagccuuuaaucccagcacucugggaggcagaggcaggcggauuucugaguucaaggccagccuggucuacaaagugaguuccaggacagccagagcuacacagagaaacccugucucaaaaaacaaaacaaaaaacaaacaaacaaacaaauaaaucuuuaagaaaaaaaaaacagcagccaugaugguccuggcgccuaugcccagccagugaugggcccucagugcucacaccgacccaggaagacaggugcaccucacuucugcuuucaagauccaagcaccaugagccaguaagauggcucagcagcagauaaagggcuugcuuucaaaccugaagaucugaguucaauucuugggacccaaguggcagaaauagagaacuaacuucuucuucuucuuuuuuuuuuuuccucgagacaggguuucucugaccaggcuggccucgaacucagaaaucugccugccucugccucccaagugcugggagaaccaacaugugugcccuggcauguauccaccuauacacauacacauaaccaccacacacauauucucucucuauaaacaaaugugguguguuguuguuguuguuguuguaagaucuuagacuagacuagcaggugccaguucuuagucaguccucaguuacaauaacugcucagggauuuuuuuuuuucuggaaaagagaaguuggcuuagaggggugaggacagcaggccagguggcugaauaagggacagcccucaucugacaucacagucucagcagaccagugggagggaagggaaggcugaccuauuuauccaggaugccccugagagauagcaaggcccaggucuuaucccagauccccauucccuguucagagcaucugcagcagggacccccugcacucaacagugaugcccaggguggaaugagauguuaugcagugcagacauuuuauagaauacaagggaaccaacuuucuucuagaggagagagcgguuggcagguccuagaggucucugcacuguaaacccccgaccuuaccucuuaccugccucuucucuccucauaggucagaguggugcuggcaacaacugggccaaagggcacuauacggagggcgcggagcugguggacucaguccuagaugucgugcggaaagagugugagaauugugacugccugcagggcuuccagcugacacacucacugggugggggcacaggcucaggcaugggcacacugcucaucagcaaggugcgugaggaguaccccgaccgcaucaugaacaccuucagcguggugccuucacccaaagugucggacacugugguggagcccuacaacgccacccuguccauccaccagcuaguggagaacacagacgagaccuacugcaucgacaaugaagcccucuacgacaucugcuuccgcacccucaagcuggccacacccaccuauggggaccucaaccaccuugugucugccaccaugaguggagucaccaccucccuucgauucccuggucagcucaaugccgaccuccgcaagcuggcugugaacauggugccguucccacgucuccacuucuucaugcccggcuucgccccacuuacagcccggggcagccagcaguaccgugcccugacggugccugagcucacgcagcagauguucgaugccaagaacaugauggcugccugugacccgcgccacggucgcuaccugaccguggccacugucuuccgugggcgcaugucuaugaaggagguggacgagcagaugcuggccauccagaguaagaacagcagcuacuucguggaguggauccccaacaacgucaagguagccgugugugacaucccaccccgugggcucaaaaugucauccaccuucauuggcaacagcacggccauccaggagcuguucaaacgcaucucggagcaguucacagccauguuccggcgcaaggccuuccugcacugguacacgggcgagggcauggaugagauggaguucaccgaggccgagagcaacaugaaugaccugguguccgaguaccagcaguaccaggacgccacugcggaggaggagggggagauguaugaagaugaugacgaggaaucggaagcccaggggcccaagugaaguugcucgcagcugggguguggggccaaguggcagccagggccaagacaagcagcaucugucccccccagagccaucuagcuacugacacugcccccagcuuugcuucucaccagcucauuagggcucccagguuaaaguccuucaguauuuauggccacccccacuccaugugaguccacuuggcucuguccuccccauuuuagccaccucuguauuuauguugcuuauucgucuguuuuuaugguuuguuuuguuuuuuuacuggguuguguuuauauucggggggagggguauacuuaauaaaguuacugcugucugucagauaccucug

SEQ ID NO: 4874 - RNA, 10740 nt, Mus musculus
uaccaauggaaucucaucuauuuuacaugacucaugggugugccacagcauuucuagacagcagaucauggagcccugugcuggcgcugucccaccugcugugcugaccugagagugcuagaggucagggacaugcgaucugagcauccuugccugcucaaugagagcagcgaggguagccagggucucugccaccucccuccuagaaaaggggcagggagggauaagggugcuuagaauuugccagaagccacaccauucccauaaaaugcacacgguagaccuggcugccccgagccuccagaaguggucaggccuggcuggcuuuuauguucaucucauuccagugguuaaguagcaagguuugggcuuccccguggcuuccgggcagagugcuccuucggcucagaccaccucuguugacuggaagaguuggcagggcaggauuuucuuucuuagugauuccuuuuguuguauuaacuuaggggcuagaaauccagggcacuugucccuaaaauacaacucaaauaagcacagccuggaacugcacagcagagcucccauggcacuuugaugccaucuagagggaccagagguccaaagaugacggggauacuuuaaucccacucuguaacugugcccuguggaagcugcagcaggaaggguggauggcgaggguaagacccuggcaggcuggaguguggccaaggcuaccuggagaugaaaaggcagcugcuggguuguaucccuuggaaacuaggguugguuuucauuuugggagacgggcagaaauaacccacauuugggggucagcagugcagaggcaggggggcucugaagaggaaccuccuggaugcagcucugcccccagcagaagcccagggcauuuucuccccgguagcauucacugcaaaugacaaucaaaagccuuguccuccucagaagauggugggcagcgggcaggucaaccuggggacaaaaagcaaguacacuuuuauuucaaaacagucuuugauuuguggucagagcagccaguguguuugucuuugugcacaugaaaggaacguugaaucucuaaaccgagugccuagcaucucacagcacaguggguggcuagguuguucccgucaccccucagcugcucccgagacagauccacagugucggagccucccaaccgaacauugggcaggaugugugggcggucaggcaaugggguguggaggauacacagugugcgccucugacagacacaggacuggggagguggcacucuguccuuccgagccaccuggaagucuucacugagguuggauguucugaacuaaagaagaccugggguagcuuuucagccuuugaacugucacacccauaggacaagccaagcggcccuggggcagagacuacaaacaguggugccugcccagggcagaggaaggguguaaaauuuucagucaagguggaaaucuuagggaaguaacaccuaccacugccacuuggcuugacagcagagccagcccuugaccugccaccaaauguacuuugggcuuuugagcucacugauguuggcgauaaauaaaccccuauguguuccugggcagcucaugggcuuggaucccuuugaaccuguuuggaaucacaagagacagaaagucuuguccuagagacaaguuuugacaagacccagaccacugcugucuguuccuucucucaucccaaggcagagacuccaucagugucgucccugauucagggaccaggaaccagcuggaccgaaggccacugggcugugcuugugcuagagcacccaagggccuaagccuggcacccggacuuugacacauugucaggggcgauggcuggagucuuggaguuggcagagggccucugugccagugcuguccuauggugccauuacgguaguccgccagcccuucagcaacuccggagcaggaggagacuggcuaaucuuccuugggcuccuccacagugaggaauguguccacaauugucccuugccgcucugggucacuggggggcuguuucucacgguucugcuccgcccuuguuuucguccaggauggugaacguaggcagcuggcucgagauagugggugcagaccuggugaaaacacagaaagguacagucaagaauucaguaagaugggggacugagucuccaccuuguggcucugccagucucaguugcgugguuucugggugcacauaggccugggugucugccacugcacuguuuauaggauaugcagggacuuuucugaugucccuaggagucacugggcuuuuuuuuuuuuucccucucauuguuuuuugagacagggucuugcuauccagcuuugguggccuggagcuuacuacaaagacuggacuggccucaaaaucagagauccagaaaugcugaaauuaaggccaugcaccacuaugucuggcucaagucuugagacugucugcccuaucccccacauugacaggccacuaccaaaucccugacuuccuaaguagcuuaauauaucuugcggcccuguaaggcugacagugucugucccaucaugagaccucagcugcuguccagggugcaggcaguauggggcuaggauaacaguugggcuggaguugggcuuccacucugccugccuggccacagaugucacgggccaucuccugacucagcauacacaugcaggcuggaggggaaggcagagcuaacaaggggugucaccagauaagguuagacuccauucugcaggagagcugggccgggaacccacgagagggagccgggguccaccuucaugcugcugucuuaucucagagcccacagcucccuggauacauggaguccacuccaccaaccuccagaagcacgugagcuggcagaguccucacugggacugguggugccuuucauaagaauguugauuuccuagcaauugggaggcagaggcaggcagaucugaauuucaggccaaccuggucuacagagcgaguuccaggccagcccgacugcaugguaagaccgugucucagaagagaaaggaacugugacuuucuucgggcccuuggcauacgguauaggcccuaaucccggucaugugcgccugucuugacuuggggcuggggcuuagcuccuuugcuuuuccuaccguguagcacaaagugggggucugaagauccaucacugauggaagaccagguguggggacucugaucccagcacuugggaggcagagacaguuggaucuccgaguuugaggccacuuuggucuauaaagagaagucaaccaggggcuacauacugagauuuuuuuuuagacagaauuucacuguguagccuuggcuauccugaaacucacucuauaguacagguuggccucgaacuaagaauucucucucugccucccaaguacugggaucaaacaugaacaacuaacauucgaugacaccaugucuauguaagacagaguuucuuuguaguucugguuguucuagagcucacccgaagaucaggcuggccuuaaacuuggagacuugccuguuucggccucccaagugcugggauuaaagguaugugucacugcuaccuggcugagaccaugucuuuaaaaagaaaagaacacugagccaggcauguuaguguaagccuuuauucccaacucccaggaggcagaggcaggcaggucucuaaguuuaaggacagccagggcuacacagaaacccuauuucaaaaagcaaaaacaagcugggcaguggugacgcacgccauuaaucccagcacuugggaggcagaggcagguagauuucugaguucgaggccagccuggucuacaaagugaguuccaggacagccagggcuacacagagaaacccugucucagaaaacaaaacaaacaaaauggaaggacugaagcauuugcggcaaaccuuguguucuggccacagggguuacaacauauccugcugacauggggcuuaggagaggauggaaggauggaagacuggggucucacccacacagcccacuccagaugauagcaccuccuccucuccugaggagaagccacucaaguggugaggggcccagguugguggcugcccccgccuugugcuuagcuuaacuuaaaguccacacuuaguaaguuauauuuucauuuggcucaauuguagaagucgagggaagguagauaggggcauagcaaugcaaaguaugagcaaggacaaguacuauacacaguuggguaaaaauggugucuuucuaaguagggaucugaggggaccaggagccccaggacauccccagagcacccccuuuaugccuuuuuucccucaagccagcgugcagccucaccugcuggugacucaguggcaagguuuucgucaucggaguccgcaaagaccucggccaacuccuggucagacauguccgucagcucagugagguccaggagaucgaaguggaccuccagagaggagacgcugcucagaggcucuagggguuccaggagacacaggcaccucucagucccacuugaagcuaccaagagccuuagggaccucuuugcacagaauccacaggugacccggcacuuuggguauucaugugugcuuucauacauaugugcacacgugcaggccagaggccgacgggggucuuacuuacuucucugcuguaccuuuugagauggggacucauauaaccaguuugucuagacuggcuggcuggucaggaagucccaaggauucucauuucugucuccucagugcaggacuuauauaaaagcacguacugccaugccugauuuuuccuacaggagggcuggggaucugaacugggguccuuaagcuuacagagcaagcaguuuacccauugagccauucccagaacuggcacuuccuguaaagccaguacuggacaagaccaggcagacucagcaaccggguggcucugcacacucuagaccggagagcuuucucagcgccuccauucuacagacaggacaacugcaagcacaguugcccuucauggggcagggcugccgccucucauacgcaggcugcuggauggauggauggauggacagacggacggauugucagugauacuuacgccuccucucugugaccugcaggaacccuggugcugguauugggaugccaaccuccuccuccuccucugccacagguguacggcacauguccccugucucaugagcugaaacauucagggcagccugugguaccuugacguccuuaacgaucucuguaaccaagauacaguguuaccuccacacucaugggaccccacaucccuccaggauggggcuguguggcaaguagggaggaacacgaggcccucgccaugaugagggguuccauuucauggccacaaggaagcagagauacgcggcugcuucccuuuaagcuguccucccugggugacugggcaaaggugucugccaguggauggagggacagacagacagaccacucagcacugcagcuccagcgugcuuagucugggaacucuacaucagguuugccagcauuaggcuccacugucucccacaccguagcuugucuaguuaugguauguuuauuagucacucguggguuccugccuuucuucugggcacugacugacuuauaaaaacccuguggaguguuugaguucaaauggaaaagaagcagagcaggaagcagcagccuugcuguccaccccauccacacacccaccuauacacacacacacacacacacacacacacaccagccccacugugguuugcugaagguucuuuucaaaacaggaauugcuugucucccuuauuuaacagcuuucuguuggagagcaggugucccucugggaucugcagacugcucagucccacacuagcacuuucuuuccagugccuggagccaucacccaguggggugcuggacacacguaucuccucccaugggguaguuuagaucuuuucgauaccugucaucucccuucccauggcacacccccccagcagccuccucaucauuccccacaccccaccaacuucccucucugguuucuagguccuucacagugugucugacccccaccugcagucacucaguguggacccagguggaugacauucccgugugacccgugaucugugcugggaugcacaagugucccguggauuauuuuuggcagcccugggugaugaacauugaacaccacacuaagggcagcugcugcccugagcaagguuugaacugaggugaccacagcccaggccccgacagcugcaugucaggcuaggcugccuuuccuaaugagauauguuggcagcagauguggggcuggagcauccgagaacacuuuccccuaucagaugcaaaaggcagagggggaguguggaucucagauggggccaggagcucaggaaagaggaaugaguagcaggcuacaguagaguugugugcaggacuaguggaccuucucugaacuccaguguccaucugcaugagggugagccgugaggacuguccaggcggaagggaagaaaugcugguacuguucccacuuuccuucauuuucuggggucucuugugcugagaugggggaccuuggcuaaauaguaaguauagccccuaucuugcaccccuugauagagauccugggguuacauacucuucagccccugggauaagacaauaguggccuuauuacaucuuuucauauuuuguccaugaggcuuuggagucaaugagaugugguaccucuguauagggugcuggggaucaaaccaagaauauccaagagcauuacacacacuuggcaaauguugucuguaguuuuaaaaguauccccauguuuugguucuuuuccaucucgcucuggccuugguccugucuuuacucuguaaauccuggugcuuuguccuuaaccagauaugugggggaggagaacgaagacagaaucgucaccaucaagaacauucuugugguacauacccaucgucccaaacuagggagguggagucagggcuuggugagaaugucuaggaacaaguaaacagaccacccuugaggcuggugcacugguuacacuuacaauccuagcaguugggaaguggugggcggaccauugagguuugaagccagaaauuaaaaucugccaggacagaggaaaccucuaacccucauccauccaucgcguucucucucucucacacacacacacaccauguguguguaugaaugucccccaucucuguguauaugaaagaaugacccuaagacuccacaguuaauaaguggcugugcuaagaaucauccggucagaggcuggagagauggcucagcggguaagagcacuggcugcucuucuagagguccugaguucaauucccagcaaccacaugauggcucacaaccaccuguacagcuacaguguacucauaugcauaaaauaaauaaaaucuuuaaaaaaaaaugccggcguaguggugcauaccuuuaaucccagcacucaggaggcagaagcaggcggauuucugaguucgaggccagccuggucuacauagugaguuccaggacagccagagccauaaagagaaacccugucucgaaaaaccaaaaaaaaaaaaaaaaaaagaaucauccggucaguuuguccucuuggcuguuguaggaauaaggaacagauucucuagcccaucccaguuaagccaaggcaccaugguaggcaggcuagggcacaccaaaacaggcagacugagcugaaugggcucaggugggcagucacccuggacacgguagagggaaguggugucugaugccuggagagggcuccacagugacccuuggcucugguccuauacaaccuccaucagagggcugcugcuguugcugcugcccuaggcuguggauggagauuaggagugccgacuucccggccugccaggcuuccuaaguacugacuggucacagcagcuuugcugaugcccuaguucuagcacauuugugacuuggaaacuaggccucaaucucauguuucuugcugugcucccaaggcugggccacuuuuuacaccacugaacaagggaacaauuaaugacaugaauauguaaacagaguggccaccagccgggagugauggucacggaggugauggucaccugagcccauuuccccagcaucucuaccccugaaucuguaccaucagugcagucuuuuaaggaugcugagaccccaugccuacucucagugcagggccacagccuccuguuucucuucgacucuggggacauccucccuccuuagagaugaggaaggggcagagacuuggugcccaaaggcaucaggugggcuucucaaggagggcagcagcuuuuacacucucaugcacaugccucagcuccaugaucccaugcuuuaaagaaauuauuaccuggggaaugauggggcaugccuuuaauuccagcgcucaagagcugaaagcaggcagaccuccgaacuccaggccagccagggcuaccuaaugucaccuuucccauccccuaaauucuuuagguuuaaaaauugucuauuaggcuuggcaugaugguacacacaccuuuagacuaaggagguggggguuaagccuggucuacauagcaagauccaggguagccagggcuacauagacccuggcuuaaugauacauuauaaagauuuuacuuuugggagaucguuucuucaguggcuacugaugaauaacaggucuagauuuaaugcggaguacuagaggaaggcuggcaaggucuguaugagcgagcccugcugcgggccugggagauggaacacagagcuccauccuccugggcucugccuuuuuuguguuucacaggcuccaaaacaaaguuaccauuacagucacccuuagggagccccaccaagcacagcccacuagcucaggaugcagacaagaaaacacgcuaaaggcaccaagagagaauucccucuuagcuuuugccucccgacaugcaggcacgguaccagcucaugauagguacuugggauuuguucacugaaucgggcgucugagccccccacccccagccaguaaugcauacaucagagacagcauacuccaucucugcuuaagcuugugggcuuguucuuucuuuccucagagaaagaaagaaagaaagaaagaaagaaagaaagaaagaaagaaagaaagaaagacagaccucugcccuauacaagggggcugccuguauugacagccaugcuaacggaggcucaggggcacaggcaaguuuccaacaucgcacagcucaaaaaauaacucugagcucuacaagccaaguccuugcucuccaaaccaucuaccuucugguacccacggagcuggugcugggaagacccagggucuggggacugucaauagcaagaacgcuggucucccauaaaaacaaaacaaagcacaaccaaucccacuggcuggaaagugucuggcgcuuaggcagauaaggguuuucaagcaggacacugcuccccgccuguagacauaggagccgcuuggggacagcucccacgggcaacccuuuggacuucagaagaagccaucguguggcuggguugcaggcggaauggcaagcuggccaaauccucagacacuugguguuuccuugggaugggaucuucaggaaauccuagagguguuggguauggcuaagcaagugauggauuguucagauuacauccaaguucccacagcgauggaucccugaaaagcuuucuggaaagcugagacgcagggugggugauuuuuaagaguuuucucucuauuaucagccacccgccugugggcacgcuccaaggagggcagacccugcgguaagauguuaaccucaagggucuucagcugcugggagaggccgaggaaggagcacaccauucacaccuucccuuccaaauauauggcagcugggcagcucggaggccgcugcccugcagcaccaagagcucgggugcaugcgccaugaccucacaaaaaccccagcucagucgggagccccagacccccuuccgccucuugucauuccuccugguaucgcggcuggggcgaacaaagccuacgcgugaacaagcggguagcaucgccccuacgaauccccucuccagaucccuaacuccggccccuacacgccccucccccgcucccaggcucggcuggcagggggcucaggacgcaaccccuggucaccuccuuggagggcaguccgcaagccuuccggagcccggagcucgcauaucagggaaagagacgcagucuguguuugccgagccggauacccgcacguuuccaaggaucuggcccggcccccuccuccgccccuagcucugagucggacgggcgggcucagaaggcaucagcgggucuccaggccccgggaguagcuggcuagugggcagagggaggggcugcgguuuguuguuggguucugggggccggggucggacucaccucccggaccagcgcccucgggagacuccaugcggccaaugggguccgcggggggugugggcagcggcggcgacagcccgggugccccaacugcucuggugacuacugaguccgggcuucgggcacagcgcaucggggcagcagcuaaggggccgcgguggcggggaggagcccgcggggcggggcgcgcagcugcuucuggcgccgcuccccuccccaucucc

SEQ ID NO: 4875 - RNA, 4498 nt, Mus musculus
augcuggggaaaugggcucaggugaccaucaccuccgugaccaucacucccggcugguggccacucuguuuacauauucaugucauuaauuguucccuuguucagugguguaaaaaguggcccagccuugggagcacagcaagaaacaugagauugaggccuaguuuccaagucacaaaugugcuagaacuagggcaucagcaaagcugcugugaccagucaguacuuaggaagccuggcaggccgggaagucggcacuccuaaucuccauccacagccuagggcagcagcaacagcagcagcccucugauggagguuguauaggaccagagccaagggucacuguggagcccucuccaggcaucagacaccacuucccucuaccguguccagggugacugcccaccugagcccauucagcucagucugccuguuuuggugugcccuagccugccuaccauggugccuuggcuuaacugggaugggcuagagaaucuguuccuuauuccuacaacagccaagaggacaaacugaccggaugauucuuuuuuuuuuuuuuuuuuugguuuuucgagacaggguuucucuuuauggcucuggcuguccuggaacucacuauguagaccaggcuggccucgaacucagaaauccgccugcuucugccuccugagugcugggauuaaagguaugcaccacuacgccggcauuuuuuuuuaaagauuuuauuuauuuuaugcauaugaguacacuguagcuguacaggugguugugagccaucaugugguugcugggaauugaacucaggaccucuagaagagcagccagugcucuuacccgcugagccaucucuccagccucugaccggaugauucuuagcacagccacuuauuaacuguggagucuuagggucauucuuucauauacacagagaugggggacauucauacacacacauggugugugugugugugagagagagagaacgcgauggauggaugaggguuagagguuuccucuguccuggcagauuuuaauuucuggcuucaaaccucaaugguccgcccaccacuucccaacugcuaggauuguaaguguaaccagugcaccagccucaaggguggucuguuuacuuguuccuagacauucucaccaagcccugacuccaccucccuaguuugggacgauggguauguaccacaagaauguucuugauggugacgauucugucuucguucuccucccccacauaucugguuaaggacaaagcaccaggauuuacagaguaaagacaggaccaaggccagagcgagauggaaaagaaccaaaacauggggauacuuuuaaaacuacagacaacauuugccaaguguguguaaugcucuuggauauucuugguuugauccccagcacccuauacagagguaccacaucucauugacuccaaagccucauggacaaaauaugaaaagauguaauaaggccacuauugucuuaucccaggggcugaagaguauguaaccccaggaucucuaucaaggggugcaagauaggggcuauacuuacuauuuagccaaggucccccaucucagcacaagagaccccagaaaaugaaggaaagugggaacaguaccagcauuucuucccuuccgccuggacaguccucacggcucacccucaugcagauggacacuggaguucagagaagguccacuaguccugcacacaacucuacuguagccugcuacucauuccucuuuccugagcuccuggccccaucugagauccacacucccccucugccuuuugcaucugauaggggaaaguguucucggaugcuccagccccacaucugcugccaacauaucucauuaggaaaggcagccuagccugacaugcagcugucggggccugggcuguggucaccucaguucaaaccuugcucagggcagcagcugcccuuagugugguguucaauguucaucacccagggcugccaaaaauaauccacgggacacuugugcaucccagcacagaucacgggucacacgggaaugucauccaccuggguccacacugagugacugcaggugggggucagacacacugugaaggaccuagaaaccagagagggaaguuggugggguguggggaaugaugaggaggcugcugggggggugugccaugggaagggagaugacagguaucgaaaagaucuaaacuaccccaugggaggagauacguguguccagcaccccacugggugauggcuccaggcacuggaaagaaagugcuagugugggacugagcagucugcagaucccagagggacaccugcucuccaacagaaagcuguuaaauaagggagacaagcaauuccuguuuugaaaagaaccuucagcaaaccacaguggggcugguguguguguguguguguguguguguguguauagguggguguguggaugggguggacagcaaggcugcugcuuccugcucugcuucuuuuccauuugaacucaaacacuccacaggguuuuuauaagucagucagugcccagaagaaaggcaggaacccacgagugacuaauaaacauaccauaacuagacaagcuacggugugggagacaguggagccuaaugcuggcaaaccugauguagaguucccagacuaagcacgcuggagcugcagugcugaguggucugucugucugucccuccauccacuggcagacaccuuugcccagucacccagggaggacagcuuaaagggaagcagccgcguaucucugcuuccuuguggccaugaaauggaaccccucaucauggcgagggccucguguuccucccuacuugccacacagccccauccuggagggauguggggucccaugaguguggagguaacacuguaucuugguuacagagaucguuaaggacgucaagguaccacaggcugcccugaauguuucagcucaugagacaggggacaugugccguacaccuguggcagaggaggaggaggagguuggcaucccaauaccagcaccaggguuccugcaggucacagagaggaggcguaaguaucacugacaauccguccgucuguccauccauccauccauccagcagccugcguaugagaggcggcagcccugccccaugaagggcaacugugcuugcaguuguccugucuguagaauggaggcgcugagaaagcucuccggucuagagugugcagagccacccgguugcugagucugccuggucuuguccaguacuggcuuuacaggaagugccaguucugggaauggcucaauggguaaacugcuugcucuguaagcuuaaggaccccaguucagauccccagcccuccuguaggaaaaaucaggcauggcaguacgugcuuuuauauaaguccugcacugaggagacagaaaugagaauccuugggacuuccugaccagccagccagucuagacaaacugguuauaugaguccccaucucaaaagguacagcagagaaguaaguaagacccccgucggccucuggccugcacgugugcacauauguaugaaagcacacaugaauacccaaagugccgggucaccuguggauucugugcaaagaggucccuaaggcucuugguagcuucaagugggacugagaggugccugugucuccuggaaccccuagagccucugagcagcgucuccucucuggagguccacuucgaucuccuggaccucacugagcugacggacaugucugaccaggaguuggccgaggucuuugcggacuccgaugacgaaaaccuugccacugagucaccagcaggugaggcugcacgcuggcuugagggaaaaaaggcauaaagggggugcucuggggauguccuggggcuccugguccccucagaucccuacuuagaaagacaccauuuuuacccaacuguguauaguacuuguccuugcucauacuuugcauugcuaugccccuaucuaccuucccucgacuucuacaauugagccaaaugaaaauauaacuuacuaaguguggacuuuaaguuaagcuaagcacaaggcgggggcagccaccaaccugggccccucaccacuugaguggcuucuccucaggagaggaggaggugcuaucaucuggagugggcugugugggugagaccccagucuuccauccuuccauccucuccuaagccccaugucagcaggauauguuguaaccccuguggccagaacacaagguuugccgcaaaugcuucaguccuuccauuuuguuuguuuuguuuucugagacaggguuucucuguguagcccuggcuguccuggaacucacuuuguagaccaggcuggccucgaacucagaaaucuaccugccucugccucccaagugcugggauuaauggcgugcgucaccacugcccagcuuguuuuugcuuuuugaaauaggguuucuguguagcccuggcuguccuuaaacuua

SEQ ID NO: 4876 - RNA, 12405 nt, Mus musculus
aaauuuucugcaggagacugcgucaggggccugcggagccuggcucuuggcuccugacccuccaguucugcguccaguuggcagcagguccugccucagccggaugauggcgccugucggggacccgccugagugcagcagacggggccuucucauccuuggagagaauugugagugugaguucauucuaucgaaggagagcugaaguguucaccagagcagaagacgaagccuuuguuguuuucuuagcacuuucuccagguagauuucaggcugcgcuugaacgagggaaaaaaacccaaaacaacaaaagcacaaaagaaccucaaugauuaaguugggaaauguggaauuuuuaaaugaauaauuuaaacugaucucuaccagucuagaauauaaguacacacauaaaauauaagcacagaguuucagagucaccugauacuuacuuaucgcuuagcaaccauacgaugccacuacauggcguucugggaguggacagagcucauggaccuuacagagaagguauacagugugaaauggaaacucaggcucagaugaggaagggcagucauaggugagggaagacccucuaacugcccacauggcugcuaacacuuggcuauccagcaucuugccugcugcagugagcacuuaacauauguagaaugacuuagugauauuauauacaauaaugagaaaugacagguaaauaagggaaauauuacccagcauacacugagggagugucauuuggggggaacccaccgggcaaauccacuggaaacuaugagaaagcacuuggaggggggguacacuuuucaaauaaauuucaaagcaguuacuuccaccaugagucacaccaaauaugccaggcuugguggcgcacgccuuuaaucccagcacucgggaggcagaggcagguggauuucugaguuccaggccagccuggucuacagagugaguuccaggacagccagggcuacacagagaaacacugucucgaaaagaaaacaaaccaaaaccaaaaccaaauaauuguaaaaguccacucucccaaagcaguaacuagaugauacucaaagaggccguguaagagcuuaguagcuaccaaaggcuuuaacacaccacacagaacacgacagagccagugagcuaaaaacaaacaaaacaaaacaaaacaaaacacaaauggagaaccaaacagcagcauccagggacccuggccggcugaaaauacuucucaggaaaauaggagcaaagguuaauauaacaagggucauucagaaagaucacaaaucaaguuacaaagaaaaaucacaacggaaguauuacaaccaggaguuuuugcucaaaguguaauaaaucuggaaauuauuaacaacuaauacaaauaagccgaggcuggagagauggcucaguggcuaagaguacacacugcucuucugaggaccugaguucaauucccacuucgggcagcucacaaccacuuguaacuuuugguggcucuggaagauccaauaccaucucugaucuccuugggcacuacacucacaugcacaacacacagagacaaacacgcauacacauaauuuaaaaaauaauaacagucaaauauucaaagcaaacauacaugaauguuguuacagauggagaagcaaaagcaucuaccaaggacuuuugggcaaaagagaaaauauaggcuaaaguucaaaaaucucuauaauguagugauggugaagacagcagcaggauagaccagaugcaaggacaacagugaugaucggaauguucuucauaguaagacacugggaguguuauuggagguaacaaaagcccaucccuggcccggggucucugucugucucugucucccccugucuuucucugucucugucugucucucugucucuguuccucucugcuucucugucucugugucuguuuuucccucuguccucuaucucucucugucucugucucucucugucucugacuuucuccccugcuugcagaucuguuugcaaaagcucucagcuacugucccaaugccaugcccgucugcuucuugccgugaugacuauggacuaacccccuaaaaggguaagccagcccccaguuaaauacacucuuuuauaagagucgccuuggucacggugucucuucacagcaauagaacaguaacuccgucagugagugugcaugugcuaugauguuuauguucacguuauguuuaaaaugugaagacugcuguguuuaagagacccaugggauguuguuuuagcuuguaaguuuguauaauguacccugucgguuaacuugcccaagauggaugauuucccgaauauuugggcuauuguugaaacuguuuaaucuuguugaguuuuuaacugcucuguuguucuuugagaauaguagucacaagacgagccacugguucuaccuuuguaagaaaauucuugguugcucaaguuaauugagguaucuaagagaaaguuauaaagguuaagcauagccagauaauauucuaaaauaaauuaauuacauuuccuugugaaguggacuggggguauugcucagugguaguguaguugcuuaacaccucaaagcccugguuccuaccaccaucaccaaaagaaaaacuacaaaaagcauaaaaaaaaagguaagcaaaguaauguaaaguagagacuagguaggugucugugaggugcuguguaugucugugagguacugucugugucuguaaaguggggucugugucugugaggugauaucugugucaaugaggugaugucugugucugugaggugaugucugugucugugaggugaugucugugucugugaggugaugucugugucugugagguggugucugugucugugagguagugucugugucugugaaguugggucugugucugugaggugaugucugugucugugaggugaugucugugucugugagguaguaucugugucugugaggugaugucugugucugugagguggugucugugucugugaaguggugucugugagguggugucugugagguggugucugugucugugaaguugggucuaugucugugaggugaugucugugucugugaggugauguaugugucugugaagugaugucugugucugugagguggugucugugucugugagauagugucugugucugugagguggugucugugucugugagguggugucugugagguggugucugugucugugaggugaugucugugucugugaggugauuuuugugucugugagguggugucugugucuguuagguggugucugugaggugaugucugugucugugaggugaugucugugucugugagguggggucugugucugugaggugauggcugugucugugaggugaugucugugucugugagguugugucugugagguggugucugugucugugauguggugucugugucugugaggugauguaugugucugugagguagggucugugucugugagguaaggucuguaucuaugagauggggucugugucugugaggugguaucugcugugucugugagguggugucugugucugugaaguaaugucuguguuugugaggugugugagguagcucagcugguaaagcacuugccaaugaacugaucaccuggguucaaucccaggacccauucagugcaaggagagaacaaagucuuagaaguaguuuugaaaacucaaagucccaaugacacacuuacucuaacaaggccacacuuucuaauccuucucaagcaguuccacuaacaggaccaagcauucaaacauuugagccuacaggaaccauuuugauucaaaccaccacucacauuaaauaaacaaauaaauaaaugaauaaauuuuuuaacaagugcuuuuuagaaagaaacaaagagaucugcacaguaaaaggaaaccaguaaagcgagcuaauaaguuaaacuucacaaaugacuccauagugagugugcucgcacgcacgcacacgcacacacacacacuuucuuugcuuucuuuucuuuucuuuucuuuuuuuuuuauuaaaaaaauuauaggggcuggagagauggcucagugguuuaaagcacuggcugcucuuccagagguccugaguucaauucccagcaaccacaugguggcucacaacuaucuguaaugggaucugaugccuucuucugaccugccuguguacaggcagacagagugcucacauacauuaaauaaauaaaucuuuaaaaggaaaaaucauguguauggguauuuuugccugcugguauguuggugcaucgcaugugugccuggcgacugugaaggucagaagaggguguuguuuuuccggaacuggaguaacaaaugguauaaaugccauagggacacugggaauccaauuuugguacuuuggaaaaacagcuggugcucuucacugcuaagccaucucgacagccccuuaauucuguuuaggaaacaaggaugaaugacaucaguaccuucaccugauacaaacugugcaguaaaaacuaaagcuauaagccaaaaaugcauggauuuuuaugcaaaauuucaaaaugauaaauuugugcuuugcugaaccaaagaaucugcuagaccucagguuccugggagcagugcuuuguguuguauaauagcuuccucugagauuaaaccaguccauccugcagggaagcucuuuaaacaagaagauaaacaaauccaaccagcuucaggaagucccugaaaccaaccaguguggggagcggguguggcggcagucccaaaggcgccagggacugcagcuaagucauaugacuugcaccugacuuccucauauagacacaaacaucuugagugcugcgcagguguaccaggauacaggugaauccaauuugguggagauuugccccugcugcccugauuagcugaagcugcaugccuggugagguggcguggccugcugugcguggaugggaacugagaguauaaaagagugagaggcccaggguucgggggagauauaaaaacaagggagauauaaaaacaagggagauauaaaaacaagggagauauaaaaacaagggagauauaaaaacaagggagauauaaacaagggagauauaaacaagaagaaucaggacugaauaaacgugugcagaaggauccuguagcagcgucguucuuccuggccaguugagcgcgcgcaacaaguggugccgaaacccgggacccaggacaaggggaaaagaaacaucuucagacacgagugaagacccucugcuacagggaggauucagaacugcaucacggggaagaagggguuaauaaaaguuccuguaaaacagacuguugagaaggauccggcguggauucagaacucuucagcuggggaacgguacugaugaagagaaagaagaaagaugaagacugaauaaacugcuguuagaaggacugguggucgcgucguucuugcuggucgagagcgggcacgacaauugguggcccguacggggaaccgacucccccaccgaguucagaacuuucagcagucagugguugcuggcaggguaaguucacggugagugaaacuugcgaccccaggaguuuaggaaggaccucggauaaaauagaggugagcauaaaguugccaggaaguaggcacaaaguaacccaggaguuugggaaggaccuccgauaaaauagaggcgaauauaacguugccaggaagcagguacaagguaacuaaagguucauggcuuugggacaaguuaagguucacgguuucaggauagauuaaggaaguaugauaaccucaguguagugaucaagagauccucgcuguguaguuaugcuuuuuucucccauugacccuuuguggguaggucugauaguuuuggucuuguuuguucugauauauggacucuguuacuguuuguguguagaggcagucaagacaggucagaaaauccuuacagagcaacaagaaaguaugucggaagaggagaagggcuuaaaaagaaaaaggaaaaagaaaggagacacaguguuaucagguggacagaaaggacaaaauaaaagagccgagguggaggaggaaggcgaauuagcuuuugugccgccucccuaugccuccucagcagccaccuguagguggaccuucugucuggagauuuggagaggaucgaguagaucagguguugacaugggcgagagggucuguuuguguguuuccacaggaccagacggaaccucuuugggugccggagagguuggugagaugcugcaagaaugaggcuccugauccaguugccccuguggaugugguggauggucccacaagcacaaaggauggagccgagaugggagauccuuucgguauuccagaagccgauaccagcucgacaugacauucaaaauuuuuccacgcuuuuugaucccugaauuccccuuaaagagauagccccucuggcuaucuaucccuugcuucagggaagaugaguggggaugagagcccugggauguaugcuuguuauaguguguguguguuuuguguuuggcacauguguuaggugcagagugugcggcccgcacuuucgccaugguagcguaggcuuuugcugcaguagaggcgggacaaucuccucagauucgguuugccgcucuaaaagaaacuaugcugcguuaugccguggggugcgaggcuaagcacugcacagaggauagcuugcuguuggcauccuguggaaggcaugucugauugcaugaagguucaguguccuaguucccuucccccaggaaaaacgacacgggagcuggccaagaccucucugggugaugagccuaagggaugguuuuguguagggccccuaugcuugcacacuggggaucagaccucuaccuucacccaugaggcuugcuugcagcaauuaagaucuggccauagguuaauuaacauccuggccuuuugaugcaccugccacaagcaaaacacaaucuccccaggaguggcuuggcaugauagagagguagucagugauaagacucccugggcaugucaccaaccuaagacagggaucaaaccaaugcuguuugucacccaaggacggguaaggggcaugguugcgaggggcuaucuacagacauucucucugccaaaaaagaaaaaagggggaauuguggggagcggguguggcggcagucccaaaggcgccagggacugcagcuaagucauaugacuugcaccugacuuccucauauagacacaaacaucuugagugcugcgcagguguaccaggauacaggugaauccaauuugguggagauuugccccugcugcccugauuagcugaagcugcgugccuggugagguggcguggccugcugugcguggaugggaacugagaguauaaaagagugagaggcccaggguucgggggagauauaaaaacaagggagauauaaaaacaagggagauauaaaaacaagggagauauaaaaacaagggagauauaaacaagggagauauaaacaagaagaaucaggacugaauaaacgugugcagaaggauccuguagcagcgucguucuuccuggccaguugagcgcgcgcaacaaaccagguucacuaggcuccucccugccggaguaagcagagacaagcugcaaaagaagagagugucagagagcggagcugccaagaagacucagagcugaccagcuggccagaagcagcagaaacuagccacacugccuggacgaaguucaacccagcuugugagcuaccagccaugcugagugggcuuuggugaaacagcuguaaggaacuccaguaaaaugcaucaguuuaccaaauuggacuucggcaguauccguacuuugguaugccuaucugaggcaaguaggaauguguuguguuuccccagggaaaguucgucacacgacagcuugggauacaagaguacuuguguuuuuauuugugacuuggcugguuuuguaugucaacuugacacaagcuggaguuaucacagagaaaagagccugccuugaguaaaugccuccauaagauccagcugaaaggcauuuucucaauuagugaucaagggugggagggcccauuguggguggugccauuccugggcugggagucuuggguucuauaagaaagcaagcugaggagcuggagaguuggcucaaugguuaagagcacugcucuuccguagguccugaguucaagucccagcaaccacaugguggcucauuccacccucuucuggagugucuggauacaacuacaguguacuuacauauaauaaauaaaucuuaauuuaaggggaaaaaaaagcaagcugaacaagccaggggaagcaagccaguaaguaacaucccuccauggccucuguaucggcuccugcuuucugaccugcuugaguuccaguccugacuuccuuuggugaugaacagcaaugugaaaguguaagcugaauaaacccuuuccucuccaacuugcuucuuggucaugauguuuugugcaggaauagaaacucugacuaagacaguuuguuugcuuuguuuuguuuguuuguuuggagagaggauuucucuacgaguucaauuuccagcaaccacaugguggcucacaacugucuauaaugggaucuguugcccucuucugguaugucugaagacagcaacaguuacucauauaaauaaaauaaauaaaucuuuaaagaaagaaagaaagaaagaaagaaagaaagaaagaaagaaagaaagaaagaaagaaagagaaagaaagaaaugauaacugugcagcugagaaaugcaaaggcacuaacacguucagcaagaucacagaucuguacaaaucuagauaacaaauuauaaaacugacucaagcaagagaaaugacucagcagcuuagcagacuacaugcuccaauaaacacaccagcagcuucauacuacaaagaauagccagcuagaugauuagcccacagucaggauccauuuacaauggcaacagagaagauaaaccaucuuguaggaaaugagagccagaaacagacaaagccacugugaggaaaacauucugaaaacucaaaagagcuaauguaggagauaugaggaugaugucauuucucuuacauaaccagacuggcggcaggaagaugugccucuucccaaguuacuuuauuaaagaggcuuuuuguuugguugguuugguuugggggugucugggggaggguuguuuugguuuguuuguuuguuuuggugguuuugguaagacaaucccaauaaaaaugccaacgaggcuuauugguuuuggagcuggacaaguuuaugcuaaagcaugcagaaaaagaaacacgcgaagacagacagggcauuguaaaaacuacaugggaaacuaguuuugccaaggauugaaacacaguccgaagucccuugaauuagaacaauguaucuuggacacacucacaaagccacugacuuuaggucagcuagggaggcggcucugcggacauucacuggagcuccugucgcuggagcaaaacaacuuuccaauaaacagugcuaacaaccaaguagucguuuggauaaggauaaaauuagauccugauguuauaccacaugcaagaauaacuucccaaugagucaggggacuaaagaacaagggggaaaaaaaacggcugaaacucucuuuaucugaguauaggugaaaauucuaaguaacccuggaacacaauauuugaaauauaugugcucgaugaauguaagaaaugguuuucugggggucuggggagauggcucagcaguugagagcacuggcugcucuuucugagacccugaguucaguucccagcaaccacgcagugccucacgaccucacgaccaucugucuaaagacacugaggcugggguggagccccuugaagcacagagacacaucaacucuuccacuuuucuuuuaagagucacggcugcuucaggagcagcauucuggaaagauuacaguuggaucugcagugaccgaugucucaccuggcacuucuguccuguuaacugagaccucuuugccugaagaacugggcaaggcguuccaccuuuagaaaagagcauggaauguuuccuacagaggggacucaugacggauuagcugaggugaguuuucaguaauccugguaccuugacgaugugaccgugagcuggcuggguggugacuccaugcagucaggucugcuggaaacacagauaccagaacucaggugucaaaaggacuuucacugccgugucugaagagucuccuguucuuccacaacagcuuuccuuaugcagcucauuagugaugucaccauggccucagcauacugugggaaagaccaaagagaacuucucaaagcacauagaucaggcagcaaagcauaaagaaaacagacaggaagugaguaaaaacagacaggaaguguguaaugaaaacaaggaagagacauagaaaacaagccaaauccagaugaguucuuggggggggggggggaggagauggcucaacauuuguugcuccugugcaggaccuguguucaauucccagcauccacaugguggcucaccacagucaauaacuucaaucccagggaucugaccccucuucugaccccuggcagcacgcagcacccacguaugugaaagaaugaguuguuggucauaaauauuggaccacacaccagaauccuuucccagggaagaaauagaaaucugagcauuaccucuucuguugauggucaagacgugaaaagcaggacuuggaaucuaauggcgggaauuugcugacgaguauggauugauuucucuaagucagccucagaauaaauguuucugggaaccuuauuauaaaaaauagguugugcgugguggcacaugccuuuaaucccagcacuugggaggcagaggcaagccaaacaaaaacaaaaacaaaaaaaccccaaaaaccuggagcauugauaacuauuuuaucuuuacaguuggcaagcagggcaaagggcagaugucuauguuaagccuacagcucagaagcacaggcccuugccucucuuauguccagagcuaggcuggcuggggcaagcuguaucugcuccaguugccgagcacagcugugcgugaacuaacugccucccacagaaacaccaacugacuugaugcccuguggaaagaaucgccuggguguggagagaugacaaaacaccagacuaugaauauugaggucugguccuggcuccgccuagcuuugaucuuacuuaggcagcuuccuagcauggcacccuuucugaucuuccugaaggacuuugaaccuugauaagcaaaugucuaccuuguaucucucggcugcaguuauucuaaucuuuaauuucauucauuugauaaucauuaagaagaauuuuuaucuuggaagaaggaggugaaaggagaaagggaaauggggguuaggugugaucuacauauauuacaugcaugcaugaaaauaucauaauuaaacccaauuuguuugcaauuaauaaagaccaagauuggcaugguggcauauaccuuuaaucccaguaguugggaggcagagggggugcaucucugggauuucuaggcuauucagagcuauauaguaagauacuuucucaaaaaauauauauagggcuggugagauggcucaguggguaagagcacccgacuguucuuccaaagguccagaguucaaaucccagcaaccacgugguggcucacaaccauccguaacaagaucugacucccucuucuggugugucugaagacagcuacaguguacuuacauauaauaaauaaauaaauauuuuaaaaaauauauauaauaaaauaaauacaaauaguucuagagugauagcucgaucaguaacaguggauacuuacaagcuugaggauguggcuuuaaucucccaggacccaugucagcagccaggaauggugggcugggccagagcugcggaggcagagguuugggagacucugcugaugccaaguuguauguaaauccgucccugggaacugaguuuaugaggucuuugugagcuuggcaugcuacaggagcccuucguggaaguuugcaugaucuaaaugcccaauugcuaauuguuuuguuucugaaguucccuuaagucggggcacauucacaacuacuguaaagacugauucugaaauugccagaaaggggaaguuacauuauaaacacuuaugagccaccauguggguacuaggaaucgaacccagguccucuggaagaacaggcaguguuccugacauugaaccaucaucucuccagcuccaaggggggcuccguucuuuuugucuucagua

SEQ ID NO: 4877 - RNA, 31044 nt, Mus musculus
ucgccgggcggcggugcgcagacgcggagccgagucccgcugggccgcagccgguggccggcucgccgugggcccguucccggcucuccacgcucgguuccucucgcucugcggagacuggaggacggaccccgcggagcuguggcggcagaauggcgcagaccgccauguccgagacuuacgguaagacgcgcggguuugcguacguguuuagaggggcaggccuuggggucccggaauguugggggccggggucagggucuccagagccggugucuagaauaucgagauauccugcaaaccucgcggugucaggaaccaggcagagauauuuagagucuugggugguuuaggguuggcuugggauccuaguaaugucagcagcugggauccugagaaucuggguguuaggagccagguggagacacugagaauccuaaagugucagcggcugggagggauccugauauucuuggggugucaaggucgagcuggaacuugagaaugucuggguguuucaggcuaggcuggaaucuugaggcucuagggguaucaggcgcuggucuggacucucuggccagcaggugcccccugcugugauucuaccaaguucccucccgcuuugacccugguuucacucuacauuuuccuccuuggauuguuuaaaucucucaggguugcaggagccaauuugucgucgauucuuguccuccucccugcagcaccaaccgcagggaugaaggcucagggccacgccugcguuuugugucucuaggggcaggguugugggccucgggagggugggguggggguguuggaauuccuuucuuugcauugagauuauaaugaguuuuaaguggaugaaugcugucucuuuucuguagaccccuggccucguguauuuucccucccucccucucuccucccguccuccccuccagauaugguugcauuauauuaccuuuauaaauacaaauauaugguccucugaugaccacaggccuuggauauggagacaugauuuuuucaucuuuuuuucuccugcagcacccagccauucucaaugcacgugcugggugcucccccucccccagucgaggcaagaauaaacaaccacuacuauguaugguuggccugugccugccagucccucacgagacuugaaacuuugacguggucugugcucgucguccgaaggagggacucgcacggaaaagcaugacgaucugucagguuaucugcaguuugugccccugcuuccuuccugccacaggguggggccagggucuggccuggaaggcucuacucgguguacgagugccauggaaacuuccccaagaguuugcgguccaacgaggaguggauuuuuaaauucagcugugaccuuaauggauaaacaauuaaaaaccaggcagcagguucugaaggauucagcauggcugugugagaaagagcugaccuagauggguuagagaggggcaaguggacaggcagaccugggauguaggccugggaguguggauugggcauccgggcauccgggcauccaaagggugaggacucaguugaagaacuuuggaguuugagagggugggacgcuggaaagugugucaugaggcacacagcagccugguccacucucuccugguaccagcaaucaucucuuccuguggccaugaagcauaaugccugccccuguaaguuuaagguacucuccagggggugacuggcuuugucagggccacagguggucuacacaugccucugugugguguguguuucuucugcagaaagccacaguaagaaaccccuccagcaaaauacacccuguagcugauugucauccuuuucuuugagucggguaaggagucccagggcgggggaguagaguccucaaagaaagcuucucacucgaggugguggccaagugaggcauggggacagcacaggaagcagcuuuaucccuugguucucucaggcaaugguagauauaagacugcacacacacacacaccuugcuucaccucagauacaguuaauuacgguuugcucaccauagcccuacugauuaaacuuugaucaugaagcugugacuguuaguguccuuucaggggcuggagauaaaacucaguggcagagagcuucucuaagcaggugcaagacaccaggagccacacacaaaaugcgugugucuguuuauucacuuacuuauuuuuauuuuaugugcauugguguuuugcuugcaugugugcucgugagagggugaucuuggagucauagacaguugugagcagcuacaugggugccuggaauugaacccagguccucaggaagagcagucagugcucuuaaccgcugagccaccucugcagcaccuguguauauuuaucucuucccuuauuucaagguauuuuccaaauaugccuuuaguuucuuguuuguauguuuugagacagguucuuuauaguuacagauggcuuagaauucaccauguagcccagguuggccucacacauacccugccucugccaccugaguccuagguuuauagacaugcauccccauuuccaggguuuuuacuuuuuaauuaagucugaaucuaauauuugcuuucagugggggaaccauauguguguauauauauaauauauuaauauauaaugcauuacauauuaauaaguagaagcuuaucuuuagaaagaggcacaaucccuaaggucccuaaggcuaccaccuuaaaagucacccaaaaucaagacaaagacuguuacucucccuugucauuggcuguauuuacaaaguauuguucccccaaauuaaaacaaccagguccgcuccuuccggacauuugccuguuggcuggcggaggaauguuugccuaaccuuuaagcuccuuguguugggaccagguucucuuucuucugugaaagagaggcuuugcgaagcuugguggaaguugaugcaaacuagggggcagugcuucuggcuucugcucacugcugcuaacugcuguagaccggcugcuaccccucgcacuggcugagggaugcccagcaccuucuugacccgaagccccaaacuccaugaucacugcuucagaucacauaguaccauagugcgaauuggaagguucaacagguaggcuucugguuaccuggucuccuugcuucgacugaggcaccuaggguguuaguaaagcauaccuccuggcuugccugugguggguuucuagagggggugugggggggucucuguacaaaucaacagacuaaucgcuugauagacucaugauccgauguuauuauugccaaccugucucuucuuguacgcucuuaguucuaucuguuuccuggccucuauuuccaucuucccugugaaacuaagcaaaacaaauccuccucccuucagcucucuuggucccagcaaacaacgcggacacugaacucaccaccugagcccuccugucuagggaggggguccuccuagcuauuguuagagauacagcgcacuguguucagugagcaccagcagggucaccccaaugcuaaccccauugucagcagccugagacccaagagcuuggaaacugggcuggagagauggcucagcgguuaagagcacugacugcucuuccagagguccugaguucaauucccagcaaccacaugguggcuuacaaccauccauaaugagaucugacacccucuccuggugugucugaaaacagcuacaauguacuuacauauaaugaauaaauauuuuuuuuaaaaaaaaggagcuugaaaacuauccuuaaguuaaacuaaccuuuaccaaacugcugcucacagaaaucgcuaagcagcguauguggugggaaaacgccagggagcuuuuuuuuuuuuuuuuuaaacgucaagugcuagaaaagacuggcauugagggagaauuugagacaagugugaacgcacuaugaucuaugccaugugcugugggaaugucuccugagacagaaguccgcucauguggcuggucccaugguugcuucugucauaguuuauguaugcaacauagacuauuucaccuagaaaaggacacacagcacucugaugucggacaugcaaugcuaagaucaguguuuucugcccauuauucauccuuacucuugugugugugagguuucaauuguguccuuaaagucacacuuaauuccuagcucuggaccuguaugcaaccuuccuuggaaugucuuugggaucuuugggaugucgauugaagguggagucgugcuggaguacuaugucccaaacucagggacucuguccuaaugagaccagggaagccuggccacagacacacccaaggagaguagguugugguaaugagccuuggguuggagagauccagucuccagccaagguacccuagcacagauggcaacuaacuaccaggaagaggacgaggcaggaagcacccuucccugagccugcagaagcuccaucccugccacaccucacgaggccucugguacuuucagacagcaaaugucugccacguuaauccagcugacuuagggcccuuugagaugcaaacccuuggaagcuaacucacaagacauagacaucagaagaugauuccugaagacagguaggcuugauaaggcaauuuggauugacaaggauaucccaaauuaaaauuuguuuucaaaagaccuucauugauaaggcaauauuaauuuucuguuagaagaauuaccuaauugccuuaagucacaacugacaacacauuuaaacaguucaagcagacaccaaaaaaaaaaaaagaacauuuauucgauucaauauuauuuuuauuuauuuuuuugugaguguuugguuuugggcuuuuucaaaacaggguuucucuguguagccccgacuguccuugaacucacuuuguagaccaggguggccuugaacacauuauagauccaccugucuguauguucagagugcugggauuaaaugagugugccaccaugucaaaguuguauuuuucuuuuucacauucacugaaaacuggugaacauuucaaggagcagggcuggggcugaggugggaggaacaccugugaucccagcacuuagaaggcagaaagagaggaaucagaagcuaagggucaucuucugcaaggugcaugugcaugcgugugugugugugugugugugugugugugugugugugugugcgcacgugcaugcgugugugcgcaugcgugugugcgugugugugcgugugugugugugugugugcgcacgugcaugcgugugugcgcacaugugugugugugcauugugugugcaugcgugugugcgugcgcaugcaugcgugcgcgcgcgcguguguguguguguguguguguguguguguguguguguaugaauaugcuacaugugugggugcaucugaucuccuggaccuggcgucacaggcaguugugaacuagguacuggauugaacucugguucucuggacgggcaggaaguguucuuaacuauugagccaucuuuccaacccugaacauuucuucgaaaugagaaaaggcuuauuguuucuggaauuucuucucugaagcucuccgaggggaguggucaaacuugagcuggucuguuuugaucauucucaguaauucuaggagagcacugcccaguuagggugguuuguuggaagccuuuggagggcccgaguccuggccuauugccuuaaccccuguugccaugacagaauuucugagaugggacaauuuugcuuguuuguuuguuuguuacgauuuauuuuuuuuugugugugugugucugaguauuugccuggauguaugcgaauauuccgugugugccuguugcccgcagagcucagacgaucugaggggaucuguuuccgcugauggacugucuucugugcauuugaaggauaugugacauuugcuacuuggugacugcaacugugcaguaaaauauaaaaugacacaagacacauauuacaggguagaacugggugucaugggcauugccaaugaccccaacaccucugaaguagagcuaggaggguaaccugggcuccgugaaacccugucuuuaaaaaagauaaaagaaaaggaaccauguuauauaacaggacauaagggaaggaagcaugguguacuuauagguuggugguugguugguuuuagguuuuuuuuugcucuuuuuuuguuguuguuguuuuguuuuuugcuuuuguuuuuugaagcuugucuacgaguucuaaggagcuggguguguuggcacagccuuuaaucuuagaacucccagggcagaagcaagcagauccagccagaucuacauagagacuccugucuagccagggcuucaaagugagaccuuguuucaaaagcaagaauuccaaagguaguuuauguugugaaagacucggucaauacaaauuggugugugaugauggugaauuugacacguacugcugcgcccaaacaagucccgccuccaacagcaugucacagcacccauuggcugagucuuguggcuguuucuacuuccucugguuuuguuuauuuuuguuguuacuuuguuguuuaaaggcaggguuucauacuggagaaauggcucagugcuuaagaauacuugcugucuuccagauaacccaaguucaauucccagcacccauaucagguagcucacaaccuccugucaguccaguuccaggggcacccaacagaucuggccucuacaggcaccauauucaugucccaccccaccaauacacacgugugcgagcgagcgcgcgcgcgcgcgcgcacacacacacacacacacacacacacacacacguaugauuuaaaaaacaaaaagacaguguuuuauguagcccaggcaggccucaaacugcuuuguagcccaggcuagucuugauccugauccuccugacuccaccuccugaaacauaugacaagauugagccaccauaccuggccccaucuucucacagguacaagugugcuuuggcuuuuuagccuuauggagucagugauauuuagauggaaaaaagggacacuauucauaaagugcucauaaauuaugaaugggaggucuauuuuagagagauguuuaucauuuucuuuuccaacauaaauuuuuaaucaugcagaaaagcgaguggagguuuaaaaacaaagcauuuugucauagcuggcucuguacguagagugugcauuuagcagccccccuggcuucuggugugccugcuauagugguuugcuggaugcugagaaagaaaacgcaagucugagcgcaguccauggguccucugcucucgcucaggaucaaagucaaaccuucuuucaauauuagaaaguaaacucucgucuuugggaacagaggguccaggugaccugucuccguccucugugcaauccauggacagccagccaaaacaggcuuugaugugaauccauuugagaaacaaugcuuuugcucucagagaagaugaaacaaaaaaagccaaaaauaaauagacacuugacguggaggccugguuuuauuauuguguuugugacagaaaucagacagucccauuguggugguggaaacggaacuaauaaaaccuguccuguagaucgaguuuccuggacuggggagaucacgugggcaccucauguagccugaaaauaggcaaaacaagucucccugccgaggacacaggucuggagccaagggcccugccaagccuuagagcagagcgugagaggaccugguucugcagccgccagcuucuggggugcuccuggagagacugugagagucagaugggggcgggguggccgaagaaguaacagggugacaagccaggccuuggguacugauccaggggcugcggggcacauuugugcucaggaugcagcucagaaccccaguggagaacaccagugcagucagucgcuggcuucauuguuacuguuugcaggaugacuccccuuugucccagcucaugacaaccugguagccucucauucaccccggucuccaacgcccuguguaggcaggggugaccuucaacuucugaggcuccugucccuacccucugaaugcaagauuauaggugugcaccaccccgcccaguuuauggauacuaguuaucaaacccaguguguuguguagguaaggcaggcuugcuacagucauaaaacauuacaaauguucugguccauucuucaggaacaguuccugcuccuuaguuaagagugcucauggacagacuguuucuaguuguugccaggccucagcuuucaggucuggucgaaacccuucugacaugaaugaugguccucugaccacugcuacacugaggacuuucccaaccugagaagcagguaugugccuuagucaucuuaucuguggaugggagugaagccauauacuucuugcccaguguacugauacccagaacucagacccacuaugagauaugccuagaucccacaugcagcuggaugaccaagaggcuagccuucaucaccccuacugaugugaccagauuuugucgacuaacggugagccauauggauccaaggcuaacuaugcucaauggugggagugcacagugguaccucagacccauuaggccucuagagcauggacacggucccucuguccaguauacuguuuggaggacacaugcuuucugugugagccugugguggccugaucauagaacucaucacaauaggaggucagacuuuucaaagacgaugagaccucaagucccugcccucagugggucaaagcugacaccccaggagccagcuccccguaaaggaagagcugagagccagcugacuguucucuguguggcaugugucaaggcaccucaggccagcccauugacucagccuccagucaagcuagcuguucacacugggugggguaacccacaccuguaaucacaauacuugggaggcagacgcagaaccccaggcuacauaguaagacccugucugaaaaggaaaagcuauucagcucucucccucuuucucuccucucugucucucuuuuuaagugaacuauucugaaaaucaucuugacagauuauuugcccuuguuucuuuauagaguuugccagguuucauccuuccguuaaccuaaucaacuucaacagucuacucuuuuuuuuuuuuuuuuuauuuauuuauuauauguaaguacacuguagcugucuucagacacuccagaagagggagucagaucucguuauggaugguugugagccaccaugugguugcugggauuugaacuucggaccuucgggaagagcagucgggugcucuuacccacugagccaucucaccagccccaacagucuacucuuuaauacacuuaagauuuguuccugacugagggcguccauccgaauugggcgucguuaucuuuagcucacuguguccugcacuggcgcugaccucucuccuuuugggcugccuuucccucaggagggcagcagacgcugcauuuuccugaaauacgcgugcccuucaugccgagcccugccagcucuuuagguuguugcuguccgcagacauuugggcuagccgucaucagagucaucugcuggcuaucuuaucuugcuuuguccucagcuccugacugaccuggugacugaugcaucuguacagaggacuggccaguaccucagccucacagcugugugggaucauuucuggccaccuucucuucuccugcuucagguguucauuucccuggcuuuacucugggugcuuucugcccccuucccaucccugacugcauccauccugaggucagaguuccuggcucuucaauaagccgugguccauacccuucccagauaccccgcccuucacucccagguccagagucugcauuugcugccacugugucucuguguugcuagaagaugugcuuugcaacauccuggcccagucuucuaccagaucugcugcucuaaggcugcaagcuuuguaggggcugguggucaggauucugccccaccucaagggcacagacuucaccagggggccuuucauggucagccugugagggaggcuacuguggccucaaccuuguuggcucacaggauuuuccagcuggaucugccacucaguaucucaaaauagacucuccuugcauccuuugacaucccuuccauuggucuucacaucucaaacucuaagcaugaaagcaaggaagcccuagaucuuccauccugccuacccaaagccaagcaccuguucgaccagaagagggacccuggagggugcacaauucaagggccuccaucccucuauggccugcggaaaucucaacuucaaaguggcaaccugaagggaacacuaagcaggcauuguagaacuuguguucaaagcucucuacugugaggcuggguguccuggaagggggccaccauguuugugucuccuuacugcuuucuccuuccuuggaggaagugggcagcauuccugggaggaucaggucauugucuccugaagucuagugcuggcagagugcagguggugaauacacgcucucucucucucucucucucucucccccucucccucacucucucucucucucucacacacacacacacacacacuugcaugcacgcacacuugcacauuguggcacucccucaucuuggggguuggacauccaguuucugaucaguuuuaucuuagcaucgaguuccacuacgagcucagaaaaagaaaauaacaggaucccaagauacagaguggggccaugaucugagucugagaacaggaccagaguuaaagcaaaauggggucacagcgggcagagcugcacaagcagaggcacuguugaccaagcaagccugaggucgugggcgcuggcugccgagcacagugugcaacgccaauccgucauuucuacucggccccgacugcagaccguuccgugccuugguucaugguccugcugugggucugcugaggucuggggaggagauggggcacugaguaucauguccucuggcugcugugacuuuuucugcuccguggaaggguggcugugucuacgcauggcugcugauugcuugguagcuuucccaucauccaucugacauuuaucauauggaaaguuaaaagcacgcuuagcacaaggccccauuuuagcauuccuauuuugggauacagacucuucccugccuucgagcuaauuccucccugaagaaaccagcauuaccugugaguguaagagccgugggauuuuucaagaggauccuggaaggaaauaccccgagaauggaaauuuaucccaccaugacaugauuugggaggggacagagcucucucucucugucucucucucucucucucucucacucgcucucucuucucuccagccauguaauaaauauucauaaacuauaaaauucuucaucucagaaccccugugcuguuccuuccacaaccccuugccacauuagcaaacauaccccucugcucucugccuccuuucuguugauuggccgguaggugggugggugggugggugggugggugggggaagguuguuucauguauuguuguuguugguagggucucacagaucccugguuagcuucuaaagccuuaaauagcugaagcgaccuuaaauuccugauuuugcugcauccaccucugagugcugauggcugucccaucccguucucuuuacagcuucuuggugauugcucgggcacagcaucgugguacucggugucacugucauacgcuguguagugucauugucagauguacagcgucauccgaugcacgguguuauuauuuuacuagauaagugaacgguagaccccuuccuugcuuuccuguguaucugccuaccuuccccugcucuuaaugucccuugccuguggauucagcuguguggcacaugugugcagugccuuuggaggccagaagagggcaucggauuccccagaagguuguuaccggccuuaggaguuccaggaacugaacacugguccucugcagaaggagcaaguguucuuaacccucagccgucucuccaggcaccauuuuguaucuccugaacauccccacuucucacuaagucaccugaacguccccgcuucucauuaagucauucuaguaggauuucuacaaucacaucaggaagaguugcccuuuuccuuucuuuuuuuuaaagauuuauuuauuuuauguauaugaguacacuguagcugaacagaugguugugagccuucauaugguuguugggaaucaaauuuuuaggaccucugcucauuccgguuaauccccugcuugcucuugucagcccaaagauuuauuuauuauuauacauaaguacacuguaguugucuucagacacaucagaagagggcaugagaucucauuucaggugguugugagccaccaugugguugcugggaauugaacucagaaccucuggaagaacagucagugcucuuaaccacugagccgucucucuagcccacgaguugccauuuuccuaaagccuccauguguaguuuagagcccagaagaaggaaggccuguuguacuugcucauaacuauguuaucagacuccaaaaacuugugacuuuugaaggaagagggacacugggguaaguagcugcugcagccauggcucugcccucgcagcuaggaucuccccaugucccugagggagucuuccuuccugcugaccgcaccacacccucuguccaccuuguacucggguaugcaugcagcaacuccccuccaugguucaagguuauguucauccugacaauuucuuugguuguugcugcuguuuaucaucacuguguguauaugcauguauauguguauaugcauguauaugcauggggggagggcauauaacguguuuccguauuugcaccuuuaccuggacuccgaggauuagacuugggccaucaggcuuagacaggaagcaccuuucucugcugagccaccuuguuuugaagcagggucuuacacuguagcccaggcuagccuuggacucuuagugacccucuugccucugccucccaaguacugagagcccaguugugaauuaucauacucagcugauuccuuuaacguuaguguucuaaagaccucagucacugugccuuuugguguuaacuuucucucacagauguuugguuucccuuuguccaccucaccuuucaggguccccuuguguguuuguuuuguugguggugguuuggugugaugagggugugugugugugugugugugugugugugugugucucgcuuuguugccugcugguaaguuuccuacaguuuccacuccacucauucucccuucccugucaucuguuccucgaucugccuugaguacugauuuuauuguuguuuuuccaggccccuguacauggcaggcaugugcuaccaccuaguccacgauacaugcccagcccucuucucucaguuuuuaauuaugaaacaaaguuguccaggcuggauuugaacuugugauucucuugccucauccucucaaguagcugggugaaaagccuggagcaccaggcucugagagaacuuauguucagugguuaucauuuuucuucccaggccaucuagacuauucgacccguucucucaagccuccuguuccuucauuuuucacugugucuucauguuauuugccauccugauggccccuuaccaggcugcucuuuggcagggccugaaggcggggucugcacaacagugaggcacugagguacauccccaccccagugucccuguucucugugugugaacgccaagaacuucacacaaacgggaucauuguuuggcuuaugucucuuaucauaauguccucaggaggaguuuuguaguuuuugguugcaaacuuaucucagagggcugugugugugucggggugggggaaccucugcgucucuaguaaaggugucguccuuccgaagcagucugcauugcuuucgggguuuuuauuguugacuuccugacucaggcuuuacuaucuagaguaauuacaguauuggcucauaauucauuuuccaaggggacaguucccauccuccugagaggagcgaguggguuucccaguugucuggguacuccagaccccagccccaccccaggcugcaccugcacuguuccagcaaggcaccguuacuccuggcuuccuaaacacucuuaccauucuuggauauuuggccaaagugauuucagacaaaaugcuuucuguuuauaaucucuuagcuuucugagcuuccguguucuugcauugagaucauguaucuuucccguccuuucuccaucacggcacacuaaugugucccccucuggcccggcguggcaaugguacagucugguacagacgguaguuuauggaggauaguucagcaaaucugaaccaaaguccaugcucagcuacgugaguccaagguccagagucggggauugugugcuggagucuucagugucacaguaacucugccugaaugucgccagccucugugccuucucccaccacacucaaggcaacaagacacccaacauuugauucuuuuuuuuuuuuaauguucucuuuacaucuuauauaacuuuauuuccuaagagaggagaaugcugaacaaagacgaggcaucccaguucccuuagccuggcgaucguaaccaccucaucuucaguuucuuggggugaaaaugcuguuuggugagaaugauuaggcuugguuuuccuuguuuuguuuuuuuccccuguggauaggaauacacacacucucuccuuccucucuuucucucucucccuccucuccaccccugccuccaggagaacccaagugcgauuccuccaagcucacguaaaagcugaguguaguaguguaacacacgucuggauccugguguuccuacauggagaugggaggugaagauaggagggagaaucacuaguucucaagccagcuggccugacacaugcugcguuagauaaaaaccaacccugucucaaacaaaauaaaaugcaagagccagcacccaagacuguccuuugaccuccacaaugugugucauggcacaaguauaucugcauucguacguacacaucacauauuucauauguauacuauaaagacugaaauuuuguauauacauuucagugguguuaaaguacacucacacuucuuaauacagaggugaccaccgcacaucucuagaacucucauguuuccaaacugaugcucaugccaugaaaugaaguucucauuucuaucccagccaggcccuggaaacccucacuccacuuuccaucuacuguaagggccucacguaaauagaaucaucaguauuugucauuguaugacugguuuaugucacuuauguccuaaaggucaucugguauagcaaguuagaaacauguuccuucuuaaggcaaaguuccauuccauuguauggacacauuucauagacucaucauauggacacacugcaugaacacauuguauagacacaccauguggacacauuguauagauacacuaagcuuaguuauuuucaucuuauaugugugucuugccuguguauauguaagugcacacugucuguacaccugaugccucggaggccagaugaggaugcuggaucccuuggaacuggaguuacggaugguuguaaacugccaugugcaugcuggaaaacaaaccuugguccucugcaaacacagccagugcucuuaaccaauaagucacuucuccagcccuuacuauaacuuguuuuugaagcagaauuaaagucuguuaaaagauacuuuaauauacauuuuauacauaauuauuaagagaaaagcacucggguagaaagaagagcgaaaucuccaugucaugcuuuaaaaacauauggugagaggcuaaaauuguucuaaugaacuaucccaugguuuucugcaaccauuuggacaucauuggagaccaaauagacguaaucucugagugaugguuauaguucuagaaacugguggcagggccaugucaaaaacuagcagcugucucagcugaaugcaggagagcaggcauggcuagggucaucaguacguggucccauuuggaagaggaugugcucuggagagaggaauacagagcaguucugggcagggaggggcuugcagcagauuaggguuacuucuggaacaaggauccaaugaugugcagcucccagccaugcagaacuagaguucuuacuaaagagauagcaauuguuuggacaaggugguaagugccuuuaaucccaggucucaugugaacaggcagauaucugaguugaagccaaccugcucuacagagcaagguccaggccagcuagaacgauauagcaagauucuguaucaaaaacagaccacaagcuaccuaacacgucuuuaaucucagcacuugggagguagaggcaggcagaucauugggaauuugaggccagccuggucuacaucgugagguccugucuuagaguaggggauggaugaauagagagagggagggagggagggagggaggggggagggaggaguugaagugcuggggauguuggcacacuuauaaugguguacuuaggagacagaggcaggagaaucaagaguucaaggccagccucugcuacaaugaaaguuuucaacccugacuuucugaaacuauguaauuaacaaauuccaucuuggaaaucuuuuauuccaguccuguaaaaagaauaccccaggggcuggagagaugacuuagcaguuaagaacacugguugcucuucagggguccugaguucaauucccagcaaccacaugguggcucacaaccaucuguaauggggaucugaugcccucuuccggugugucugaagacagcaacaguguacucacauauauauauauaauaaaaaaauaaaucucaggagcuggagauguaucugagcagugguucuuacccugugggucucugucccucuggggguccauugacucuuucacagggucacaucaaauauuuauauuacuuuucauaacaguagcaaaaucacaguuauaaaguagcaaugaaaauaauuuuaugguuggggguccccauaacaggaggaaccgcacuauaggacugcagcauuaggaaggcugagaaccacugucucagagcguaagagcauuggcugcucucgcugaggacugggguuugauuuccagcuucuacacagcagcucacaaccaucuguaacgccagcuccagagggaucuggugcccucuucugacuucugcagguacugcacacacguggugcacagacauuuaggcagaccacuaaaugacccugucuguauugaguagugggcaugcagccugaacuugaccucagcugcuuuccaggaaccacagccaagggaugaagugacacucagccacgcguccgagaacucacacguaaacguguagagagggaagaagcaggcuuccaucucuaggcugauuaugcuugcagcugagaaugcguguucguaguggcuagcagggaccaguuuuauucauugucacaguuaauuuuuaaacaucacauucaugaagaaguuaucaaaggaacuguuugaaggagcucugagcuuaucagaagcacagggacgugaaaccgguaaauaaggaaaggcaacgggcgucuccacagaagacucaguuaccucuuuuaucauaucagcaacugccacuucaccauaguuuacgaaugcauucguggcucccuuuaaaguuauuucuuaucuuuucuuugccuuucagauuucuuguuuaaauucuuggucaucggaaaugcgggaacuggcaaaucuugcuugcuucaucaguucauugaaaagaaaugugaguaacaccaggcaucuuaacagcacaugugaaccacccgcaugcacgugcuucugggagagcugggcucgcuggcacacagcacggacuugcucacgggaaagcagaacuuuccgaggggaaauuccuuuuuaaauguaugugcauugguguaucgccugcauguuugucugcgugagggcaucagguccccuggaacuggaguuacagagaguugugagcugccccgugguugcugggaauuguaccaggauccucuaggagagcagccagugcccuugaccucugagccaucucucuggccccaagacuucccucuuaaaaauuuauuauuugaaaauuucauacauguauauuuugaucaucuccucccccauuuccuuaucucuuccccucccucuaggacccucuuccuaacauacccccacccucuagaaccucccccugggacccucuucaaaguaaccccccagcaccccaauaucacggacuuauuuguguagucacuuauuaaggucacuugcauauuuguguggggucauuuacaggaucauggcacaggcagcuuaccaguggcuacaccccugaaucuaaacaacucucccucccuuagcugccauuaacugcuaaugucuccucagccggugcagccuugccuaaugagccccucacccuucuaggcuggaaugcugaugggcucgauuuugugcaggcuuuacacaggccacauggcaccggugcugugagcucgugagugcaguggccacaucauguccagacauguguaguucauagcgcuccuccccgccccauggcucuuauaucuuuccccugcccucauucccccaucccaacacuucucugugagcgacccucagcucuuauucucagcacuuugagcagcugugagucugcguuaaaaggaagguucucugaccaagguugugagcagcccuaaccucagaguauacauguaaacaguuagaaggcucuuuaacaacacguccauuuagcaacacaacuauaguaaguuccccaacuaagcccucuaaacuguucagcaugggcucuugaccaggauugcagaaccauuaugaauuuucuccuuugaggcaggccucagauccagucugagugguugguuccuccuguaacagucacguuacuguuguaccaguggcacauccuaccggguggucagcauuguagcagcagggucuacugccggguaagaggacuuuuaagcagcacuacgagguugugguuuuuuguuuuguuuuuaaauacaaggucacauuauguagccuuggcuagccugaaacuugcugcauaaaccugaauggcccugaacucagaauggccauucacccagugccucugccuucugagugcugggauuaaaggauuuggcaccauguccauauagguuguauucuuaaaccuuuacaugauggcguuuuuauuaaguuaguguuucgguucaauggcagcuugguguauacuguuuucucacccuuacccuaagauggugagcccagcaaaggauucuucaauaggacucuguuugcugguagaguagccagauagacaucagagugcaguuggguggguuguagccuucaguugcccugggugccuccagugccucugaggcccuuugucccuauccuguccugcucugcgggccaggaagaagaauggaaaugacccagcuagcgggggaugucuguuacagaggacgcuggaccacagugccacgugcuuaccucggcucacagcauuuagggaagggagauccgaucuuucuuccacacuguuuuaagacuguggaagccuguaaguucgaaaacccuuagaaaacgugaaacuguggucauggugugaggaacuguggagaccugcucauuagggcagucagaggcaggcucaacacagaccuggcuuaauaaauuacaucuaaggaggggaaccccucagguugggggagggagagagacagagcaucuuggcaaagaaugaaagacauuucuggaauuucuuccaucaggacccaucagugcugagcuggucagauccucugcccugcaugugcuguagcauggcuuaccaacagcauccucugaaccuucacuuauuuuugauuuuuggaaaugguucaccucucauccuuuagcucucuggcugcccaggaacuucguacacagccaagguggcaucgaacucacgccucggccuugccucagcccccccagcugcugggauugcaggcaugaaccagcagauggcacccuucccgugugcacagugccugcucgugguccuuucaggcuuguuagcacacugcacugcuccaucucugagaauaguuaacagccagacagguugcauauccguuccugccuguccccagagccucagaagcagcacacucaccuuauucagucacagcagccuccgccccauuacugcucaccuuacuuauuacucaccuuagucggccuggauuacugcuuaggccucccucugcaguuugcugggggggccggaggggguccuuccuaccugaucacacacuugaaucuuucuggcgcaggcuggauuaucugucuaaccucuuguccauccaaauauucuuuuuuuaaaaaagcauuaccaugcagcaccccugguugcugaagcuguguccaggcaugagcugagcugagagacagccagugaggugcagcguucucucgaagucauggcuuccucacagcuauccuguacugauggcaugccccagaugaguuuagaagagauaggacugguuucuccaauaaacccacggaaacauuugcugugcucugcuagaacuaauggacacuugguaauacacauaggaaagaaccaaauggggaaaaaaaaaaagauuuguccagacagaccccaaucagagugcuauggucagguuaucuuuggggucuccucugcuccagaauaacacuugaccaccuugcugcugaucaagugcccagcuaguuaccaggcacaugcccuaccacauggcagaccgguucccaucagguuucuggcugcuggugcaagucuucucggcagacagucugggaucucaagcucagggcagccucuuccaguagccauaccauguguuaggagacagaggaacucuauugucucggugaaaacagaaaucgugucauaugcuuaguacggcccaucagcugacuauuagagaaugggcgguugaagcaacccgccuuuucaccugccaggccccugccuccccucccccaaacaccucccuuuuuacuguuuuuuuaaauuaguuuuccagcccuuggucuaucuuaacguugcuguuuaaaccuugaacuguugcagucagguucuaaaguguaauuauuuguucuuuguuuuucuuuuuagucaaagaugacucaaaucauaccauaggaguggaauuuggcucaaagauaauaaaugucggugguaaauauguaaaguuacagauaugggacacggccggccaggagcgguucagguagcuuuccuucuuauuuacugauaaugguacuuggaaggcuuagcccaacuccuucacugcguguggucucaaaccagcaugcacacguaacucaaaaucugcagcuccauccggacgcucucacgucugagggcccugacuggaucccagauaccaaaacaaacaaaccaucacuaggggacuagacucucagagguagcaacucggucaggaggaugcgguacuggcacuggguauccguguaguuggcuuuugguuucagucuguuuggcauuuugagccagcaucucgcugugcagucuagguagaccucaugcccacgaccuucuuguaucaagcucuguaugccaggaugaccggugcgaagcaccauccgggcuauaguaugccuucagauuaaaaucaaggcaaagacaaggcagguggcuuuuucccauauuacacgucuaugagggauuuuuaaacugccauggaggguuuuaucccuuuacacugacuggagcaggcugugacaguugccauggauccugcaggacagguucacacaacuggcacucagaaagacuuaaccccagaccacugcuaaucagguuguguggucagcauccuguaacaaugaaugcacaguggggugugaacauuuuagccacgcauucugcagaguacaccaagucacagagucaagauucaguguggaagaagcgauaacccccacccacccacccucccacacacgcaggcuuuucacuuuuuaauuaaacuuggggauagaguaugguaguacccauaguccuagcuacuuuggagguugaggcaggaggaucgcucuaguccaggggaucaaggccagccugggcaauagagugugagaccacaggugaugccagagcaaauguuauucugcuaguauaaaaacuuaacaagauggcucagcagcuaaaggcugggcaagcgugacaggcugaauuccaucucccgacuaugcaaagguggaaguacagagaugacuccacaaaguuaucugacucccacauacaugacguggcacccaccugcgccaccccaacaucauacacacaaucaaguguaaaaaacuagcagggagagagcaguugguuuuacaggggagaaaauacuaaaaaccaguuccuugagaaugugagguggacagagacccaguccucaguagagcaaggagagaagaaggauguuguguaggucgaaguaaauguggccccuggcagggaucuaggcuguuccugucuugggcuuuaccugggaagaagggagggaacagcauagggcaccugggggugggggaggggacagagaugugagggucuccuggugccugcugcccacagagagcucaggacauucgggccacaugcagacccaugaaccucgugaccuaaagagcugcucagcagagcucucccuguuuuggagagagcgcccugcguguccuggcucuaugugguucaaaaggaagcaugguuucuauggggagaaguaaagggccuugauuguuagaagccccugucauuccuucaggucugugacgagaagcuacuacagaggugcagcuggggcacuccuugucuaugacaucaccagguaaugucaccuccccgucgcucaggcuacuugguguucugcaucccuguguuggcgagacauaugauuuaguucggucuagauaggcagcauggcuguacccagggggaucauaaaggucuuugguaugugugaggugcugggacugaaacaagccuuuggccucauccuucacacugucugagacacgcuccucaaggucuacaaggcugugugccuucucagacauaaucaagagguugaagauacagacucaggcucaaaucagugggcucagagccuagcuccaaugacuuuucaaacucuacaggccuggacuucauaaggguaaaauucuugggucguagaggugguuaaaucaacuaaugaaauacuguugcaguuguaguuacuggcuacauguaacaacuuaguuuuauuccuggguugcucuggccacauuucaaauguuccaugccccacaugccuggugaccacaggacuggccagugcagcucccagcacacucccgucuugaaaaucucaucaauccacugaccucagaguuagcagcauuguccuggaaacacgugauccaaaagguuccaccaaggggcccuuccugggaggaaccugaccuaggagagaacaacauggcugccuuccucuucugagagggggugacacuccugacuucacccuccucauuccccccggugccaugagagacucaaccugccagggugugacaucacuuguguggguccuuaaaugugggagccaaccugcagaucugagcugguccuggguagacaaaagccaggaaguccugcauagugucccuaagccccaggagguccuugcaaaguugucgugguggauuccuaugggucaaggugcucacaagucuacaggugaccaugauuaguguugcaagccaggcacguaucuugcacauacucgggguucaggugcaucugugaagggaaggaaagcccuuuuuugaaacccagaggguuucauuguaauagaagcuaaacauagcccaugagccuauuguaucaccaagcauucggguucccacgucaccucugaggcccaguugauaaacagugugugcauggugaggaugacuggaaacaguugcuaguuuuauaaaauacauguaucauuuccacaaucuuaugucacacagccgagaaaccuacaaugcgcuuacuaauugguuaacagaugccagaaugcuggcgagccagaacaucguccuuauccucugcgggaacaagaaggacuuggaugccgaccgggaagucaccuuccucgaagccuccagguucgcacaagagaauggcaagugacuuuuuccucuaagagagucucucaggguggucugggcacagugacauuugggggucuuaaccaccugguggaguuuugagacgaagcuaucuuaugaaacuguggagucucuacugucaacuuaggcuauuucagcauagcuuagucugugcccguugugccgacaaaggucaguggguugaggaaagcaagggauuuaccaucugcagggcuuuuaugucucugguauguuagccaucuuagaguggcacguuuuuuaauguaaccugaagcauaauugguaaagucauccuccugcauagaaaggaagcagaugaaacagccagcuagcuucauuuucuuacauuaagucauucauucaacggcagcaaaccucuaccuuguuuauucuuuugagacagagucuuuuuauguagcccuggcuguccugaagcucacucuguagaccaggcuggguaacaacuuuauuaaugucaaaaccgcauugcaaaauuggcaguugcuugcagagauaacagcauuauaaacauuuaggaagagccuuaauucugagccagcugagacuacuccauccuuaaguccacauaugguuggaggcagacagaaaccugcuuucccaucuuaacagggguuuacuaagaacuaaacaugacccaggcuugguguuuugggcuugcaauccuuguacuuaggaggcagaggcaggaggauuucugaaaucuugaagguagccagggcuauacaaugaaacuguuucaaauggggggaggggaaauagaggaagaaagguaggaagaaagaaagaaaaaggaaagagaaccaauuaagucuacacaugagauguguggucccaaccuuccuaaugcugacccuguaauacacgacaguuucucaugcuguggugacccgaccagaaaguuauuuucguugcuauuucacaacuguaauuuugcuacuguuaugacccuuaggcaaccccuaaccccuagggucaggacccacagguugagaaccauuguuuuaggauuagcuguuuguaugguucucuguauagcccuggcuguccuggaacucacucucuagaccaggcuggucuugaacucacagacauccaccugccuccugagugcugggauuaaagguguguaccgucauccaaccuccacccugccuccccugcucccccaucccuggcauuuuagagcuauuuagaaagcaggagguguuuagaaugaucaggaaaacccuccauuaguacagaccuguuaguacaggcuuauagcugugauguaccugccagcaggcuuuccccugcuuuccccugcucuggagauaaaggaacaugagucuaaguaauacagcagggcuagagagccggaucagugggugagagcacuuguucuuacaaaggacucaaguucgauucucaacuuaaccaccacguugggcaccagguauccauguggugcuuaaacauccauucaggcaaaacauucaugaaaaacuaauaaaaauaaaucaagugggacuacaaaaccuccccaauuauuauuaaugaucauuaguauuaacgauuagaggagagccaaauuaguaaaaauuaucuaggaugcccaaauguacacauuuuuaaacugaauauaaauuagaagcugugggcggggauggcuuuucuuggacaguggggcuguggcuggcugggauggacauggguccugcucaugugcuguguagugcagugauuugucagcacguagaucacuuggagaagaaaguuuggcuccaagucaugauuuuagccaaacagccccaacuggcguaguaacugccacagugugcugccuucauccugucagcucgggggucagggcacaacaauggcuauucuucagaaaggguugggcucccauaacugagcacaucaacacacccggaccaauacccugugaucccagcacuugggaggcauggucaagagagccaaaaguuuaagaccaaccucagcuacauguaaccuuaucucauaaaaacagacaacaaaaauauauauuuauguguauuaauuuuacauuuacagaaagagaagguuuagguacuggauuuugcauguuucuacaugagaauccugaacaggcuugucagcacuuaaaagucacugucauugggccagcaagauggcuuagaggacaaagacacuugccuccaagcccgaggacaucaauuucaucccuguggcccacauagcggaaggaagaaaagucugaccuacaaacuguccucugaccacugcgcccacaccauagcaugcacucccuccuagaaugagaaucugcacugagauuuuaaagaucacucucucucacucugcuaaauguggcucccucucuucuuugauaccauuuguagagcugauguuccuggaaaccagugcacugacuggcgagaacgucgaagaggcuuucaugcagugugcaaggaaaauacuuaacaaaauugaaucagguaccagccuuucccuggccucaucuguggguuuugcccuguagcucaccagugcccccugcuggcugugaugagcaaggcuguaguaaagcucugcuauauagcaagucagucaugcuuaccugagagaagcaagcucccaggagucccuggucaggggcaggugugcgcugggugcuaucaacuugaguuguuacacacuaguaagugaacauugcuauugcuguugcuuaguuuuaaguucauuuuuuuaugcauaauacuguuacaugauuccacucaaacaucgaaaacucaggcucagaaagcacacauuuuucgugcggaggauccaaauuccguuccguuccuagcaccuauacuggauagcucauaaccgucucuaauuccaagagauccaaugaaugcccucucguggccaucuugggcuccugcacacaggugugcauacacacauuuuaaauaaaucuugaaaacuccagaagccccugaagucacuaggaauguuucaugcccuguacuugaaugaauacuucauucuuguaggcacuggggugauagcauauaaaugugaggaccugaguuugaucccuagcacccguguaauaaucugggugugauaguacaugcuaguaaucgaggcacugguaaggcagagucaggaagaccccugaggcucacucgccaggcuguguugccaaguuauugaaccccaggucucagagaacccaugucucaaaacagguagaaagcaugcauguugagcucuggcauccauguguuacacaccuacacacguguuacacaccugugcacauguguuacacacauuuuaaaacuaaggcauuucuuuuccagcccagugugguggcgcacaccuuuggucccagcauuagggaggcagagacagauaaaucucuauacucaaggccagucuggcccacauaguaagccaaagcuaaauagugagucccuguuucaaaaaacaaaaaauauuguuaguagauauauuuuugcucuccacaaugaagacacaaaugcaugggacaucacacuuugcccuuuacuuaccguguguggggaacacagagucacaggcauuuuccugguccucaggugaacuggaccccgagaggaugggcucuggcauccaguauggagacgcugcccugagacagcugcggucaccucggcguacacaggcuccaagugcacaggaguguggcugcuaggcgccccagugacacagguggauguugggggcccugcauccuggcaggaaggaggggcuguaaaacugcaguaggaggugaagaggaggggaggagaggcccuuaggaauagucagaggucauccccacaggacuggcccugcaggagcuccucccccaaccauucagaagcaaagaccgggcugacagggagagcccaguggucgugcuguagccauucuucacucaaaccacggagugcacucgaccuaaccggagcaucuccagaacuagcaagcucuccgcuaaacuuucaguagcgcccucucccauuuaccauaguggacauuuuuguuggggaaguugaggcaggaacucacucuccagcccaccugggccccuaccuuaggacaauccuccugccucagccucccucccaagcccugggauuccagguccccaugcccagcucacaggcuggcgagcagugugagccaguguugaugcagucaggucugccgggcucugagccguuuggucuuuacaagcacaggaguaucugaaucacgcuuaacgguucucagguucagcgguggguccuggaguacagccgccggagccugaagaggcuggaguuuuuacuaccaucuuuucuacucggcacagaaguagaucuuccuggggaacgguguacgcuggcagccggggcucagcagccauucugcgaacuaacucagcggacaguaccuuuagaugccacauguaugcagaccccugccccacacguacccuucacguucuguuaaauccagcuugugcugcccacagcacguucccacagcacagagccggugugacaugacagaacccugcacucagugagcuuucuuuuuaaacucccaggaaaugcaguugugaaugugagagagcgugcuuuucucauugcgcguugguuaacucccaggagaugcagucaugaacgugagcgugcuuuccuccuuguguugguuaugcguaugacccgguaugaaaggacucuggugugaacagccagugcguuucuuauuuaaucccucuccccccaccccuuuuacacuguuucugugauccacaccugaaaugcuaaacccacaggacucauuaacaccuggaaauaaaguggaacggaguuucucacgcacaguacacuguccugcucugugcagucgcgugagccugcccaggcugcucggcuuccacgccacccucaccgucucccggccagaagacacacuguugaccgcaaugcuuuuccugaagcucaguguaggggcaucgaccgccaccucuucgcaugggucguuguuucguggucauuuucaggaaacucacuaccucuaggacaaaggauauugcuuauuaagaaauccuggccaaggcuaaagugcuuugguuugcaugugcaaggccccgggcuuggucuccagcaaacaccuccauaccacacaccuacggucacaccuaggucagacgugcugauagcacaccuauaaucccugcacucagugaacugagacagcagagggcgcucaugaguucaagaccagcuugagcuuaagagacuggaguacgguguaugggguggguaccucauaagaggugaaucucacaaaauaucuuuguagcucuuccugaauacguaaaugccuuacugcauacaacuaucaagucgacccgcuucuguuuucaggcagggucucacuauguagcccuggaacuugcuguguagaccgggaugaucucaaacucacaaaauccaccugccucugccuuaugaguucugggaguaaaggccugugccgccacaccaggcaaagcuuuuuuccccaacaaacagugucuccugagcacugcuuugugcacauuuuaauaugccgaaacuucauugcuauccuauucugcucucuucuauuuaaaacguuguccaauuuugagauuucugguuggcaauuuaugaauaugcuacuuaguguccaccucagcucuggucuucugucaccaacuucacaguagaauauaaugcaugaucucacuugcuuuggcuggccaggucuguuuauacacuaggacugcugucucaguaaugcugugucccggaagggcuugcacggcucuggcugggggaagcagccucugcccauuggcacaugguggucacugggaucuccugcauuguggcugauccucaccugucaucucuagugcucaugggaggugcaagccuccagcuuacucugaacuccucaguccucccuaucuguagcugacccauaagacgccccagcuggaccuggccacacagccucagccucugccuccgucccaauacaguagcugcuaggacaccuuccguuaccugcaucaguccgugggugggacgcucacauguucugcagagucagaugggucccgggaagucuuggcagcuuugcagugugguuggcauggaaacaccaagacaugguauacacugauauguuuguuuugguuugcauucuuuuuuaaugcuguucagccucucugaaccugcucucuuuuagguaaaacauuuuuaguauuaaauaucucacuguaaaauuuuugaaucauuuuagucuuuucagaguuccccccuccccuuuaagagagggucuuacucuagcccaggcuggcuccacacucaagauaauccugccucagccuccuuaugcugggauuauggugugugccaauaugaccaacucuagauaaggaauucccagcugacuuuuuuuccccacuaaugauccacauucucuggucucuaugaagaauuugccaucauucagauugucaaagaaggguguggguuuucuuugagcaccucaugcugucuuuuucguucugggcaguuugaugac

SEQ ID NO: 4878 - RNA, 2620 nt, Mus musculus
caggaaaggaaaggaaaggaaaggaaaggaaaggaaaggaauccaggaugcaggauauacugcagaaaugagugcugacaacuuccagcuuccaucccgugggacacccaccaacucccacugccuaaagacccccaccaaagguccauggaguuaaaaaugcauagaccaagccgggcgugguggcgcaugccuuuaaucccagcacucaggaggcagaggcagguggauuucugaguuugaggccagccuggucuacaaaaugaguuccaggacagccagggcuacacagagaaacccugucucgaaaaacaaaaacaaaaacaacaacaaaaaaaugcauagaccaaaacaaaacaaaacaagcaaagcaaacgaaaaaaccugcuucuuguagagauuuuuuuaaaaaaaaucuucagauacucucaguuacuuaaaagcucuuguacguucccaccgaucagauuuuucuacaaagguguuuaaagguccauaauuacugcggucccgggaugcuguccauggugcugacuugggugcugcgcgugaucauauucgagaggccuagcagggauugucccaggagcugaacauccaucucgugauaugaguccuaugucugauguaacugugucuuguacaaaccuggauaaagagagaagaugucuauaaagauaaaugaugggugggccagcacacagaccuuaauaaaccacuaacucaccuccucuguagaaguggguagcagaaaaaaaaauguaguucugccaaucuaaagccuguuuugagggcuggguauagaauucaauuggcagaguaaccaccucacaugcaugaagcccuggguucuugcauccccagagcugcaguaacuagguggcacacaccuguuaucccagcaguucagagguagagacaggaagugcagaaaguucaagguuauccuugcccauuuaguuccaaagcuagucugggcuacgugaaacccugucucaggaggaggaggaggaggaggaggaccaucaucaucaccaucuacuaugguggcggauacacuugagagguaaaugaaucuacauagugaguuccgggacagucagggcuacauaagaaagacaccgccccccaacccaaauccauuucaaauucacaugcaaguauuuugaaaugacccacaaagaccuuaccugggucaggaacugcagaauuggccaugggacagcacuggcuuaauccagaaaguagaucaugcagcuauccugguuuucuugaggaguuaacuuaccaggaaagcaaacucucacccucgccugcacugggccuccugcuugcuccucuccaauuaauauuuccgguguccucugugucaggaaguccuguuccauuugcaaagucuuuuaaagauguuuuuaucgcugcuuugucuccugccauguggagaccccaaugccuccugcgugccaagcaaacaccuaucucacccuugcucgcucuccucucuugccauuuagucucgcucuugugagguuagcacagaccuuugaauuagcaggcaacccucagugagacacaacugcaaagauguugccuagcagcugaaacgggcaugugccgcugcacugugaacagguaagaugccuaagguuacuugcaaaaguguauaaacguguuaggaacucucgggguagggagaagaagcgggcacaagaccaacccaagugcucagacauccucuaaacgcacaguguaagaauacauuucuauuuucuucucauucucgucauuguagccaagcugggcaucuuuaguucaauauucuguuuaauucucaaguaaaaguagcacagaaaaugaaaacgcuuacagaaaacgguuuuaauuaagaccuuaaaaucagguuuuuaaaaaagacuuguaugucguuuauuuuaaauaugacuggauucucaaacauuuucagauguuuccagcauagaaguuaauuuuaaauuauuucacugcuccuagaauaggaaaaaguuaaaaucaauuaauuaaaauucucauagguucaaaaaguaaucaccgucuuuuuuaaaggagaaaauuugaacccuaaacauuagggacucagguguggggagucaccacuaauucauacugacuuuauuugcgagguaugaacauugaauguucuccaaaguccugaucguuugugcucuguguaaaaagaaugcggcacaugccuuucaucccagugcuugggaggcagaggcaagcggaucucugaguucgaggccagccuggucuacagaguuccaggacagccagggcuacacagacaaacccuguucugagaaggggaggggcggguaauuugguaaagacaccaccaggcaucucagcacaccccggccugcacuucuacacacguaugcaaaaggaugcacaucuguuuucugagcaagucugauggccaggguugggggggguccugugucccucccccaccugucuuucugagauugccgggugcuguuugacgauguagggaaugcaggcuuucaaggcauggcuuuacaaagagugauucucaacaaccugggcuacugugccaaucacccugauuacgcaacau

SEQ ID NO: 4879 - RNA, 19838 nt, Mus musculus
ugauccuuccuggaugccuguccuuucaaaucuuucugcagcgauugcaucaaugcuuccuuuuacaaaagccaucuguagagcaggauugcaacaguaacaacccugcgacccuguccauuagagcccaagccaaacauuugcaccagguccuugagcaggcccuaggcuuuauuuuauuuuauuuauuuauuuuuacaaaaguuggccucuaguaaguuauaaaaggcaagggcaggugaggcggcucauaccugcuaauuccagcacuugugagguuggcggagaaggaucaggaguucaagaccagcuugggcucuggaaugaguucuagaccagccuugguaacaugagauuugucucaaaaagggggcagaggagggaaauguauuaaaauagcaacaucaacaacaucauuaacaacaacaauaaaaaaaucacuaaggccugagaacccgggcguugugaaaagaggaaggaaucgggacacaggauuugguccucggcuagguguugguugcucagguugcaucuagagcugaagccuccucgcgaggcccccaguagcgagugggcgaacgagcuggggguucacagcagcgccccaggcgcgggcgcaggagcgggcgggggcccggcgggcgcgcggggaggugcaggcuucaggcuagggcggcgccuucgucuccggcugcuguaggaccgcggagccaccgcuccaucggcgacaucuugguggaggacgcgcaaggagaaacgcuguucgcgcuauagcugcugcgccacgaucucagcugaccuccggagagcggaggauagaacaggcaggagguaaggacgcugcuccuagaguccccgacuccucgcccaggagggugucuggggaccuaagauccccugucccgucaccuugaguccgguggucuccaccucuaccgaguggagcagaccccuggugaccaccuaucauuccaucuagauaggucgcgucgccuggaaucccuccugaaaccccgcccccgcuauuaccugaacuaggggccuucccagcccggaacuccgcccccgcuaggaacgcccucucccagaaacacccgucacagacccgcccccucuccgccccuccuugccccagccuccgcccuccaguccgggcggggcuccggguuugaaccgcgcggcgggccgcgccucugaguccgucgcacccguaggcggcagcgcggagcaggcagucggcggcgcgcggcaccauguccccgggcagcggggugaagagcgaguauaugaagcgcuaucgggagccgcgcugggacgaauacgcgccgugcuaccgcgagcugcugcgcuaccgccugggccgccggcugcuggagcaagcgcacgcgcccuggcucugggacgccuggggcccggacagccccucggacagcucggcuucacccaguccggcccccaggggcgcguuaggggagcccucggcgcccuccgcgcgggaggaggagcagccggugggggagcgcggcgcggagcugcgggacgcggaggagcaggacacaguguuaccagguacgggcacagcgcguugcuccguucucagcgcuuccuguuuugguuuaauugggguugacagaauccgcuugcugaacuaagcggggaaggugcgggccgcauuuccaccuucccaccccagguuucccuaauuuggugacucuuggcggagcccuuuaugaccuccaacucauaugacccugguugggguccuuggucgcaggcaguggcccgcucagugagcccucgauccaccagauggcggaucuguuuguuucugcgcauccuguuuggcgagaggagcuuuucauuccaaagaugaccgacugaaguuaagaacgcccgagcugucauaauggggucaugguugucagugugaacgccuugaaggccuggucucgcugucucugaagaaugguaugcguuuguuuguggacgaaccccucuuuguauacgcugugagccacuuucccgccguugcggaguggggcugucagcagagagcccugggguuugccuggacucagggcaguacuucaguacaacuguagaucacuaugguugccagccaccucucugaacucuucugagaguccaguggugaaaaaguuauuucucagugacuggucuaggaauauguauuuucucauucgaccuucaaagucauaugaugggcccuuuguuuuuaaucucaguuuuguaaacaaagccaugggagcuugggauccauggucggagucugaaagggucggauuucccugcucuugguuacuauguuugccuauucucaguucuugcauggcugggccgccuugugucaucuggucgcuuaugacgaccauucugaugcuucagugaugugguuagaaauuagggaaaguggcagaagguggugggggcggugagcaugucucccagguauuaauaugaaaacugagcccuugcuaacugugagguuuuuuuuuauugggacgagcaaaccugcuuuuccuuucccacugugguuugaagagguuaccugcuaucuaucuguguguuccauaugaaaaccugacagcacuuuagugggcuucgugccgaguucaugauuauuuggguuuccauggagauacagagcccuccccaaagauuugcaaaauuccugcuaaaauuuuugguguguaggcauuagggaaaauagaugugucccgcuuucgggauucuccauccgcagcucuuuugcuggcuccugcgggccagugucaaugugagaaauguuccugacagaugcauuauaaugcuagacuggugagccacugauucacauugcucuaaaauacauuugccuuauuuucacugaaaggguuuuuguuuguuuguuuuguuuuguuuuucaagucuuuguuuuucagaguuucucuguguagaugugacaguucuggaacucacuguguacacuaggcuggcccugaacugguccaccugccauugccucuugagggcugagauucagugugugccaccacugcccaggugcaaggacuuucacaugaggaaucuugugucuccaugaaacgaaugacauggugcucccccuccccccagcagcugucuacuuguuagguaaccugcuucccgcuccucugcuuuuuccauuuuccuuuuugggguacugaagauugaauucaagacguuggguaugcuaggcaaaugcucucccacugaaccccauucccagcucccuuuguaucuuuuguuuugagacagggucucaaacaaaacuaagccacacucuuaagccacaaucuugaauuuccucuguagcccaggcuggccucaaauguaugauccucuguuucagucucuugaauggguggcugguauuauuuuuauuuuauuuuauuuuauuuauuuauuuauuuauuuuuuuauuuuauuuuuugagacaggguuucucuguauagcccuggcuguccuggaacucacucuguagaccaggcuggccucgaacucagaaaucugccuaccucugccucccaagugcugggauuaaaggcaugcgccaccaugcccggcuguagcugguauuauaacagacacuuuuuauuuguauucuuuuuuugggaccagggcuuacuguuuugcccagguuggccucaaacuccugggcuuaagccaucuucccgccccaguuuccugaguaguacacuuggcugguauuuacuucuauauacuuuuauggcugcccccaccccaccccacccccaguuuuaccuuggcuuuauuucuguucuccuaauacagacacacucguuucuacacagucuucauagcugucguauucugugugauauggggcccauggaaacuggaugggugcuccaggcugacccacuuugcuccucugggucccuuuucucucucucacaauguagccaaguacagugguucaucaucacacccaccuuuacucauccccuggggccacugaccuacuucugucuggccugccugcugcccuguggcaggcuugacauuguugucuaaagaggguccuuggcauugcaucaggcacuuccagcuuuucccugauaggugggagcgacugccauguuuugacucacccccgcauugguagaggucaucucucagcuuaagaaaggaugaaaaguugcauuuugaggaaaaacaacccucguaauuuuugagguugugaugacaucucuuuguuucuaagacaucuggagccauugccccaucucugagagcucugacccuugaucuguacuuauaacugccuccccccgggggggggggcugcuagaaucuuuugucuguccugacucuuagggauugauauaggucauuugcaagucccuacaccaaacucucuaauuuuuuuuucuuuuucuauuuuauguguauggguguuuuguuuguauauguguccauguaccaugugcaugcaguacucucagagaccagaagagagugucguaucccuuggaacuggagggugugagccuccgugugggugcuuggaauagaaccuggguccucuggaagugcaucuuguguucuuaacugaugggccaucucuccagcccccccaaaguuaucuuuaauucugagaagucuuauugaauuauuuuuauuuuauuucacuuauuucuucuuggggggggugagaguuaauuuuauggugcuggaaauggaacucaagacuucguauauacuaggaaagugcugugccacugacccuccagccuccuccuccuccucuucuucuucuucuuuuugaaauuaagcagaguuauuaaauaaaaguuacacacauuuauaguuuacugugugacguguauguauauagugagugaugcugaaaucaaguugagcauuggcgucaucucaaacccuggcagcucaguggacugagugcuuguuuacaugugugaagcccuggguuccauccucagcacaaacgugguggugcaugcuuguaauuccagcacuuaggcugaguugaggacagaagugagauaccggucagcuguauacaugagacuuuguuucaaaaugggaaaaguaucuaguuuauuguuuucccgguuuuggaaacaguuuuccuaaguagccuaaggggcuucaacuccgaauccuccacagcugggaucacagaagguucuugcgguggguacacuguaucuuuucuuguaagagauguuauuagagaguuuuguuucucuuuguguguuuaggggacuguaucuccuccccuuccucuuuguuuuuguuucuuuuuguuuauaauucuguauugcucucuggagacuuuuuuuuuuucaaaugauugagaucuguuggcuuccuucucuuauuugagaaaaggcucugaaaagugcuuuguaagcuccacccgccaugcuggaggcggaagugcuuuguuaguaggaauucuguacuuuucuagcuguccuguguugccuuauuugggcgggcggggcggggggcggcuacuuuauuggguucuauuaucuaccacccuucugacccuaauuucauuccaaucccuuccaacaccagaacacuagguagaagagaaagaguuggaggggaaaauuagaccucguuagacaacuuccugcugauuagggacauuggguuccuuggguaaguccagucuucauuaucagguuaucuccagugucucuucccaucucuuugcucacaaccacuugacuaacagcaaucaggagcagcagaggagaagcagcugccccaggcucuuuaagggcgcacucauuuauaccuucuccagaguccucagaauuaaacugucugcagcuggcaaaaaucacaccccugcuagugcaugaggcaaaucauaaucaccugcugugaagcgggcucuuuucccacaccugggauuaaaacaaaaauauauucacauagcauuaacucucucucucucucucucucucuucucucucucucucucucucucucucccucccuucuuuccuuuuuuuuuuuaaaaggaaacuaaaauucucacuacaguuuugcuuuuaaaacuggugaaggcaaccuccagauuuauuuuugggauacugggaaauuuaacccagcuucucgaugcuacacaacugucauugcuggucuacugcagauaagaugaggggcugccugccuguuaguccaucuccacuuccuuauuccacagcugcacuuuucaacuacauuuuauuuuugaugaaauuuacaagcacacuauuuuaaaaacaaccuguucaaaaauuaggaaaguaauccuuccccacuuccuacucaugccuacuccuuguucuuucuaccucuugucucagcuuuuuaaaauuuuuuuuauuuuuuauuuuuuugccagucagucucucacuuuauugucguugucaucucaggccuugacugcauacuugcgcagaggauacagucgcuccuucugcugcugcuucuuggucuucagcuucuccucgugcuuggugagccgguggcgcauggcucuagucuucuugggucacaggucuaggggcuuguauuucuugcccuuguagaauuuccugagguuuucuuuuugagucugguuaauaacagugaggacucgggcgauagacuugcgaacgacucguaucuuggagagcuuggacgcggccgccugucacuuuggcgacccguagcugggacaauuccaccuucagaucguccaguuguuucaacagcuccuccuucuucuugccgcgcaggucccgagccuuaaucuuggccauuucagcauuguucacggcugaagccaccugguucgagaguugucucugcauuuuuauuuauuuuauuuuauuuuuuuggugggaggcagaagcuuucagaagguucuuuuucaccuaggcagacucaagagacuguggugccuuucugccuuccuucguucacuguacugggcuuuuugaacauggaagcuucuuucaagucaagauuuccuaacaccauuuaaaggcauuuccucugcuucaugguucacuauccuuuucuucucccccuucuuuucucuuuucaucgaagcaggguuuuuauaguguagcccagaccgauuucacacuauagaaaaucuccugccugagauuucugaguacuaggauuacagaucugccucugggaucaaacuucuaacauuuuaaaauucagaauuuuauuuuaucacccgaugugguggugcaagccuuucauuccagcacucaggaggcaaaggcagguagaucucucugaguuccaggucggccugguuuacauaaugaguuccaggacagccaaggcuauguagugagacccugucuggguaaaaagaaaaaaaaauauguauaugagugcuuuuccugcauagauauggucuccagggaagccagaagagggcaucagaucuccugggauuggaguuacagacacuugugagucacuauauggcugcugggaauggaaccuggguccuuuggaagaagagccggugcucuuauuggcugagccaucaauacaacuucuccuauugaccuugaacucuucauucugcuuuaaccuggcuagcugguauugcagguguaaaauacugcuuccaucuccaugucuuuuuugcuaaaauauguacucauggguuagugagauggcucagugcagaaaggcgauugcugccaagccugauaaucugaguucgauuccugggucccacaugguagaaggaauaaaccaacuucugcaaguuuuuuuuuuuuuuaaagauuuauuuauuuauuauauguaaguacauuguagcugucuucagacacuccagaagagggagucagaucucguuacggaugguugugagccaccaugugguugcugggauuugaacucuggaccuucggaagagcagucgggugcucuuacccacugagccaucucaccagccccugcaaguuuugcucuaauauccauacacauacaugcacacacacacacacacacacacacacacacacacacaauggugggagggguaaccagauggccacuccugaccuaucugcucauauuuaaugcuggggccugaaagugcucugagggacccagauguggugucccgagugguuuauuggcuugucuauuggcugcacgagagagacagacauggguauuuucuggggcauuuaaaacuuauccucugggaguccccuggguguccuucccaguuggugccucucuucuugccccaggggagccagccaaucugccacaugcuuggagcccaggaugaaagcuauagaggaggcucucugugugcugaggccuccuguccuguuaggaaggcaucacucuggcuuccgcugugcuggcaucccagguccaggacccugugcuucuucaucuuuagccaguacucuggcauucagggaggagagguuaggcacuuuggguagaacgaaagaaaaaggcuggacagugguguugcauaccuuuguucccagcacuagagacagguggaucucugugaggucagagcaagccuggucuacauugugagugccuggacaacggggggggggggggggggggauggggagggggagagggacgacuaugaaaagauuauccacugcugcaaauaugaaauccagccaaaaucagcagcgcuccugaagccugguaggcccuuuccaaggcuggcacaccuugucugauagguauuaucauuggcuucugcugagagaccagcuaagcuguugcuauaucaacacuugccaagcguccuccuaugcugggcccuccuuauagcgugcagauggucuuugggacagcaggcaauaaaacggagcuugauggagggccccuccuuuccaguuucuccgugggccagacaguaucuuucccucucagcuugcuuuccuuggaaguuacagcagucugcucaaguguggaguuggggugcccuaacccaguucuuaguagaugagucuauugcuuuucagaaggguuuggggugggggcuggcuggugcugggccuuuggaaagaaguccaauggccuucuugcccuggccuugagaaugcugugccuaguggacccuuuuggggcucagcuuuugccuuaggcugcuuuccaggcaguuggccuccucuggcugaccugagucuguguuucugucuuaccugcuucucuccauauuuuauugaauguuuucugugguaccaaugauuccccuggccuuugucauugugccuucuggccuuuacugagugggacuuuguggaggaagagauugaagcauucauuuaaacagagcccgcugcuuuauuauuauuuacuuaugugcauauguauguguguguauuacgcacacgugcaugcggcugccuauggaggacaggaaauaggauuucauggagauggaaucgcaggagcuaccugauuuggugguggaagacagguccucuccaagagcagaaaaugcucuuaacugcugagccauuucuccagccucugcuucaauuauucauccauucuuuccuucaucuaucuagaaaugggguuuuucuguguaucccuagcuagaccaggcuaaccuugagcucacagagaugaaccugccucuggagugcuaggauuaaagauagacaccacaaugucuggcccauuucuugaauaggcuugugagagguuugugaaucuguuuaguuuuuuguuuuuaccaaacuaacuucuauuaguuuuguuuuuuguuuuugugccaaaagaacuuuuaucuauguggauucuuuucuugggagucauagcauguacuucuggauagguuagaacucacuauguggccaggcuggccucaaacucacggagauccuccugccucugucucuugaguguuuggauaaaggcuuaccaccaccaugccugacugguuuuguuguuugcuuuuuuuucucuuggaauuuuuagacagggucucuacauauaccuggcuguccuagaacucacucuguagaccaggcugcccaugaacucucagagaucccccugccucugccuccaagugcugggauuaaagccaccauacacugauuuuguuuuuuaagagaggcucuuacuacauagcccaaacugaccuugaacuaaagguccuccaccaaccucccugggauuacagucaccugcuaccuccugacccagguuggccucaaauuuaguauccugcugaggugaccuugaccucgauugcuuccaucucccaagugggauuauaauaacgugugguaaaauacauagaaaacaaaguuuaccacuuuaacuuugaaacgcacaguguggggugcuaacuacuugguguguuuuuuccgucugcaucccacugaacuuggagcuaggcugggcgccggugagcugcagacagagguccuuuucuucuucaucccugccccagggcugaguuacgggagcaguguguaccagacuccucacgugugugcugcggggaaauauuuuuuuuuuaaaaaaaggcacauuccugugcuugcaucagcaacucucugccccaguggccuggcuggccaugcacuggcgggcaauggccaacauguuuuuaucucauggagauucugacucagagcugcaaaaucuuuccacccagcucacuagguucccacuggugggucguuaccacgccagccccaugcuucaaauuccccaugacuuuuguggcacaucugacaaacccaugcuuugaugccauaccuuucucucuugaacccagaugaggugccgcaugaaggaaaacacaacauaaacuuaguucagaaacaacaguaacucagucgcugggugcaacaacuaaaauccuaaccuggaaagccuuauuacaucuaaauccucagguggcaaauccuaacggauccgccauugaaaccaggagacacuuguagcuacaucuuguuguccucacucuaucucuauccaaaaagaccuaacucuuuccugcuuccuguccaaccuggaagucccaccuacucacccagugguuggcuccuuuauucauuaggggauugguucacaagaagucaccugaggaugacucacuccuuguccgcagccccucccaggagaguggaauuagugucaacauacaaacagcaucagguccauccacaacacgugugugcuggaucugaacucagggccucaggcucacacagcaaguguucuuuacccccugagccauuucuucuaucugugugugaugaugauccaaaauggaaauucuuauuguugcuguuuugagguugggcuuuacucuauaaauauuuguucaaauaggauuuuaagagcauauaguuauaugugauuaucauguaccaagcuggccuaaaacucagcucaaaagugaaagggauuugaaaguugugucuguguuuguagcuucauuucccuaaugguugugagaauauguucguuguaauuucauuuuauggaaguccaguucuggaaacgagggaagagucccuauuacggcuuuggcugugaaaagcucauguaugcuccacaucugcuugaugggaaugcuccagcucucucuacgcgacugcauucugcuuccccccuuacaaccugacucuucaaaacugcucgguggugacgggcgcauucccuauagagcagcugccauggcguuacuggauggcugacccacgcgugacgugccuaacagagaagcacagucaucuuacuuacuuuuaguuuucuagaguuuguuuuuugauagccacgcguggcugcaggcuauugcacugggcagcuccagccuggauuuauuuuaauuugaccguccccuugguuggugagaaaagcauugcaacccuacccuguaucguguggggaauacugcuuuuguuugccugaaaacauccucauuuugaacaucauucuuucaaagaggauccuaaaagcauauacuuaaaucuaauuaccaugugccaggcacgauuuugagaguuuuauaaauaucaaaaucacagugauacguuuuaucucauuucuucuguuuuuguccaucuuuugucuccugcugggaauaauuuucaagcaucguuuguuuuuugcuuuuuuuuuuuuuuuuucuuaagcacagagugcgagcaccauuauuucacagucuguaggugauaauuuaaguucuuaagucuauggcgccagcuggcugucucugcauuguuuucucuuccugggugcugggcuaucuucugugacacgcugugguacucugguaaugcugugugaaaauuauuuguaggagucauuuggacucugggguucugucuagguuccuaggucccuacccuaggugggcaguggcuuuuguacuucacugagcuauuugggguccuacgguaaaaaaggguugauucacugcucugcacuuggcuugaccccugaccugaguguccccccaccccagagccucauggguaagcuacaggguucagucccaguacacugacuuugcuguggaauauggcacuuccucagguuuucuucugguuucuuuuuacuuuccuagacagccuucauuugcucuuggacugacucacacacacauacacacucucucucucucucucucucucucucucucauuaaauaaguguccuggggauccaacagugcccuuuugacuuccugcuccacguuucuccugggcaguccuguguacucugacccuggucccagcuucucucucaaggugccugugggugucuaccagcagcuugucuggcuguuccauccuuccuucaugccuaggauaccucggguucauagauuggaaggaccaucugcuuagaacauccauggagaccagucaggcuccccugcccuaccuccaccccaccccaguggcaucacggugccagcaugucuguuuacccuggucugcagucugcuuuccuggcaggcauuuggcccuauucuuuuaaccaacccauccuaaaauauagaccaggccacaucauuccugagcuuaaaaucccccacaauuacccaugauuucuaagguaucaucacccccaaccuccaauccaagguuggcacagaaaggcuuuguuccccuggugccuccugcucccggccuguaucugucgacuguguguguacuuguccuuagagcuucucacauccccucuucccuuucagaggacggucccucucugagucucucucuggucagcauaagcuuuucccucacagaaaggcauuauuguucucucccggcuuuccugggagaucuggaggagaggaggugaagagauucagaacucaggugacacacacucccuuguucuccagauuugaccucacagguccugucccaggcuacucuuucucuuugcuuugacuuugcgguucccacuuugcgucauccuauacugaagggaggaaggguaaggguccagcgugcagaaguguacucaggcaguguguggacgucaguaaguggaaccugguguuccucuccccggaagcuccccgcagggacggccuaggguguuggugucagaccccagguguggcuugugucacgugauacuuaagauguucagucaaaggaauggguuguuagagcucaggccgaagcuaaggcagaugugaagguuuccuacagucaggcguaccgucuggaucgcccacaccgggaacacucuccuguaaaggcguacggaacacaugcccagccaagggcaucggggcaucggggcaucggggcuguucucugaggcgacccagcuuuguuccagcagucuguguagcagucaagaagacccaagcucugcagcagcugauggaggaggggauguauaccaugcuugagcagugggugacucacucccauggagcucguguuccagcgugugcguguguguguguguguguguguguguguguguguaggagggaaggaaacaggcucaggaaggauuuaugcacaaaucaugucuuauaaaggacggugguauuaaaaugucaaaagguagguaagggaaaucuggacauucuggaauguuccuaaauaccugauguugaccucagguugggcaaccacauauauaccacccccccccaaguacccuccacuccccaggucugcugacaucauucaaugcccccucccaccauacccgccauuucccucucucaucacugaagcaucugaagggaggaagggucucgguucuuggaaaggguagggaagguacagaguucccugcagcgguggcggcggcggcggcggcuagggugaagcugcuugcuuauagcuugaugguucaggaaacagaaaucaggucaaaacugggauugggcuacaacccauaauacucauucuguggugacucaccucuuccaucaagacuccaccucccagagacuccccagccuccuaaagcaauacccccaguggggaucagguguucaaacccaugagccuccgaggauauuacauacccaagcccaacgcuguggcccuggcucaugaggucgcuccuguuucaaugucucuggggaugcuguaaaggguacacuugaguggcuguggugaccacauucuguugugugacaagaguccuuggacucaguuggacagccaccuccuuguaggcacagauaaggagggcuuccucaguguacaucgaaacagaggcauaagggucaaacuccagggagugacuuagaagccagucuucagcagcugcccaguaaggacagccuagucuguccgcaaaggaagcauccaauagagaagcccucaggggccuguggagggagcuccugcuacggaaacgcugcucauuuggauagcgauggugacuccuguggaugggcaucacgggugcuuuggaauaguuuugguuuaaugcugguaauuuguuuccauagcugguuuaaguaaaaccuguagaguuaaacaugugacugacuugaugaaacauuauuuuucaacuuaagucauauauauguauauauguauguguguguguguauauauauauauauauauauauauauguauguauguguauauauauauaugaacuugaacuuuaaaguuuuuccaucucaucuugucccuuuuuuuuuuccaaaagcaccaccaaaaaaggacacggaagagaaacccgaagaacacaagacaaaagagacugauggggcacccaguggcccuggaccgcggcaacagccuagugccuuaugugccagaggaaguaagaaagccaccagaagcccacagagaucgacgagcaagauaaaagagaacaagcacccguuugcucuuuauggcuggggagagagacagauggacaugggaagccagaagacacacaacgucugcgcgucagccucugugcacgaggugugccuugaacggggccagacuagcccugagcugccuugggggcauuucuccuauggcuacggugcccagcgccacuggaaguccuuggguuaugugggaguccauggaagccaaaagaaggggucucugguccuagaaagauggaguggacuuugguuaacuggggcuacagccagggcuaaggucugaugacaggaagagguagcugucauugugguguaugaguucuguggucugggccacagggauaaugggagcaggaguuauccccuggggaggcaucagauucccucagcuuucguagccugguguccuuaaccaaggcuuucuccucagcuccucugacgacuuggcgucuacuagggacuucuguuuucccuucagacgagauucagccugaugcuuuccuaguugucagucauuguguuuucuucccccgagcuccagccacuagcucggccuugguuuaucauucucucaaggccugagacaucuuagacacgagaaccuuuagugguagccaugaaacaauacuguguaagcaccagcugaaugccagggacgccuuuaagaacaggcaggaagaggaacgacagacuugguuucccugggaugccaggcgaguucccggaguagcauguugguggcagauguuguuuaucugagguggaaucugagacaagggagcuguuaacagaggauucucaugagucccugggaccauuuuaauaaacucccuugacauguuacacacacacucucauacacacacacacacacucauacacacacucauacacacacacacacucauacacacacacacacacucauacacacacacucauacacacacacacacucauacacacacacacucauacacacacacucauacacacacacucauacacacacucauacacucauacacacacacacacucauacacacacacacacucacacucauacacauauacaaacgagagacaggcugaggaugaccuuggaauccugauucucuugccaacuuuggggauuuuacaggcuuguauggccguaccuggcaguacuccacauucuuuuucaaaaaaagauuuacuuaggggcuggaaagauggcucagugguuaagagcuccgauugcucuuccaaagguccugacuucaaaucccagcaaccacaugguggcucacaaucaucuguaaugggaucugaugcccucuucuggugugucugaagagagcuacaguguauucacauauaauaaauaaacaaaucuuuuuuuaaaaaaaagauuuauuuauuuauuuuauguaugugaguacacuguagcuguacugaugguugugagccaucaugugguugcugggaauuugaauucaggaccucucugcucccucuggucgagccugcuugcuccagccuaaagauuuauuuauuauuauaucuaaguacacuguaacugucuucagacgcaccaggucucauuacgggugguugugagccaccaugugacuccugggauuugaacucaagaccuuccaaagagcagucagugcucuuaaccccugagccaucucuccggcccuguccuccacauucuuaguguaguauuuuaaagcaugcuagauaacuaacuaacucuuugaccugcuuaacgucuaggagugccuacaguuuucuagagcuugguguggugguacccauaucaucucauugcuuuugaagcagagcagaaggaucccugauguuuauagccagucucaucuauguagugaguaccaggccagacagagcuacacgagagauccugucucaauaaauaaauaaaaaaacaaaccaacccuaaaaacaagaguuuucccaagcuaguccuagauuagaugcaaguuagcugguuaccauuucuaucuaaacuuuuuuuuuuuaauauuuauuauguacauaguacacugcagcugucuucagacacaccagaagagggcaucagaucucauuacagaugguugugagucaccaugugguugcugggauuugaacuuagaaccucuggaagagcagucagugcucguaaccacugagccaucucuccagcccucuauguaaacuuuuaccucuuaacagauauuuuuuguuuuuugucaugugucuaugugggucugcauccaugagugcaguggugcccccggaggccagagguaucagagcuccuuggggcuagaguuauagacaguugugagccacccagcuuggguucugggaauugaacucggguccuuugcaagagcaaauguaauuuucuguugcucagcuuugcuguuguugguaauggguggcgaugggacaguuuacaccucgaagcaagcauugaugccauagacugguggggcuugacuccuuacuucagggaaucagacuggcaacauaagacagggucuccuguaccucaggcuggcgcugagauuuccaaggcucuugguucuaccucccaagugcugggguuacaggugugcgccaccaugccugggaauagaacccaggacuuccugugugcuagguugcgacaagccauauccccagacuuuuaguuagauauucuuaaaaaucagcucuaacccacuuagcuacuaccuuuauuuuugaccuuucuguagauucaugaaucagcacuucgagccaagaauagaagacagguggagaaaaggaagcuggcugcccagaggcagcgggcucacucgguggacguggaaaagaaccagaggguaaagccggcgucugccgagaacccauggcugacagaguauaugcggugcuacucagcgagggcguagccccggggccauccucuuucgaguguucacacaagaaaaggaaaacaaagacuggcaacugagaccacacacggguggaagaaaccaacuguuccugcaagccccucccccuuaggaaauuccaagagaugguuuugcucucaugaugguuggucaccugccuuaguagugggacagaccauggaagccauagaugcuggcuuguuuaugaagacaaguccccaagucuugauauucuuguaagaguuuuuauuguaaagauuuugcucuuuggagauacccacaccgagugccuuuaaccggcucuaggcgcuucccacccaccccuccuguaguccagucagagcugcucuuuuucaucagcuccacauuccacagcuggcaggguguccuguccacuguucaggacucaccgugcaguucgccaugcacggagccaaggaaggcagguauggagauccgggcuguucugaaaagccagagcuuuggcggcugcggaccgauuacacuugauagguuuuguuucaucucgucuucauauagacagugagacuucaggauuuucuggccagagcgagggucaccuuuucucccuaagucaucccuuagacguucauuuaaugcauaguuuaauaguucuggaacauuccagugagcgacacgcagagagcauguucagagcaacgaugacguuucuuuugagucacuuuccuuuaacugcaguuggcugcuuaagucugaccgccauuccucucuucuaagagagauagcggaugaagauauugagaaguuguaaucugcagugacauuuaaugaacuggguuuguuuggccuguggggaugggaccagcagacaccguuaggguguccuugccugcaucaugcccuccuuuuacagaacuuaaugacggcuuugugcacagugcugauggucuagguugaaaaccuggcugcuugaucgcuggcccgaugaucuuugcugccauacugugggagaauuucgggcaggugcuggccugaugguaauguucguucuuccuuuaauagggaaccacugucaggguuuuaaaaaagagguuuuaaagaacacguguuuccgugagaugggugccuuggccgccgugcagaagagacucccagaaggaugagcaccguguucuucuggagagauggggagcucuuuugccugcacccacgcagcuucugagccugcuggguaagacccaguguuggguguguggcugagcauucccgugauauuuuuacuuuggguucuugaguaugauaauuucuagaaugcagacugacuucauuccacgugagacugucacacgaugucaucugaaaacuguaucaagcuuugaaaaugcacacuaaagaauuuuuuuuuucuaaaaaaaaaaaccacuuuuaaaauauuugccuaguuuuguacaguccccauucauguacagagcccucccucugagguguauauuuaauuaaagaguaaguucuacauguuguccaaauacag

SEQ ID NO: 4880 - RNA, 4350 nt, Mus musculus
uagauagauuaagaagacuuuuacuugacaagugccuccucucgaggaucuucuuuaaaaccauagucaccuggcauggugguacacgccuucaaucgcagcacuccggagguagaugcagucugugagcacaaguccagcauggucuacaaagcagguccaggacagccaggucuacacagagaaacccugccucaaagaaccaaaccaacaguaaagagagccugauagcaauguaacaagugauguggcgcugcucauuucaagccuuguccauugucuuugucaguguugugaucgugugacucaaucguccccugguggcuguuuccugucuacugaucccuauguccuggugccugaccucaguguguguguguguguguguguguguguguguguguguguguguucauuucuuuucuuuuuuuaaaaaauucuuuuuuuuuuuaauuuauuuauuguauauaaguacacuguagcugucuucagacaccccagaagagggcaucagaucucauuacagaugguugugagccaccaagugguugcugggauuugaacucaggaccuuuggaagagcagucagugcucuuaaccacugagccaucucuccagcccguguguucauuucuuugggacaaaggcuuccugugcugcccaggcugcucuuggcuggcugucagguucaaggcacccuucuccuucagcaucccgagugcuggaaggacaggcacccugguuaaguuuuaacacccuugcaguccuguggccagcuuugugacaguguuucuauuaaauuauucccccauuagggcaacauagaaaugacuauuaguugaaaacuuacacauugaagaaaugucuuaaacuguagggaaaaaaaaauuucagauucuacugaagauuuccucuggagcaucugcucugaccaauaggaaccugcagggcucugaggcucugaagaggcugccauuccccugagggcucugaaugggaggaggcugcagugugggcauguucgcucagugacuuagcaguacuggcugcuguacugcucaugugcggaggaguuucagccgucagaagugaccgugucuucuguuugcaggcauccagcucagcgaguacuugccagaggugacggaccuacugcgagcagagcagcugggaagccucaaguccaacucuuacuuugaguuuguucugaaagcaaauuaugaguauuauguccaaggacagaugugacauuuguagaaaugguuguuucuaaaauuuguguaaauauuugcuuauuaaaaaaaaauauugaggccaaaaaacuuaggucuggaucaaccugaagucuguuuugucugcagcaaccagguuuucuaugcuuuauaugggagccgcgauauaaaaggaggggcccugaugcucuuuuucagcuguaagguauuuccuccuccucuuccaccugaagucacccuugcuucuguguagcugcccuucuccagccucccucgguccaaagaggcagcaaaacaaaacagguugccucgcuccccaacugguuguccaauaccagcccugaaaaaauauaagaauguguauaauaauauacaugaauuuacaugcaaguaacguucuaugggcugagcaagugugucuguuuauuugggucagcaauuaaaagaugcuacagguuggagagcagggcagcggaagugaggaaguguuggagauggcaggggacggggaaaacagauugcccucugcauguggcacucugggagucucugagaagcugaucucuuggucggaggcaaagggaagugccugcuuagcaaagugaagaugagaugucacugauuuauacuguggccuagaaaccaaaacccugggucuaacucgggagggugggcagcugguaacucacugggaauguucucacuuccuacauugauuuaaaaauuacaagcaaggggcagggcuggagagauggcucagugguuaagagcgcugucuacucuuccagaggacuugaauucaauucccagcaaccacaugguggcucacuaccaucuguaauaggucccagggcccucuucuggugugucugaagacagugacaguguacucacauauauaaaauaaaucuuuuuuaaaaaaaaaguuaaaacuuaaaagccaaaaaagccauauauauauguguguguguguguguguguguguguguguguguguguguguguguguaaaauuaaaggauuaaaagugugggccacugcauccaucaauaauggauaagucuuaaaguguuuuaguaagauguuuguguggcuuucugagcugucaguaaguugucauugcuaccagauaugguacuggcauugucugugaccccaguauugacucauaaaccuaggaugguuucuagucucaccguagacggucccuuccuaaacaucguaaugccaaggcuggucuacccagagauguugcucugagagcucuggccauggccuaccugucugaagaagggggcuaaaccuuuauggcaacuaucgcagcuucagaaugguuggcauguaaacuuacuccagcaguaaaaaugaaauuaagacuuucaguguugaauaucuuucccuccuaaguuuuaaaaacuggucacauaauccaucucugaagaaugaaugauuuguuucuaagucagguagcuaagacugucuccugguacccgguguacauucuugggauccuucucuuguuggccuauccguuaguucagcaugaacuaguuaggacugugaauggcagcagccacccuugucccugaggugagugugcuguauucugaggaugugugagucagucaggaccugaaagggcccuggcaaccuguacagagcacagggggaaagguuuuguuguuuuauucucuugacuggaugcuauggggagagccagaggucugcaagacaaauucaugguguuucgggcugucaugguuggucccacauucugaguguucccaguguggccucccccaccacugccagucuguccucagaauggcauaauauucauguauaaaauacaauauauguugaaaaacaauguguauauauguuguauauauuuaucauauguguaugauaugugcauauaaacucuggcuggccucaaacucucagccccugugccucagcuucccaaguccuaaaacugcaaguguacacaccagcccuggcuagaacaauuuuuuuaaggcgugugaagccugacauugagcucauauccaaaauaaacacaaguaacugguggaccuggaagcugggcuucuguuuugaaaugagcuucagucgaccaccuuuuguauugugugggcaauggugaguacuuagcacaccuuuggacuucuguucucagaggagcuccaguuuuccuucuccugcugggauggcagguccuugcaugcaucugcauugccuuaauaaaaacgagguuuucuuuuugucugcuuuucacuuguaagaaccagcuccuuacgcucggccgcccagcccgaauucaguccccagugugaguggagaggggaccagcucccucuccuguccuguccuguccugugacacgcgugccuucccugucaggcucugagguuccagaacugcugcugcaagaguugaaaggguagagccgaccugugcugcugcucacuagggaaagacagacugaugcuaauacaagccuaggcugcaacaggacugagggauugccgugcugccuguuaguuguccuguuugcuucugguagauaccgcaaggacuuacaggaugugagggguaaaggggcaaagggggggggggggagauuaagaagaggugugggugugucgcaugguggcguaagugcccugcacacaagcauuuaagggcccagcaagaagacagccggcgagaaccuagccgggauuccagagaaaaacugucaggaaaggaaagggugcagcugaaccuagaguuuaccugccuacucaccugccugcugcugcgccagguguggggccgcagguuuccuguaguucgcaaaccacugcguucaagguccacuuuaugcugucacgcaaagcugagaaaucugcauagugggauaagcaagagcuuucgagagucuggggcgguauguacagcccggcccgaugagguccagucaccuggacaauucucccuacauccaugccccaaauguaagcacccccaaagcugaccauagucugcauuugcugcuugcuucuuuuuaacaguuccagguccuggcccagggcacaggcaaagccacagagcugaugcccguuaggcagug

SEQ ID NO: 4881 - RNA, 52164 nt, Mus musculus
cuuacgucaucucuaggcgccuucccgccccucagguguucaagcuccgggcgcgcgagguucucgcuauuagcccgcgagugccgcuuccuccacgcucucugcaaacauguuuccgagcgucuccucuccgcgaaccccagggccggggacccgacgcgguccgcuagucgggaucgggcccacguccacgccuagagcgagcaggaggggucugucucugggaucugcgguuaacucgcccgugcuguucucgcccgcaggccggcgcagcucggugagcucacgguaaguggggguucggggaccagcgggguccgcuccacagcggggagguggagccuggcagugggguaagcugccgcagaguucgaaaguacuucuggucauucucgcguuuuauugucgcugcuuaaugguggcccucguuuugcccguucucuguuuaacucuuuauuggacccauggauucacucugucuccgcgcuacagaaaagaaugaaagaaccuuuugagcacuacgcuugcaagguaggaacauacuucagauuauuguaaagauuaaaaagucauuucuuuauuauguugacacaggucagugucgggcugcuguuuguuuaaaguugugguuugacucuguggcguuugacacgaguaacauuuggucugguguagucuuuuugugauauaguguaggaaugcagccuggaacucaguccuguccacuuugggacagcccaugcuacguacccuaggcugacuuugcucaauccacuuuuaagauucuucuauuucaagcaugcaguagcuugucuggcuaccaucauuuuguuuaacacuuccagcuuuaagucaggaucucagcaucucaggauucaguacaccuaucugagucaugguaagagccuacaaaccuggcaaaaauguuuucucagugccuagcaaaugcuuauuacuacauacugauuggcaguuaaaggacuugggccacaaaaugugaugguugugacuagguuacauaaaagcacuuugugugugugugugugugugugugugugugugagagagagagagagagagcgugcuucacuaaagaugcuggugugcugccaaguccacauguauaguagaauuguuacccuccucaauguaauuaacacgaaaauucagaauuggguuaccuuuuucuagaagaauuucuucuguucaucuuucaaaagugaauuucugggauggaaagauggcucuggggauaagagcacuugcuuuucgauaucuaucuaucuaucauacaaucauauauauauauauacacauauauacacacacacacauauauguauauaugauggguuaaaaagauaguaagaugcauauauguucugauacaucauuuuugcucaaaacaaacaaaaaaaccaguaaauuaaucucaaaaguaccugacaacuauugccuuaaaauuauuuuaaaagguauugcuggacaugguaguacacaacuuaaaauccuagcacauggaaagcuaagguaggaggacccuggaucagagcuagucuuggcuauauaguuccaaagcaaccagagacacacagugauguguguguguguguguguguguguguguguguguauguuuguguguauguuuguguguguguguguguguguguguguaucuuaagugaauuuuuuucugcaugaaaacaggaaauacugagucuaacagagacuuaugauuaaaauguaugaaccuacaagucuugugauaauucagagaguaacugugaugcugagagcacacgugggacccuuguuuuuguuugcuuguuuuuugagacaggguucuggaacuuacuguguagaccaggcuaaccucaggcagauaucacagagaucugccuccucucugugccuggcuuucacuuuauuguuuaagaagaacccuucacaguacugaccucagaggcagagguguacucacuucuaauuucugaacucagaugacucaggcauggugguuaguuuuuugugaacacaaacuagaaucaucugaguaggggggagcccaauuaagaaacccccacccccacuccugagaugacacagugguuaagagcacugacugcucuuucagagguccugaguucaauucccaucauccacguuguaucagcaacagcuuacucauauauauaaaauaaauaaaucuuuaaagaaaagaaaaugcccccauaggcuugccuucaggggugauuuucaugauuggugauugauguaaaagggccugacucacugggcagugccacccauuggcaaguggcccuggaguguauaagaaaguaaacugagcaagccaguaaagaccauuuauccauggccccugcuucaguucccgccuccaguuucccgccaugacucccuuggugaugggcagugaccuggaaauauaagaucaaauaaacucuuuccuccucaaguugcuuuugcucauggucuuauaucauagcaauuucaauaaauucuauugaaaagugcagucaguuacauagugcacaccagcuggugucuuucaccauuacacaucauuagagauagcucaaguagguuuguaaaggugagcauaaugggaaauuucaaguuauaguuaauccuauguggucucuuucuuuagaggaacgccuacucggauauucccccaccauuccauaucagagucugugaacuacgaugugagaguguuuggaucaucucucccuguuaagaucauggaagcccugacaauggcugaggguaggugucaucuuuucauuuguucccauauuggucaauaaccaggucacaugugaugacauuuuggcuuugucugguagagacguaggcagccugcugagcucuccccaucccugagacauugaucugugaaguugagugaaucuuuauaagauagucacaucagugaucagugauuuuuuuuuuuaaagauuuauuauuauacacaauacacuguagcuaucuucagacacaccagaagagggugucagaucucauuacggaugguugugagcugggauuugaacucaggaccuuuggaagagcagucagugcucuuaacugcugagccaccucuccagccucacuaauaauuuuuaacuuaaagcuuugauauuuguguaugucacucacgucuguucagucacagcaugugggggcucaggggagcuuucagaucaugaagcuugaguagcaguggauacaaauguccuguuguaaaaggaccgguugccguccuucagcuuaggcaccccggcugccagucccugagcuggcaguguucacacugcuacccuccgccaugcauccuccucuccaccuagcuucucccccuucauucucuuuuugucauccugaaauuuuuuuucgccccugagacaggauuuucucuguguaguccuggcuguccuggaacucacucuguagaccaggcuggccuugaacucagaaaucuaccugccucugccucccgagugcugggauuaaaggcguccgccaccacucucggccauccugaaauuuuuaauucauauucugagcauacuucuggucaugccauguucgugcucacagugcauaggcuccccucuaggaguucaggagugaaucccgagaagcugagaucuauaaacaaaagagcagugcagacuugaagaacuugucuccauugugggucugaccacaucugauguugggucagaucugcacgggguggggcugaacacucacaagcaggugcuucaggucagcagaaaguucugcacagcuugggcgcauuuccacaguuagcauauucauuuccagugcugugugcuuugcacugcuacccugucuaaaagcaaagagcaaagcucaaauaagauucucaaagcugggaacacaugaaggcuuaccaccgcucccuagacacagugguguauugacucauucugucccuuaggaagcaaugcucuuguguuuccuuaggaugaaaugguuacccucgcuaaggagcucuguuugaaaauuauauucuuuugaaggaaugugauaauuucuucaaaaauaguaguuaauacgaggguuauuguuugguuuaucaaauuauaagugauucuuacagaaguuaaaucgucucuuugguuuuggggccaggagggggguagaccagacugacuucaaacucaaaaagauccaucugucucugcuuccugaguguuggaauuaaaggcaugugccauuaagccuaucuaagauucuuuauaacagggcuagagagauggcucccuuccaaagauccugaguucaauucccagcauccacauggcagcucacagccaucuguaaugggaauccagugccuucuucuggugugucugaagacagcgauaguguacucauauacaugaaauaauuuaaaaaaaaauuuuuuaaagauacuuuauaacaaaaguuaaagaguauuaaacauauacccaaauaguuuuugccuuuguauauguuucuaaagguaauuaucagaacuaaauaaaucucauuuuugauagauuaaucuuaaauauuuggaaguuaugugacuugcauuuuuaaauuaauuuuacuuuaauaauguauuauaguaguuguaucuuugcacaccuaaguauauacaugcaccauguguaugcacgagccuguggugucagaagggucagugggcucuucgagagcuagaguguuaagugggucuauaucgucaugugggugcugguaaccagacccagguccucugcaggagcaguaaugcaacugccuguuuuggagacaaaugugguaaaaaagauguugcuacaaggagaugaaacgacuuuucauggucuggaugugggguuaacugcaugucuuauuuccucagcugacgagcagcuuucuguccaugucgaugaaggugggugggccugccugguaugcacggagaagcuccucauuuggaagauugcugugucgccugucacuaagguaacggcccuucagauacccagucaggaaaagggaucccggcugauucuuucuuuguacuuuucuucuuugaaguucacuaaggaggcugucagcccgagagagcauuaagaauucaggauauggaggcuagugagauggcucagcagggaagaguucuucugcagguucugaguucaauucccagcaacuucgugguggcucaccaucucuaaggggaccugaugcccucaggauguauauguagggagagagaggcagagagaaugagaauaaauuaaagaaaaccaccagauuuuuaaauaaauaaaaaaaauccaggauaaugaaauauugaauguacauguuaguuggaaaaaaaagcuuuucuauuaauaguuuccuuuuauugaugucuuuaguguuuuuccuucucuaaagacccacugcagccaaacugaaugaacaugagcuugagcuacuacugucugagcucuggaucaugugcuguuguagaaaauguucccaaucgaggguuucucccaauccaggguuucucccccaccuuugaccacuuaguuccugauaaaagacacacaaccuuuauauuuacaaugagccucaaucagcacuagagcuuugcagauaucuacccucugugguauaaaacuccauuuuccuaucaguaaucccagauuuuuuuuuaaagauuuauuuauuauuauaucuaaguacacuguagcugucuucagacacaccagaagaggguguuagaucucauuaugggugguugugagccaccaugugguugcugggauuugaacucaggaacuugagaggagcagucagugcucuuacccgcugagccaucuugccagccaguaaccccagauuuuaacuuacuauguuucaucuggccugcucuuagcuccaguuggccagcccuuggguccauguuuuuaugaacucaccuaagccaugguggcuucucuaagguaucccuucgcacuguguucucuugaggcugcaagcugccugaacuugcucaccauuaucuuccuugcaguugaguuuuuucugaaggaccagcucaaucuacucaccauaccguguaucugagugcuuucuauguuuuagugaaaguccagugggggguuaggaaccugcaccauguuugagagaguacuuucaacccuggaaaugccaugugcaagaaagacagacagagugcgcaugggcacguguguguacaugugugugugcauauucucacauacugagaaugcagguuccuguccuguaagauacucuuacaauccugggggagcacccugggaaggcguucuagagauggcucagugguuuaauguauguacuugguguucuugcagaaguccccagcucgguucucagcagcuacauggugccucacaaauauugacagcucuaauuccaaagggauccaaugccuucuucuggcccccauaggcaccagcaccagacauaucuguagugcacauacaugcauguaggcaaauuacuugugcauauaaaauuaauaauuuuuuaaaaauuaaacaaagcagcccagugugguagugcaugccuuugguuccagacuccugaggcagagacaggucgggugaguuuuuguggauucaaagucaguuuagucuacauagucuugaauuucaagacaaccagggaaagaaagaguaaaaggggaaagggaaaguguguagagagagaggaagaggaagagaagaaggaggaggggagagaagaagugaggaaggagcuaaucccggaucaucagcaugguguucucuuacucuaagcuccuauuuucucuuccuacuuuaaacuccaaaaggauuaucagguggggagaagaggagccgugccuuuggcuaacaucaacuuuaaauaugaguggcuuaagaugccagggaggaauuaaauguuggccuucaauguagaguaaauauagaccagcagcucucauugcccuuauccucagccaaacuugaguuccuuaccuugauaaaggaaaccagacccaauccaacaggcuccuccccuacacagagagcccuucugucuuauccuuucccaccugaagugcuuuggccauuuaauaguuuuuaaacaaaaucuguauuauuugcacuuaauaaaguuagauuagaggcuuugagaauguccagggaccacagugcugagcagugccuauagaaaucuagcacugguacggcccacacagcugagaccugagcaugcuuguuugugaguuggauucauagugguaaaaugacaugaguugcuaggccgaccuugguggacagcucccaacaguggaagcauuggugacacuucuaacauccucuuagccuccucucaagaccaucuccuagcuguugucacuaaugugggucaucgucccaugggagcaugggcuccuuccugccugaaucuuggugucugaagacuugccgcccuccuuggcuacacagaaaggauguguacuuagaaguaggaggggggauucugcauguguacugaguuagcagagggaacugaguguacagcuacaagccuaagaaauaguuugauggagacuugguguaauuucucucugaccauaauaauuuuacaugucaaauagauauuaccucagcuagcaaaguuuugcaggaaacuuggccacuuccccuagcccagugguucucaaccugugggucaugaccccauggacaucccauaucauauuuacauuaugauuuauaacagcaaaauugcaguuaggaaguagcaaugaaauaauugucugguugaggggucacugcaacaugaggaaguguauuaaagggucacaucauuaggaagguugggagccacuuguaacaaguagagcccuuggccuggcaugacaagcacagacugguucauauagagguccauuuuagcguccaugugucccugacuuuguuguugaucaaaaagagcugagaaaagaaggauauuguggaauaguguuucaggauggacucaaaguaugcagaaaaauuagaggcgccagaaugaacaaauuggguugaauguaaagguuuuucuaucuggguuugucuuacaguugucugucugcaaagaacuccagcugcccccuagcgauuuccacgggagcgcugauuugguggcccugucuuaugcugcgaccucaggugaaguccauucugugcagguaggugacuuggaaaugacuggaggcucagcgggugggagccuguggggcucauacagagaagaugggcucagugcccagcacccacuuugggugacuuaugauugcaagaaacuccaguuccaggcgacccaacacucuuuucugaccucugcaggcaccugcaagcagguggugaacguacagacaagcaggcauacaugcagacacacauuucuuacaaagcuaacggagagccugauguggagguacacacuuaaucccaccacuggggaggcagagaugggcagagccuggucuucgucaaauuccaagccagcuagagcuagacaaggcaaguccucgucucagacaaacaauacuuuuuguaaaauaagaauaugaaacagcaagaugcagccugaggaaauacucauaaauccaacuuaaaaacagagauggcccagagguuaagagcuuguugcuucugccgaggaacccaauuuaauuacagcagccacauggugguucacaaccaucuagaacuccaguuccagggaacuggaucccuucugacuuccacaggcaccaggcauguacauaugcauguacauacacgcaggcaaaacacucauauacauaaaauacauaaaccaaagaaaaagaagaaaggaaaaaaaagcagggcagagucuucaggagacacaacuuuaccgucagcacaugaggagcuguguggcacugucagccguuagaacagugcacacagcaccaguggggcacugcugcccagcuguagaguggcugaagagccugacgcugccugccaacuccacugcaugcucuuaugcuagguucccagggucguuuccuccccaugacucccccaacccucuugaacgcaggguuucucuguguagcccuggcuguccuggaacucacucuguagaccaggcgggccuugaacucacagagaucaccugccucugcuccccagugcugggaucuguaaccuagcuuuggcugagucuccugcaucucccugcucccugucccucagaucccauguguuuauuaccagccucaucacccuccacacugcuuuuucuccucccucuuuaguuuccuggccucuaugcacacucgucgccacagaaagaaaaauauguaagaaaagcuaagauugcaugugagagcaaacaaagugcuugucccuccgagccuggaccucucaauagaauauuuuccaguucuguccacccaccugcaaaucuuauaauuuugauugagaaguggaaaguuaacacaaaggucacuuguguuacagcaguuuuauuugcaucucuggagcuguccuuugacagacagcucagucacaugugcacgcgguaacucaggugaaccuuggggagcugaggaggagaagcacagcugcagcucggcccuguugguuuugcucucugccuucucaaagugccagaaguuaagggauggaaacugguuccucaauaaaacggggaagggcagcugucaggucucaucaggagugggugacagaacugcuggguguccuuaugaugggugcuaacaccaucugcacauggggagguucacgugugugaacaguuuacuguugcuuauucuuuaaagaauuuugaugggcaugguuguacacaacaguaaucccaguacuugagaugcagaggcaagcagaucucuucagggcuagacagggcuacacagugagaccuucucuaaaauaaauaauuaaauauauaaaauaauaaaauuaaacauaaauucuuauuuucaucagugucuuaggcuccugcuuguaaggccuucuugcauuguugcugaugacugugguuuuguuucaaggcuguuucugucaugguugcuaccaaagagggguccauccgcuauuggcccagccucgccagggaagacaccuacucagacaccuguguggauuugggaggcgagaagaugugcagguuccugacagcagugcagguguguacagggagagcugcagcgugggcagguagggagggaggucugaagcuggaaauguggguucugaacagcuguagggaccugggaggcaucagagacaggcaaggaagagaagaaggugagggccacggugugaacuagagcaagggaggcuauucauugcacaguuacaaaugcuguuagaaagguucaugcaagcugggccuggugcgauauaacuuuaaucccagcacucaggaggcaaaggcaggcagauuucugugaguaccaggauagccugggcuacauauaaaagcccgucucuccccacccccacccccaaaaaagagggggaaggcgagggaaacuaauucucuuagaugcuaggagaauacuugcugauaucuacucuacaguuauggaagcaaucuaaggcuggcuuaacaggcacagggcccuugauuccaucccuagaaccacuuaaaccagauauuauggcccaugccugugaucccagcaucuaggaggauggggaguccuaggucauccuuggcuacauagugaguucaagguuagcuuggaaugcuugcggcugccucaaaaaaaaagaagaaaaagaaaccugaaauuuguugaacauacuaaugguaaacccuucauuugaagcucagauuuuaaaagaugaaauuuauuucuucuguaagaguauuuuuguguauugacuagugaaaagauuugguauuuauucacagggaggaaguuucauccuguccuccguggggagccaguugguucgauugauuccugaaagcucaggaaagauucaccagcauguccugccccagggccaaggcaugcucucagggauuggccggaggguuucuucccuuuucgggauucuguccccuacuagugaccucaugguaaguuuauaaagaacuccuauacacuaaguugaaauuucccuugacagugguauugccuucguaugaauguaagcugcuguguuucuguuucuuagugugaguguuugcuguguauguauuucugggcaccacgugguugccuggugccugcaagaagccagaggauagagcaucagauccucugcaacugcagucaugaacaguugugagcugccaugagggugcuggaauucaacuuggguccucuugaagagcagcgagucucuccagcccucuugugagaauguuaagguugaguuuggccugugugucuccuacuccuccagucugugggugucucccacuuucucuacugcuggccugggaggauggagguuuguucucuugugaagcagagcacuuccugaccucgggccaccuugacacuuguucccuugagucagguguaagcauagacuuaccaucuuuucaucuauuucugcuaaugaagcugucccuuuucucaggugaccuggguuuccaaccuccgugagagucucugcuucuuucuguuguucuucagugguuccccagcugcuucugggugcaucuccuaccacugcucugucaguucccugcugacacuccugcuuacaggcagggauggccaccgcacuguugcccugucuugcccuaaaaugaaauggagacaauggggguuuaaacuaaaaaccguuguguacaugacuuaaaacaucuguuuuguaccaaagagucuacucauacagacaaugaccaugucugguaaauguccuucucccugccugauucucuucacauucuuuuaucaaaagccauagccaaugucuccgggacuuauaaguuuauagacuucauacucaagccacuguuguggcuucuuacauauuuucuucuuauguauuuuuucaauuuuaauaaggcacugcuucucugagaauuguaacuuucccaucucccaacucugcuuuccaauucugcucuucccaggccucuucuuugacaaguuggucuugguuucaaggucuaccucucccuacagagccugggacaagaauucuagucagaaagcuauaaagcacaugaggucggagucagucucagcauguccccuucucucugcacagcuggccaguguucugugggacagaggaggaucaaguuucuacacccugacgaguucaaacaucagcaaaugggaacuggacgauucuucagagaagcagguucacagcugggaugugcacaggacccugaaggagagcaucaccgaugcuguuugggugaggagcaguagugcccacuugugguuuacacaucgcuuaugguguguggcugcucguuccuucuuuaucuuuuguuugcgugagacagggacucagucuguguagcccaggcugguuguggacucuuuaacccuccugccucagcuucccaagugcugggacuguaggugagcuucaccacagccagcccgucugccucauuuguuugaacacauuuccauguaauaagucgauagccauuaaauacguauaaguagguguucaguuccuaccuauaauagaccucagugguuaacuuguugauuugugagguggcaagauagaagacagucuuguguagcucaggcuggccuuuugccucugccacuuauucacuaggaauauaaacaugugccaccauacccagcugaccuaauguucuuuuaaagacaggguaucacucuacaguccugccucuccuggaacccacuuuguagaccaagcuaucuuuagucucacagagaccugccugugucugccuccuagguguugggauuaaaggugugcaccuggcuaguuuuuaaauguucauugcucaugggcaaaacacuuugccaggugcugggcacacagugguggaaaaaaaggcacaguaacuacugggagcuuacacuuugguauuuccauuuaggggucugaaaguaacuaugaagcuauuaaagaaggggucaacauucaguacuuggacuugaaacaaaacugguaaguacuuaacuugucuuaaagaaguuggacaacggggugacaucuuuguugugcugguguucuugugguuacuaagccucugagacgucuguuucuuagguaguggugcugguucaugugggaaauuuaaacauuccucagcuauaaauaguguguuccuuacaucuucauggcuugcacagcuggcccggcucugucuuuauuccaucuuaaggugaugccagcacccccuccuuucuguugccaagggagcccugaacaguggucuuugcucuauggagacauuggguucucgucaccguuagugaaggagcucuugucccacagucagugacuaagcugauguaaugaggcuguguccuccauugcgagcuagacucagcaugguuaugcuuggucuuaggaagggcuuggcagaucacucaggcauccugaggcaagaggauugggguuccuggccagcgugagccaugcacaagacucugucgaaaacagaccaaguugaagacuuuuuuguucuuguuugagacaggguuucucuguauagcccuggcuguccuggagcucacucuguagaccaggcuggccuagaacucagaaauccaccugccucugccuccaguguuggaacuaaaggcgcgugacaccaccuuaccuggacaauuggagacguuuccugugucccguauguucugguuuugguguggcacagccgguguccuugcuucucggaagguguugcggcugccucuggucaugaggggugguuaucuccaguaccauugagucuguuagcuuguuucucagcaggaccugaaaacccuguaaagacuuaggagucuuuacugaguuauuauugacaacguugugcuuuccucauuuuagauguaacgagguuagcuuuguuuuguggcagcuuuguagcacaaguuagccuuggccuugggguucuccugacucggucccuagagcacuggagcaccaggcauguucucauuccuggcugggauuuccccaucuuaaguuuauuaauguacagguucuuuuuuuaauugauuaaaaaaauuuuuuuuccuaugcauugcuguuuugccugcauguaugucuaugugaggguaucauauuuucuggaaccagagccacaaacagcccucagcugccauguagguacuaggaauugaacccagguccucuggaagcaaagccagugaucucagcugcuaaaccaucucuccagccccagcguguagauuuuuauauaaccuguuuaucaauguuuuacugaucugcagaauuucgauugacuaccuacuguuuucacugcuuaaaauaacuuuauggauuuugggggauuugguuugugggagauuauuuuguuuugagacaugggcucacuguauaacuggccuggaacucacagaaaucugccugucuuuacuucccacgugggguuuuuguagagguuuuuguuuuguuuuguuuuguuuuguuaagauuuauagccucucugucucuuucucccacucuguguguguaugucuaugcacauacacacacauacguauaccugcagagcgcagaaaacaucacauuccuuggagcuggcguuucaugcuugugagccuccugaugugggugcugggaacaggccucugaagaguaacaaaugcucuuagcaguugagcagucucucuagcacuauggguuguuuuguuuuguuuuuccaauuaggaucauagguaaaaucagggaauccuagcccuauaggaccaccucuuaaggacccuguuagaugaguaacaagguacugccucaguagcgcugggugaacaagcauaggugcugcucauggccuuaggucaccuugaccuuaguaauggacugugcuaauucccagacuaagccaggcugauugaauaagccaggugcauauagaauagucaucuuaaccacaguccugauacagaacaggauugauuggugcucagcgcuagagcaacgucugcauacacucggcagaguuuaaaccucacauagguggcaguggggagaagagaucacuuuccucccuuugugccccugacaguuacugauccguccuucaaaguucugucuuuuucagaaugcuguauaaaugcuauguaauacagcuugacaugguugauuuaaaaucaauucagaaaugucuccauuuccuuugcuagauagcauucaagagaaaauauguguagauauaucaggauuuaucugcucagcaguugaaggcauucaguuguuuucagguuggcuacuguaauaaagccacuguaaacauuugcauuaaggcaauugugagaauguuuuuuuuuucuucccuuaaguauucaaauaucuagguucaggguucuaguuuauaugguguguauaauuuuguaagaaucugacuuuacaaagaauccugcaggguguaauggcaucugccuuuggaccucugaaucucaggacagccagggcuguguauagugaaacccugucuccaacaacagcagcagacacagaggccuccuuucucuucccaccccuuuucuagcgaugggcuccugauuuuggcagcagcguggcaccugggagacagccccugucuugucuauuacucugugaucacgguggaagacaaugguaaccagaugucagaugcagucaccguagaagugacucaguauaaccccccuuuccagguaaguucgucacagggaggccacagcucaccagaguccugcauagccacugguggcuuuaaggcucacuggcaagauuuggaaauaguuguagauauuagugcguuuuguuuuuccaucucccucucuggcccagugugaaguaaagaaagaugauacugaagguagcccgcagccaguccuuggacgauuucgcuguagcucgguauugaguggaaaggaaguuggaugacaagcugcauggugaaauacuuggauucaaauuuuggggggugugcguugguuuguaguugagaucggaugacuguguagucuagucugacuacauauucaagaugcagucuugucucuugucucccaaguuguuauuauagguaugugcuaucgugucuuccugggauucaguuuugagaccuuuauauuauaaacaaauuccaugugccuaggggagacugugauuuauguacucacaaaauaaaccaccaggagacagcaucagugauguugaguauaaacagaaauuaaacacguucucuaguaacuggcauuugccagggaagccauguccuuuaaccucauguagcaucuaagucuauuaagucuuuacuuacuugagacggagucucacuguguagcucuggcucauccuggaguucagagugcugccugccucugcccccaugugcagguguuaaaggugugugaccgugccuggcccuggcuuguuuguuuggggaucuacauugagugcagugcuggcgggggcggggcguuguaugugccucuggagcugggcacaggugacugugagccaccccauagcgauccucucacagagcccuuucuccagcuacuaaaucuuuauucuuaauauacuugcuuaucuaaaucccauaagaaaaucuguuguucuuugauuuguaacagggauaaaucuuaccauguguuucaguucaguauaacuggaaaucauagcucagugucauuuuaauuuuucacaaagugccgaggaauauaaagaaaacaauuugugaauaaaucugcccuacagucucacuuuaauguuauuuuggggacgagagauggcuuagugaggaagagcauuugcugcucuggcagaggacccaaguuugguuuccagcacccauguuaggugucuuacagacaccuguucuccagcccagggggauccaaagugucuaagccccuguagguaccugcaucugugugugcgcauauccaccaggcgcacacauacacauuaaaaauaauuuuuauaaaauuuuaauuacuucucuagugaugguggcuguauuccuaguuuuaugucuagugaguuuguacuuauauuucuuccucugacuucauagugaacagauacucaauggucuuguauaugagagcuuguuuggggcccuugggcuugaagauguuuggugguaaaacaagagcuagcuuggugugguggcacacgcuuacuaggaaguacaugucuuacuagaggcagcaggucacaguaaguuuaaggucagccaagcagccaaagauacagagcaauacugcgucuucaaaaaaaaaaaaaguguuguuuuuuuuuuuuuucugcaucugccaguauaaaaauaaauaacaaaugagagcuuuucacuuuucauuuguugcaaacuuugaauuauaauguuuuugguuaguugguuggcuuuucaagacaggguuucucuguguagcccuggcugaucuggaacucacacuauagaccaagcuggccucaaacucagagauucucuugucucugccucccaagugcccagauuaaagguguuuaauccugccaccacacuuggcuuaucuuaacuucauagaagaauuucaaaauuuugcuaauugcagcucaacaaaucauuuuuauaagauaaguaucuuagaccguuggcccuuguagaacuaccuaaggcaggauaacguaugagcugucggaagucccgcagguuggguggagguccagaguaaaggucccagcagccgugcucccauugucauaggcagcaccugcuuuugggugcauuuaccuaagcuaagguaagcaggccugcccagcagagccuuccucagacuccaugguagcacgguuagcaguucagugucugaacuccagaggaacacaagcauccaggcagucgcagggauuauaaaccucccuguccugucuaugaaccaucuguguaguguaugacuuccacggaauaaucagugagugagaauuuuaacauucuguggaauggugucauauaaacaugguugugaaaaucauagauauuuuugucugaauucuuacuaacuauaauccuaaauuuaccuuucagucugaagaccugaucgcaugucgauugauggugccaaacuuuucaagccagaugaccuaucuuuacauggagaaugcugucuuugugugcuccacaggcacugggaaguuuucucuuccucaggaaaagauugucuuugauacacaagguacuuucaaagacaagaugaguuucuuucuucauugaauuauauuuccccuuugucagaauucagucaguccuaugcacaugucacauucugaacucccgugcucuacuuuuaugugagucuauucacucaccaguaucuuacaagguucagugagucuucuuaaguaaagguuuaugucaugucugagugcacugucgcuguccucagacacaccagaagagggcgucagaccccauuccagaugguugugacccaccaugugguuguugggaauuaaacucaggaccuucagaagagcagucagugcucuuucucgaaacaggguuucucuguguagcccuggccguccuagaacccacuaugcagaccaggcaggccuugaacucagaaaucagccugccucugccucccaaaugcuggcccagucagugcucuuaacugcugagccauccuuccaauaaauaauucuuaaauucuagcucuuugaccaauucauuagccauccuucaugguuucuuaucuuuuauuguacauuuugcuucugguuugcuaccugccaguuagaaauguuaauacuguuugcagcagcugaguucacagccaugcugaauaccuaagcugggcagaacuccuguuuucuuuacaugcaaaauuaguuuaaaagauuuuucuuuuccuuagaagagaccaaggagauaaguacuaacacugagagaagugagugcucuucuugguuugugagagggacuuacucugaauuaauacucuucauaauacuuuguccagcccuggcaaaaagaauccugggaccagcagauacugacggguggcacggccucccaagacugcuauagaggucagagucugggcagggccacagauacagcugcgugguggucccguauuguaugcuguuccuaggcacagcagccugccaacugccuagauuggccuuaggcaaggagcaagagggcgccacaaggcagagaugcugccauuuccaguuugcagaauaaagaauugggaagaauugaggaggggcuuugcucacuguucccuugcaaggacaagguuugguuugguugguugguuguuuuguuuuuucaagauuuuuuuaucugugcagggacaggggagggggcggggagggggaacccguggaagccagaagaggguguagucccugcagcugggguuucgggaggcuguagccucucagugaggucacuaagaacugaacucgucgugugcagaagcagcaagugcuguaacugagucauugcuccugcccaguguuucuuguuuguaaguggaaaggccgucugcuucauggaguaggagcaggaucuuuauuuaagugucauaagcaggaaaggucacaggccgucaagacagugaggugguagagcugaggaauuaaucugugccaucuugguguguucuguucucaggggauggcauuuugggcgcuggcuccugugcugguguuccuauccuuuucucuaggaauaguggucuggugucugucacuccaagggaaaauguaucccuguuagcagaagaccuggaagagucuuugaccuccucaguugguggacggggcagugagguaaggaucgaagaucguuuaacauuuccuucaucagcacauucacaccaggccgcgggcaaggucugggagaucacuuccugguuaucuugcacccagucucuaggucuucuuucccagagcagcugcuuguaggucacgggcauuccuucugcucuuaccucuguaucuuugaguugggacuugggacaauucaugcuuccuucucuccuuuaccuuuccuaggagcagggugcggggcgacugcuggugugguuccugggcccagggggcacuuguggcaucacauacauugugcagccgugggauuccggagcacuggcaguguggaugucgcacacaccauccagcggcuccugggggugcugguuggggaguuuccuguggucacucaggaagguggccaggcuuagccugcugacuguccagacccuaagguccuguucccaccuaugccaggcagaccuguaugccaccuuacgaggguucuggggaaucaaacucagguagccaaacuugcacagcaaguaagugucuaauuccgacauugagagggcucagugacaccagaggaugaauuccuagagucuuaaugagauuaaagauaaauaaaaaaucaacuuuguuaucuuggaaccugagauaacuuuuucuguaaguuugaggguuuuaaacaauaaaaaauauuucagccacaaaaggacuaaaaauauuguuuauggauuuuuuucaucuaaggaugaaauauagaaauauuuuuagacaaaaaauauuauuuugacacuaauauaaccaacuguguuucuuucaacaaacuccaaagcuacuaauauaaauaaacaaauuaguugauuaauuaauuuuaaaaaagcugccuacucuuguuuacuaauucaauaaucauaggagcugguagaaaacuuaguaaugcuauaacaacucauauuuuuguaguuuguaguaugugagaaucugaaauuuaauaaaagaaaauauugccuuaucuugcaaaaaaaauccaaaaaguuugcaaaaaauauuuucauauuugcuuaaaauauguuuccucuuucacugaaauacauggcaaauucacauauuugauuuuguucaucguaagacacuggcuugucuaaugucuauaagucucugugucuugcuguguauguagcucagacugguauugaacugucuucuugccucauucuccucaagguuggacuaacaggcaugcgcuccuaugucuaaacuguguguagaguguuuucauaauuaaaaguugaagugaaugaagccagucauggugguacaagucuuuaauaccagcacuugggaggcaaaggcagguguaacucugugaguuacaggccagcauggucuacauagagaguuccagguccugucucaaaaaagggagggggaugcuggagaaauggcuaagcaauuuagagcauuugcugcucuuguagaggaccuggguuugauccuagcacccuuauagugcucagaaccauuuguaacuccaguuucaggagaucuuguucucuuuccuggccuuugagggccucagguacagaacacguguguacauauaugcaugcagucaaacacucauacacauaaaauaaaaauaagcauuuuaaacaacaacaacaaaauuggaauggauuggcaguuuguccggaaggugguguauuuuagcuccuguugugaucacguggcugguuaucuggcagugcugcuccaugguccugaguuccuuuugcacuguuccguuucuuccuaguucuccuuaguccugcucagccgugucauucccgcuaaugcccauugugacaagcauagagacaguugggacaguucugaccaauggugggaaaguccugaguuaccugccuuuccugcagggcuuugauuggucaucagcaaucagcucuggcugugugaucuaccgcaggaucaccuuucagguaggaaugauccugugccuucaccucuaagugauagcuuuuuucuuugcagaguaugguuuuugagaccaccacaaaaaacgaaacuguagcccaugaagacaagacaaaacugcuuaaggcugcauuucuacaguacugcagguauggcaccuaagaucucucugucucugucucuguguguguguguucauagaauccagaaaagggcaucagaucucuuggagcuggaguuacaggcaauugugacgcaccugaucagggugacaggaaccaaaacguccucugcaagagcaagagccgcuccuaaccaccccagcacauacccacgcaccucccuguugcuuuaugggucuugcuguguaacucaggcugguccuccuaucuugcuccucuaaugcaggauuuguagccaugaccacuaugcucagcuggccuagcacauuuuaaaucacagcguguuguaaaugaauuauccuuaauauaaguauuagcagcuaauuuaguccccaauaacaaacagagaaaccaagauuuaaagcugccccuuaauagcugaccccacccuccucugcuaauguggcugccucuuagcccaucccagugugcuuugauaauauuauugaucuugcaccuugggcuuagcuguguuuccaugaucuuucuccagacccccugccucauggcuccaccccuccauucuccuggaggaucugagccuccucucuccuuccucugcuugguccacagcccgcccuguucucuguucugcccagccauugggugaucagcauuuauugauaagguagagaacaaaugguaagaauuacacaaauuugagaccagagauuauugguauaaggauuacaaugcccuguccagauugaaacaggauauaggagcagaaaaaaaucaguauuugauuaacacaaggguaaacuucacacaauguacaaaaguauaagcuacagcuuacaguugugugggacacaguuugcugaugcuugcugugcacuggugggcacugagagcuaguggugagagugugccguuucgaggaagucuuucugggugcugagguucuaaacaauuaucugaaccugacagccagugaggccccguguaggucgggagcaucggaucuuaacacggccuucaugggaaacaauggccauucaaauuggcagucuugaagacaguggacauggucucccuuauaaaguaucaaaguggauaaauugcagacugaguuguauggauguugcagaagcaucuccuuugacuuagguuuaguuaccacagaacccaguguucuucaggcuugcucagauucugcaguuuggcuguuggagaucaggucggguggcaguugggcaagucccagcugugcucucguugugcccagauuccgauguggcuguuucuggccuggacuucucacauuuguagggccuuggcuggcagcucuuugcuuccuguagagugugauugcugccuugacauuugagacagguaaccaguugggggcaucuguugagcagcacccuugacucucccacuagaagccugguaccacacugguccuucccccuguuuguuauaaccacauuaucuccaaacauugucaaauaguccugagagucaaacauaacagauaaaacuuucaaguguugucuauuuuuuagcuucauauuauuugguuuucauuuuucuuuauucaaaaaauuuuguaaauacaagguguuuuguuuaugagaguuuggggaagcaucuguaauuauugauuaggucuuguacaaguagaucccuauagccuguuggaagccuggggcuccagccccaguugucgacagcuggagaucauuucagcucuuuggggcugaccacgugucuuuagcagaugagucaccugugcaaagagccccuagaacuugaccccacucucacgggcuggcugggcuuguuuguggagugcaggguuccugauguacuggaguauguuuggggcacaguagccuuagaacugugccgucuagguuuuagggcaugcguguacaguggaaccgccaugggcacugguucacaugucaguuucuuaucaucacauuaucugccuguuacguacuuuccuucauaggcaggauugguuuauguuugaauagacuugggaaaaugccuugccugccaagucugucucuugccagagcagcgaggcuguagguagcaugguugcugguucuggcaguuugaggagaggggugaaggagcaguaguuugccuugcaugucuugguuuggaaagaugccucuacugccaccugcaggauggugcaggauggugcacguucacuuaggagacucuaagcuugucagucuaacacugccuuguuuauggucugcuggucucccuguccuguccacaugggggcaccaccagauaguggaguguguauuuauggccuuguauugcaugguugagucuuacuagagagauuuggguuauuucaucuugcacagguuucuagugauggucuuguagacugugcaugaaagugcagccaggaacuguagcuuucauuuugguuucuuauggcuaccaaaacaaaugaccaagccaggcagugguggugcacaccuuuaaucccagcacuugggaggcagaggcagguggauuucugaguucgaggacagccagggcuacauagagaaacccuguuuugaggaaaccaaaaaagacaaaugaccauaaagucuguggcuuauggggcucacauuacagggucacagggccacagugcccuggagggucugggaagugcguucaugcucucauccucacaaccauggccccugacaagcuugugagcuuguugaugcuucuuuucuguuugccucuuucuaguucuuuucuuucgaggcagcgacuuguguagccuaggcuagccuagaacuggagaucauucucccucagccuugcacuccuugugcuaggguaucagacuugucccacugcacucagcacgugaccuuacaucagcuguaggcuggguuuugcccccccccaagaucauccuuaucuuaauucauccuucccaaauagagagcaccgaggcuccagguagacaugagugugggguguugcucaucuaaugcaggcaguuugagguguucccagggaaggguuaccagguacagaaaggggccucagccuaaauagucucaggaaguguuucuggguccaacgcagcuauacccuagacccauagcuauacccaacauagcuauacccaagagcuuuacuugugcauggcucaggaccaggaguuuuaaggaaguggacacuucacaguaaaaacaccauucuuccacuagaguucugaguuacuaccagauccuccuaacuucccauauuugacaguuggacuagaguggcgccugcacacccucgggacccugggguugugugcagccacacaccgcagucugcaggcugugcauguuuagaucuccuucaugccuucucgguguaggccauauuuaucuucuucuuggccuuacugguaucuggguauuuucucaugacucugcccagguuagaagaguccucuuuuuaggagcucacuguccuucaugcuguugcucuggaacuuuccccccaaacuuuccaggugcaccggcugguuuugugucaacuugacacaagcuggagucaucagagaggaaggagucucaguugaggaaaugccuccaugagauccagcuguaaggcauuuucucaauuagugaucaauggggccagccccuuguggguggugccaucccuuggcuggugguccuggguucuauaagagagcaaggugagcaagccagaggaagcaagccaguaaguaacaucccuccaugccccuccaucagccaccaaggucuugcccuguucugaguuccugucaugauuuccuucacugauaagcagcaauggggacguauccuuuccuccccagcuugcuuuuuggucaugguguuuuauugcagcauuagaaacccuugcucagacacuaggugaccuguuuuuuacaucugaugcagcguccuuggugacaacagagcaugcucuguggauggcugauaccccuuggccucuuccuccagagagcucuccuucccucuaaaggguuuauuuuccuuccuggugcuugcugguguguuaguuacuuuccucauuguugugaccaaauaucugacaguuuaaaaaaaggaaggacuuuuguuguagcuuagagcugacaguggucaucccucauggggaaaggucaaagggaguggucaucacaggggauggucguggggagugcguuccauuccacuucacuuuuuauucagucuggccgaugacugagucuucccaccucaacuuagagaacuccagagauuugucuugaaggugacucuagagccuguggagguaacaguucugucugaccucuauguccaagcacuucccugcaaauauaccauugcgugguuaguggucugacugaugccauggugacuuucucucugucccagucauuggauggugcuuggccugacagaggcuucaguguauugaugaguguacagcugcacagaaaccuuauucuugugcuauucacagaccuuuggacugaagcguguacaugugaauuuagccuucguuuguguuuguguggggagcuugggaaagucuugccuucgugaugcauucucgcuccguucacggcaggaaagauuugggccgcgcucagauaauggcugaugagcuguuuuccucucacacggauuuggauucggacccugagcuagacaaggccgugacucagaucaguguggaccugauugaugacuacccggccucagacccacgcugggcagagucugucccccaggguaagucgacuugauucguuaugauggaggaauuaaaacggagcacagagcugaaaggaguguugguuuccacacucagugaccacuccgcacacuuuuagugucucaagcaguuaaagguagccuucccuccggcacauugugacaagggccccaaacacauggcccgugugucagaguagaaagaguucugauucuuagcauuuuaaucuaaaacagcuugguggcuguguuagucaggguucucuagaggagcagaaacaguaggaugaguaaguaauggaguuuauuagagcuuagagcacccugcacgcugugguccuucccguccacauggcaggccggcuaccgucagaaaauucaacaguuagcaguuguucaguccgcaaggcuggaugucucagcugcucuucaguacacaucagagucuccaaggacccggcucuugugccagugaaagagcggaccuuccagugagagcaagaccgagcuggcaaagagcaaaagcaugccuuuauuaugauggaggaauuaaaacggagcugagaggaguguugguuuucguuacuuggcugccaugacaggguauggcccagauuuagaaugggucuucugaccucaaaugguccagauuuaagauggaucuuccuaccaaucucaagugauccaguuaaauaaaaauaccucacaggugugcccaggggcuugaguuucuaguuaauucacguguacuggaguggacagccaagaaugacagccuucacagaggaguugguaagcauuugguucucacuugcuccaaaguaaauaguuucggcacacucuaagcauuggcugguaggaucucccagguguuggagaaauucuugguauucagaagugaacaccuccccucccccgcugucccaggugacaacccacuuaggcugcucugcauuccuaguuaccagaaagugugucagaugcaaaucucucuccacaccaaggucugcuuccgagaugucugcugagccuugcacgggacuugggacguuuccuugcugcuuucuuggagccaagucguacagugacuaacccagggcacagugucaagaauacuagguuuuucucugaauuuaaaagcucuuuugacacagagucucacuuuguagucuaagaugucccagaacucacuauagccuggucuagccuuguuaucuccugcucccacuuuaccaagaggucagaugacugaugugagccaccgugaauuauguauccaguugugcagcucuuugagugacauauguaacucuuguuaaggauuggugcucugcuccuuuuagcuccucccagcuuguuucuuucugucugcuacuguucugaaaaugguuuugugucuacauuuugcugcuguguucugacagaggccccugggcugagcaacaccucacugaucauuuugcaccagcuggaggacaagaugaaagcucacugccucuugguggacuuccuucaccaaguaagccucagcacuggguuagggggugggcugucacucuagcccucuuucuggguaucuuugagggccuuggcacacguggaugucagaggacagcucucggguguuucuuucucucuggugaucagauggucccuuuacccacugagcuagcucaccgcccgagaccagggauuuguaaaaaucagaaucucauacaaacguuuuugaugcuuuuguguaaaaacauggauuuuuguacacugauucuguauugucaggaggaccuugacugugugcugagagcugaugacaaguguggacacacccgcucaucagaagccacaggcagccaggguuugggcacacagugacuuggaggacauaauggaggcucagcugccaacagcucuaguugugugugcagacccaacacugcugucucuuguguuugcauucucuucuguggcuuguagggguuuuuuguuuuguuuuuugaaaacaagaucuugcuguguaaaccuagcugaccuaaaauucacuauauugaucaggcuggccuagagaucaccuaccucugccucccaagugguagguuaaaggagugagccaucaggcccagcucaucuccauagcuuugucucugagcaggaagcauuugcugucacagccaggacacacguacaacccagcucaguacuucuguauuugaggccucucuuugauugugaauggggugggaagugaucuggcacuguggcuguggucccugguguguacugggaugaucuuagcacacagcugccgcuuuacucugugcuccccaagcacucccuguggacggcucucacaggagaacugcgcuuuuaacuuacuuaaagagugggaaaaugagucaaaucauguaacgguacuuuuauuuuaagaaucaucagccagccaugguagaagcuuuaauuuuccuacucagggacaaaggcaggcagaucuuugaguucaaagccaaccuggucuacacagugaguucugucucaaaauaaaaagaaaaaaagaggaaaaagaaaaagccaugaaaugagcaaguagaauggagacgauggccaccgcgaaacaccccgcugcugaaguugucugucaugugagaagucaaggcacagccucacgaguggcaugagcccuguguuuugggggacuuacaguuugcuugagagggguuauuuuguuuguuuuggagguuaggguuucauguagccuggaauauguaaccagagccagcuuugaacuccugaucugacauuuacugccugagccaucuugcugcacccccacacgcccccuuuguguuuuuaagaaguugccugccgggguguacagagacagaggugagggaaggagaaauaaggucacuuguuaaugaagaaaugguacuuaaguguggaaagcaguccaucauuguuucaugaguuuuggcugcuuucuaguucuuguuauuguaauauuugauaaauaaacuagauccuggcaaccaaccagaaacaggcacccauacaggagacacugccugcccuucaucuaaagucguggcucuggaaaucauuccauaagaugguugcuccaaguuuccguaucucaacgcucuguaauccaggauaguaauccagguauaaaucagaaaagccaugugauccucaugcugucuaacuagugguuugagacguguagcagccauggauagaaucaguauccugcacggagcacugggagcagugucacccagagguggccuauaguggggaagcuccuuggagaauguggccacauucucugagugccuucugagaacaagugcuuguuguauuuuguuuuugugaggucggcuuguuuagacguuugagcuccuauccaaucagagggacacccauguccacccgacugcuacucugugaacaugcagaaaagcugucagcugccaucacacuaaaaaaccaccacucucgacugccagaccuggugaacucagcuauccugcucgcccugaacaagagggagugugagguucccaacagccugacuccugccgaugucuucuuucgagaggucagcugcgcccuaguucuugucuuccugugucuugugucaucuuccugugucuucucugagcugugccauguguggacaucccugcuggggcaggguguuaaaagaccucauugacauguucgcucgggcucccugccuauggaugcuguuaguuguguccucuucacugugugccuuccaaaagggagagacaguugacugagaagggggcucccucaugacuagcacaggaagcuguccuugcucaguaggcucuugggccucuagcuugcucugggguaaagaguugaggcacugugcacauagcagguuggagcagcuacucuuuuguguguguguguguguguguguguguguguguguguguguuuacacauguguggguuuuuaugccacauauagcccauauggaggucagagaacaacuuugaguucucuccuuuuaucauaugguucccaggagucaaacuugucaaacagcauggcagcagacaacuugaccuguuaaguugucucacuggcccaagaccaagcaucucugcagcugacuacagcccagugaccaucccuuccccucacccugcuuucuggaguggugcuuuauccugucugcuugcauauaacagcagcauaucccuaaagggugcuaagaauguuaagaggugguugcucagcucagcucagcucagaggaacauguuugauuuggcagccuuuguagacaaaggucaggagccugcugggagccgagccccaccuuggcauugacucaguuugggaagagcccgggaccacucaggcuucauaaaguagcacugaccacucugacagcugaguggcacagcagagggcugggucugcaccacuggacacuggugagagcauggagccuucauuggcuuuuguuagacauucauccuugaugucugcugggaaugugugucagaucccccaccccaaauaccucccccaaaucuaaaaguccuguauauaaaaugaccaagagcuauaccauccucuagugugcuguaaaucaucucuagguuccauuuaguagcuaaagugacaguaacuguaauaaguaagacuaacuuucuugguuuuacauuuacuuucaucauuacauuaauaacuucuguugaaugauggaaagauacaguguaccaaguaggaccuauuaucccuuagagccuaaugcugugacugucuacccucaggugucccagguggacacuaucugugagugccuccuggagcaugaggaacaaguccugcgugaaguugcguuggucucucaggagugggcagagguggcgaucgacgucaauacuguccucaagguacuguacaugacagcaguuucaacaaacggcaauccagaauagggacaagaagugguuuucuuaacccugcucuguguugccugaguuagugagauuacagcuguuuguuaaauucaaaaaagcuacaacagcauauauuuuaaugaucuaacacauuuuuuuuaguguuuccuuugugcacaccaauggguuucuauaauuuugacguugcauuugguaaauuuguuuuuguuuuguuuuuuucuagacaggguuucucuguguagcccuggcuguccuggaacucacucuguagaccagccuggcuuugaacucagaaauccaccugccucugccuccugagugcugggaucaaaggcaugugccaccacgcccagcuugguaaaguauucuuuaaggaagccuuuuucucuaacaucauugcagagguauauuguuaauggaguccguuccuuucucuggccuugaacuccuaguccagccucugucuuccaguuaacugggacguggacgugggcgugcacuaccucuaccuucugcguuuucauugcucaaaguuuguuacuuagauuauuaccuaagggguuucauucuguuuuuccuauucgacucuauagugcuuuuuuuuuuuuuaagauuuauuuacuuguuaugaaugugaguacacugccacucucuucagacacaccagaagagggcaucacaucccauuguagaugguugugagucaccaugugauugcuggcaguuaaacucaggaccucuggaagagcagucccugcucuuaaacacugaguggucucucuagcccuauagugccauuuuuuuucugcuuugguuacuuaauuuuuccgaaaugaagcuaaauuguagaauaaaacaaauuuuugaaagcugaaagaaccacaagugccgaauguuuuuuuacuuguaggcugguguugaggucucccuuaggcacaguguaugacagaaagagauuaacuggauuguacuaacggcuuauugcuucccaggugugaugauguauuucauuuucccaggacaugcuacaggcugccacucacuaccgccuaaacaaaagcucuauguacagucaggaagagguacuagggaaggagccagaguaugugccauggacagguaccguagucugccgugcuagugcugggucaguccuuagggcaggcuuaugagugagaucaaggacagguuaacggucaucucuagacucaaagggucucucggguggguacguugguugguugguuucuuuguuuugguuuuguuuucgagacaggguuucucuguguagccccagcuauccugaagcucacucuguagaccaggcuggccucaaucucagagauccccaccucucccucccgagugcugggauugaaugugucaauccagugaccaccacuggucacuuuggcuguaauuauugauucccuccugugucuguaucugaguggacuuaugaugcaccugccaggguuuagcagugagaccuccuccacagaagcagguggugguaguggaggacaaggcgcuacuucaugcucacaucacagagugggugggauagcuuugaaggagcugagaaggaagcaggaucucauguaccugggucucuagcugcauauguaucaaaagauggccuagucggccaucacuggaaagagaggcccauuggacuugcaaacuuuauaugccccaguacaggggaacgccagggccaaaaagggggaguagggggguggguaugggggacuuuugggauagcauuggaaauauaaaugaggaaaauaccuaauaaaaaauuuuuuaaaaaaaaucuccacugagaaggagaugggguucacagggcagagcaggugucaccugaacacugcuguguuuuccuagagcagugaggaagccugauuuucaggugguuggucuuucccuuacccaccauggagcccuuucuuaggacguuacuuuaaacuuuacagccacaagugguccauccgguauccgcacagcagucaugcgccagcacgggaucauccugaagaugguauacccucaggcugacagcaaacuucggaacguugucauggagcagcuuguggcacuaauugacugcuuccuggacagcuacguuucccagcugaagucgcuagagaaauccagugaccaagaacgauacagcagucuggaaguggaguaccugcagaaaagauccgagcugcucucgccccuucgugagugucugccagucggaaguggcugugggcggcaugcacaacggguggagcuggagaggugcaguuagucugccugugcccaagacaaaaccaggcacauguggagaaacaccacaggagguucccuugauugaaaaaagagaucaguugaugaagcugugcagauccccucagccauggaguucagcaugcuggacugcuggguggcauuuuuuagcacuugagaggcuggcucagaaaaaagaacucgggcuuucauaugaacagguuuuagaacagagccugaugguuguuggugaagggcacaggugcauggugugggcacaggugcacggugugggcacaugugcacggugcagcuguugagcagauagcaauuuccuuuuauagucagaucaggaagguuuguucugcuagugaguagugggagucuccucuggggagccagcaauggauucagggcuguguuugccucuuaggaaaguuuagguggaugauuaaugggcacaguuuauguuacaucaucucuuucuccugaagucacacuaggucaguacccaugggcagcuucucuggcagagaaguauugugacuuugauauccugguucagaugugugaacagacagacaaccaagcccgacuccagcgcuacaugacccaguuugcugaccagguaaccacacugguguguaugggagugguaguggaguuagcuuaccacacugucuaaagcuuucccuguccagaaagcugcuguggcuuugagaugaggagugagaggggaacaugacagauuuucacauuacauugucuuguugggcaaacucauccuuauguaaauagauugugaguuaccuuucuacugcugugauacaacaucaccaaggcaucuuagagaagaguuugaguuuccauuugcagaggcuuuagagucugcaugguggagcaaugcauagccauagaaaguggaggcucacaucuuaaccuccagcagagagggaaaaccagaaaugggugagucuuuacauucucaagccauucuguguugugaaaaacauuuuuaaaaauccuuccugccuuagagcacaaguugccuaacuauugugcugccuaaggcauaguuaaaaaugaagagcuaaagcugggcagugguggcgcaccccuuuaaccccagcacuugggaggcagaggcaggagaauuucugaguucaaggccagccuggucuacagagugaguuccaggacaaccagggcuacuaagagaaacccuauuugggggucggggcgggggcugggagggggagagcuaccaugggcuaggggccaagagaguguaucacagggggcugccucauuagagagcagcccagacggaacauagaaauuaguacaucauaacuuggagugaucucuaggaaaguagauuccgucagcauggagaguaagcaguagcccagcuauugugcugccuaagacauauuuaaaauguaaaggcugccugcaucuuucacccaggaauauaaauagucuaaggcgggaaggacccccauaccaggauguuuuaaaauacuuuuuacaacaauccccagugacauacuuuuuucaccaagccacaccuccuagaccuacucaaacagugccacugacugagugaggcuccaagguccaaaucuguaggggacaccucaucagaccaccacauaaacacugggagguuuacuggccuuugggaaaugcugucauuuugagggguuugcuuuuguuuuuuaacacaaggucugugucuccuaagugcuagaguuacaggcaccaggcuuggcuaacuuuugaaucuauucucuccuuaaagcguaaccagaccucugaagugcacagaaacuuagagcauccucacaggcggggagcucagacagacuccuacugucagcacuucugaugccagcuuucuguuuuuagacaaaguuuagaugcugccagggugauuugguugucccuuauauagcuacuuugucccaugaguuaaccuuauaaaagcauuuccccucuacuauuaaggacuuuuguauaaaauugagaacaugggcuauaaguagcugucaguggcuugaggaagaagacagguuuuguuuuccaacuaaggucucccgucugcccuugaccuccaccgaaauccacccgucccucccucugugaccugcugggauuagaccacaagcccagcugaaaacaggugguuguuuguuuguuuguuuguuucucucuguaacucuggagauccauccaauucugccuccugagugcugggauuaaaggcgugcaccaccaccacacaccuggcugagaacagguuuuaacgucacugagucccagugcugccuuuuggcggcgugcugcgugcucauaaggaguuugugucaguccugcagucaucagcacugaggccgcugcucugcguuccucuuugguuguuuucuuugacgucugugaguguugugccugcccauguguauaugugcagcaugugcauucccgaugccugugaaggucagaagaagccacagaucccaggaacuguagcugcugcuagcuguuagccaucguguagguucugggaucugaaccagguccucugggagagcagcaaguacucuucacugcugagucaccucuccaacccucacaccagugcuucucaguagguuugccaagagauggcuggauugaggcguaggagugcacuguccauaacuguauggaacauauguuugguuuugcuuugcuuuuuaauuaaaugcauauggauguucugccugcauguaugucuagacaccacacgcaugccuggaagaagccagaagaggguguuggaucaccaggaacuggauuaaauauaguugugagccaccguguaggcccuggaaauugaacuuggguccucuguaagggcagccagugguuuaaaugcugaacugucucugcagccccaacacuuguauuuugucaauacaggaauuacuugcuaaaagauucuguuuggggaacugcaagguggcuuagcaccugcugaccugagucagauucuagagccuccguggugggaagagaggaaagagagucacuucccaagguguccccugcccccaugcaugccauuggcacaugugggcacagucacacacacaagcaaguggaggcauugaguaguuuauauuuuuaaagcuguuuuacuaacuauugauacauucuuggucuauucuuuguagaauuuuucagauuuucucuuucguugguaccuggaaaaaggaaagcggggaaaauugcugucucagcccauuucucagcauggacaguuggcaaauuuuuugcaagcccaugagcaucucagcugguuacaugaaauuaauagucaggaguuagagaagguaagaugguuugcuuacgagaagcagcugguuaauuaaucuguuuuaacaauucaaguauugcuuauagccauacagcugacaaacagucagugucuagacguuucucacuggagacgagaucucuauuguguagcccuagcuaaucuagaacuguuguuguagaccacacuggccucaaagucacagaggccugauucaucuaccuugugaguaccgggauuaaaagcaucuaccaccacaccugauuuaaaauucuauuacaucguuuuuguaugugugcauaugcaagagcacugucaggagggggucagaaagcaacuucaagauaguucuuuucaccgucgguucuagggauuaaacucaggucugucuuggagccaagucuguuaucuaaugagccaucucugaaauauaaguucuuaugguauagauauguuagucuucuuuaucuuuucauauuguauguauauguuuaaacuucaucuugcauuccaugaauauauauauaguuacaaaacaucaauuuacaauagacuuuuuaaauuuaauuuaaaacaugcuauuaauggguugucaacacauauacuucagucuuaauuugcuuucuguugcagugauaaacacugugaccaagaacaacguagggaaggaaagguuuauuuggcacacauccuaaucacagugaccacugaaggagguugggacaggagcagaggcaggagccguggaggagcugcucgcuugcuugucuucagucucacacucaccuuguuauauagcccaggcccaugugccugggauaacaccacccguugagggccuccuacgucaguuagcagagaaaauguccaaacagacagcccacaggccagugagauuuugucuucccaguuaugucuagguuuguguccaguugacagaaacucaccagcaugccuccuguucucuuucaucauuggagagagauauuuuauuauauaaaaucauuaguuuuuucuugcuaaugacuucuaauaaaaauucaaaucauggggucuguggagaugacucagucaguaaagugcuugcuguacaaacagaagggucuuaguuauccugagaacccuuguaaaaagccagacccacagugcacacacaagguuucaguacugaaaaggcagagauagguagauccccagcucacugggcagccagccuguguccaugagcacuaaguuuggugagagauccugucucauaaaagaagcugggggcaggagagauaacucagagguugagagcacugacugcucuuccagagguccugaguucaauucccagcaaccacaugguggcuaaauaccaaucuauaaugagaucuggugcccacuucuggcaugcaggcacaacucuguguacauaauagauaaaucuuuuagaagaagaagcuggagagugaccaauaaagacaccagacaccucugagcugaaugcacacaaacgagcacauacacaaaacucacauuaggcguaaaauggugcauauuaaagugugcuggugccagggugccgagugagcacacaguuggaauggagcgccuguuuucuaagucucccuucucaugcuugcccugucagcuugagagcucacgguguguugcuagugcuuugacauugaucucagcucgguuuguugcucaccacuaugucuuccuuucagacagcguccuuguuuuguuuuucguaggcucauacaacacugcuagguuuggcaaauauggaaacucguuacuuugcaaagaaaaaaacccuucuuggcuugaguaaacuggcagcuuuagcuucagacauuucagaggacaggcugcaagagaagauugaagguaagggguccgaaugaaaaggcacgugagucaguugcacugugucugucuggagucgcuccauuucaguaggaugcugcugccugucuuacugacugcccauacuuuaccauucagucaugaacuuggagucguuagcccaucauucugcugaguagguggaaacgagaacauccuggggcuugcuggccccauuagugccagucuggccacaugagugagcucugguaaauaagguggaggucaauugaagaaggcauccaugucagccucuggcuucuuucuacacuugcaaaagcuaagccauugaguugaggguugaugaaaagauaauucuguguuuuuccgucagguacacagaccucucagcuaagacaggcccauguuucacacuuuugaagugcugugacauguucacgucgucagcucacauguccuuuagccagugcuuagccugccccugcaucucuucacaggggagcaagacacugugcacacgccagccugcacccuucaguuguuaguacugggaagacagaagggucacccccucagccaaaccacuguggggaggauuuugggaagaccuaggaaauuuaaacuuuuuuuuuccuugaaauagggucucacuaugaagcccaggcugcccccccaccaaugcugugaaugaacagauuuaauauuagaugauguugcaauaggcuuguuaauuucugaaggcuggguaaugcuguuugugauuaaaugcccuuuuucaccuguguuuugguuuuuguuuguuuuuuucuuuaauauuuguauaugaauauacugucacucucuucagacacaccagaagagggcaccagaucccaguacagaugagaugguugugagccaccaugugguugcugggaauugaacuuaggaccucuggaagugcagccagugcucuuaaccgcuaagccaucucuccaaccuugguuuuguuuuguguuuuuguuuuguuuuguuuuguuuuugagacaagguuuuucuguguaggucuggcuauccuggaacucacuccagacuaggcuggccuugaacucagagaucuuccugccucugcuucccuaguucuggaauuaaacuauguccuuauucuuaggaauaccuccugaaguuagaaauuaaaugucaugaagccugcagccucccugugauagaaaagggggagggguagaaauggaggaggaaagccaggccuggugguugugccugccugugaccccugcaccuucgaggcuaaagcggaagaacagaaguuuuaaggccaauccuggcuacauaggaaacugaaggccagccugggcuaugugagguccuggcucaaaaaaaaaaaaaguuguuuaugaaaacuccuguaaucccacuaggagguagaaccuggcaaaucucagucucaaaaauuaauuuuaguguaugaguaauuucuguggaaaguuugaguuguggggaagggguggggucgauuggagguuuccaccugcugaaggaacuccugugauuuuggguugguucugcuggcuggaagucuguggaacauugcugcuaugggugggcaugcugugcuuuagccugucgguugugaccacuguggugggcuuagagcagugcggaggacagggcuaggacccauccacugaguguucuuaccuguuaaugcaagggcauguggcuuucugauaugacuugguuucuggauaacacugccguacucuuucacugagcugcccucaggugggacuuguagagggcacucaccuccugaaguagcuuucuuucuuggcagauacuuucugcugcuguggucuuggaucaaacaguaaaucuguugucagcaaugaagaauaagcaguuagaggcauaacaucuggagauuuggguagcagugacuugccuuuagagcuguuuagagcugguuggcuucaauuugcauuuuaaugaugauggcagaagugaaaucccuuuguguccuugaucaccagccauggcugagcaagagcgcuuccugcuacaccaggagacccugccagagcagcugcugaccgagagacagcugagucuuagugcaaugccuguguugaccgcaccacaacucaucaguguaagugucauagaugucacagccguguccuguguccucacccagaacagcuugccuuugcuaggucauacuccggagcucccagcagcgucuucccuucucucaccugccagagacauuuccccuagaaaagauguuaggagcaggaagaauuagcaagacgcagcagaguaggaugcauucugugaggugaccgcuccuaggugauacuuugucgucucucguuagccagaagcacagacugcaguacugcacuguuuccuggcaacagugauccagccacggccagagcaccucggauucaucagaugagaagcuggugcugugcacucugccuucccccuccucuucccauuucuccccagucugcucugauugcaguuaaaggaaagcagacaguccaggaccuguuagaguguagaggcccugguuagcaacagcuccugaauggugcacucuccugagagggcaucugguugagacaucuaagauguaggcuguaugugccguuauuucauggaaagugugaugccaggcuugcucagacaccuuagacucuccaguuucuaagguggaggaggcaaagggauuuugcaaaacauuauagauuuaagcccccaugguagcaaaaacuaggaaauuacuaaagaauuauauauaguuuuuauaaaugaaauuugucuuaugacauaaugcuagcagaaggagauaggaaaaacucauauugguaauuugaaucaaaaaaguuuuuuauuuuuguuuuuuuuacauuuguuuuguuuuguuuuucaagauugggguuucucugugcaguucuggcuauccucgaacuuacuuuguagacaaggcuggccucgaauuuggagaccuaccugccucugccuccugagugcugagauuaaggguguguaccaccaccaauauuaaaaaaaaaguuuuugacuaaaagauggcaggauuuugagucacguguauaguaaucuguaacgcacagagagacuagcucucacggguguuuguucacuucuacagcgucaagcacuagaacccagggccucauaugcuaggcaggugcuuaccacaaaccaguggagggcuagguuggagcuuuuaaagccauuugaaagagaagcauuccaaaagccagacgcugagcugugagcuccggcaggaauuugugucaaagccuguacaugaaaaccuacuggaaagcuugugcuauauucuugaucugagaauguaaaauuuuccgaauuuuuugaaaauauauguguauugcauuauaccaauuaacuuuuggcuuagaauauccauuguuagacaauuuucuauagacagaauauagcucccaaaugugacauuguucuuggcuacaaaaauacauuuagauuaugugaaagagaauaaugacuuauuuucuccuuaaaauguugugaguaaucugccuuggacuuguuacagcuguauaucugugacgaaaacagaagagccaaugaguaugauuucaagaaagccuuggacuuacuggaguacauugaugagguaagaaaucguuguagcugggcagaguggcacaugccuuuaaucucagcacucuaugggcagaggcagcuggaucuuugaguucaaggccagccuggucuacagagugauuuccaggacaggcagaacuacauagcaacacccugucuugaaaaacugaaaaaagaaaaaaguuaaaaagagagagaaaacacacugucucaggcaucugcguagguaauaaaaagaugcccucauggaaagaguuaucuuuggguaagagccuaaaguuauuuaugaaggcagucauccauccagacuguuauaagaccugacugacaggaaacaccacauuuccaguuggcuuuuccuguacaaguggaaaaaaauuagggauggguuauuuauguguuuguguguggagggcaacuugccagaguucugucuuccuuaccaggagcaaauucaggccauuugguuuuguugcaaguaccuuaccugcugagcacuggucuucaaaacaaacuucauugugggugcuggaagccaaaucccauucuuuuguaagagccgaaaguacuguugauugcugggucaucccuccagccuauuuuaagauuuggggggguuuugagguuuuuguuuuguuuuugagguaggguauugguauaauagaaacccucuuacuuaagucucccaccucccaacugcugagcucacagguguugcacagcccccauggcuggcuauauagccaucuuguuuuuuauccuaugugcauucauguuuguguaugcauguacaucugugcacuuggguacagaggucagaggucaaccuugagugccauccucagcagcaccguccacacucauccuuugggacaagacguuuguuugccuggagcucaucaacugaacuagacuggccggccagugagacccagggauccuccuuucucucccucccuggcaggacuacagaugcccccucacacuggggccagguccucacacguaaagcaacacuugacucuagguuucccugccucacccuuugucaucuuaaccucugagaguuccugugaacucagugaucggaaaccagcacagacgucagcagagcuggcuucagagacagggugaagccagcuggagagucauagguucuuuacacacccacguggcaggcagcucacaacucucuguaauuccaguuucaagagauccugugcccucuuccuugggcaucaugcacacauauaguacauuuauauacauagaagcaaaauacucauaaacauuaauaaaguuuauaaauggcaaugguuaugaauuaauguagaacuacaguguuaauuagggguuacuguuaauaauuguuaauuaagggucaguauaauuaaaauuuuaauguacauuuuauuuuuaaagccaaauuuuuuucuucuucuucaagacagaguuucucuguguagcccuggcuguccuggaacucacucuguagaccucagaaauccgccugccucugccucccaagugcugggauuaaaggcgugcgccaucguugcccggccaaagccaagcuuuaaucgaguuuuuucuguuuugcugugaaggaagaagaugugagcauugaugaccugaagcuggagauucugugcagagcacugcagagagaugaguaaguccuugcuugggcaccagguccacuggcaggaaccgaccccagaugaacugugacacgguacacaagauggcguaugugcuucuggguauuucagcuuuucacauagcacacuauggguuuauuuuuuauugauucuuugugaguuucccaucaugcaccccaguccugcucaucucccaucucuucauagccucccucugcccuugcagccucuccccaaccccaaaauaaaaaacauacaagcaaaaaacaaaagcuuagaaaacauuccuucauggaagcuuuagugaguuacaguguguccccauaguaugucccucuuuccgcacaucuucaguugcuauguucauugcaaugagucauuggucugguuccagaucucuggcuucugugacauuaucaguauuguauccuuacuggaccuccuccugguuacccuguuguuacucugugucauggggauccugcaacaggacugguccuuacacacaucccaaccgaucgaagacuauauagauuuuggggugagccaaucagagcccuggaucuggaccuggauggcagcugagcuggucagugagccaccagggcaggcuuuccagcacugcuccagccaggccgcccaaugcuacagucagccagaggcaaggucaacugucacgcccuccagaggcagcuccacucugcugcccaggcaaggcagggaaccacucugaaguguagcagccggggagggucugggccagcucgcucucucugcccuggacuggcuccacucugcugcccaggcaaagugcaaggcaggcucuccugagugaggagcagcaccagcuccccgcucucagacuuaaucucugcauaguuuugaugagaacucccugucugguuuaaaauugucagcaucgugugugggcguggcagaggucagagaguaacguuagaauaguuaauaguucucuccuucccugccucuaccuuugcuaucaaaccugggccaucagaccugcgaggcaaacauguuugcacacuaagccaucuugccggcccugguccuagcuuguagucugagccuuagguuggcugugucuuguguacauggaacaccagaaagcagugguguucaugugccacugggaaggaagccacuccugcugccaaacugugauguagggcacucgcggucgggaaagccagagauugcugagaacuguucauacugcugugcuugggaagccagcauuuaaggaugcuggccagguguguuacuugaagcguuuucuucagaaagacgccucacaaccgcuaugaugagaacacgccuguaauucuaguagcacccgagagaugaggcaauaggauaaagaguuuggggccagccugcacuacauagcaaaaugcuguguccaaauaaacaaagccuuuuuuuuuuuuaaagauguguauuuacuauuauaucuaaguacacuguagcugucuucagacauaccagaagagggcgucagaucucauuaugggugguugugagcccccaugugguugcugggauuugaacucaggaccuucggaagagcagucagugcucuuaaccucugggccaucucuccagccccaaagucuuuuaaaagcuucugugguagggacauugauggcaugugcugccaguguagcucaggccaauacagaucuagauaggucucacauuuaaagucuguuacgucgauaacuuggagcagugccacagaacuugacacucgauuacaucauccuauggccaucaggagaaggccacaguagcaaacaaaacucugugucucgucugcucugaugauucuguuucccucaugauuuucuuuuucagcuggucugguucagauggcaaagaugauccaaucgaagugucuaaagacaguguguuuguaaagaucuugcagaaacuuauaaaagacgguaagugguuuauugacuauuagagauaaauguugcagccgggcuugguggcacacaucuuuaaucccagcacucaagaggcagaggcagcagaucucugaguuugagaccagccuggucuacagagugaguuccaggacaacuuaagcuguuacacagagaauauugcuagcugauuuuggacaucgugggaauuguguguugccaacacaaccugugccagggccucagauggcuugagaugaugugcagauuagcguugcucucagugaagcugcugcugugcucuuggcccuggagacccagggcuaacaagguucaggugaaguccuccaccccaggacacagacucuggcugugacagcacaaggcugugacugaaguaauuaucuccucugagaggcagacuuuuugguguauucuuucuugagcugcucaagaauaaaugacgagagggcuggagaaacggcuugguaguuaacaguacuuccugcucuucagaggacccaggccaggcggcccacagcuccugaaccuccaguuccuuaguaagcagcacccacucuggccuccauagucacagcauggugugugaaaagggcaagggcugcugggcuaccucagcaaguagagacaccagaccugagggcuugcguucaauccccaccacaguccacacacacuaagauuacauggaacagggcuggugacuugguucuuuagcuaagaacucuuguucucucccagcccccacaggguaacucacagcuaucuguagcuccagucucagggacucugaaguccuugccuuuacaggcugcaggcacauguguaguggacauucauaccugcaggcagaacacccagacauacaguaaaucuaaauaacuaaaugaauagauuuuaaagaaaauauaauuuaaaaauuggggcuggagagguggcuggacaguuagcuucccaugaagguggguuugauucccagcagccacacaguggcucacaaccaucucucccuucauuuccacgggguagaaccccuggcugcugcgaacaccaggcacacguguggugcacacacagggagagacauuuugcaggcaaaauacucaugcauaaugauuuuuaaaugcauaaagauuuuuuaaaaucuuuuuuuuuuaauuauauguaaguacacuauagcugucuucagacaccccagaagagggcauuggaucucauuacagaugguugugagcuaccauaugguugcugggaauugaacucaggaccuugagaagagcagucagugcucuuaaccacugagccaucucuccagcccccaaaaaaucuuuuuuaaaaaugaaauugcaauacuuauauccauuuuagacauuaagacuaaaauucgauuuagaaaaagaaauaagagcugagugugucugugucuaaagcagugagaagaugacauuugcugaacaaagcccacauccacugcuuuggaaaagacgagucuuuaaaagaccucugccuuucuguuguauagugugagcucaacacaggcagaaugucagaaaggcacagaagacagaacagucuacagaggugggauugcuacagaauuacuggaucaacaccagggagggugccaggucuagauagugcacagaccggccugccugccugccugccucuggcgagucuuuguagauugggagaugcuauauuugaaacauccagugaaugaauagagccugaguccagugacccuacagaaugacuaaggauggcagucacuaggaugucagucacauggcccccaacaauggcugugcacaugcugcaaaguauauuguuuaaucucucuagagcaugccugcccuugccuacauagaacacgccugcccccaccuggcauacgggugcaugguagaccuuuuggguuuugaugauaauugaauuguucaacucauaacaauuauaaaaagauggugcuagauagauuaagaagacuuuuacuugacaagugccuccucucgaggaucuucuuuaaaaccauagucaccuggcauggugguacacgccuucaaucgcagcacuccggagguagaugcagucugugagcacaaguccagcauggucuacaaagcagguccaggacagccaggucuacacagagaaacccugccucaaagaaccaaaccaacaguaaagagagccugauagcaauguaacaagugauguggcgcugcucauuucaagccuuguccauugucuuugucaguguugugaucgugugacucaaucguccccugguggcuguuuccugucuacugaucccuauguccuggugccugaccucaguguguguguguguguguguguguguguguguguguguguguguucauuucuuuucuuuuuuuaaaaaauucuuuuuuuuuuuaauuuauuuauuguauauaaguacacuguagcugucuucagacaccccagaagagggcaucagaucucauuacagaugguugugagccaccaagugguugcugggauuugaacucaggaccuuuggaagagcagucagugcucuuaaccacugagccaucucuccagcccguguguucauuucuuugggacaaaggcuuccugugcugcccaggcugcucuuggcuggcugucagguucaaggcacccuucuccuucagcaucccgagugcuggaaggacaggcacccugguuaaguuuuaacacccuugcaguccuguggccagcuuugugacaguguuucuauuaaauuauucccccauuagggcaacauagaaaugacuauuaguugaaaacuuacacauugaagaaaugucuuaaacuguagggaaaaaaaaauuucagauucuacugaagauuuccucuggagcaucugcucugaccaauaggaaccugcagggcucugaggcucugaagaggcugccauuccccugagggcucugaaugggaggaggcugcagugugggcauguucgcucagugacuuagcaguacuggcugcuguacugcucaugugcggaggaguuucagccgucagaagugaccgugucuucuguuugcaggcauccagcucagcgaguacuugccagaggugacggaccuacugcgagcagagcagcugggaagccucaaguccaacucuuacuuugaguuuguucugaaagcaaauuaugaguauuauguccaaggacagaugugacauuuguagaaaugguuguuucuaaaauuuguguaaauauuugcuuauuaaaaaaaaauauugaggccaaaaaacuuaggucuggaucaaccugaagucuguuuugucugcagcaaccagguuuucuaugcuuuauaugggagccgcgauauaaaaggaggggcccugaugcucuuuuucagcuguaagguauuuccuccuccucuuccaccugaagucacccuugcuucuguguagcugcccuucuccagccucccucgguccaaagaggcagcaaaacaaaacagguugccucgcuccccaacugguuguccaauaccagcccugaaaaaauauaagaauguguauaauaauauacaugaauuuacaugcaaguaacguucuaugggcugagcaagugugucuguuuauuugggucagcaauuaaaagaugcuacagguuggagagcagggcagcggaagugaggaaguguuggagauggcaggggacggggaaaacagauugcccucugcauguggcacucugggagucucugagaagcugaucucuuggucggaggcaaagggaagugccugcuuagcaaagugaagaugagaugucacugauuuauacuguggccuagaaaccaaaacccugggucuaacucgggagggugggcagcugguaacucacugggaauguucucacuuccuacauugauuuaaaaauuacaagcaaggggcagggcuggagagauggcucagugguuaagagcgcugucuacucuuccagaggacuugaauucaauucccagcaaccacaugguggcucacuaccaucuguaauaggucccagggcccucuucuggugugucugaagacagugacaguguacucacauauauaaaauaaaucuuuuuuaaaaaaaaaguuaaaacuuaaaagccaaaaaagccauauauauauguguguguguguguguguguguguguguguguguguguguguguguguaaaauuaaaggauuaaaagugugggccacugcauccaucaauaauggauaagucuuaaaguguuuuaguaagauguuuguguggcuuucugagcugucaguaaguugucauugcuaccagauaugguacuggcauugucugugaccccaguauugacucauaaaccuaggaugguuucuagucucaccguagacggucccuuccuaaacaucguaaugccaaggcuggucuacccagagauguugcucugagagcucuggccauggccuaccugucugaagaagggggcuaaaccuuuauggcaacuaucgcagcuucagaaugguuggcauguaaacuuacuccagcaguaaaaaugaaauuaagacuuucaguguugaauaucuuucccuccuaaguuuuaaaaacuggucacauaauccaucucugaagaaugaaugauuuguuucuaagucagguagcuaagacugucuccugguacccgguguacauucuugggauccuucucuuguuggccuauccguuaguucagcaugaacuaguuaggacugugaauggcagcagccacccuugucccugaggugagugugcuguauucugaggaugugugagucagucaggaccugaaagggcccuggcaaccuguacagagcacagggggaaagguuuuguuguuuuauucucuugacuggaugcuauggggagagccagaggucugcaagacaaauucaugguguuucgggcugucaugguuggucccacauucugaguguucccaguguggccucccccaccacugccagucuguccucagaauggcauaauauucauguauaaaauacaauauauguugaaaaacaauguguauauauguuguauauauuuaucauauguguaugauaugugcauauaaacucuggcuggccucaaacucucagccccugugccucagcuucccaaguccuaaaacugcaaguguacacaccagcccuggcuagaacaauuuuuuuaaggcgugugaagccugacauugagcucauauccaaaauaaacacaaguaacugguggaccuggaagcugggcuucuguuuugaaaugagcuucagucgaccaccuuuuguauugugugggcaauggugaguacuuagcacaccuuuggacuucuguucucagaggagcuccaguuuuccuucuccugcugggauggcagguccuugcaugcaucugcauugccuuaauaaaaacgagguuuucuuuuu

SEQ ID NO: 4882 - RNA, 9506 nt, Mus musculus
cugcgacccgauucaccgcgguggauccagugcuccggaccgagagcuugccagaagcgccggucuccggcuggagcugacccuccgcggcgagcgugggcuggggaaggaggcgcccgugggcggagcugaggaagucgcgcucugggcggcgguggugugcucacaguuuuucccaaccuaauucagaucgguucaggcuuguucuucguucgauugucugggcucugcagcggguugcagcuuuuugcuuuccaggcacagcuugcauuuugaugggucuguccuacugccggagauucggaaaugacagugcccccaguccccgggcauguucacucucaucgcugccccugaaguuccagacccuaguagaagccgauagcaggcgugcacacaguucuguuaguccucugcggcuguuucggaagaccguaguguguguaugggggugucuuuuccauucugcuccccacauuacuaaacagugaacugagauuagcccgaggcuguacuagaguuuguaaauauucagggcugauaacugcccagggacccuugcugaacuugugaggucccuuguuacuucggguggccuuuccuuuucgguuuuuucauugugucccacuuagacaacauuguagccagacuuuugaccacuuuauggguuccuauuucuaccacuugucucccucucaaccccccaacacuagguaggagaaagaaggcuagaggaaaagggggcuucgauauccguagacuacuuccugcugauagaggcaucgaguuccuuggggcaguuuugaucuuuuaagagcucagaaagccagaaggagggcauuggacucugaaguuaguuacagggggguugugcgccaccuagcaugggugcugggaauugaacucggaaaaaaaaagaaaagcauuuagaaguagcuacuugagccagguguggcugcacacaccuauaaucucuguaggaccagaaguuguucaaagccacccugggcuacaugagacacugucucaaaugccaacaaacaaacccaauuaccugagagaccauuauggacacaagguuguuaggcauaucagaaguaaauacagugggaggggguagggggagagagaacauggaagggaggagucaucucugcccuaaggaugagagaaagcagcuuuccaguccacaguccaggagaaacgugcgcaugcguaauggagccuuuaauucuugcaaagugcaguguaggagaauuucgguuucuuuuuuguuuugguuugguuugguuuuccgagacaggguuucucuguguagcccuggcuguccuggaacucacuuuguagaccaggcuggccucaaacucagaaauccgccugccucugccucccgagugcugggauuaaaggcgugcgccaccucgcccggcugaauuuugguuucuuuaaacacagaaauguuauaagaauaugucuucacuuuaaucccgggugugggauguagggcugcuucagauugucuagaauugcucauuaugaggcagguggaccucugacuuugaggccagccuagucuacaaagugaguuccagaacagccagggcuacacagagaaaaacccugccuccagagauccaccuaccucugccuccugaucacugggauuggaggugugcauaacugucuggcuugcacagguauggcauauacucacagacacauaauaaauguuuuuuaaaaaaaacccaaaauaagggguugaagagaugccucagcaauuaagagcacuggcuguucuuccagaggucccaaguucaauucccagaacgcacauagaagcucacaaucugaugccuucuucuggucugcaggcagacaugcagacaaagcaccugacacauuuaaaauaaaaacccaccaaaauaaaagccaagcauguagcaugcagaaauaaaacuacccuagaguucuagggccagcuagccugauggcagagaaucuagcgucaaacacugaaagaugaggaggcccacucaguuguccccugacccugcgcaguguccucccagccaggagggacugaaucucuugggaacaguaaggaacuuucucccugaaguugccuuugccaugcuauuacagcaaagagaggcuaagacaagugacaaaguugccucacuggguacaugugaccuaaguguuugucuacaucgugggauuuaccagagcaccagauguaaugugugcagagugcuugagacaaagcagcccccaaacacugcuugccacagcccuuugccagauugcuuuguacugacuuugccugccucucuccauaagcuagagagggcugaaggcagacacugcugaauccuuugucaaggccacagcacugugcucaugguggggcaggaaauaauaauggggcuggaguaguuggacagacacuaauaaauagcaaacacaugagagucucagauaaggaaaggcauggaacacaaagucaauacucuguauaugacauguuagauuaaaaaguuuuuuugagucucuauaacaaauuuuauuaagaaacuagggcuugagagauggcucagcgauugagagcacugacugcucuuccagagguccugaguucaaaucccagcaaccacacgguggcucacaaccaucuguaacgagaucugaugcccucuucuggugugucugaagacagcuacaguguacuuauauauaauaauaaauaaaucuuuaaaaaaaaaagaaauuaauauguggauggaggcagcaggggcaguagugaguucgaggccagccuagucuacagaguuugagaacagccagggcuacaaagagaaacccugucuggaaaacuagaggggaaaaaauaaagaaaauaaagugacuaccaaauuuuaaaagaagugauagccaugaggcugaagcaugaauguaaguucgugguaaagcacuuagcauguguggagaaccucgggucaaccucagcaucauaacacacagacacagauuaaguucacuauaaauuuuaaucugauauaaaauguuaaccauauuaagaaagaaaacgugaugacucaauucaauuuucauaaugcuuucucaccagucugaucugcaacaacuccgaguucugaggacacccugcaaggagcugagcagauguggacaguggaaggugaccgucacaggugugcugccuacucaccccaagaccugcacacacauccauggggccucaugcucauuacccgguuccccagguaacauaaguggugacacugcuucucaucaagaggcacggcagguguguccauuuaacuaccucucagcguagcugugucucaggcucuacaucaccagcaaaaaaacaaacaaaaaacccacuuccuccgcaacauccaguuaacagcacugauaccaaaggaaaaaaaaaagagcaaauucauauucauuagccacugucacugcuguaagagcugugacacuguaggugacaaaccauaagcacagagagcaaggguaccuuuauccggcagcucccaguuaagguuccaugcacuccauggagcagggcuuccaaacucuuccaaucucuguuugaaacaaagucucaagcgcuggcugguuuuaaagcucaggugggugugagccacucuacuuuuucuuuuggaaaccagagugguuuauuucaugacuguugaaaucgucaacaugaacuggaugcugcaacaauuacccucggguuuaaguuuuuccuucacaggauccaugucuacacaauaaacaauucaggagccuccuuccccccagacccagcagaguuucaucuccuagccuugguucugcaguuagauguucucuggugcuuggaagggcagccacacuugccacacggugacuccugaagguuucuaggacuuagagucucagcagcaggaccacaugugacuuaacugugauacuuuccaaaggcugauguuccuucugaugccuugccucugcaagagucaucauacucaaggcugaaaauuauauuauucagauucagccuuauuaauaaaaauuuaaaauauaaaacuacaauauaccugggaaucacauauuuaaaauggguauuuuuuuuuucaaaauacaugcuucaacagaugcgccauggauuuucauccaccucuguugauaacgccugguuaucuguaccuugcuucucaaaaagagucauuaaacaaggagguaauaaaaaaauagaagcuuuccaguuuacagaacgggacuucuuccuuuggcaaaauguaucagacucuggugcucagauggugagcacugcacauuuggacagguacagcccuguagugcuccagaacucugacgccagaagguaauggaggauggacgcgucaaacuuucccucaguggcccuagguaggugcgucaguggcuuaaauuaguuaggccuuuaguuucuaauucccuuuuuaaaguugucaccugagaacaacucgacucugacagcacacacaggaagugagguguucugcuuggcuagcaaacacuggaacccugcagucacuucagcgcuuuagacauuuagagagcuacgauuuuacaacugaagaaaggucugggaggacagguacaucguaaaaugacauugugcacucuuuguggaaagaggcauauuucaaauaacugaaguaugcucccaggcuucacacggccuccaggcccuguucucugcaaugcuguuugguuuuaaggucucucagcccacggguagcugcugcucuguuucugucuguggacaggguauaugauagagucacagcccugcuucaguuacccaauaccugcacugcaggcuacgcccgugcagguuccaggaacugcucugcuccauuauaugacaggaaacucugcuuguucaucaguuuucuguaaagcccauugggcuucaggagcagcucuucaugugucccguguucacagaucuuuccguggucaaggacagcaacaaaguuggcauucuuaaugguggacaggcggugggcuaugaucagcacgguucucccuuccaucagccggucaagggccuccuggaccaggugcucauuuucggcauccagugcacugugacagacaaggccacacacaagaggaagcagagaugacagagcuguauacaugguugcucacacugcuaagacgcccuccagccuggacacacgcacacuagauacacuaacacugucacacaugucacaaagauaaccucaccugguugcuucaucaaggagaagaauuuugggguucugaaaaaguaagaguggaagaaucaaaaugacuucucaguacacacagcgcuggacagcgagaggacagcugaggcucaguauguaaaggcacuaaccaccaagccugacagcccgaacgccacaccauuagaccugacaaguuguuugcugaccuuuguguacuccgucccaagagaaauaaauaaagaguaaugaaaccauuuaaagcuaacuauuauacuuuuuaaagaauuauuuauuucauguacaugaguacacugucacugucuucagacaccaggagagggcaugggaucccauuacaggugguugugagccaccaugugggugcugggaauugaacucuccugguguguuuggagacagcgacaguguacuauacauagaauaaauaaacaguuauuuaaaaaaccacuacauccugaggagacuaacaagggagaugcugcuuccucaaaaguacagcuacuggcccccucccccccccccacaccacgggguucuuccugcuccuggcuggaguugccugccugaggcaucuaaucuuucuuuuuuuauuauuagguauuuuccucguuuacauuuucaaugcuaucccaaaggucccccauacccaccccccccccccaagcaucuaaucuuuuccucagcagaacuacugaguaaagguuagacccuacucugacacuuaguucaucaucagucaccagacaauugguucuucuagguaaaugucugugugcuaaccuccucccagacaccacuuccacaccagauucuagagacauuucucaacuacgacaaauacucagacacuaagcccucagcagagcuccagcucagcguucuaccagacugccagucguauauaauauauuauacauucaaacauccauaauacauacauacaaaugcacgcgugcaagugcaggcgugcacaugcacauauccccucuucaaaaaacaaaacuucagugggcacuggcaaggugucggcaggcggcugucuuaccuucagcagggcucuggcuauugcaauccucugcuucugcccaccugacagaaacaaacagagaaggcaagcugaacaaaauugcuuaggaaauuuucaaguaagacaagugacaauuuggagggaacuucuuccauuuaaccacaauagaugggcaggaguuugucuuuaaacauacugucuuacugaauugcaaagcaagcaguuaccauagcuaacacauacugaggacuuccuucacagaagacucuuccuaagcgcgcgaagcauguuaaucuaugacagucguuacuggggccagacccuacgacugcuuuaauuucuacaggugaaaacugaugccaggugugguugcaaaugccuuuaaacccagcacucagaagucagagacaagccaaucucugaguaugaggcccuccuagucgguaacagagugaguuccaggacaaccagggcuauuaaagaaacucugucucaacacacacacacacacacacacacacacacacacacacacacacacacacacgccaaaaucaaaucaaaucaaaucaaaacaaaaaccaaacaacucccucccaaaacugaggcacaacuaugcauggugacauauacuucuaauccgagcacucaggagguagguagaggcagguagaucucugcaaguuuaaggccugucugucuacagagugaguuuugugcuagccagggcuguauaaugagacccugucucaaaaacaaacaaaaaaaaaacaauaaaacaacauuucacacaaaaaacaaccuggggcacagaguggggcucuugguacugcuucaaggauauuggcaagaacauuuguauugggcaaggacaagggaguaaacucagacaagauucugacauugggcuaggacaaggcucaagacgaacacagcugaggaagguguucuuugugucuugaucaucucauuaagucccugaauacagaaccauggcaccuuugcuuaugcuuuguuugauccuugucuuugaccuagaacggacccuacucuuugcagguaccuagaaugguauagaagcagacuguuuguuuguuuguuuuguuuuuuuuuguuuuuuuuuuuuuguuuuuuuugguuuuuugagacaggguuucucuguauagcccuggcuguccuggaacucacuugguagaccaggcuggccucgaacucagaaauccgccugccucugccucccgagugccgggauuaaaggcaugcgccaccaugcccggcuuguuuuauguguacaugaagcuaaagguuacaaaccaggcacuaguuccccucuccuuuaaguccagauuccacuccaagccagggaacaggugguguguugagaugcaggcuuggagugagcaaucuagccauucccaucugccuugcaucuggcucccuccuacaaguccaucuuccagcagccaggacugccugucacucacaccuccuuaugugggucgccuaaugugaccccaugcagcugacuaugaacagacagcaugucauucaucaagguguucaacacauggcacuaaggugcugcccucucaggaagccacugugggaugcaggaaauccccuucccauucuugggggaaagggaagcuuguucugacuggcuguagaaugugaagugggaucuguacuagagcuaaaggcaagcacuuauuugguuagacacagacuucuuucaauacaaaugcugaaaguauuucuucuagugguucugagcuccccuccucugaggaguaugacggcuaggccuggcagugcuuagaccacagaggacaaaugaagcaacaggaugguggucauugguuacaaagcaaacaauggagagcaaauaucacggagacucgugcuggggcucagucgccugcucccuugggaugauuucugcauguucucauaucuuagcaggauucucucucucugucuccucuuuuaaaaagauuuauuuauguauugaguacacuguagcugucuucagacacacuagaagauggcaucagaucucauuacagaugguugugagccaccaagugguugcugggaauugaacucaggaccucuggaagagcagaugguucucuuauccacugagccaucucuccagccccaggaguugaguuuucaaaagcccacacaaggccuucuugugcuugcuccucucucucccucucucccucucucccucccuccccuugcuuaggaucagaacgaacgugcucuuucuccggcaccaugccugccugcugcugugcuccccuccaugaugauaaugaauuacccucugaaaccaaagcaagucccuaauuaaaugcuuucuuuuuauagaaguugccuuggucguggugucucuccacagcaacagaacagucugagaugacuuccugcaccggguuucuuugggaugauccuuucccucgggcaggucgccacacaaccuucucuucuguaacuccguacagccucaggcugcacagcacauccuuccccagccccgccccaaggcugucaccgacuagcuggcgccagucccaggaaggaagcacauccucucagaaaagauggugugguuuccuaggaaacuucaucuacaaacaagggugcaccgggaaccgcguggggacguccuggggcgaguguuucugcugcacugccaggagcgagcugacaaacgcagcguggggaccacuuaccugacaggaggaugcccuucuccccgaccacagugucgaagcccugugggaagcuucggaugaacucagcggcguuggccaccucugcggcccucuccaccugcugggcugugaccgaggagagguugucagcuccauaggcaauguucucagcgacagagcaggagaacaggacuggcuccugaaaacggaauggagcacaucugucaggggcuucagacgacucccaagggcgcgccucagccaggaguggcgcacgcuucuaaagcugucuggaggucuuguuccucuacgacuucacccagcugacuuuaaaaguuccagucaaggggccggcaaaugucucaggagguaaaggugccugcugugaagucugauaacaugagcuuucuguaaguucaagccccagaaccugcucaguaaaaggagaaccagcuc

SEQ ID NO: 4883 - RNA, 30679 nt, Mus musculus
auuaaguucacuauaaauuuuaaucugauauaaaauguuaaccauauuaagaaagaaaacgugaugacucaauucaauuuucauaaugcuuucucaccagucugaucugcaacaacuccgaguucugaggacacccugcaaggagcugagcagauguggacaguggaaggugaccgucacaggugugcugccuacucaccccaagaccugcacacacauccauggggccucaugcucauuacccgguuccccagguaacauaaguggugacacugcuucucaucaagaggcacggcagguguguccauuuaacuaccucucagcguagcugugucucaggcucuacaucaccagcaaaaaaacaaacaaaaaacccacuuccuccgcaacauccaguuaacagcacugauaccaaaggaaaaaaaaaagagcaaauucauauucauuagccacugucacugcuguaagagcugugacacuguaggugacaaaccauaagcacagagagcaaggguaccuuuauccggcagcucccaguuaagguuccaugcacuccauggagcagggcuuccaaacucuuccaaucucuguuugaaacaaagucucaagcgcuggcugguuuuaaagcucaggugggugugagccacucuacuuuuucuuuuggaaaccagagugguuuauuucaugacuguugaaaucgucaacaugaacuggaugcugcaacaauuacccucggguuuaaguuuuuccuucacaggauccaugucuacacaauaaacaauucaggagccuccuuccccccagacccagcagaguuucaucuccuagccuugguucugcaguuagauguucucuggugcuuggaagggcagccacacuugccacacggugacuccugaagguuucuaggacuuagagucucagcagcaggaccacaugugacuuaacugugauacuuuccaaaggcugauguuccuucugaugccuugccucugcaagagucaucauacucaaggcugaaaauuauauuauucagauucagccuuauuaauaaaaauuuaaaauauaaaacuacaauauaccugggaaucacauauuuaaaauggguauuuuuuuuuucaaaauacaugcuucaacagaugcgccauggauuuucauccaccucuguugauaacgccugguuaucuguaccuugcuucucaaaaagagucauuaaacaaggagguaauaaaaaaauagaagcuuuccaguuuacagaacgggacuucuuccuuuggcaaaauguaucagacucuggugcucagauggugagcacugcacauuuggacagguacagcccuguagugcuccagaacucugacgccagaagguaauggaggauggacgcgucaaacuuucccucaguggcccuagguaggugcgucaguggcuuaaauuaguuaggccuuuaguuucuaauucccuuuuuaaaguugucaccugagaacaacucgacucugacagcacacacaggaagugagguguucugcuuggcuagcaaacacuggaacccugcagucacuucagcgcuuuagacauuuagagagcuacgauuuuacaacugaagaaaggucugggaggacagguacaucguaaaaugacauugugcacucuuuguggaaagaggcauauuucaaauaacugaaguaugcucccaggcuucacacggccuccaggcccuguucucugcaaugcuguuugguuuuaaggucucucagcccacggguagcugcugcucuguuucugucuguggacaggguauaugauagagucacagcccugcuucaguuacccaauaccugcacugcaggcuacgcccgugcagguuccaggaacugcucugcuccauuauaugacaggaaacucugcuuguucaucaguuuucuguaaagcccauugggcuucaggagcagcucuucaugugucccguguucacagaucuuuccguggucaaggacagcaacaaaguuggcauucuuaaugguggacaggcggugggcuaugaucagcacgguucucccuuccaucagccggucaagggccuccuggaccaggugcucauuuucggcauccagugcacugugacagacaaggccacacacaagaggaagcagagaugacagagcuguauacaugguugcucacacugcuaagacgcccuccagccuggacacacgcacacuagauacacuaacacugucacacaugucacaaagauaaccucaccugguugcuucaucaaggagaagaauuuugggguucugaaaaaguaagaguggaagaaucaaaaugacuucucaguacacacagcgcuggacagcgagaggacagcugaggcucaguauguaaaggcacuaaccaccaagccugacagcccgaacgccacaccauuagaccugacaaguuguuugcugaccuuuguguacuccgucccaagagaaauaaauaaagaguaaugaaaccauuuaaagcuaacuauuauacuuuuuaaagaauuauuuauuucauguacaugaguacacugucacugucuucagacaccaggagagggcaugggaucccauuacaggugguugugagccaccaugugggugcugggaauugaacucuccugguguguuuggagacagcgacaguguacuauacauagaauaaauaaacaguuauuuaaaaaaccacuacauccugaggagacuaacaagggagaugcugcuuccucaaaaguacagcuacuggcccccucccccccccccacaccacgggguucuuccugcuccuggcuggaguugccugccugaggcaucuaaucuuucuuuuuuuauuauuagguauuuuccucguuuacauuuucaaugcuaucccaaaggucccccauacccaccccccccccccaagcaucuaaucuuuuccucagcagaacuacugaguaaagguuagacccuacucugacacuuaguucaucaucagucaccagacaauugguucuucuagguaaaugucugugugcuaaccuccucccagacaccacuuccacaccagauucuagagacauuucucaacuacgacaaauacucagacacuaagcccucagcagagcuccagcucagcguucuaccagacugccagucguauauaauauauuauacauucaaacauccauaauacauacauacaaaugcacgcgugcaagugcaggcgugcacaugcacauauccccucuucaaaaaacaaaacuucagugggcacuggcaaggugucggcaggcggcugucuuaccuucagcagggcucuggcuauugcaauccucugcuucugcccaccugacagaaacaaacagagaaggcaagcugaacaaaauugcuuaggaaauuuucaaguaagacaagugacaauuuggagggaacuucuuccauuuaaccacaauagaugggcaggaguuugucuuuaaacauacugucuuacugaauugcaaagcaagcaguuaccauagcuaacacauacugaggacuuccuucacagaagacucuuccuaagcgcgcgaagcauguuaaucuaugacagucguuacuggggccagacccuacgacugcuuuaauuucuacaggugaaaacugaugccaggugugguugcaaaugccuuuaaacccagcacucagaagucagagacaagccaaucucugaguaugaggcccuccuagucgguaacagagugaguuccaggacaaccagggcuauuaaagaaacucugucucaacacacacacacacacacacacacacacacacacacacacacacacacacacgccaaaaucaaaucaaaucaaaucaaaacaaaaaccaaacaacucccucccaaaacugaggcacaacuaugcauggugacauauacuucuaauccgagcacucaggagguagguagaggcagguagaucucugcaaguuuaaggccugucugucuacagagugaguuuugugcuagccagggcuguauaaugagacccugucucaaaaacaaacaaaaaaaaaacaauaaaacaacauuucacacaaaaaacaaccuggggcacagaguggggcucuugguacugcuucaaggauauuggcaagaacauuuguauugggcaaggacaagggaguaaacucagacaagauucugacauugggcuaggacaaggcucaagacgaacacagcugaggaagguguucuuugugucuugaucaucucauuaagucccugaauacagaaccauggcaccuuugcuuaugcuuuguuugauccuugucuuugaccuagaacggacccuacucuuugcagguaccuagaaugguauagaagcagacuguuuguuuguuuguuuuguuuuuuuuuguuuuuuuuuuuuuguuuuuuuugguuuuuugagacaggguuucucuguauagcccuggcuguccuggaacucacuugguagaccaggcuggccucgaacucagaaauccgccugccucugccucccgagugccgggauuaaaggcaugcgccaccaugcccggcuuguuuuauguguacaugaagcuaaagguuacaaaccaggcacuaguuccccucuccuuuaaguccagauuccacuccaagccagggaacaggugguguguugagaugcaggcuuggagugagcaaucuagccauucccaucugccuugcaucuggcucccuccuacaaguccaucuuccagcagccaggacugccugucacucacaccuccuuaugugggucgccuaaugugaccccaugcagcugacuaugaacagacagcaugucauucaucaagguguucaacacauggcacuaaggugcugcccucucaggaagccacugugggaugcaggaaauccccuucccauucuugggggaaagggaagcuuguucugacuggcuguagaaugugaagugggaucuguacuagagcuaaaggcaagcacuuauuugguuagacacagacuucuuucaauacaaaugcugaaaguauuucuucuagugguucugagcuccccuccucugaggaguaugacggcuaggccuggcagugcuuagaccacagaggacaaaugaagcaacaggaugguggucauugguuacaaagcaaacaauggagagcaaauaucacggagacucgugcuggggcucagucgccugcucccuugggaugauuucugcauguucucauaucuuagcaggauucucucucucugucuccucuuuuaaaaagauuuauuuauguauugaguacacuguagcugucuucagacacacuagaagauggcaucagaucucauuacagaugguugugagccaccaagugguugcugggaauugaacucaggaccucuggaagagcagaugguucucuuauccacugagccaucucuccagccccaggaguugaguuuucaaaagcccacacaaggccuucuugugcuugcuccucucucucccucucucccucucucccucccuccccuugcuuaggaucagaacgaacgugcucuuucuccggcaccaugccugccugcugcugugcuccccuccaugaugauaaugaauuacccucugaaaccaaagcaagucccuaauuaaaugcuuucuuuuuauagaaguugccuuggucguggugucucuccacagcaacagaacagucugagaugacuuccugcaccggguuucuuugggaugauccuuucccucgggcaggucgccacacaaccuucucuucuguaacuccguacagccucaggcugcacagcacauccuuccccagccccgccccaaggcugucaccgacuagcuggcgccagucccaggaaggaagcacauccucucagaaaagauggugugguuuccuaggaaacuucaucuacaaacaagggugcaccgggaaccgcguggggacguccuggggcgaguguuucugcugcacugccaggagcgagcugacaaacgcagcguggggaccacuuaccugacaggaggaugcccuucuccccgaccacagugucgaagcccugugggaagcuucggaugaacucagcggcguuggccaccucugcggcccucuccaccugcugggcugugaccgaggagagguugucagcuccauaggcaauguucucagcgacagagcaggagaacaggacuggcuccugaaaacggaauggagcacaucugucaggggcuucagacgacucccaagggcgcgccucagccaggaguggcgcacgcuucuaaagcugucuggaggucuuguuccucuacgacuucacccagcugacuuuaaaaguuccagucaaggggccggcaaaugucucaggagguaaaggugccugcugugaagucugauaacaugagcuuucuguaaguucaagccccagaaccugcucaguaaaaggagaaccagcuccucuacguagucaccugaccuccacaugcaugccaaguuaugcacacgugcacacgcacacacacauauaaacacaaacacacacacacacaaaauguaaucuuuucaaaaaggucccauuuagccgggcaugguggcacacgccuuugaucccagcacuugggaggcagaggcagguggauuucugagaagacagccuggucuacaaagugaguuccaggacagccaggacuacacagagagacccugucucaaaaaaaaaaaaaggucccagcuuaccaugaagaagaccaaaaugaucuguuguccuguugucuucacuacacugugggaaggaguccccaacaugggugccuacaauugccggcccaugacaaccuuauaaaucucagccccuucccuaaggcuagcaaggccuagaagaccuaaguucgacuaccuaccuuccaauacagacaaagggcccaaguccacccauugcuuucugacaaagaaccagacaccaccauaacauccugacugccagccccacauagcacagcagucucuaguccucugcccucaugacacacauugcugaggucuaaucaguaccaggguugugccaucuauccauccuagugcagaagucccaaucaagagugggaaugggaggcaugggcgugaccacagggugcacagugguaaaagaguuggcugggauacaguuguugcuccacgcagucuugugcaaggagcuccgugaaaaggaaccgcacuugcuuccuauggacacacaggggaacugugaaggacagcaagaguuucucccgguccuuccuccagccccccagugcugcacaggaacgccagucucagcucuuaauagaaagucagcauuucaacugauuguguugagucccugggccauaggaaacugucuguguguggaguggguguguauggagugcuguguguggaguagguuuguguggagagguguguguggagugguauguguggaguggugugugugugaaguguguguguggagugguguguguggaguguguguguguggaauggugugugugugaaguguguguguggagugguguguguggaguguaucuguggaguggguguguguggaauguguguggaguggugcgauccaucuggaagccucugucccacucuggagaacacgagauggaggcaaagccaagggaccacagcuccaacaaggugagcgagcgagcgagagggaaguaagggaaacccgucuuccuaccugacucacugucccaaucuuggaucucagccagacgggguuuagcugacgaaugucauggccaucaaggcugacuguuccugaugggagggagaaggcagaggucaccacaggucaagggugauaaccaaagugaacccuaaaaggagggggaaucccagacucacugcucccucuucccucccuuacugaggcaggagcucauguagucagucaacugcagacucccugugcagccgaggaugacccccaacucacccuccuuucucagucuaccuaccugggaggacugugccguuauuugaccccucucccacuaagacuguacuggggagcaaauccagaauuuuuuuuuuuuuuuugagacaggguuucucugugcagcccuggcuguccuggaacucacucuguagaccaggcuggccucaaacucagaaaucugccugccuuugccugccaagugcugggauuaaaggcgugcgccaucacugccuggcccaaauccagauuuuuuuuuuuuuuuuugcauacuaaauaaacaguaaccaguugauccgcaucccaacccccaggcaaccuuuaaagacuaaacacagggucaggacuccaguguagcuaguggugaaacacucgcuuagcauaugcaagggccuggguucugucccaaccaccgaagaaaaucaacuuccauaauguccauauggaacucaaaaccaacaaggcugggacuuucagagcaacaggagccuucuggaaugucugaagcuaggaccuccccuaguggaugggaggcuagccagccccccccuccugaguuuggaggugcuggcagcuaggcuaccuggcaguguugguguuccaugaaucugaagucuuaugcagcgccuugauuccaaagagaagugugugggacaggggaggaaaacacagugugcacuggcuagcaguucugauggcagucuccugacugcagucuccugaucaugcugguaucagaagagaccaugaaggcccaguucagggauggaggucuacaauguucugcaaguuuaaacuggagucucuucagcagccccgucuaagacugcagaacagugcacauacauacauaccucacgaauggaugagacagucucauacuugcuaaguacacagccaaggaagaggcuggagggauagcucaaccguuaagagcacugacuguccuuccagaggccugaguucaauucccagcaaccacaugguggcucacaaccauccauaaugaggucugccuaacccuaacccuaacccuaacccuaacccuaacccuaacccuaacccccuaacccuaacccuaacccuaacccccuaacccccuaacccuaacccuaaccuaacccuaacccuaacccucuucuggucuacaggcacacaugcaggcagaacauacaaaauaaaucuaaacugucuggucuggacacagaagacccuaaaaaaacagucaaggaacagcccugaggcagaagccaucagaaggccucuugaaauccagaauugcuaugucagcacaugucagcagaguuccaguguggguaugggacaguccacagcacccauggcugcuggcaccagaagguauuugcugggugcugcugggcagucuugcugacccauuuccaaggguaggaauaugggaaaguguugucagauguggucucuccuaggcauggggugggaacaggcaucaggagaagucacugacagcucagagaugccucugcccacacugucacuagccaccuaccagaauuagggucguacaaccgcagcaggagcgaaaccacuguugauuucccagaaccacuugggccaaccagcgcugugacagauccagaugggauggaaagacugaaauccuggaauacggacaccucugggcgagcaggguaugugaagugcacguuucugaacuccagggcacccuggaagguuuucucaucuaacaccauccccucugaaacacaagagggaaggcagaaagccaaagugagaagaauggagcucagggcagaaugccccugccucccugugggugucucccuugccugacugaagugaacagaaacaggccuagaugcugggcuuaucauguaaggucuugugcgaccuuaauugaggugucaccuuuucuugggagcagugugaagcacagugugaagacuggcccucgggucugacccaccucagugacaucucucagugccaccgugcucuaguggcuucugugcccauggcuccagggaaggugaugacaaggaggaggagaugguucuccaucaguaccaacaucccagcaucccaaggaggagaugguccuccaucaguaccagcaucccaaggaggagaugguccuccaucaguaccagcaucccagcaucacccccccagagccaagaaauguaaagccuuguuuucaucuccgccuuccccaaccucuuacaaaagccaggaucacuaaggaagacuugggagggccaucuggguguccuaugcacaccaggccugcuugcugcuacccugcccuuggugguaaugaauggaugcagguguaugugcggcaugucaugucaucaggcccacauuuccagaacauccccucaaguguacccauugguucccauggaaacccugaucucccuguuuugcagcaggggccaccucuuggcaguggcccacucccugaggagggcagaaugccagucuaacugucaaaacgaugaacagccccaccacauacccaccguuaaaaggcagccguggcugucucuccagcagcucccagagccgcccaccagcacccaggccuuucaucagcucggaguagaaugaacucaguccugaggacaaaaagagucuaucaucagcugacaagaaaggccacggguccuccuguccugggggauccuggagacagcaaccacagcuggcaaugugaaaccuaugcuuucacuaaagccgaggcugucggcugcuccaccucuuaccuagugcuccugcagccucucauucucagaguccuaacauggaaaaggaccacacugcucaccagugacaagucacagcucccccucagacagcacgccaagugucgcacgggggcuuuccccaugugaacugaaauuccuucaaaaaagauccuacaggggcuaugagggcacgagagacagaagaaucuuaaaugugcaugaguaagagagagacacuggccaggaaaggcugcacgcuuuacugauuccaaccccaugacacuugaaaacuucaaagcuaugcagauaguaacaaaaaaacaaaacaaaacaaaacaaacaaacaaacaaacaaaaaaaaaacgaucugugcgcaccaggagugggagaaguaaggggggggggauggaaauguucaggacaauaacagcaaaucucuggugauguuauaauggugaauucaggaccauauacauuucuccaaucuaucuaucucuaucucucucucucucucucucucucucucucucucucucucucucucucucucucucucucucucucccucucccucucucucucucucucucucugugugugucuccugagcccgcaugcaaauguuaugacggguugauaacaacaauguaucaauguuggcucagcaacaguguaacuaucggccacucuggugaaaagggcacccauccuuacacugaggugggggacaaucacuguaaaugcaacaguguuuccuucuaaaaagaacucucagacccauguaaauuccaggccagcaggaucuacauagugaauaucucagcuuuucccagagaagcaucuccauguagugaacagcagugaagagagacucagccaugacacuaaaaauuggcaagauauccaguugaacucagccugcaugcuugguuauuacagcaccuccacuaaggcucagguacuuuugccaaagacaggaucaaaagaaugucagagcaagaagacagggggaggggcuguggaauguugucuuccaggcagggcaugccuuugccaucaggaacucaccagaacuauggcugcagacacuagacccccaugagaccggcccugcaaugggcaagaaaggggacuacaggguccuaccacucacugcugaacuucuggcgacccacagagucugggaaguggcgggggcagauagucacugucuucaucuguuacccacuguuacucggagccauacugauaguccggguuaaacucagugggacacaaaacaaaaauccaugagcacgggaagagauauccuuaaagaggagcugacagggaauuaagaaaagagaggacgggguaggaagcggggaagacagaauguccuagguacauggaaugaaacuguccaagaacgaaauaaaaaugauaaaaagguauuauuaaucugaggaguaagagagcagcugaagggucugggcagcaccacgagugaggugagacucucccuauccaggcuuggggucuccgcagugcugccaaccaucacauggcccccugggaaugggaggacacauucugcaaacucaggcugggaaacacagcuccccugugguccuaagcugugggaggacacaaggccccaaacuucccaacagggaaccugcuuggccacucacgaaacuucaguuuugcuuagcagacuggcacgguaagaaugcccauucaguggggccuguuuuucaauguguacccucaaagccuguucauaugauauaccuccgaugcucaauccaacccagaaagcguacaugaggaaggaagagagcucgcccacugucauaugggcacugcccaucagcaggccuccuuuguacaggacagacagcacaaucagguuuccugagagcccagccuacaggaggaagaaaacaaagacgucagugcgaccgaaggcuucuugggacaagaguauaaacuagaucucggccucccuuuuaauauauaaaacuucucagagaaagguuuugagggccuggagagauggcucagcgguugagaacacugacugcucuuccaaagguccugaguucaaaucccagcaaccacgugguggcgcacaaccaucauaacaagaucugacucccucuucuggagugucugaagacaacuacaguguacuuacauauaauaaauaaauaaaucuuuaaaaaaaaaaaagaaaagaaaaaaggaagguuuugaaauauuugcagccaugaagggaacacuugcauccccacaagagcuuagacacgacuccccucagacuauucaccaaucuacucagcucagaagaaaagagagcagcaccuaggccugccuaacaggugugaaucgucugccauguucguggcucugaggagacauggagcugcagcccugaccccaucuccgugaguccugguccccaagggugcuucucuagcacuaggcagcuucugaggagauggguuauauggggaugucuccauuuucucuuuaucuguuuauuuuuuuuucuuuuuaauuaauuaauuaauuaauuaauuaauuuuacaugaguacacuguagcugucuucagggcaucagaucucauuaggggugguugugagccaccugggauuugaacacaggaucucuggaagagcagucagugcucuuaaccgaugagccaucuccccagcccucuuuaucuaguuuuuguuuguguuugacagucucacuaugcaauccaggcugcuccaagaucacuacacagaccaggcugccccaaguucacuacacagaccaggcugcuccaagcucacuacauagaccaggcugcuccaagcucacuacauagagcaggcuggccucaaacuuacacuaagcugcccgucucaggcuccugagcgugcccagcacacacagugguuugccauucaggguuccugguuacaucuaagggaccagcgccugguaaacacauguugcagcccaguccuaagguccacagagccuggcuacuccaugucaguggcccucaaagcugccuggcacacacuggggaccagcagcagaucucauacgagcuacuuuuucuuugauuccacauccuugcuuccuucuccugccauaaagauagcuuccaguccaagucauuaguaggauugaaguaaaaucaugucugcuguguuaagagucucgggaugaaagucucuugcaaucucauggccuacggugauccacuuacugcuccaaagaagccggcucgugccaaggccuccuucugugccagcugcagcaacugguccacucggccgguguacuucuccacuuccgucaucuccuucccaaaagcucggaugguucuuauguuuccaauccgcuccucggcuagcuguggggauucaaauacauagaaagggcugggaagauggcuuagcaguuaggacacuuggugcucuuauagaggauccaaguuuuauucccagcauccacacggaguuauacccaucuguaacuccaguucuagaggaucugaugccuucuuuccuucaccggcaccaagcacacauguggugcacagacaugcaugcagguaaaaccacacacacacacacacacacacacacacacacacacauugaagggaagagugucacacgggaauugacagcaaaguuaaaaugugguucuuauucaauauucugccaaugggaggcucuauaugaggcagagucaaguaagaucacauaccggaguacaaagaagaguacauuuugcugucagaaaauauagacugcagggcuggagagaagacugagaguguucgcuguucuugcuaaggggacugugccugaacucauuaaacucacaacugccugcuucagggaacuaaaugcccucuacuggccucugaggguaacugcauuuauauauauauauauauauauauauauauauauguauguauacacacacacacauacuccccccccauauauauguaauuauaaaauaaaucuuuuuuuaaaguaauuuuuauuuuauuuauaugaguacacuguagcugucuucagacaccccagaagagggcauuacagaagggugggacuugaacucaggaccucugggagagcaguuggugcucuuaaccgcugagccaucuccagcccauaaaucuucuuuuaaaaagaagccuucccuauugagcucaugcaaacacauugucagacagacacuuuccccaaacacauuagcuuccauuugcuuuuauuuuugucuuugguucaaagaaaacauuuagagagauagccuaggcuagucucaaauucaugauccuccugucucaggcuccaaaaugcugggcuuacagugugucccaucacagccgucggucauauuagcuuuuuguccuaccaggagcagugacagaagacagugaaaaauugacguaagccagguauagggcucccaacuguagcacuagcccuugggaggcugaggcucuggagaggaguagcaugaauuugaggccagcccugccuauauugugaguuccaggccagccugggaaacagagcaaacuggaggacaucuaggguaaguggcuagcuagguguagacugucucacuguccugacguccacugggggacaaggaaggacuuaguugcucauuucuuucccuggugcugaggcugggaaggaacauaccuugcacaccaugcauuccgccuguugcucugagccccacaccuagaucacacacauggaagcucaguaccuguguggcuucugccaaggaguccuguguggcuuuggacaguuuccguagauaucgcccauaaaucacagcgaggacagagaugggcgguaccacacucagaacaaagguggccagacuuggugacacaaaaaacugucaagaacaaaagucaagagcguuuguuccuugaaguggcaaggcauccucagaccugccaugugcagccaagagacaguccccaaaccaagcuuucuguuugaguuuuuauggcaucuuugauccuuacaaaaccuaacacccucaauccuagcacucaggaggcagaggcagguaaccucugaguuagaggcuagccuggucuacauagcgaguuccaggacaaccaggucuauacugugaugcccugcaucaaaaucaaacaaccucaaaaacccaaggagggcacgguaccaaggaggcuguggcuagccugcuggggaaaggacggaagcagcgcacccccuggcuaguucaagauguucuaggauaucagagcacaucuucaacagcagagagaggggcaggaugcaagcaggccuacuguguucugcacuggucaaaccacaucaugagcucuaaguuuggguauaaucaccuuaaagcccugagugauuagaauuuuccauauaaaucaauaggucagagaagucaccaaagcgccccauguuauacacaguugaaguggggcuccuaacauaccuaccacagggcuggggcuugggggagacuguuuccagggcucagcagccuagggccaguggaucagcccuggucaguuuaaccucaacaguggcucaaagaacagaaccuucuugaaugagaucagacuuccccaauucugcaaaguggccauuauuuuaaauguuccuagugauuccucaaugcacuguuaaaaccugccuaaucucauauaaacggcuaaggccuccuacaguccagcaguaaagcugacagauggacggccugagcgcucaucuauuuccucccucauaguucuaaguaacuggcaauccuuuuuuauguccugcucuuggcguugacuuggcuuuugguugcuuuuuaucacaaucucauacagcccaggcuaaacuagcuucaaacuggauugugcagccaagaaugaccuuaaauuucugauucuccugccucuaucgauugaguucugguauuacaggcguaugcgacuaagcccuguguacuggacauggaacccaggacucagugcauacuggggaugcacucugccaacugagucacaacccuggcacuugcuugccuuuuaaccucguuccaugaauuuuacgaucacacucaccaguuauucgggccaggggggcugguuggagagugagcggagaugggcugagccgucagagguaagcgagaugucuauggcacacaggcugccuugcaggagcacaaaggugaggucuacaccccuugaacucacacuugguucccaaaggcgcuccuuggccugacacaauuggcugucuucacaccugcucuucaggaaaagccacucucuuaauacuuacucaagagagguaggccaggccagcagaggugaugccuuugucccuacagucugcggcaauguucuugguucuauaugcuuacaaaaugacaagaacaucucaugccucuccugcuccugagagcccugacagaaaacaccaagaggaaaggcugacauaccaucaugccaacaccaacggaggccugggccccagcucucaggccaucggagagguucucagucacggagcgccccaggagugcgguauccgaggagaggcgguuaauuaauucgccugugcgggucuugucaaagaaagcaaccucuugccuuagaauggaggagaacagagaggugcgcagccuguucacaaugcucugaccugcaaaguaaacacaacagccaacggugacugcagccaccggcaagcuguuuauuuagccugcugucagagcccguuuguagacugagcacaucagcucuguggauccugacacgggguggacucauacagaccuggccuguauguaucuauauguaacuuccuguuaguuaacuacagacugugggagcaaggacaggagauagugaugaagguagugacguggccagcaagaagauccagcaggugacgguccuugucauacaaaccugaugaccuaaggcaacaccucggacccaggaacccacagagaccaccugcuccagaacauuuuccucugaucucaccacaugcgcaugcaugccugcccguguauguaaacauaucauaacaacuauaaauacacuucaauucuuuaaaagguaacaugauccuugacauguuaggagcaucaaagaccuggagcauuaaucuguacaugacugucuccccuuacgugaauugcacuuagcaauagcaggaauggguuaaccacccggacaccaucuuacuagccacacagacaugaaacgcaguccugcgcugccagcaguccugcugauaaaccagacucucuacaggaaagccacucaaguucccaccccagcagcuccacaacagcacggagcagacagcucuugcuuugcuaccugcucaacccugaccacaagagaguagagaauguuccgaaugaccguaacaccuuccuggggggacgugagagccgaaugcaacauuaggaagacaaggggccuggagcagcagcacuuggagcccugauccgaccccgggguccuuuguuaccucacaagacugaccugaagccgggcagugguggcgcacgccuuuaaucccagcacuugggaggcagaggcagguggauuucugaguuugaggccagccuggucuauaaagugaguuccaggacagccagggcuacacagagaaaccgucucgaaaaaaccaaaaccaaaccaaaccaaaacaaaacaaacaaaaaaagacugaccugaagacugcaugagguagacacgaaugccguuggcagcagcgccgcacaggaacacacaggugagcacagcacagagccgagucaagcuaucgccauagcccucgcuuggguugguauagaugacaucaaugauccuucccaggaagaagggggcagacauggugaugacacuggacacagccagaaacccaacugcagcugaaagacaggagcgacacucguauucacagcacagcacagggcagagccaaguauacacgagacucaggcccacgcuggccucaguggcugggcguucuccuucaccaauggccugacuaaaggaaggggcagauggcuucagguugagaacaagcagcauggcugugugggaaugugcguuccuuccucacgcaguuacagagaggauguguuaugguuuguauuccuuccugugagcaggaccugcagccgcagugggcucccuccuggcuucugguauucacacucauuucagauccugcuucugcauuucugcuccucgcucuaacucccuggcaucuaacuacaccuucguucgaagggcagacuauccagggaaaguuaucuuguguauaugugaggaagggggagcuuuuuuugugucaaagccuaacucuguagcccaggcuuggcuucagacucaguauguagcucagguuggucuuaaacuucccacgacacuaucucggcuccuugaaugcugggauuguaagugcaugucacugugccgggcuuaacacucuugacugugcucaauauuucaaagcucucgauacauaaacuuuggggagcaguuccugggacccacuugcacagggggugucccuucugaguauuauggcucuggggaauaaagcaugaaguaacaguuaucaggagaacaauucuccuugucaguaaacaacagauaaggaggcagaagcuugccuuccagccauguguggugaugacuguaaucccagcccuuggggcacagaggcagaucuaugaguucaaggccggccuauucuacacagcaaguuucaagccccccagucuuagcuacuuaguuggcuaaaacaaacaacaaaucauucuaagcaaaguccaguuagaaagaacacacaccacagacaaccacaccuaugccuuuuuuuuuaagccauuaauuuauuuuauguauuugaguacauuguagcugucuucaaacacaucaaaagagggcuuuggaucccauuacagaugguugugagccacuaaugugguugcugggaauugaacucaggaccucuggaagagcagucagugcucuuaaccacugagccaccucuccagucccacacuuauacuuuuuuuguuuuuuuguuuuuucgagacaggguuucucuguauagcccuggcuguccuggaacucacucuguagaccaggcuggcuucgaacucagaaauccgccugccucugccucccgagugcugggauuaaaggugugcaccaccacgcucggcuacacuuauacuuuuaaggaacaugaagucauacacgaccaauuuuuuucuacuggugaugauggugaagccucgggaaggaggcucucacaccggugggagcucacacugcccuggugaaggagcaaguucacaccagcaacagaugaggucucgagugacuaguaacggacucccgagaauuaaacuuccauauugugggaauccaaagccaaggaugugggauuagagcauugcuuauauccgcaaaagaauccauaccuuaaacacccacauaaaucaguuaagucgaaccuacuaaaaagaauuuauaaauaguaagcuaccaguuuaaggaacgaagucacucuuugguuaccaaccuagaacaauugagcaagauguacugugggaucugggccuggugacacagggcugaugcuauccaggaggaucacaaguucaagucuaaccucagcuacggagugaguucaaguccagucuaggcaacuuaaugagacacggucucaauauaaagagggcuaugguugucccuaagugguagagcacuugccgggcaugcaugaaauccuagguuuaauccccaguacugcuaaagcagagaaagacaacagacaggcagacagacagacagacaaagacaagacaaacagcugguuaaagaacaaguucuagauaacaauauuagcaucugcagagugguuccuucuuugcuccuuccucagaguuuacaggaauucagaacauuucuggaagagugauagguucaguagcccaggcucccaggcuccuuuuacgugggugcugugauaggugcagggcaagucugccuccucuggguuucccugguuuggauaacaaaucucuuaggagccuugcugauuuguggcaggacugccugagaauccaggaagaguucccugggccccuuugcagaugaugaggcuucugucuccuuggcugagugauaaggcuggaccacugagccaacagagcaaggggagagagcaugggggugggacccacucuucagagaggccugacccugcuuccugcccuccauauaucuccuucuuucuguccuggcauucuaagugugcugcuggcucacuguugacaucuguuuugccaccugcuguagccccagggcccucaccugugucacacagcaggagcucagucaauacuugcugagagacagaaagaguauuggacuuuagcaagggaguggccaagugccugaccagagcaaaguccuuugucagcucaacagggaaggucagacccaggcauucagggagcucacaugccaguugucaaaacucagggauggcucacaaccauccaugacgccaguuccagaggauccaaugcccucuccugaccucugcaagaaccaggcacagguacauacaugcaaaaaaaaaaaaaacuugaaaaauuuuaaguuaaaaaaaaaauugagggggcuggugagauggcucaguggguaagagcacccgacugcucuuccgaaggucuggaguucaaaucccagcaaccacaugguggcucacaaccaucuguaagaagaucugacucccucuucuggagugucugaagacagcuacaguguacuuacauauaauaaauaaauaaaucuuuaaaaaaaaaaaaaaaaaaaaauugagccgggcgugguugcacacgccuuuaaucccagcacuugggaggcagaggcaggcagauuucugaguuggaggccagccuggucuauagagugaguuccaggacagccaaggcuacacagagaaacccugucucaaaaaacaacaacaacaacaacaauaauaauuugggcuggagagauggcuuagugguuaagaguaccaacugcucuuccuaaagguccugaguucaaaucccagcaaccacauggucgcucacaaccaucuguaacaagaucugaugcccccuuccggaguaucuacaguguacuuacauauaauaauaaauaaaucuuuuuuaaaaaucaaagaaaaauagaaaaacuccauaaucauaaacugggugcguugucacaccuguguacccagucccaccagacacucaggagguaggcagaggagugccaagagcuucugcuauuuguggaguuugaggccauccuuagcuacauaucuuaagacaaaacaacacaacccguacucucacucuaacuggauagugugaaccaggacagaaaccauucccuuucagaguaaugcugcaugcucccaugggacagugacagggcagggagaguggcuugacacuggucucacauaacucagcuggugacugaccacaaggaagaaccuucccaaaggccaggcucuccucuaguuuccuuuccuuuccuuucccuuucuuuuuuucuuuuuucuuuuucuuuuuuucuucuuucuugagacauggucuugcuauacaacucuggcuagccuagaacgcuacauauauauagacugcacacagauggaacuuccgguggcuuuacugcuucugucacccgagugcugggauguggugauuugaauaugcuuggccccugggaaguggcacugugggggagguguggccuuguuggaagaagugugucacuguguggguggguuuugaggucuccuagugcccaaguucugcccaguguagaagagagcuuccuugaggcugccugaauaagagagucuuucucugguugcuuucagaucaagauguagaacucuugguuccuccagcaccacgucugccugcacacugccaugcuucccgccaugaugguaauggacugaaccucugcuccuguaagccagccccaauuaaauguuugccuuuaugagaguugcguuggucauagucuccacagcuauauaacccgaacuaaggcaaaggauuacaggcauuccuggagcacacuauguagaccaggcuggccucaaacuugcagugaucuuccugccucugccucccgagugcugggguuauaggugugaacuauuaugccagacuucucuaguuuucuaaaucacaugaagaaucuguacguugaacuccguaaccccgguuccaacugaguucuaacacuguaaugauacucauacaaagaagagggggacccugcuguggugaagcacaccuggaauuccaaguucaaggccagccuggucuacccagccaguuccaggccagccaugguuacacagugagauacgguauggggggaaaaaaggaggcuauuugacuaaaucuaaacucauccaaguauaguucauguacuuacuaauuuauucuauuauuuaaaaacaaauuuggcucccgacaggucgcauguguacacccacccaggggcaaucuggauucaaaaaugaaagacacgcgugcacacacacacacacacacacacacacacacacacgagugugccaguuaauuuuugacaagccgugacuucccugaaggcugaguacuccuaaaccuuccccugcuaccccagccccaguggggaaguggccauuggccccuuaccuggauucuuacauggcugguuggcuuucucuccugcagcgcuuaugucccauccuucucccgggagucauggugacucccuccuuccuuccauuccuaggccucgaagaaccaaaugucccaccucagucuaucugcccagacacugacuguuagcucuuuauugaucgaucaaaaacuaauuggggacaaggaccuuuagcauuuggacacacggauucccgauuuugggggccagauuaauucaaagcauuagaaccaaucuucaacauuuuaagauuuauuuuaguuuacauguauggaaguuuugccugcaugcacguauguuuagcaugugcgugugcauguuggaucuccuagauaaaggguuaugaguauuugugagccacacauggaugccaggaaccaaacccagguccucugcaagagcaaccagggcuaagccauaucucuggaccugacugaucgauugauugauugauuuuuuuguuuguuuguuuggguuuuuuuuuuuuuugagacaggguuucucuguauagcccuggcuguccuggaacucacuuuguagaccaggcuggccucgaucgaacucagaaauccgccugccucugccuccugagugcugggauuaaaggagugcgccaccacgcccagcgauugauugauuuuuacuuauuuauuguagugguuugaauaaaaaagggcuuccagggcuggugagauggcucaguggguaagaguacccgacugcucuucugaagguccagaguucaaaucccaacaaccacaugguggcucacaaccauccguaacaagaucugacucgcucuucaggugugucugaagacagcuacaguguacuuacaaauaaucaauaaauaaaucuuuuaaaaaaaaaaaaagaaagaaaagggcuuccauagcccuguagagaguagcacuauuaggagguguggccuuguuagagugggugugaccuuauuagaguggguguggccuuguuagaguugggguggcuuuguuggaugaagugugucacuaggggcaggcuugggggucuuagaagcucaagccuggccagugugucacugucacccccugcugccugaggacccagagguagaauucucagcuccuucuccagcaccuaucuaacugcaggcugcgaugcuucugggcuaacccucugaacuguacaccagcccaaacuaaaugguaucucuguacaucaauaaacacuaagacuuuuauuuuguuguuuuguuuuguuuuggaguaggagcucuuuaaaacucuggcuguuuuagaacucacucuaucaaacucagagaugcaucugccucuaccuccagagugcuggcauuaaaguuaugcguugccacugcccagccaauucauuuauuuuuaaucuaguguauacaugaguguguggguguuuucagagguaucagauucccucagagcuggaguuuaagugguugugagcuaccugacaugggaauugaacucugguccucuggagggcaaugcacacccuuaaccacugucucuucuccucggucccaauuugcuuauuuauuuuugagacacagccucacauagccuaggauaaccucaaacuaacuaugaagccaaggauggcaguucuccugccuccaccuccugcucucaaaugccaggauuagaguugugugccaacaugccagguuuuacacagugcuaggaucagacccggggcuuugugugugccgggcuaaccacucugccaacugagcaguuguaccccaaucucuggguuauuuuacuguugucacccccuuguauuacaaucugaauguaaauaaaaaagauucugccauacggggcuaugggacaucggguuccacccaaauccuagaccuuacucugcacacuguaaccuggaauucuccacguucccuccacagcacaguguagcaccugucagccugacaggccccagcgguuucagaccgauauucucaaugcccacuguccuuauacgacuuaguccuggcggucagaggggucagggggggucagaaacaguaaaugcagauggccucgggucugcaccaggccugggauguccaaggcugaggagggucaggaaagcugguucuaaagagaagacaggaccaaaacccagcucugccaccaacaugucugacccaacacgagucacucaucuccucugugccucaaauuuuccuacaauaaacagacgacaacaacagaaccuucucacggagcugccuugagcagagcagauccagaaggcaucuggcacagcgccuggucgcugucauuucagaaaacaggcugugcauuggcucaguccagagguaacucagcugucccaucucagagaccagggaccgaaaggaaaaagacaaaacggccgcuuccucaggagggcgagagcuguuugcaagcaugcugggaucugcagggauugggagagguuuucagagaugauguggaucugacagggaaugggggagaggacacagggggaugagggggaucaacucuaagcugagggaaggaagugaagauaggggcugagagccuagacuaaagccaaacaggaaguggguucaggagaucgucaaaucccugcagucgccccacaucacaggcugugccucuugccccucagaccuucauuuggguaucaggaagcagucucuguaggccgucccaucccuuucucgagguacuuaacuaugaccccuccaaggacauagguacaaaggucagccaugagcucgaccaguuccaggcaggcaccagcuuuuaagaacagucauuauugcgcaucaucaguccuuaccaggaaacaggagggcagaugaccugaauccugcggaucugcacuugugaagggaacagaguacacugauaguauagcuaggagcccgcccugugaaccaggagacccagcucuccagcuaucaucucaucguggggcugcugcucacugggagagccgagcccuggccugcuaucugccaaacacacaggaagccugaguaaguacaccccuguccccuccugcuccccccaccccaccccacccccgucugcuccgugcacguuccugauggcccugggcucagcaccuucugaggcuccugguaaccacagugauaagaguagcacucagugcugaaaggcucuggguagcacugcagacuuagugauaccaagauagcugaaauccugaaggagugggcugcccagaggagugaccgcuccacuucugcucugggcgagcaucugcagacaucucccauuggaggccaugcuuuccaaguuuuggaucuauaacuuugaagucuucuggggaacaaacugcugaaguggagggaagguaggauuaguacugaacacaacccccagucuugggaguguauuuucucuaaaacuagaaaacuaacauccgaagccaggagugauggggcacaccuuuagucccagcacucaggaggcagaguuuggagccagccuggucuacagagugaguuccaaaacagucaaggcuacacagagaaacccugucucaaaaaaaugaggguggagaaggaaagugucaugcuagaauggcggucccgucucaacagcacacuaggccaagacuguuucacguggaagagguuuuauugggugagacaaggaggugaaggcagaaagagaggggggggagagagagagagagaaagagagagagagagagagagagagagagagagagagagagagagagagaaagaggugguggcagaaagagaaaggagaaagagagagggagggguauuccccuuauuuauauggaaaaugacauaacacagguaaaggugugaggcaagccaaguggauucugggaauauaguagcuguugucuugguaacaggucuguaggucacucuguugccugugaugucauauguuuggaagguccugaugccaacagaaagagaaagaggagagggagagagagggagagggagauggggagggggagggagagagggagacagagagagagagggagagagggagggaagggagggagggagggagagagagagagagagagaggggagagagagagaucugcugcuuuggggggggauauuuaaagaaaugaugacaggcaugguggcuccugcucugacaagggaauaauguuaugaguuuguggucagucuaagcuauaaagugaucuccugucucaaaaaccagacagacagacagacgaaaaccuaugcaacaguucuguuuccccagcauuucaaagaugugccaacccuuagcaugaucuauuacaaauuaacggccccaccacuuccuuuuacucccaccagggccaacauccagaccagcuuugccaugacuucugaagaaaagauaagcuaucuaagagcucuucuucagcuuuccuggagacagaauauauuuacuaccuccuuaggaagccuuaagaauucccagcacuugggagguugaggcauagauuucaagcuggaggccuaccuggacuauagagcaagacccugacucagaaacaaaacccuuacugucggcggcagugugucugucccucaggccacacaucugaugguucagugaggcagacugacagcucggaugauggaagccgguuccuguucugacuuacuuaaugcagacuccacagcaugcuggcagggcaggacaaguggggccagauggcaggucacagacaugacagguacaggcagacagggaagggcuagguggcaucagcaaagccugauucuccacaacuuugagaucuuaaguuucagaagcagaagccuaggugccugccucagccccucacagccugcacacaauugcccagagucucaggcuccuccgugcacacugucugcuccucccugugcccucccccacuucccauggacaucuuuuaaaccuggguuugguggcucacacuuauaauuccagcacuugggagauggucaagaagaucaggaguucaaggacauccucggcuacauaaugaauuugaggcuagccugggcuacaugacaccugucucaauaaaacacagaggagggggcugaagagaugguccagugguuaagagcagugguugcucuuccagaggacccagaguucaggguucaaucccuacuacucucacauggcagcucacaacugucuauaacuccaguuccaggggaucugacauccucacacagacauacaugcaggcacauaauauaaaacaaaaauaaauguucauaugaugaaaguaaauaauucauuuaaagagauuaaggaaaauacagaggggaaaaaaaaagcuuacaggauagcaaagaagacaaugacuuuuuccauugaaauccacaaccauuguaaaaucugucuucuuuuacuaaggucacaacaacuuccugauucucguagauggcaguccccugugcccuugcuccacaggcaaccugcuccaugcccaauagcccccaaagagaguaauuuguacagcaagggacccaacaaccuauuugaaguccugccuguuucaagaacuguguggcaaagucuuuccuuuuugcaaaacccucaugccuaucccauuucaucucugauccaaacacuucgcugccugcuaagcagggauucccaggagcaggacuccaugucagcuucccaagguaaucgaacccacaggaggagggcacaguucauauucacagaaggaauggagauuuagagcucuagcucucaggauggcucugcuccaaccagccuugccugcaccgacugccagacaugugggaguuacagaauauugucacuuagacccagccaauucugauuucucuuuaaaagccauuugucuauccggcugaguuacugucuaguucuuuuaugcuguggccagugccugguccugaccaagucaccacuuagggaggugacagccagcacaaagcucacagugauccacuucauucugggaaauuuuggugguugcuugauacuguguaacccuagcgauguuauuauuauuacuacuauuauuauaaauguauacuauaaaguagacaugauuuuggcaaaacuccuguuuuuuuuuuuucuuaaaggaggaaacucuaacuuauucagagaaugccccaaagcagaugcugacaagcugauagggaccaaauauucuaguaauaggcucagauggggagugccagccagcauccauagcuuuccaacaggugucagcagacuugaucgcccuugucaaggccaaggccaggccgaggcccaccggccgcccacuggcccacuaguacccccagguucuuaccugacagucucccgcgcucggggcgcaccagcccuaggagcuuccauacuucugagcgcccggucgccgcgggacgccgcugcgagucguucccaaggucucgcacaccgguggcagcugcacccuggagccuggcgaacaggggaugugcggcgcgggguccugccagcacccagcaccugcgggcccccgaggagguggcccacugccccacgccgccaggcagcccggauaggggcgcgggaaagcggaggcccgaacccggcuuguggaucagagagguccacgcgcguacgagcgggguccauucagaagccagccauauccgagaggagacggccggggcccacgcucgcacggcagggccccgacgcggaaucagcaguagcgcccuagcagaaggggcgcgcauggcgcugcgucugcccggacagucucaccaaccggccgggccgcacgccccgggacccuccccgcccggcccgagcacagggcggggacgcagcagcggcccgccccucccgccccaucgggccagcgcccgggccgcgccuuccgccgcguaggguccaccccugggcggcgaccagccgcuagcuccccggcagugccuuguccggcaggcagucgccagcgccugcgcccgccagccgcacgcggaagcuuuuucgcucuccugcgcccuccacgacuugugaaccuggagcguccgagcccuuucucucgccggucacu
